United States Patent 7,868,149 (PLANT GENOME SEQUENCE AND USES THEREOF) - sequence listing, part 78

SEQ ID NO: 42094 - DNA, 55110 bp, Oryza sativa
  unsure (1)..(55110): unsure at all n locations
cgccgctccgccccgccaaacggcaaccacatcggcggcgccgtcatcttcgatctccccttcctttgtcgcctctaccggaccggctactggcagtgggagaaccaccaccaccggccggagctggccaagggcaccagcgcgcggcggccgcctcgccatctccatcagcggctacagtgacagctagatctcctctccgctgtcggccgcgtcgaccctcttccccgccgctgcatcggccgtcggacctcctctccgtcgcgctcctccttcgccagctgttagccgcgccgcccgcgccaccgtgcgtcgccgcctcaccccgacgacgaccgccgcactcctccctgcgcgacggcagccatcagcggcgccgcccgtcccatcagccctcctctccgcgccgctccttccccgtcagctgccggccacgtcagccctcctccacgctgcgtcgaagacgctgccgccatccacgcccagaggaaaaaggagagaaagggagagaagaggggaaaaagagaaagggcggtgacgtggtttatctgacatgtgggacccatgtggggcctacataggtcccacgctgagtcagccgccacgtgaaataaaaccggggttaaaaccgccaagggatctattgtgacaggttttataagttggaggacgccagatatccggttttgcggttgggtgacgattttgtatctggtttacaacttgagggaccttcggtgtactttttcctaggaattcgcacagccacagatagcatccgtgccacgacgcaaccttcggtgtactttttcctaggaattcgcacagccacagatacatccgtgccacgacgcaacaagaagtttcgcattctaatacttagctactaattggtaaattattactactacttgcactatgcaaaaggcaaatcagatcttaattcacatggcatggacatgataaaagcaacacaaaagaaccagagcacatctggatgagatgaagatgaagttcatccatccagcaagaagcaatttgggacgagtccggtctctccctcaatcagcaccttcccctgtaattaagcaagaaccaatttgatcagcacagagatcaatccatcatcacgaaattggatgaataatttagttttaagcatcatttacacatgcccagatgtcaaaaggataccttactgacatgtgaactgcagaagagcactcttcctgtttgagttacaagtaagcatgttgccatctcaactgaagaactggcagtacccgtgccaatatatcaccaacacttaaaatttcatatggcacggcacacctattgtggccttcaatctctttaacaaattcctcagaaaagaaattgttacatttttgcacaaggactagttaatgaatggactctagaagtgaaatttgtatgatggtggattgtgcgttgattcatggagaattacctgctactacaattttgcggaagaagaaattacattttgacactaactgttaattagttgtgaatcaatatttgttgggaacagagaaagaaaaggaacattggtgatgatcctggaagtggaaaaataacttgatttaaatggtgagtactgaataaacatatccaaaaaatactggcgataaaggtggtgtctgaatggagttttatgagaatctcttgcataattcattgctcgagactcaatactgggttaatatacccagagattagtgagaggcaaggtcaattgtcatcttattaaactgcgataactgttgatggttgattttttctttccagcaaaaacaacaagaccacattcactcaagaaagtcagaacaaaaaaagggcctaaaagagtgccaactgagtgaaatgtttcatacttcctccgtttcacaatgtaagactttctagcattgcctatattcatttagatgttaatgaacctagatatatgtatgtgtttagattcactaacatctatatgtatgtgggcaatgctaaaaagtcttacattgtgaaacggagggagtacttccaagttagcttcctgtacaactaagactcctacttatatagtcagaacttaccatgcgagaaattaatcaaaacaatcacaaacactagcaacaaatatttctcatcctctagagaacaaattagaaatcactctccttttgcccaaaacatttcagttagtaacattgtccctaagaacacaatacaaattgccactcacacaaataattagtcctgctcttaatgggtcatgaatcaatatagtggggaaagagaaaagaaagaaaaagcattgttgatcgtcatggaagcaaaaacaacttgatttaaatggtgaatgttaaatagacatatccaaaatactggtgatggcattagcatcttaatagagttatatatgaatctccaccatattttttttatgaaacaaagccaattcattggttcagacacagagattagcaggttgcgaggtcaattaccatcttactgattagactctcataagtgctaatgattgattttttttattataaaagggaacgcaattttgatcaccaaagtcaaatacaagaaggacaaaggacataaaacaatgtcacattgagtacgcaagaaattaatcaaagtaatcccaactcctagcaacaaatatttctcccatctgctagaggataaattagaaatagctcatttttttccagaatatttctgccaataacactgtccctaagaacagtataggtgtagaacacaacatgaaatggaaactcacacacataattaatcacgttgttatgaatttgcaacaaataagtcagaaaaataaaactcattagagttgaatcaggaacacccacatgctgaaattttcaccaccatatccatttacaaaattgtgctgcagggcaaaatgtaatacagaagctactctacaaattcagaataaatacaacagtatatatataggataaacttatgtaatatcctcgcaaccttaagtcacaacacaaatccctcttttaagaaaaaaagtaaacaaatcgaaaggtgcaaaaccatctctgcgactacctctacgctttctttcatcataccagtttggttctttcatcatagtaccagtttgaaacccaagacatacaactctataaaatctgtgcaagaaaagaaaggcttgccttttttttttaccgcgcagcaattcaggcagccgcagctcgcgaggccttccagctctcgtactgggggtcgtcggtgggcagctcgaagcggcagagcgggcacgagttgcgcacgtcgagccacggcatgatgcactcctcgtggtaaccgtgcgagcagggcagcctcttcacgcgctccccggcggcgacgccgtccctgcacaccgcgcactcctccccttcgccgtcctcgccggcggcgacgacggcggacggtagcgcctcgacggccgacctcgccgcgggcggcttgctcttcaggaacaaaccctccccgacgagcacctcgtacacgtcacggtcggaggtgtacacgaagccctcgtcggcgggcggcggcggcggcggcggcacgtcggcgaggacctcccactcgggctccggctgatccatcccggcgccgccggagggagatgccacctcctcccaatcgaattcctccgccgcgttggaggcctcaagccgcagatccgccaccccctcctcctcctcgtcgtcgtcatccaattggaggcaatcccaccggatctcctcctcctcctcctcatcggggaagccgaggtggtcggggcttggcgcgacgagcgcgtcgtggaagaggtcgggctccacggagaggaactggctgcggaggcggtcggcggccgccaccaccgacgccgccgagaaccccgacgacggatccgggtggaacaccggcacgaaggcgtcgtagcacgaagacgacgacgacgcatctagggtttggggcatctcgtcggaggcgagccggacgaggagagacgaggacgccatggacgcgagagatagagaggggaacgaaaaaatcgcgccctggattagcgtctcgcgagccgcttgctattatagctcccctaaataaaataaaataaaataaaaataaaaattaattctgctagtgaaactctcgtggtacgtagtagattggaacggcgaccgacgagacgaccctcgtcgctgacgagtggggccacccgatggtgggggattataaaagaaccagtggttggtggtgggtcccactcgtcagtggcgtgatggttacgtgtctcgcctgtcggggctgtgtcgtgcgggagcagaaaattaaaagtgctcgcgtttttttttggggcctgattagctaccaaacaaaattttttcacccagtctgattgacatatgcatggaatattaaatattgtgtgtaaattgtgacacaaatcttctaagcctaattgcatcatgatttggcaatattgtgtttaataaattaatcacctaatttctagataaaatctgtaatttattttattattagtctatatttaatactttaaatatgtgtccgtatatctaatctgacacgccaaaagtttcccttaggcgaactaaataggccctatgtgttctctgtacttttggggcaatgacaggtggggccgtgtgcttttgtcccgaggtgttagtgagagaagagatggtggtgggtacggtttggggaggtggggggcagtgtggtggcgctgtgcagtgtgagcggagcaaaggggaagaagggttgggtggttgcttgtcatgtgcgcgtgtgacaggctggaagaacagcgacgcaacgcaaccaagggaggacgctgagcggggcagcgtctggggcggaggcgagcaaaccgttcgttacctggtagctgttgggttggacggttgactatacggtgatacgccttggttgtgtagagtatttttttaaggagtaaattatactccatttcttaaaataagtttcacttcggcattatgctgtgtcatatgattaagagtaaatttcgtagaattacggatacttgggtcaaattatctcgaaactacatatttaacaataaatttattataaaattacaggtttaaggctaagtattataaaactacaaatttaataataaaattatcatagaactatagattttagagtttaaatccttagctccaatgttttatttgagttataaatgttcaaattttgtgattaaattgatataaaacctgtagttttgtgataactttgttactaaatatgtaattttgtgatatttcacctaaatatgtaattctatgataattttagtgttaaatttgtagttttgtgatacatcgtaataaatttgtagttttgtgaagtttactctgtaattaaaggaaaatattgtaaaatctaagtaaaaattattgattttttttgaatttagaccatatttcatgggatttcattctgattttgtgaaatttctatatgtttgatgatgtattctagtgttaaacctgtgtaaaatgaaacgtgttacaatctacctagtgcaatttaagagtaaagtttgttttttcatttgttaatctttagagtttaactgatgtcctttggttcagtttgatattattgagaagattattgcttaaagaaaatttgacaatagatcaagtcacaataaaatgatatttacatgaatcttttaaatcttaaaagatcaacgacattaaatattaaaaacggatggagtatttgtttttataacattaaaatgaaaaataccaacaattcatgggctaacaataattcgcattttctcgacggaatggtatcctttgttgggcttacattttttttccgaggggtaagggcaggagctatgccgatttcattaaaagatgggagaaagaaaagttcacaacacataatttacaagaataaaaaaaatcccaggaatcaagaggaggatacaagaattttgagttagtgcaacgcaactagcagcaggatgttgcgacggatcatctaaacaatctgggcttcgtcaaaagccttgcacatggcagacgggtggtaaggtgccttacaggtttgaattttttttgttatgattcggtacaggtgtactcggctagcacatgctaactttgaatctttgtcaattcaatattttatcttcatcacgtcgggtttgtaatacacgtacatgccagaaagtgttattagcaaataataaaatgttgtgctgaactgatgactaagtgtgtgagtgggcaaacgtgtgatgtggacatttgagctgcaattttacttcagaaagcaataaaaatgtgtgcttaactttaataaacttggctctcatgttttctctatcaagttgcatgcccctttaatttgcaattttggcaggagtggaatattttattttagttgatgactcttggattagctggtgagagggactcatcaactatggtgtactatacgaggaatcattagtactttggacgataatgagattggcttagaaaatttctgccttgagttggcaaccataacagattttgttggagtgtataaagtgaattgcccgtctttccctatcagtttaggcttttaggtgcaactgacttgtgcatgcaacttaatatggtatcagaacnnnnnnnnnnnnnnnnnnnnnnnnnnnnnnnnnnnnnnaaataaaacaattgcagcccactccaatattccacgcttgagacttgagggggtctcgcgtgagggggagtgttggagtgtataaagtgaattgcccgtctttccctatcagcttaggcttttaggtgcaattggctggtgcatgcaacttaatcatcgccagcgtcgccgtatctttctcgactacacttcgctcttctccggcaaccgcgtgctgctccggcaattctccctctatgccgttctcgtgccgcgaccgtctcggaggccttctctgctagtcccctccgatattggcgtatggttcatggtggtcccctacctcgcctatgcggtattggcaacaccgttgcgcgcattcatcccgagttgtccccgggtttggcaaacccggcgtgacgtctcgtccttcacggttcgactacatcagctcttcggcgtcatcttcctccacgatcgccgtgattgtgtcaccgtcttcgtctctagcgtgtcttcgcgcaccattggtccacgatgccctcctgtgcatccacgaccactctacggcgcctcatgcgctccctgcggctcgactacctcaacatcagcttcctgacttcggctacatcgaccacggctactatacgcatggcttcatcgaccacggctctctcggctccttcgctttggctacgtcgacaatggcacaaagggctatcatccgtgttgagcactcttgccggtttcttctccagtccaagtgtccgcgttgctcacgcttggactgcggggggatgttagagtatatggtagttagagttatattaggataggattggtttgtgtggactccttccatatctgtaatccttccttatctcctccccatgtactcctatatatatcggccccctgaggctcaatacaaagtgtctcacgttacgcaatatacctctcctatactatccatcagatttcacctgtccaggttttgagaatttgaggtccagcttctcggttatcaaaaggttttgagattcaatgagatttctcaactagtgcagaacagaggctttgaattttggaattctataagatttgtacagattgttctcttttgggttacaggcttacagcatcgctagagactgaaacaactgaaatgatgctgtagtttgtctattactccttctgttttcacccctgcgtgggtgggtgggtaaatggttggtaagagggtgcaaatgaagttattttggaacaaatggctgaggctagaagtgaagttattttgggacggagtgggtacttaccaagattgttctgagatactcttttgcaatgaaattttcaattaaagaaaagttatcttttgtcacaaaatattttgctattacaaatttacaattcatatgtgcaggcacaagcatacatgctaaatagccttacaatgcattaatttccttaccactaaatataggtcattaggtcttcctgtgatccttgagatcaaacttcaggagaccttgaccattaacttcatgcatatagaatcagcatcttgagaacaaatgcaattagatgtttcttagaagtatttcataatgttttcattgatatatcattacaaatatcatgtctaaaatctttcatagtttattttgtgcttgtaattgcattacagattgcaacttattctagccctggggcacaaaattggaatttgacacagcagcctcattcttgggccctgcaatttcattggcaagggcccaaataatctcaatctgtcaggctcccagattatacaaaagatggtcagcttatgcttgctcaagtttacacattcctttcagtatttctccacaatttgtactagtagtatctagtactactagaattttattattgtattgttacaaagatcatgactgaatctcttatcagagtttatttttgtaattgcattacagcttgcgccatgaaacttattctagcaatggggcacagaaacaggatccgcgatggcggtctcattcctgggccctgtcatttcactggcaagggtccaaacaatctcaatctatcaggtttccagattctgcaaaataggcctgttcagcttatgcctgctcaagtttacacatttcagtatttctccacaaattgtactagtatctagtaccactaaaatttactattggagccaaattgtttctccattggcacacaagatgctgaatttttactcttcagttacccatcttaaactacaaaccttgccataaagagtataaacattgttagtaaagagaagctcctggagcaaatcaggtaattgctcatcttttctcttttaacgagctcagctgagcaaggcaggcctacactaatcaacatgtcctgtagtctctgtttgataacgctgtgtcctgaactgctccttctgaatattttgactaatcatttccatcttctcggtaatgacccaatcagctgctctgatcaactgctctttcgcttctcgctgcgcctttcgaagaacttagcacgaactcccttgtctcttctctttacagtcacagatggatcatgatgagctgaactgatcgtgtattcgtgtgtgtgagtatgtgtttttctctgaactctgaagattctgacgacgacgacgataaaagatcgtatcttgggggcctgacactcactcccgtttgcttcaggccgggtgattttcttgataaagctaaagacgcccattttgcacaggggacgctttaatcatgttgcccaagaaccctgtaaaaaccagctgcattgcaatgttcgtgtcgagaggggtgagttcgatgtcacgtccttttcatctttatctcgcggtttgcacgcatttcgcaaagcgtttttcgcaggagccacctgtaatccccccctctttcccgagcccgacggttatcagccggactcgggtaagagggaggcagctgcgaggaagagggaggaagaagaaaggcgaaaaggattcagaacagtgtcatcaccgaaaggtgaagtacttcatgcctagaagaataacctcacggtttacacgcatttcgcaaagcgtttttcgtaagagccacctgtaatccccccctcttacccaagcccgacggttatcagccggactcgggtaagagaaaggcagttgcgaggaagagggaggaagaagaaaggcgaaaaggattcagaacagtgtcttcaccgaaaggtgaagtactccatgcctagaagaataaaaggtggacaatgtgttgttaggcagtagtacagggtgacttgcatttcactccttgcaaagtgacaatgtgcaacttaggtaggattactgtcagtgaggaggacaggattactgtgcggtaaaaaaatggggttaagaggggtaagtgcccctggtaattaccgtggctgggcaaaagcgtgtctggggtggataaaaagaattgcatttggttggctttgctttgccaatcaaaaggcttgattcggggtggcgcgaaccccgaggctaatgatagtttagtttagggttagagtgaggttgggggaatcagaagagcatctaaaggctctcaggttggttaccttaattggagtacactagttgtactataagcattaggtgtttgcaatttgcttccatgatcaatggatgtgatgctttagtttggaaattctaagcatgtaaaattgcatttttcttacgacctactcactctttcccaaattaatattcatataatagaattcaaaatttctcaaattaattatcatataaacgtatggacacatatttcatcgaaatataattaatgcgacatgagaaaatgtgtatatgctaaggtgtaattggcatggtgttttaatcaatgcatgcataatgagagaatgtgtacatgtgtcttgattgatacaatttaaattaacttttggtcttggtacataaacatataaacatatatgataatcaatttgggatggagggagtatttagtttattgccacttttaatctgactaaatttttacattatcaatcggacaataaactaaacacatttcaaccattgctacattatcaaattttggcagctctagaaacttcatctcttaaaactctaccataattttgcaaagacatcaaaccaaataaaaccaatgctaccaaaatttaatgatactaaaatgtatcaaaattcagtattaacaaattttggtatggctgattttgacaataagtgaataaggttttaatttctcgtactcctctgccaaaaaaaacttaattcagaggatgtatctagactatatgtatgtttagatacatcttcaggattggaatttttttaatggagggagtacgtgttaacgttcaataaaatgactaaaatgattatccgcgaagtgacccgcacccttctttgcgacgaacctgtcactggaagaaaactagtacgagtgatcatgttgatcacgaaggtgtagacagttgttcgtgtccaataataactgtactaaagtaactgtaccgacatgacagtggtggtcaaacgatgatgagagagaatggtacttgatttacagcaaggcttcagaaaggcatcagattaaacaaagcctgtgatagttggcattgtcagaaacttgagtgaggatgatgccacttgcccagatgagaagatggcaggggtaattagtgagtaagcaagctaaagcaaaggttaaaacagcatgattaaagggtttgtttctactttttactgtactttgctaccaagaaatggtaaaggcagggggtagtaataaactcaaaactaccctcgatctcctaggctgtaaaaatcatgtcgctggatgcagcaaactggctataaaatcaagaacacttacaacatctctctctctctctctctctctctcctggagtctctctgtttgattggttagggagcaaggcgatggatgctaatggcggcaatgggtttggagtagagagcaacgcttcggctgtccatggtggcatggcgatggcttggcaatggcatggcggccagatgagcggcggcagctcgtgcgctgcggcgccgccgccggtgcaacagccggcgatggattctctcgcgtggtcgtcgacggtctcgccgagcaccggcgctgccacggcggcgagcggcgccggcttcttgctgccaccggcagccgtgcgcggcggcttcggcagtttcccggtcaactccggcggcatcgtcgagccggccggtgactgctcgtcggagtccaagaagaggagatcagacgaggtacacactcacttgctccccgtctcatcgcatcgatcaaaacattcttaataaaaagcttgatgaatcgtttgcacaattgcttgcaccggcatttgcaagattgctggaacggatcacgcgaacgcatcgaacgcgcttgccgattctgggaacgagaccgagtgtagcaaagatgtcaacggcgaagtgatcggcccgccggcgacggcggcggccggcggcaagtcgaaagggaagggagccaaggacgccggcgaggcgcagaaggaagggtacagccatgtcagagctcggaaggggcaggcaaccaacaaccacagcttagcagagagggtataccctacatacaaaatttgaacagtttcaaatttttttaaatattttttttggggggaagagaacagtaatatttacaaatttcttcaaactgatcacctgaactatgagtcaaataattgaagattgtggtgttatgtttcttggcagctgagaagggagaagatcagcgagaggatgaagctcctgcaagaccttgtccctggctgcagcaaagtgagcattctaacccagaactgaagctacagtgcgaaggtttctgaatcatatgtgaatttcataagaatggatggtaatttgtgtttctgaatttgattcgattaggtcaccgggaaggcgttgatgctcgacgagatcatcaactatgttcagtccctgcaaagacaagtcgaggtactgacatgatcatccacagggaatgactgcaatttcacctgacaaagcacaacgcaaacactgatattcggttttcactttccatctctgcagtttctgtcgatgaagctctcggcagtcaacccaagaatcgatctcgacattgaatcacttgtcaacaattccaaggatgtatggaacttgaaccatcttcccttcctcctctctgtttttcttcttcagtttgcttcgcgagaaatcagaaattcagaaatgtgtgcgacaagttcatcatatttcttgatgatttcaggttcttcgttttcccgggcagccttcctctgctcccatgggattctccttctccacggagatgatgccggggctacaattatcacgaccgggcatccttcagggaggtgtccatggcatgatcaatccagatgtgttcaccagcctcatgcagaagcagcagcaaaatgacaagggagcattcagagagcctcaggtttgcatctgatacatgccattgttatttgttagtatcacttcggctaagttatacaggaaggtttaagccattagaaagaactaggccagccaaataccattcagtttcatctagtttcatattattatatactctctctgtcccaaaatataacaatttctagctatgtatctggaatctggataaggagatatacatagctaaaaaatgcatattttagaaaggaggttgtagtacagtagcagtttgcaagacaaacacatactgttcaccattctacactcattgcaaacgtgatcatctgatgggctctctgattcttgaacagatgcatcagactttggatggatcattccgtaacaccgcacaaatgccgtatccacaggtcatgagttcagaagagctaagcatcaggcaagatcaagatgggtttcacatgtgaattgcagcaacatggatgaagcaggtttattctgatcagaaagcagatggagtgacaagcacaaacagcatgtgcataggaattactgctgctgagcaattcagaattgcaattctagttgcctgagcaagtgaccagctgcaatctgacttccaatgggaagggaagaggtttcccatagattcagtacatggggtgtagctgtgatcaaatatcagaactgaagcttcactgaactggacagctagaactgcaatccatgatagctagaaactcctctgacataggacggaaaaaaagaactgaagaaaatatatctgtgcatgtgacaaaaaatggatgtccaaatatttgatgcgagcaattgaatcgcattgggatgcatatcttgttttttgtggctccttccaagtagcagcgaaaagcaatgtttgatagaaacactgaaatacaactgttcagcatgaaatttaatgcttatgcatcatttttttttcgcaattgcccctttttttttcatattgagtataccttcctttcagagtttgttttctgttctggtggtcctttggctgtgagattttatgggacatgatcacaatagataatcttaggcagtcctaaaaatcaaattttgatttatgctaaacatcctgtgagctccattgaccatttggatattgggtttatctcgccaacttaaatcgcaacagctgagagtaataacatacagattctatcataacgatgatgcctaaataggtcaacagttgaaattttgagacagtaagaatgcatcatttgtttatcttgcattttgatattcttttcttactagacaaaatgcttcttcaaaatgtgtagcgcaagaatattaggcttaagcattgatctccacaatgtaaattgatagtaaaaactgcataaatatagaaaacaacaaagggacatttgtattgtactgattatttttcatgttttattgataagaccaccccctccaatagatagaggtggccaatgagtctacagactctactgcacctacaaaaatgctgggtaacaacccaagtaatatctatgacaaaatcatgtttttaaaccatgattatatcccatagcaactatttctgaagttctaacaaaggatgcccaagagaactcacttattaatccctccatgggtcactctcaggcctcacttcagaaggctcaatcacctccgtcaccgtggcttcagatgagcctgtctctgtgctggcatcaccagtggttgctgcttcagtctcggtgtctgacctcccccatctcccgccaagggcaattgtcatcatctcatagatcttaccacccaactccgcaggactgtcaggctggacattccaagtaaacaaacagtcaaatggtaaggttcatgatgaccaagaaatgaaatataatgagtgtgttttgcttacagtatatccactggagatcagagcagtctcatacaacagctcaacagccctcttagcttctgtactttcaggctcatttttgcaggcagcctgccaacaattgtttctcattcatgttaattattgcttatgtagaaatgggtacatcaattactgatgataagcaacaaatcttacattcaagtccttgacaatagggtggtcagggttaatttcgaaaatccttctacccctcatgaactccaagcttgatgtgtccccaagtgtttgtgctttcatgagtctgaattgttgaaaaatatgcgttagaaatcaagcatagtacaacacaatgatttaatcgtacaggaaatacctttccatgttggcagaccaaccaaacttgccagatacaagaacacatggtgacaaactgaggcgctttgatatttgaacctttgctaccttgtcaccaagctgctgttttacccagtcacacagaagagtgtattcctgtttgctttccttattgtcctcatcttcatcacctgtgcaaacaaatatatattagagtgatgcagatagccatgaaaaactgtatccagagcaaatttcaaacacttcctcagtcctcacccaactccaggtcctctttgctgatatcaacaaacttcttctctttataggtctgcaaattctgaatggcaacctcatctattggctcaatgaggtagagaacctaaagagggaaaaaaaacagcaacatgagttaagtggaagcaagaatgacagttcttgtctcatcggtattatgttgtgttcatacttcaatgtctttctgaaccaacttttctaggaaaggagcagtctttgcactctggagactatctgtagcaatgtaatagattgctttttggttctctggcatgttttctacatattgatcaagacttatcaaatctccctcatttttagaagtgtggaaacgcagcagaggtgcaagacgcttgtgatttccggtgtcctcaatgcaaccaagtttgatgaacttgccaaagctctcccagaacttcttgtaatcctgcagtacatatgacaaggcttcaacacgtattcaaacataaaaactcaggggacagggtagctacgagtttttacctccttgtcatccttttcagaaatctcctcaatcatatcaaatgtcttcctaacaagtctctttcgcataattcttacctaataaacaacataaattatctcgaaatgcccataggaagatcaacaatgataactttccttgtatgtaatttgaaatataagagctggcatgcatttcttattaacttactattcgactctcctgaagaatctcacgagaaacattgaggggaaggtcatttgaatcaactacaccttttacaaagctcaagtatctggggaactgcaaaatgcaatgctaaactcagaaatttgttctattaatcaaatagacaatcaaggaaggacaacacaaatgcatattcacaagcaactatcttgtggactgagagataatataccagttcaccatcgaagtcatcagagataaatactcttttgacatataaccggatattcttagtttttggattcattatctcctcattactaagcggagccattcctggaatgtaaaggacactcctaaattccacctcaccctggtagcagaaaatatcatgtcataaacaatattccatgcacttaagttaagtgaagtgatgtttgacaaattcatgtacctctgttgtgaagtgagtgtaggccagaggatctaagaactcattgaatgccttcttataaaattcattgtattctgttttctcaatttcctttggacttctcatctgcacacagagaatatgattcaactatctgcttccttaaacagtggatagcacctcacatgcattttttttgggagatagaataccaaataggtaaggttcaaagactgcaaattgtgtgcaatggaagtaacaaagataaaattacccatataggctttgtttcattggctagctcccaatcccagtatttctcagtaattgtcttctttttcttttgttcaccctataggtggatgcgaatcagtttcaaagaacaaagtcaatataaggataagaaattagaagcagatcatccaagataactaacctctttcgcctcttcaccttcttttgcctcttcatcctcttcaacctgtcaagcaaggaggtcacatcagtgaaagaaatctgaaaggaatcaagaatagtagctctaaagaacttgtaagatgcatgttaagagaattagcaagaaaaaaccaccaaggccttacctcgacagttctggatttttcctgccatgtgtatatggggaaagacacaaactgagagtagttcttaactaggccttgaatccttccaggatcagcaaactcaaacttatcatcaggctgcatagttacagaatatgaggtttccatttttttgtgacgaagatgtgagattttagttataaaaaggtattcatttcgacaaatagaaaagaccaaactcacccttaaaacgagagtaatctgagtgccacgtgtaagcattttttcaggatcagtctcttccttgatgacataagagctactgtcagctacaccttcccatacatattgcttatctgatttggggctcttagtggagaccacaacctgcaaacacataatttagggggaaaaagatcaatgaaaaaataaaaagaaacatattccatgaaatatattttacaaggatagcatccaaaaaatgtctcataccttttccgctacaagaaaagctgagtaaaacccaaccccaaactggccaatcagaccattatcggctccaaggtctttattctcctggattgtgattgatttggtattaggaatgaaacaacgaagcaaacacacaggtagtacacattgcctagacattggtacaaatattcagaaagtagaaagggaaggaacaatgctctacctttagagccttcaaaaattttgaggtgccactctgagcaatagtaccaaggcaatccttaagttcatctttggtcattccaatgccagtatcactataagaacaataacaagattgtactagtaaactacctgcactaaacagttcgagtcgacaaagcacaactattagagaataacttacgtaatagttatggttcctgcatcagggtctggtttaatccttatctccaactcgccgccatcagcaaggagagaagaatcagtcacaccaagaaacctcagcttatccaatgcgtcactcgcattactgagaacacccacccgatagttagcacataaagtgatgagccatgggatcaaattttaaaaggcttttaaatggaactatcgtttggctatgttattattgatgaaacactacatttggcgagagttactactgacctcacaagctcccgaagaaatacttccttgtggctgtaaaggctatggacaatcaaatccattaggcggctaacctacacagcacaaaagggattaaacagttactatattgggctatacaagtccatcacaccacatgtcgaattcacgatgaaaaatgatgaatcataaattcataataacaacattccattactgtaactctagtgaaatgctagcataatcaaacagcgaagaaactatttccatccaaccccgaagccatcccgacccgtcgtcactcacctccgcctggtactcgaacttctcctcctccgccgtctcctcggccttctccgcgacggcggcgtcgcacctcacccgcaccagtctccccctgctcccgctccccgcctcccacctcacccctctcccgcacctcgccgacccgctcccccgcgccgcgcccgcccccggcgccctaaccctccccgcgcacggccgcagcgccgccaccgacgacgcccccaggctcctgctcagcgaaggcgccatgtgagacctctagtagtagagcgcggcggcggctgcacggcggcgagccgaggcgaggcggagaggataagggtggaggagttgctagggttttttgttgcgggtttaggaggagaggaggaggaggaagagatgaggcgacgggggaagcttctagaagcggtcgaagcgagccgccgctgcagtgcagtgtcgcgcttgagtgtggggttgggtcgttctgaccgttcgatccgcggatcggacggctggattgagatcgaggagaggttggttctcatttcctcggttcctccgcagagtgtggggccacctgtcagtgagagtactttcatgggccaactcgctgcttgggcttgggtttgggcttattaatttcaaggcccatttaggactttggggccatttgaaattttgaagtttgaactacttcacgtcaaattcatatatttggaactgatgaaatcgtgtcaaacttgtgtgaaatccatcaaaccagagaggcatacacaataatgcaatgcaatacaaaagaatttaacagggactcaaattgagaggcagcagtaaaaaaaaaacaaaaaaatgacgtgctatatttctctttactgttcatagatggtttatgattttgatcatcatccggagcacacaccacacagaccaatgttgacatctaacatgggagagaagactagctacagccacaacgccactctctgaatcgatcaccgatctcggctagtctcgatgcttcgaggaggctctttgaagcaatcaacattgcagagccccatcgatctgatcatctctccgagcctgtcaaaaatttacaccaatgtcagtttgtggcaagagtatttatcatctttttaatcacaacaaatctgcggcaatatcatttatcatccaaagtttcttcactaggaaaaatgacttaggtaacatgattactgcaactctgtatgatgatggtggaagtgaagaattgttcagagaaccaacctgtcgatgctttttcttggtttatctggctgatcgtgttcatccctcgtcctgtcaaatgtgtcaacacttctccttgatttttctttcttctccacgatggatcttggcttctctctgcggcccgtgcttcgccttcgtttatcgacacgatcattgctcaatcgaggcggcagctcatgcctcgtgctcttcctcggtggctctagcctctgtgaggtcgtccatggagcgtcagagagagcagaaccatcggaagccgtttcggtttcggctagcagcttctcattctcggttgatgatgattctttctccaaaggcatattttcgatcgtcgatatgaacttcttcagatgccttatgtacactgggaaggtctgcaggttacagtggtctcctccctcgatccatagaggttcatacttattttggcacagctcccatagctgcttcccatgggaacaatcgacaatatcatcatttgtgccctgaaaaacaagtgaaaaggatatattaagttaaattacataaagttgtacatgagaaatgcacagagatgcatatatattcaggcttacatgaattaccaaaacgggagatttaacaaggggcattttctcaatgttctgcaaagaaaacaggtgttcggttagcatggacaatgcatgggaattaattttagtatctcttgatagttcagtcgtcagtgaggcaaaccttgtatatgtcaaaccagtatgttttcttcacagaatacatgacacgcaggccagacaatatggggctgtgcagaactactgctcttatacgatgtaactgagcagctaaatcgacagtcggaccgctaccgacagactgaccgtacaggataatgtcttcttccctggtgccatatacctccacaaggcatttgtatgcagcctctatgtcagcgaaggtattagcttcacttgcctgagaatggaaggaaacagaatgatttgattcaatagggctttcaatttccaatttagtctttaactcaattattggaataagctcactgaaaagaggaattgtggaactgaaaacaatcaagtggggttcagttttgcggtgtcttgtaaaaagaaaatagaaggcctcaagtgtttccaattcatcagctaataaaacattccgaaagtaatgttaggtttattgcactcctatataggcaaagataagagcgttaatttcaggaaagaatagagagcattgttaaccttgcctgatgaccgtccataaccagaataatcatacctgcaaagattgaggaaattattccaaatgcaggaaaatgaggagctaagtacataaatacaaccattaattcacaccaattcctcatttgctacgatgaagtggcaaataaggtaacgggtaaaattttagtaggatatgaggaatttatccttaaaacagttaaaaatagatgcaccaaggtgaatgcgaatagcctatctagcataattgaaatcctccacattgacaaagatgtctctgttataaaaaaaaacgtcacaaagtccagaaaatgaaagtctacaggacaggatacaacaaaattgactaagaatcttttgcgttgtttatcagcaacagttagttctgaacatcattgaaaatgaaacatggaatgatttttgtgatcaataatcggacaaaaacatctcaaacacgatggctattgcaggaagcgcaccagctccattggaccatttgctttacatgaagaatccagacgccaattaattgaggtaggcaacctggaaagctaagtacttggctctcctgccgagtgtgggtctgtgggatcagggaaaacatggccttcttgatgaatgtgagatcaggaaaaagctatacctgtgcatttttcaagcttttttttttttttgcgaatacgcgtattgcttatcattgtatcaagatcgaaggttgtagatacaaaaatcggtcgagctggggaaaaaacaacaaaaggaaaaatgggggaaaaaaaggaggggatggaaaaccactattatgactctaatacaaaatgtcaaatccatgtataacgcgatcatcaatttcaatgtaagaatccataagaggatcttatgggaggtaaaggtatcactaaaaatcaaagtatttatgtggtttcttcaaaaaaaaaaagtaatcttgacgaaagataacctcataaagagaaaatggaggggaaacaagctatgttgtttttgtaatacacaagagaccatccaacatcttttctttgattgccatgttgcacgttttgcttggcgatgtgtcttctttgccttcaatatcccccctccccacaatgcaaaagatatttttggtaactggctaaggggagtgcctagacccacaaaaaaatgattttatttggagctagtgctctatgttggtcaatttggcgttgccgtaatgatatagtttttaactataaaaaaatgcctaacatcatgcaggttatcttcatgtgtttcaattggcttcactcttgatgtatgatgctttcacaggaacaaacatgatactatacgcaatggtgctacacgtttggaattggtagctaaggaacttttactccagtttggatggcgtagtacctacagaatttcgtgatagaatctacgtgattttaaaaaatattattttagtagatcatattatcggtagaagttgggggtttgtaccatcttgccttttttaagctcttttctgttcatttctgaactttttggctatgtgcctacgggcagaggccggagatgtaacccatttccattttctaaaaaaaaataactctaatactccccctttgtagacaagcccactagtgacttcattgttctgacgtctttttttgggcacacttgctctcatcccaacccactttccagtatgaaaattcctctgatgtacctatcacagtgtgtaatgaggacctacaactagttattaccaggttcatgcgcaatcgaccagttctttttttctttttgggtacaggagggtagccccaatgtcaacgaggaaactgtttgtacagccctcaataactgtaactctgtaagactaatttagctgtttaatcatgtgtcacgaaatagcaaaaccaaaagagcgagtagtttacaaatccaaagaatttgagtacatgtgaacacaatacactgatcaatataaactctatgaactgagcccactgaaatttcagatcaaatagaacagatgccaaccactaatcaatgctcaatcccaatgatcaggtggaaatcaatccttgacaacgcatactcgacaggacaatcaattgacggaggaagtgctaccagattccaaattgtagaaatctagttgaaagccaaaactgcaatactatgaacagtgctctgtgtactacagctaaattcaggacattctaagcattagaacaagacatattcaaaagatcacaggacttcattaacgacgaatataaactggtctcaaacaaatagacagagatgaaaatcgagctagccaattaaacgatgaatatatactggtcccctccagcaaggcagcaagttcatcaagacaccaacggaaggcaaaacaattgacccggatcaaaccaaggcccggctattcaagcaaagccatcaatcatcaattcatcatccaccaaagcagcaacgtttactcccctaagcagtgaaagttaaactaccaaaacaaataatcacacgaactgacgaacacttaccccatgaggtttacatggaggcgggcgctgaactcgacgaagagctcgtacatcttcccgatgtcggcggcgttgccgtgggagtagagcacggtgagcctcgccttggggcaccgcacgtacacggcgatgatctccgtgccccgccgcgtccgcacccgcctcgcctccacaccttccctccacgggacccccgtcagagacaccctcctcgccgtcgccgccgccgccggagcagccgaccccggcggtggcggctcctcctcgtcggccacgccgtacgccggcgggtcgggcgggaaaaacgcgaacttcgcggccaccgaggacgtcaccccgcccatatcctaccacctcacgacaccggcggcagcggcatcagagggttcctccggccggcgagcggcggcggaggctgggggagagggagggacgtgtccgtgcaaagccggaactatttggagggcttttatggaaacctccacggccaaggtctcctccctaaaggggctatttgtaattaccaaacttatgtagggacctaaatgtaataattggaaagttcaggggtttatcggagggcgagggggataaagaacgggcggggaatcagcggaggagttgccgggagaattaaaggaaacgatgtcacgtgaccgccggcaagggcgcacgtgaggtcccggctttacatgtagcactcgcatttttctttcctttgatccgggtcttgatatcctaagattatggattatgattgtaattatgctcactgctaaaaatgggggaaaaccctagtgattgtgacacggcacaagattttctctctcacggtgttgttgctaggagtgcatatctgcatttaattagaaattcaaaaatgatgtgcgactaatgctaaaacagttgctattctctgtttaatattttttgtcaatgaactgtattgtttgatccacagttgacaatcaactttgtagtaaagattttttaaaaaaaaactttgtagtagcatagttgttgttgcatcaatctgttcatcaagagggtctctgcatttggaggttgtggattgtaagtatgtcctacataattatgagtatgttttgttttgcattgcacctgaattattagcaggcaagaaatgtgctcatttttttcgcaggacgagtcattaactgaaaattttcaataattatggaaaagctattagtatatgccatatgaaaaggcatggtccatgcaaactggcttttcatgatttctgcagctcctgctgctgaggaccagacccagtgtaagctctgaaggtgacattgaattgaagaattggttggcagtagctctgatctgcctgccactgtctcttcttcctgcaccccagctcacccttgcaaacccatacctacatgccttttttcatcaaaagaaatgcacaattctgcagcatgccaagaaaatttcatccatttttatcacagcaacatgacttgctaatcgccatgtactacaagttgagattcatctgagtggatggaattgttagtattagaaaaggctggttcgaatggaacacagcaatcgtggcagattaaactaacaaaatggcattgatatcattagcctttttcctccccacaagagaaaaaaacaaagatcattagcctttctagctctgctttggatgcaactaagctctgcaatgcttaaaacggggaaagttgggtgtctcttttgatgctgcgtatactcgattgtttttccttttcattcctggtgcctgagccaggtcgaatgtgtaaaagccagtgaaaaaaaatcaaatgcatctaaaccatctgaacaaatgcatttgatttggtacttctgtctgaactagtgagtcatatatgcactgctttccttcctgtaatctacctccattaatcttcagttgtagtgtctggtaatgatgacctgatgaggattccattctcccagttggtcgagtacacaaaggctggagaggtgaaaagatgatcaaatcaaatgcgcacgcttgctgttactactctcttttggttctggctgtcagaaattcagaacgaaagttgcaagacaagtatgcctgctgtttggaagtcaatcatcatcaccggagcccgagctgcacttccctggcatttcttgtccgggccagctgtgacactccttttttttgttctcaaactgtcaattgtgacttgctcactccgtttttggccttgttcagttctaaattttttcttcaaactttcaactttttcatcacatcaaaattttcctacacacataaactttcaactttccatcacatcgttccaatttcaaccaaacttctaattttaacgtgaactaaacacaccctttaaatgtatagcattattaacttttgaaatgatatctatccattcatcttactagatgttagagaaaatataaaccatagttaaagtatttttagtgataaaacaaatcacaacaaaataaatcttgctcgcatagtctttttgacaaatagaaatagtctgacgtcatgtctaaaagacaacaacgttgtatatttaataatttaaaatgaatataggacgatgtctgttgacttatataaggcatatcttattttagtacaaatctttaagattaattttagctgttagtttctttaaaaataatagctgtataaatcaacttttcgtcaaaacacttcaaaatatgaatccgttgacatagactgtacacactacatgtaattatactttgactaattatttattgaaatttacaaatataaacttttaaaatcaaaataagattgcggaaaatctagtggtttttggggggggggggaggaccatgaatcaacaagattcaagagtacactggcacttccatcagcagaggcccagaacgatgtcagaattcagacggaaaaagtacacccaaggtccctcaacttatcatcgagatataaaaacattcttgagcgcaaaactagatatacggggtccctcaactatataaaacggtcacccgaggtccctcggtggttttcaatccggttttatccgacgtgacggctgaatcagcatggaacccacatgggccccacatgtcagctggccacgtcatcaccctctccccttctctccctttctctcccctctctctctctcttctcgtttgggcaggcagctggagaggacgtcggcgactcggcgggctgctgccttcggcggggcggggtgggagaggacgagggcgtcggcggccggcgacgggcggtgcggtggcgcggcgacaccggagaaggggctctgcgaggttcaccggcctgggggacgacgacagcttggaggacctcctcatcgattcgcacgcgcatctcggtgagcagcgcgtcgtccggctccagcacgcccgtggcggccagcgactcgaacaacagcgccatgccatcggacttgacggtgtcgagggcgtcggagtggagggcgaccttggcaatgtcgtcgaggtcgggctggatcgaggccgtggtcgtcggcagggcggcccaaggggcacctgttcaaccggccgccatcggcgctggggaaggagccgccaccgcaccagaactacgccgccgtgttcgacagcctcgacgccgcggccgcccgacgagcgcgcgcaggtggagcgcgtcatggtgggcgaagagaacaagggcgtcctactccgggatggcgcgcaccggcgggagcggcacgcccggctgcagcagtgggcggcgcgcatggagatggccgggttcaccagcgtgcctccagtccgcaccgcctcggctggtgaggaggacgcagcccccgtcgccgcgcacctcgacgccggggtcacgctcctcgacccaggcggagtgggacgacggcgcggttggcggcgtcggaggtggtggcagcgcccctgctcccggcgctcggcaggccgtcccagaggaggtcggtgatgacccgattggcggcgtcggagttgtggtacgtgtcccagaagacgaacgccttgcggtcgctgcagggccgcgagttcggcaggcacaggccccccaccgtcatgcccaccgtcgccccaccgtggcggcgagcgcctgcgactccgactgcccgccggcgtcgaggccgacgccgacgccgacgcctagcaccgggtcgtcgtcgttccacgcgacgcgctgaagctgcgcgtgtgcgccaacgtgctcggcctcgttaaggccaaggtcggcgcggtggcgccgtatgagccctgctgctcgctgctcgacggcctcgtcgacctcgaagccgtcgtctgcccgcccgcgcagctgatcagatagttttgaccccatttgatcagatagttagctggatttgtttctgaaggaagcaacgactacatcaagaacttcttgcagccgttcatggcggacggccagacgtacacgcacgacacgttctccgcctcctcatcaccactctggaccggcaactaaaggcaagaacacacactaatctcccctgtgaaaatgaccagtaaagacgaggcctgatatatcgtccatggcggtggttaaattgttcgcttttgcagaggctgtacgggttgggcgcgaggaaggtggtgttcaactcgctgccgccgctgggctgcatcccgtcgcagcgcatccactccggcaacggcaagtgcctggaccacgtgaacgaatacgccgtggagttcaacgcggccgccaagaagctgctcaacggcatgaacgacgcatcgccgccgctttgcccccctcctccccaggcggcgacgccttgctccctgctcccacgtcaccgccgccgccgccgccgcgtcgccggccgccggacctcctctcccgcctcgcctcgtcgtctcttccccactcggcggttggtctgcccagaggccagagccccagagagaagagagagagaaggggggagagagaggaggctgacgtgtggggcctacgtgggtcccacgctgacttaggcgccacgtcggacaaaatcggagtcaaaaccaaagtgaacggttttgtaagttgagagatgacgtatatccggtttggttgggggacgatttcgtaactcgatgacaagttgagggaccttcggtgtactttttccgaattcagacaggccatgtccaatatcctcgactttgggcctctgtactttaactttgcagagcagttgggcctaggtcaaaaaccaagtggataagtctattttacctccctcaagtcatatccctggttgagtcgcatctatcaaccgatataacccatcatacaactcccagaaccactgcaaatcaattccccagccggttttgtcccacgtagcatcttagaccacttggataccttcagtcttaccggcgtgtactacccggtttgaccggccacccaatgccgacctgcacagttcaccaacagaaacactattcactgtattttcaataaacacttacctttgacaaattgttcatcacatatattaaatcaacacattaatttcataccaaggttatccagacaatgctcagccgaataatccgattgtgatcggattttctgcccctttatggtacaatagctagttgctcatgtacccttgaaccagagaaactcgaggaatagtccacgagcaactatagctaattggagacgatcttttgttgcaagtgtagtgcttgagagtgatcgtttgagtacacccaccaagagtctagtgttgatcggtggcttcaattgaaggcttcatcatgtcactcttagaagcgtgtttggtggtcttataagaagattatgggagaaatagcatttgtgtgaagatttttggggttttttcacagtgggaaagaaccaaaatatgagggcgatcgtggactttgtgactatatatgaaataggggcaaaactcttacgcatagtgttttaacgaggattagtggatattgttgaatctccgataccttaaaaaacccaatatcgttgtatctggaattccctttcttccactatctgtaacactttcccaactccactcctccatttttcacgtacacgtttttcaaatcgctaaacagtgtgttttttggtaaaaaaaaatataggaaagttgttgtaaaaatcatactccctccatctctaaatgtttgacaccgttgacttttttaaatatgtttgaccgtttgtcttattcaaaaaatttaagtaattattaattcttttcctactatttgattcattgttaaatatacttttatgtatacatatagttttacatattgcacaaaagtttttgaataagacgaacggtcaaacatgtttaaaaaagttaacggcgttaaaaatttaagtaaggagggagtattagtctatttaaagttttctttagctaatatataattaatcatgcgctaatctactattccggtttccatgtgaaagagagaagttctcaacttcaaccaacgaacacggtcttagtttgtgcgtttcttttcttagtctcaactagagtgtgtaagacgtcaactaggttagaaaactttgaaaagggttactttgaccgtgttcttcaaaaatcctattttacctccttgtagaacatctttgatcctgcactccagaaagcaagcaagcaatgatctgaacaacttatcaaagtagtcaaaaaatgtcctaagatcagactttttcagcacagtagcaacaacagtagccagtacgacctggttgatttggcccacagtatttactagctgggattatcacttcgtttaaaggtagcaagtttaatagtatatacaactaatagctctaattcatctatagccaattaaatagctaattcataaacagttatctataaaaatatactacacctttaatatagtctcacctcccacacacataatgtattggagtccgtgctgtagctggctgcaaatatgtagcacgctttctttctctctcctcttctcatctccacgtacgtgtgcgaacagctaacttatagcctgctattgtactcgctctaatttgataggagtagtagtagtatttcattggtaagctccggcgttgggctgcacctctctccttttgctgtcggtcatggaagcatcggcgcggagccccagcgagcgacgtcggcgacgcgaagccgcacgttctcgtcgactcgacgtcgtgccgtacccggccggcgcaggggcacatgctcccgcccctcgcctcgcgccgctgctggcgtcgcgctcgccttcctcggtcgcgccacggtcacgctgctttcccgtcgtccgcgtcgcggctcctcccggccgcgtgcgtcggctttttacctccgtttccgttagcacgtttttcaaattactcaacatacggtatgtttcatacgaaaactctctataaaagttactttaaaatataaaatatatctatttttgtcaagtttgtaataattaaaacttaattaatcatttgcgaatgattttctcgtattacatgcgccaacttaatctttatctcagtgagttttaaacaccaccttatttttatgttatatgttaagtttatttcttaaattaataatttatgcctataatcaaatcgataatccgtcgtaataatctactcgacaatctaaatcaaacgaaaagaatccccttaaattgccactaaattcccactcttatgttttcacgcacacgcttttcgaactactaaacgtgtgtgtttcgaaaaaaattctataggaaagtttctttgaaatatcatactacttccgtcccaaaatataagtagttttagagtcgtgcaagggtattgaatggagaagtgttgtgattgattaagaagacaaagtacgtggagaatttaaatgttggagggttgtaattggttgaaaacaaaatataggtggagataaattgctagaagtcgttatattttaggacggggtagcattaatctattttttaaatttgtttatctaatactcccttcgttcctaattaatcatcatataatattttgaggttattcccaaatgatcacctttttaatatgcattccctaaatctttctattatctgcgtatgaaagtaaatggacattgatacatatatatatatatatatatatatatatatatatatatatatatatatatatatatatatatatatccatgcgcacaactatatacaatcaacatgcaacattttggtttattattggttacaaaatagtcgggattacatgtaatagagtttgttaccgaagtaaatatagtacgagagaactattaacttttattaatcttggcgtactcttttaatacgatgaccaattaaaaaaatacttaattaatcatgcgttaatctactgctcatgtaaaaaagaaagataccaaccgctacaatccatcacaacctagcttctgacagaattagaagctccccaaacaacatagctagctttggtccagattttaagaaactgtaattataaaatccagaaaatgaactaggagttagaagctgtaaaacccaaccttttcagattctcagaaactggctatcaatcaattgtttctcagaacgtcagctccctacacatatcctactaaatatgaaacggaaggacagggtacctatctcgacgtcaaagtcattcgtatacaagacataaaaaaaaaaaaggtcagtcgtacaatagaagcactttcttttatcctacatggatacagcgatgacaaaaattaaatcttaaactttaattttaattttttaagaccttttattgtagtttctttttcaagattaacgtctaaatcattaataacacatatttaaaatttctaactataaattactaccggaggaccgttcgtcggcagcagccagagtctctgacgttgcatcgattgtgtttgtctaagccaattcactccagttctagtgttgaactgttgataattgggttgcacctctcgttttgctgtcggccatggacgcgcacgcaccgccccggagccctgcgtccgacggcggccatggcgacggcgacggcgacacgaagaagccgcacgtcctcgtcgtgccgtacccggcgcagggccacatgctcccgctcctcgacctcgtcgcgctgctggccgcgcgcggcctcgcgctcgccgtcgccgtgacgcccgggaacgtcccgctcctcgcgccgctgctggcgtcgtgcccgccgtcgtcggtcgccacggtcaccctgcctttcccggcggcgtcggcgtcggggctcctcccggccgggtgcggcgagaacaccaaggacctgccgggacacctcttccgcccgtttatggcctctctcgcggcgctccgcgcgccgctgctcgcctggtgcaaggcgcagcgccgccgccgccgccgcgtcacggccgtcgtctccgacatgttcacggggtggacgcagccgctcgccgcggacctcggcgtgccgcacgtgacgttctcggcctccggcgcgcactacctcgccgtgtcgcactccctctggcgccgcctgccgagaaggcgctgccccgacgaggccgtcagcttccaggacgtgcccggctcgcccacgttccgttggagccacctgtcgtggctgtaccggacgtacgtcgccggcgacgaggtctccgaggcgatccggcagttcttcctgtggaatctggagagctcatgcttcgtcgccaactctttcacggcgatcgaggccgcgtacgtggatcgcccgctcccggacctgatggagaagaaggtgtttgcggtgggccccctgtcggacgccgtgggccggtgcaccgaccgcggcgggaagccggcggtggcgccggcgagggtggcggcgtggctggacgcgttcgacgacggctccgtcctgtacgtctgcttcgggacgcagcaggcgctgtcgccggcgcaggcggcgagcctggccggcgcgctggggcggagcgcggcgccgttcgtctgggcggcgaggggcggcacgccggtgccgggcgggttcgaggcggcgacggcggcgcgcggtatggtcatccgcgggtgggcgccgcaggtggagatcctgcgccaccgcgccgtggggtggttcctgacgcactgcggctggaactcggtgctcgaggcggtcgccgccggcgtggcgatgctcgcgtggccgatgagcgccgaccagttcaccaacgcgtggctgctcgcggaggccggcgtggccgtggccgtggcggagggcgccgacgccgtgcccgacgccggacagatggccgacgccatagcctcggcgatcgggaacggcggggcgtcggtgagacagcgcgcggcggagctcggcaggagcacggcggcggcggtggcggagggtgggagttcttccgtagacttggaagagttggtgagcatcctaagctcgccaaagctgactaattaatgtatttttattcaaactgctactctctgtttcaggttagaagacgtaatcaaagtcaaactattctaagtttgattaattttataaaaaaaataataatattttaaacccaaaacaaatatattatgaaaatttattcaattatagatttaatgaaactatgctgttgttataaatattaatattttttctacagaattagttaaatttagagtagtatgaacaaagtcgaaacatcttataacctaaaacggagggagtatatattttattcctaataaactgtgattagatgcgaatataatggttattttcggaagctgggaatagtataatggttatttgggattggggctaagccggctaacctttgtcctagcaaacttattaccatcactgtattttatagggcaatgctattgaccaaacaaaatatcttcttagtatttctaaatttcatataaaccaaataaaattttactattgctattctattgaaacctataaaaaaaattagtaatcctgaaagtttctgtcataaagggtataggccacaaatactatcatagaaagcttacctgacttgataaataggaggtgaaccaaatcggctacttgtaagtagagcagaacttgggaatggctaacacttgtaatacaagataatgggtggatagaatattcgtaagcttcctatacataaaacaagtcgtatgtggctaaattactaataactacatgtaactgtgtatctcaatctatataagatgggcgtgggtctcaagattggggcagatgcaatcacatgaacatgacatatacaaaaccctatagcaatacaattcactaaacaagagtagagtacggtattaatataattatctctcatcgagtttgtataaatctctttctcttgtatcaccattgagctcttagttcaacgcatagcgttctaacaaacgacactactattaataactttaccgaatactttacaacaaacacatataagagcaagttcatagtatagccgtctatcagctccaatatatctatagtcaatttaataactaatacatacaatagttacctactatactatagatacatggtcccacctgtcatacacacattgcgtcttgcaatccgtgctgcagctggctataaatatgtagcccgctgcacttctttctcatctttttatctcctagaaatgtatttatatctggcttatagtttgttattgtacctgctctaatactaccaacaacaataatacatttaactttgatagccttgaaagtggcaaaaaaaaatgaacatactcttttagagcaagtagtatggttctcattctcaacaaccatcttcccacatgtacacagtgacatgttattcaagatgcacctggtgtcttcttgcaactgttggagtacagaatcactagtgcagaacttcttttttttttaagttttagaattctgacctacacgtttattttatcttttagtgggatacctgtatgattcatatatatgttcatccctatctctctatatgcactgtgcttgtaatctctactatcgaaatctgtacaaatcagagggcaattagcgaggccacgtggcatgactggattcatgggtttggtccctcgcgcacagccgtcagatcacgcatctacggtgatatatcgtgcggtggatcttgttgtaaaatataatctttcgagggagtttaatgcaaaagagtagagtatccatactccagtaaatacttcgttcgtcatccgttcccatccgccgccaaggctccaatctccgctcgttccccaccgcggccgtcgcctcgctgtcgccgggcggctgccgatcccgagccaacagcccgccctgctgccggcacgcggtcgttgaatcgagggcgctgcctcgcccccatgattttctggtgcgtcgccgctctccacgtgttcctcatcagccgcaacgtccactttctccgccaccggcagccgaggcgccgcctccgcccacatcgcagcattgacttctccaggttggctcaccaactccatcggctattccaggtcatccaccgtctcacccctctgaattgcaaactactatcccctgctgcactctgcctgttcgttgtaatgcttattagtggaaaatagttcaacaatgtcatctgccaacgattagtagaacctatgatgtgaatccatcatgttgtttgtctgtgaccactgagagtttaataatgcttattaatatgttgccatgcgaatgctcctagaccaaaatgtagtctctgtcagtttcttgggtttctttgtaaccatctgaatttaaatcggtaaattgcctatctgttgtatgtaatttcagaagtttaaaatagcaaacgtcaagatggggctatctcatgataaccttaagtggtaagatgaggttggggatacaattcatatcaagagttttttactgatttggaccaattatcatgtacaattttaaaatgacacaaataaaaaaaaatgacacaaagaaaaattatgtagacatgaactgcaaaaacatatatggtgattagatacttagatgaatgagagagaatccttgcttacttggtgcaagattaaagattaaaagaaacggtaaagtttatctacggtaaagttcagctgcatatataagttacaatgtgcaacacgtaagaccaggcttctttgcaatcatttatctactaagaatctactggtacaagaggattaggaggcaccagcatattctgctcatgtttgaggtaaacgctataccaaattattaaacgaataatcaattcctcaggctctttgtgtaaactgaaatgcactcaaaacgtgatctttaaagaataagaagtgaaagttattttaaaaaaaggatttccagagttcttatagacatctggagggataaaatgaagataagtactttcattactttggttcattggactttagaatttgtgcgcacatattcgactttcaactgatgtcgatgaactcattgtcttgcagccttcaattgatctgaataaagcttattccagaaactatgtcatatctgagaacaattagatattagaattaaattaaattcatattacagagagcagaaattggtactagaactgttatgtcgttagcattattatgttactttatattacagattgtttctgcattttctcagcactcaagtggaaaataagctggaaattcatgcatcgttttgtaattttaataaatttgtaaactaataaatagcccatggagatctttctcatacattgtagtgctgtcgaaactcaagtatggttgaattagtaccatgattaatcgtagcttcatgcactttcttttattttggcaatggtctctttgcgtactcttctattcatgcaatgacatgatactgaatactgagcattgaattctgaaactgaactggcattattttgaagaaataaaaaaaaaccaatcatgttattaggcaacaagatcagtgatcatgctcaagttgataaggaaccatattattaaatgtttaattttgattattttcctagcctggtactgaagtactgtctaatttgacctctgaagtacttgacatttgaattttttctaccattgccatgaagattttgtaaggttgctttttattatacctgtacagttagatgcaatatttaaccaatcgaagtaggagtttttgtgtattcttttaatatataatttttttcctttcaaaaatgcggaagaaaaacaaattggaattgcaaaatttaacgctgacaaagcatccattcaaggcattcctttcttttttgagagaatcccttatatgccactagaaattggttagttctcttatatgccactcaaaattggcttctcccttatacaccactagttaagtttttctatccttttatgctactcccagcactatagcatttgttgactgttagtcaaatattagttttttttcataaatgaccaatatgccatctcaactaaaaaatgtgtaaacttcaaaaaaatcataactaatttattttaaatcctttttgagtgaacaaagttttgtcagaacaagtggaaaatgctctttgtaataaaaatattgttggaaagctgcatgtttcatacttgtattgaaaatttatttgtgatggtgatggctaaaattgcatgtgattgaaaaacaaaatcaattttcatatgttgtatccagtagatatattagtactaaaatacctatcattggttatataccaactctcaatggtaaatgtgtctttttactatgaagttaacggtcaactgacggtggagtgacggcaatggcataaaagggaggacaaacttgaaccggtggcatagaaaggaagagccaatttgaaggggcatataagagaaccggttaatttggagtgacacataagggattctcactcttttttcatgttagcaatggtgtaattaatactcacctgtcaaatacataaatcccctgccaatggttctactgagtcctttttcttgctcttgttcaagaacattttattttcctcttctgatctcaagtcccaacgtctattaatttatttctttaggtttctggttcaatatgttaagaaaaaaaaccattgatcctaaacaaggccactgacaaaatagattggcctaatctaaattgggcgcggcaaagccgcacgttgtttctagtaagttttctaagttcagcaactttttttgtaagtcatgggtagagaaaccatttttggttggtcgacccaaattcacaatagtcccggttccattaaaaactgggacttataagaggatgatctttagtcccggttggaaactccaaccggaattaaaaatcatttttagtcccggttgattccatgttaggctgtattagggccctaggatctttagttccggttagtaacaccatccaggactaaaaacctatttttagttctggttgatgttactaaccgggaataaaaatcaaaacacactatatagtccctagtaccgatcctcttttcccatccacacaacaaactcctccctctatctcttttttcctctctaacttcttatctctttccttatctctaactcctagccttctctttcctttttttttccttccattcaaagcgagaagagggcgggccggccaggcaacgggcggcgcggggggccgcgcggcggcggccggcggcggccggccgccgcggaggggaggataggaggcggcagtggccggctgattgttcttttttttttacaatttatgatttatcctgtgatgtatttgatttgtgtgtgatgtgaatcttgatgtattttttagaacttgtgatgtaatttttttaagagtttggatgtatttagagatgatctatttgaggatttggagatgttctgtgatatgtgatgatttggatttgggatttcttagtatgattaggggatggtgtgaaatcaatattcaatgttaaaaataatgaaaaagagaaaaaaaaagaaaaaatatctttagtcccggttatttgaaccgggactaaatctttttagtcccggattcgtagtcccgggattaaaaagtacttctccaccagtgagtgttattgatgacgggggctgatacagccttgtgtctagcttcataaatttctattaatattttataacaatatcatataatttataaaaacatttaaacttctactattagaatacctaattatataaccctacacgcgaggatttcctagttgctccaataactgatgcctatcatggttcatggagcaagatgacaggagtttgagacatttagctaatttatttattatgccgatgggtttccttggaagagttgagacattttattatgccgatggactcaagggttggctgatgactccatattgttttcttcaccagtaagggtttgtttggattagtgtcctactattattttttaagttttgtcactactaccaattatttggtagaataaatttgtattcatcttatttggtttgctactaaaatattgctaaattgtgatactatactgaagaaagttctatattactaccaaatttggtatagacattaccaaaaagttagcatcaatccaaacaaatgataggtactatttatgctactaaaatattgttttggtagcaatccaaaactaccctaattctctgctaaaaggcttggacatggacacgtaagtatacctgtgtctgcctgccaatttaggtctggtgccaaaattaaccttaccaaaatttgggaataccaaaattttaacaaactgacactattgccaaaatttcggtaggattagcttaataatgttaccaaaattctatacatattgccaatatttggtaacaaactaaatatagctacataattgtcaattttaacaaataatggtatagttgaaaatgtcatcaatctgaacagccccttaatttgcaagtggagcacacggtgaaagtggtgactgcaagacttcttctacagtactacaacagtactacagagtagggatgtcaattgtgcccgtttacccgttaacccatggataaaaacctattagggttgggtttgttctccattttatacccatgggtatcttgttgggtcaaaagctatgcccgatgggtaaatgggtatgggtatgtgtaatcactacccatgcccgctttgcccgtttacccgtgaaatctaacttacatttaggctaggatcaaaatccactagaatacataagccacgttctttgttttctacggtttcccttttattttccttattatttctctccccctctatcgtcaccagaggagagacaccacaccgaggcggagaatatttgatgttttaagtttgatttgaacttagaagcttgtagactttttgttccactgcttttgttgtggcgggtaaccatccttacccgtcatgtagtaatgggtatacccacgggcacaaataatctcacgggcacgggtatgaataggcactacccatgcccgtcacacccaattgccatccctactgcagagatgtactgttcatatgagggagcagtgaactaatgccataaacagtgttgcttactgtagctactggaaccaaaaaaacgtactgttgcatattgtctgtaccaaatttaccttagcgtgcgatccgattctgtcggtctacagtacccctaatgtgcagtacatttcatcctctccctttagtatctcttatgcagaggatctcaatttagcttggtggggtttttttccacagttagtacacgaaattctggtgggcattctataattttccacggtgaaaggtatgggcggcgctctagtggaagaatatggattgattcttcaggctattccactgtggccttgtttagttctaaactttttctttaaacttttaactttttcatcacatcaaaatttttctacacacataaacttctaacttttccgtcacattgttttaatttaaaccaaacttttaattctgacgtgaactaaacacaccctatagcagctaggattcatgtgctcgaatagctttgaaatcatgacggctaaatactctctctctgttcctataatatagcaagttaaaactagacgaaaaattttatagtataataaatctgaccacatttttatttagattcgttatactataaaatatcttatctatttttaaattgctatattatgttacggggagtacaaacaaggatctttcgaggagtgattggagtgaagaccgatgcaccacttacagtataaaaggaacacgtgtgtacagttgcgacaatgatgacttgtagtacgttgatagtgttgtcggcgtgtggttggtgagttttcttcaagttacagtcttcaaaaagataatctgagtgtgaagattttaaagtatacggactcacatttaaatcattaaacgtagaataataacaaaataaattacagattccgtctataaactgcgagacaaatttattaaacctaattaatccgtcattagcaaatatttactgtagcatcacattgtcaaattgtggcgtaattaggctcaaaagattcgtctcgtaatttacaagcaaattgtacaattggtattttttcccctcacatttaatgtcccatgtatgtgtccaaactctaaacatttgatgtgattttttttgacaaaaattttaggatctcaacgagacctttgtcctactataccaatagaaactttatgttgtccaatgctattcgttaaaaaaaaggtcatgtatggtatgcgtcactcgaatttacctctgtgcatagtcttgccaactaggtatcccctccatccctaattgtagttttttctttttttttcttttttttaaaccgttgaaccaacggtactccatacatctgctcgtatttagttgctataaaaataaccactttacctttatacataaaagaaatatgaaaatccgtagaccaaattattagggttaattacaaactagcatggtggcccgcgcagattgcgcggctagtatcattatattctctctcatataatagcatatatgttttctcattatattattcaaatatattaaaatcacaacatatttttaaattttgcaataactttacaaaactattaatgtgtaatatttatattgtattttatatacgtgttagttattaattatttttaatattaaattttagttatttgtaaattatatatattcctatatggactctagactcgtcttttaatacttcttttttttaatttcgaattttctgtaaattgtatttctatatagactctatgctcttctttcaatattatttatttttatttcttaatttttattatttttaattgtatttctatgtggactctaaactcatctttcaatattttttaatttttaatttcgaatttcagttacttctaaattgtattcctatatgtactttaaactcttctttccatgttttttttaatttcgaattttagttatttataaattgtattttatacagactctaaactctacttttaattttattatgtttattctaaattttagttagttagaagcccgacgaccgcgccaagcacttccgctgccgcacgtcgcctgcaacccaacgtaacttaatgttgttggatttttcatttcatgattttgtggatttgtgattcattttcttgctcagatggatcggattgggagagaggtaatacatgggtattaggtttcttgcggggatcaaattcatgaggtcgagattggtattttcgtgttgtttttgattatctggttgattgattgatttgaggatctagctcggggattctttctgaaggcagactcggactcggggaaggacagatcacacggacgagtgaaaaatcatacatacgaatgaaaattatgtgacgataggaaaaatactaatcttttaattagttaagatatgtactctatactctacttctaatatttcttatttttaattccgaatttccgttatttcctaattgtatttctatatggactctatactctacttctaatattccttatttttaattccgaatttcagttattttctaattgtatttttatatggactctagtcccctcttctaatattccttattttttaactctgaatttcaactatttctaaattgtatttctatatggactctagtctcctattctaatattccttattttttaattccgaatttcagctatttcctaattgtatttctatatggactctagtctcctcttctaatattccttatttttaaatttcgaatttcagctatttctaaattgtatttctatatggactctagtcttctattctaatattccttatttttaattccgaatttcagctatttctaaattgtatttctatatggactctgctttttctttttctccgattaatgtgagaatttctaggccataagagcgaacgtggaggctcctttttctattcctttaataatataatagatgtgcgtatttagataaataccattacaatttgtctatttatagttgtgccactcaaatttaataaaattggaaccataccatcgccgttcatttttcatcctctccctcatatgctcgtgggacccacctgtcagattcatcttcttcctccaccctctcctctttctctttttttttccaatctctctcccccacgtctgtgatgttcgccgttgcgccagggaacgggtcaccggcacggaggttgttgtcagcgtccgtcaccctgtgctgctgtgcaccaccttgtgcgttggctagccgtgctcgccgacgccattctctgcaaagatttaacgtttctcactatcaatttaacaaatgaactcatcaaatctaccgatagcgattggatttaacaagaatgtaccaaccaagatcgaagcagtcggcggctcggcgtcgtgggggctgcccatggcgggggcctcccggccgaggcgacgtggaagccttcccgccgcacagggcgtccctaggggcgtacggccagcgcgcccgcgcagggtccccaattttcaggggccccctaggcccaaaacttcaacgcactagatatataactcaataagtaaattggtagtctaactagtcctaaaaatctgttatttttcttgtcgtttcggcttcgattacgcctttgccggttcgcacagttgcgccggttcgcaatcttgaatcgcctcccactatggaccttgccaatcacaacgaacgagaggagtaaacgacgcctcacttctttctctcgtgcggtcgtgccggttgacgcctgccgcgcccctgacctaattctttctggtaatttctaatccggtaatctctaattttggattatcattttaggccattctagattgctatgaaatatattacagagtataattattttcatattatatcatcaattaagtttttatccttcaactttacacagggccctcgaatttaacgggacggccctgccgccgtatgtcaaggtccccaaccgccgacacgttgccgccgccgccattcgtcttgacggactgcgccactaagcagcagcacgagatggcgaggaggaggcagagaagagaggcggcgtccgccacgttcacaagaggaggctgagaagtggtagagagagatggaaaaaaaagagaaaagaggaggatggaggaagaaaatgaatctgataggcgggtcccacgtgcatattgggggagaagatggaaaatgtggtggcgatggcatggttctaattttaaaaatttgagtggcacggttataaatagacgatttgtaatgtcatttatctgaataggtatatttgcaatggcatgaatcaaattaacccaaattattaaaagtgtacaattttggtagggttagtgaaggtgctatttcagcatcctatgccatgtcatgttgaattttggatcggtgttggtatatttagttagtttagaggtcttaagatactttttaaaatagtttataaattcaatacatccactcacatgttaattaccatcaatgtattttactcttttaatgcactactgtttcttttttccttcgattattggcacggattgtttatccaggtaagactataaatcaatatttaaaaaataaactacgtaaatagcttagaataggtggtataatcatgcaacaaagaaagtttccttttgagaaatattttttttagaagcgtggagtacaaaaatgcagggaaaacactgaaaaaaaaaagcataataataacgtagttatatttttttttacggaggaagtgtataatacggcctcgcgcgaacctaccaggtttttactcctgcaaaaacacggatacaaaagcttaaaaaaaaacagtattagatcgagaaccctagccccctagttcgccatggactttcgacgacggaagccgccgaaggacggcagggtgttcgtccgcggtctcgccgcgggcaccgccggcgaggcggacctcctccgccacttcgatcgttacggagtggtggacgaagtctccatcccgagggtcgtcggcgaggtcgacagcctcaccggcctcccggccctccgcttcgccatcgtcaagttcggccaccccgagttcgccggcctcgccctcaacgatcgggagcaggtcatcgacggccagatggtatggtcggcgtctccgatcgacttgacacagttaatctctctttctgaatataagcagaataaggcgtgtcaaattttcttggtttatattgcgccatatgtaattgtgctcaaacaaacaaatcatgttttaaatatgtaattgttgctggaacgggacgaccggctgcaggtagccatcgtgctgcggctgctgctgaaatgggaagccctgctgcaggtggacatcgtcgtgctgcggcggctgcaacggcaagtcctcctggtgcgaagcctgatcagtcaaccggtggagcttggtgttctccaggaacagagcatgcgcaagagagatgacgtcctccagatactgccacgaggttcctcgtggagggtagattccttccatgtcttttcccaagttcttgagagcaagacttgccatatggattcgggattggattttaatccctcgtgcgtgtcactaaaatagttacgaaaaaaattgagaagatatattaacatgtgatatatcgcttcacaaaaatgcaaattaaaattcaatttctacatctcgcaaaataaatttaactgtgaatatatgttaactagctatagtttaattttttttcgttgcgagatgtagaagttaaatttgaacttgtatgtttatggagtaatatattacatgttacatcttctcaaattttcttcataactattttaagtgacatacaaataacgatgtgacatccttcgaaggatcgaaatagtttcccatatggattcggagtcctcagcgttctcgcagttggttgggtagtatagggaagcatcctttcgcagggaccgtagatttgatcgggcgagtttggcgagtggcgctggttccgaacctcgcacgtcgtgtttggcaagcgcatcattctgcaactcgtggctggtgtcgcggtggcgctggcgcatcaggatcaggtccgcagcttcggccttcgggatctctgaccgcgcggccgtgctgctctgcgtccgcatcgttctgcaactcgtggccggtgtggcggtggcgcagcaggttctcgtagtcgtactcgtactcgtctatgacgatctcgccgccgtgccgctcgaagtccgaactttaagcagcctcggccaaacgccatggaagagacatcacaacccactggctcctgcaaaaaaaaccattcacaaactcaggatcgattctgcattactcggctaagaatctaatcgaaacaacacacagtaggatgcaaattcagttactgtcaaatgcagtttcagtttgatccacaaaattcattctgcacatgtaggatggcaaaaccattgcacgattagttgatcaccttcagtttaatttatctaagattggagtaaatgacagtaacaacgcacttctagttataaattattgtaatttgagatttgagatacacccttgccgcgccatgcagttaacaatttttaatggcacgcacgagcacaagaactttcaccgatcaaccgactcgaggtatgcagtttccagctcattcgccatcttctccatcgcgatccacgagctgccaccttcctccaccgccgccgcggcggccgcggcgagctcgctggtcttggccctcacatccgccagcttcccggcgtccgcggcgtcggcgaacacgcgcgcgagcgcccccgggtagggcacagcgcccgcgccatccgcggcacgcacaccggcgccgtgcaggtcgaccacgagccgcgcgtcgatgaactggtcggccttcatcggccaggcgaggagcggcaccccggcggcgacgccctcgagcgtcgagttccagccgcagtgcgtcaggaacgcgcccacggcggcgtgccggaggatctccatctgcggcgcccagccgcgcacgacgcggccacgcgcggccgtcctctcctccagcccctccggcaccacggcggcgtccgcgcccacctcccagacgaaccgcgcgccgctcgcctccagcgcggcgcccagcgccgccgcctgggccggcggcggcttgtacatgctcccgaagcagacatagaccaccgaacgcgagggacacgtgtcgagccaggagaacagctgctctgcttccgatgacctctcctctccccggcagccggagtcggcgaccgggccgaccgaccacacgcggccatggccgaagaacctgttcaggtactccaagaactcgccctcgatctcgtcaaatgaattcaccacggcgccccaagctctggagttgagcaagaagccttcccgcacgagctcccagtccggatcgccggcgacgtagctcctcaccaccgacgggacatgctcgtacgggaaagacggggacccgggaagagggggacacggaggtcgtcggcgaggagctgcacccatccaagaaagaagtcggagacgacgacggtgggggcatcgtccgggcgagaccgcgcccaggagaggagcggcgcgctgataccggagagatggacggcgaggagcgcgtggtgtgagttctcgtggagggaggcgtcggggagatggatcgggagggcggcggcgaggggggtggatgcgaggaaggcggagaggagggggagatcggaggccgtgacggcgacggtgagggcgacgccgtggcgggtggagaggcggtgggcgaagtcgaggagcggcaggaggtggccccgcgacggcaaggggacgacgagggcatgcggccgccgccgggagggcacgccgtcgttggtggacatggcggccggagaagagtttgattgcgcgcgaggaccagtagtctctggagatgagtgaacctccgaggcttggagtgagtggtgataggctgtcgagcagtagcatttctagctgctctatgacaatcaacatcagtcaattattacttcctccggctcgttttaaacataacgatgatttcgtgtctaatcttaatcatttgtattatttaattttttttatttttattattattagataacaaacatgaatactactttatacgttacttatattttttattttttaaaaaataattaaaataaaatgaatgattaaaattgaacgtgtaacctcatgactatatttataatatgacagtggaagcattttattagaagactttatacttaattagttgttgaaatggtagtagtatgaacagcttgtgctcgccaccgacccggatgcggaccgccactgggcgtgctaggctcgtgaagtcaaattacacggcgactcggctgggccccgacgctcgcagggatttcggcggggcttttaactattcgccatttttagatttgggctgtgtttatatctaaactttagatctaaatttttaacttttttcatcacattaacctgtcatacacacaacttttcagttacatcgtaccaatttcaacccaaactttcaacttttaaaaaaactaaacacagacttggcaaataactatttgccacccctatcttaatgacatgtgggtccacatgtatctatgacatgtgggttcagtggcaaaaagttaattgccacatctaaatgtggcaaatggttaagagggtgtttaggaagaagggactaaaatttagtccctcataaaattgtagtccctcccacagggacttatgcttttgtgtccctccttcccaaacaccacctaaatatctcgatttcggggggctcgcgggcagcttgggggaccacgagagctcacggaataagttcaccggatgtccctcaattgtacgccgagtctttctgaggtctctaaccacaataacaaaaaatgtgtatctctaagatatgtaaaaccgttcaaaaaaatcccaaaatagtatagatgtctggtttcgttgatatgacattatagtcaacaaaaaataaaaaaataaaaagtgtggcccacatgcaagtgagaagaaaaaaatatgaagcccacgcgtcagcattatcttctttctttctcttttctttttttttccttctacctcaagctgtgccacaggcacacacagggacgcaattacggcgcgctcgtgttcctcaggctggagcttatgctcgtcatcctcgccatgccctgcgtctcccaggcgtcggcggtgctcatccgaggcggcactacgaccgggctggcaccgggctggccggtgggatcgtgctcacggcgttcctggttgctctgctgctgttcctgtcgctgggcgtcactacggggaggctgctgcactacaaggaggtgcaccaggagattgttcgccggacgctcggccccggcaagcgtgctcagtggacgtggaaggaccccgcccgccctgcctggctcgtcaagctcagtccgctcttcgatgacctgcgtgtctcgcccaagtacatgctctcgcagatcgcaggcagcggcctcgtagcggatcatcgtgtccgacgacgagaatgaggacgccgaggcgccgttcctgcagaagttgctcggcatactacggattgttgacgattcttaaatcataatataatatctgactgtcaatatctgcatataataaaataaaacatgatatccgacttagtggtaggtattattactaatcatttccactagtgatggtgaaatatgtgtatgcaggtgttttaagaaaaaaacacatccgtcaagcaacaaactgcacctccgcgcattcaggatacatttacacagattgaaggccctataaatcaagtaaacaactctaaatgggcccaactatcatgccaatgggctgagggcctcaaaattagtgtccacgacaaaaaaacgggccgaacggagccgtcccgggttcggccgaacctccaattcggccgaatactttttgtagccgttgatcgtgagattcgacatggacggccctgatctcttcccgatgacggttggagggtagtttggtcgtttcctatacctgtaaccgtcatatggaggctataaatagagctcatctcattcattcacaacacacaactttgagatgaattattattggtatttcttaacgacattactagaaatataatttccagcaatgacgcagaaatacttctggtatattatggttatagagttcatccgcaagcgcacggatacaccatagtagcatttcacccgagagtattccaagagtatcgtatttattttatcccgtgggaagatcatgtagagagaactcaactaataacttatatattacttgtgataatcatattctaagcaggggttaagataatccaagggtacagtgacacacaagcattactactcatcctcgtaataattaatctaagctaggtagaaagaaaagagaaagagaatctattcctatacttctaatatacatagtatacatacattctagttaactggtatactagctaataccctctatccgtaataattaatctaagctaggtggaaagaaaagagaaagagaatctattcctatacttctaatatacatagtatacatacattctagttaactggtatactagctaataccctctatccgatgccctcctggtacttcgagaagccacccctgactgctgagttccttacgacagcccgtcatgaccatccaaccagggctaaatacggaggaataccctcctcaggaaattaacttaggattatatataggcgcggaggaatacccgtactgagctgtcaccatcagcggcacacctctcatctgcaatatataaccccaaataatgatatcccgtaacctagacaccacgtctaaactaccagatactactctaatattatcatcatgacatagagtaattgcataagcaaacactatacccgcaccaaagcatctcccagataagctagcagtatattcagtataacatgaacataatgtaaagtaggtactaacatactcggaaagtatttcaataccataaatggtacactctgtctgtcaagaaattccacggtgaatgggaggagcttaagtgcaatttctgccttactttcttgacagacagagtgtaccattgtttcgcttcttctctaagagaaagaaacaatttccactttagagtttcatgtgtcatgcctacgatggataggcacgaagacactagctcaaagtcccgaagatggaggtatgggcgttcaccgatactaccagagaaggttttctctcgaaccatggctataaagccaggactgatttcgtagccatccgaaaggattggttttgaagaacaggatggctcacaaagatcagcccgaggagcagaaatgttttgaattgtgggttgctccatcaaggaaaggaatcaaagaagaagaaatatacataaagatacgaggatgacctagactcggataaattaacaaccgttccccggcaacggcgccagaaatacttgttggtatttcttacgaccacagataaatccgcaagcgcacagaataccgctgtagcacttcaccttcgggtgaccccaaaaggatatcaaactcagggaacatgtgtaatctacctaatgctaagacaatccgaggagaacaactaaagataggtaggctaggctagaaaggtctttctaagggttttaattatctaagctaagttaaaggtaattccctatctgttgctttgggcaccgacccctgctagtctgtcagcgtggttctggctatagctctatgatgtatccgaacgtggaggattacttggacgggattcagggctgtcaccacctaccgcctacctctgacaaatccgtgggatacacaacaaacaaaggtaatatctaacctagacaccacgtctaagttattaattactactctaatactcgagcaggaacttccttctctatccggagtcctagtactagtgcacttagtataaatactaaacaatgaacctgcaaagatggaaatctatcttactcagacaaaataattaaataacataacaaaggaacacgaatgcttactttatagaagaagttctccgaatcaggagcagagtgtaccgacagctccggtactcctccagaattcctcctaggaagctacactcgtcgaggtagaagtcggatgagcgccaaacttccgggcactcctccagagcttcccctcactctctaccttattctcatgtacaaaagatacaatagagcctcttataattcagctcaaagttgtgtgttgtgaatgaatgagaggagctctatttatagcctccatatgacggttacatgtatgggaaacgaccaaactaccctccaaccgtcatcaggaagagatcagggccgtccacgttgaatctcacgatcaacggctacaaaaagtgttcgggcggaacccaggacggctccgttcggcccgtttttcatcgtggacactaattttgaggccctcaacccattggcatgatagttgggcccatttggagttgtttacttgacttatggggcctccaatccgtgtaaatatgtcctgaatacgcggaggtgcagtttgttgcttgacggatgtgttttcttcttaaaatacctgcatacacatatttcaccaacactagtgaaaatgattagtaataatacttaccactaatttggataccatgttttatttcattatatgcaggtattgacggtcagatattatgatttaaggaccgtcaacacggatctacttcacgttcatggagtcggtgaagcgggtggcgctggggatcgtggcgagcacgcacatacgctggcacacatcgtcggaccactcgtcgtgtgcgaacgccgtggtggtgctcgccatcgcctccttccagctcttcttcatccgcaaccgcgctcgcctgccgccgccgccgctgttccgcagccacactcgcccgccgacgtcatcgctttgcctgctctgggcgcccgttgccgctccctctccgcaggaagaacgaaagataagaagagaaaaaagaaaagagaaaggaagaagatgatgctgacacgtgggtcctatatttttttattctcacttacatgtaggcttcacatttttattttttatttttttactgactagatgccacaccagcgaaaccagacatctatgctgccttgggaccttctttgaacagttttaca

SEQ ID NO: 42095 - DNA, 5743 bp, Oryza sativa
tgcgggaggtgaccggcgagccggtcggccagaggattgagataatggcctagagaagaagaggagaagcgtggctgacagtgagcctcaacgtttttcatttctacgcttgacactgacatgtcttacaatctgattcagccagttagtagggtccaagatgccatgtgggacaaaatcacccagggagtcgatttggaacggttttcaaagttgggggacaggttatacccggttttgcggttgagggatgccattcaactagagacatttttggagggaggaaaatagacttatcaatgaagatgagtgctcttgattatctaggctctaagcccaactgatgtgacgtgtcagaagcgaactgccggagacgaaatcacgtcgaatgaacgggccaaaacggtcgttatgcagtactacattgtttccatttctacttttatagttttactatttttattttcgttttcatcagtaaccatttccatatagttcgattggtaaaaatcgaaaacaatcaaacgctatgtaaaagtaaatggcggtagtagaagatataggctgattgctagtcagaggcttgccgtacacggtggttcggtgcatggtctcgggtcgtcgtcaaagtcgtcgcaaaggttagtaaaattgggccgtgttattcaaaattttttctacaaaaattttcaaccttttcgttacataaaatatttggacacgtgcatagagcattaaatatggacgaaaaaatcaattgcacaatttacatgtaaatcacgagacaaatctttttaagcctaattacgccatgatttaacaatgtgatgctacagtaaacatttactaataatggattaattaggcttaataaattcgtctcgcagtttacaggcaaaatctgtaatttattttgttattagtctatatttaatactttaaatgtgtggccatataacttaaaaaaaattgggcacactgatctacatgtctttgcggcaagtgagcaggaaaattgagctctgtcttcaccatttgcagtacgggtacaatcaagagcaggtcaccacgagccgcggcgcataagagcaggtcggtcagcatatggcaataatgcaataaggcatcctcaatatttaaggtcactatggctataagatggaatccacatcatttgtatgttcatttgtatatagtatatgctacaatgtgtatagctttttcttaatcttaaactgggacccattcattaaaaaattatattcaacatgaatgaaagagcacatgcatggtgcaaaaggtatgaactaattttttatttcttatggtctagccttaagcttaaggttggccatagccatttttttcactttctcctctcccaatgcataaaggtggaacaaaaatactactttattctttaaggttgttttgcatgtaatattgtggatgccctaatgctctagcgcttcgtctgaaaactttaaaaaaccagcaataacttcagaacttgtatttttcttatatactagtgaacttgtaaatagaccaatcacaacaggagtctttgtaaatggattgtaagcagatcatgtgctatctccgtcctaaaatataataatctagtactccatccgttctataatataagggtccgttctataatataagggattttggagggatgtgatcctgtccaaattcgtagtaatatgataagttacgttcctctaaaatctattatattatgggatggagggagtaatgaatatgacacatccttacaacactatggaacgaagggagtaaataatatggaaaattttggttttttttggtaaaattcattacagcccctgtatgatggctaagagtgttgcatgatcagttgatcgccttcagctaaatgtctctgagataaattacagcacaaaacgaccccctcaagttaattggaggtacactctgccgtgccatactgctacgcatgtgacaacaacaacaaatgagtcaagaacgccgccgtgtcgcgtgacctcaccgatcaaccgaacgaaggagacatgcacgcagtttccagctccttcgccatgctctcgaaggcgacgcgcgagctgccaccttcctccaccgccgccgcggcggccgcggcgagcgcggcggccttggccctcacgtcgccgcacttcgccccgtccacggcgtccgcgagcgcgcgcgccagcgtcgccgcgtcgggcacggcggccgcgccctccgcgacgcgcaccgcggcgccgcgcaggtcgaccacgagccgcgcgtcgatgaactggtcggccttcatcggccaggcgaggagcggcaccccggcggcgacgccctcgagcgtcgagttccagccgcagtgcgtcaggaacgcgcccacggcggcgtgccggaggatctccacctgcggcgcccagccgcgcacgacgcggccacgcgcggccgtcctctcctccagcccctccggcagcacggcggcgtcggcgcccaccgcccagacgaaccgcgcgccgctcgcctccagcgcggcgcccagcgccgccgcctgggccggcggcggcttgtacatgctcccgaagcagacatacaccaccgaacgcgcgggacacgtatcgagccaggagaacagctgctctgcttccggcaatctctcctctccccggcagccggagtcggcgaccgggccgaccgcccacacgcggccatggccgaagaaccgtttgagccactccaagaactcgcgctccatctcgtcgaacgaattcaccacggcgccccaagctctggcgttgaggcggaagccttcaagcgcgacctcccaatccggatcgcccgcgacgtagctcctcaccaccgacggcacgtgctcgtacgggaaagccggcgacccggggagcgtgtcgaggacgaccgaaatcttggggtccagcggcagcgcgccattccagagctgctcgagcgcggcgacggcgaacgcgccgctggcgtagaacacgacccgcgggacgccgaggtcgtcggcgaggagctgcgcccaccccaggaagaagtcggagacgacgacggtggggggatcgtccgggcgagaccgcgcccaggagaggagcggcgcgcggatgccggagagatggacggcgaggagcgcgtggttggagttctccgggagggaggcgtcggggagatggaacgggagggcggcggcgaggggggtggatgcgaggaaggcggagaggagggggaggtcggaggccgtgacggcgacggtgagggcgacgccgtggcgggtggagaggcggtgggcgaagtcgaggagcggcaggaggtggccccgcgacggcaaggggaggacgaggacgtgcggccgccgccgccgccgggagggcacgccgttggtggtggtggcggccatgactgagaaaaaggcgggaagagggagacagggatgcgtgtgtgggccgtggagacaggagaagtgggaactcgtaggctgtagccggctttgagtgagtgggtgtcttgctgtcaagcggcgtctttttcttggttgacagtggactccggtcaagtcttttactactacttattcgcaggtcaattttgagcttttgatttttctgcacggaataaaagggactggaaggagtatatactccctccgtcccaaaataaataaacttatagagtttaaatttatgtcaaaaataaaccaacttatatttttttaccaaccatcaatccacaaaacgataaattttattacttcaatacccctcacctacacatcattcaatacaatattcacattaattaagggcattatggtcttttgtttctctccttaaaaactccttgggacgttaaggtttgagtttattttagggagagaggtaggctatcaaaaaatctcgaggctcgcgagctgctcgagcttcagatgagccgagcccgagcctcccccaaagctcgcgagctttatcgagccgagctcgagtttctatcaagctatgaatttttgttgttatttcataaattaggagatcaagtatgtgttaacgaccaaatttggtaatatcagcatcggaaaaggagattagatcaaggtggagtcgaaggtggagattaatccgagaacagagcaagaatcggctgaagtccagatcggctacgattaggatcggctgggtctgagtcggactaggtgagccgatgcaaccgattctgacagtataatttggtgtatgacattgggttgaattgaggtgcttcaagatgattgccgcacatggatagagtcctgagatggcaattgtatctattaattaggatgtttttatgtaacttccttagagatatgtttgggcaaaagtctgccgcaaagacttatggtatcttagagtttgttagagatagtggtcgtgtccggtatggacatatcttgtaattctcgggtataaatagaccccgagccatatgtaatttttaacacacacgttcaatacaatctcggcgcatctccaactttttgctttagttttgtttcgacgagttcttgctttcggtttgagctgcatcggtttcgatcttcaacaagaggtaaaacttgttatgacggcttgtgttctcgggattagtgcttccatctttatgacactctaatcttgtctacataattcgtcaagttatcatatatcttatataatctttggcaatatcgtcatctaacctacaatcggctaacatccgttaatagaaggcagccgattaggttaaatagcgacgttgtcttagattatataagatatctaccactttatgaaacacctagcggcttgattgtctagatattgttcttcttttcatacttaatgctacatcagttgagtttgatctattaagtcgtgcttagaatatcaatctctagcctgtactctggttgccgattagggtagtatcggagtttcagccgatcttatctgatttaactatattcgatctatatgcttcaaagacatgttaaatccgccctttatgtcaagatcttattgcatttaagtatattaagcttttgtttggtatattatatttgttttgatatctttatataaagtagtatcggagtattagctgatacatgctagatctatctgatcggctatgctataaacatatataatcatgttattaatatatatttcgatctaagtgatttatactgtctcggcatggtgaccgatctatcccaatcacttgatttaagtatatattaatataagaactatatatcgttaatatctacagccgatcgcatagatttagttccttactatctatttataaccgtcgatcgattcatatatgacatcggctcaaagataaatgatatctcatcggcacctagtcgatcggctatcatttatagatttgaccacgaattctttgtctctatttcttgttgattataggatcaaatcaactggcacactcatacattcgaaggcgagctttggacctgtactgaagttaagcagatttcccaggcctcgtgttttctatcaacacgcttttggcacgcctggttgaagcatctagacccccggtgttaattttggtaattaatgacaagcgctaattgtggactaaccgttgtctttgagctatacattttaagttaggtccacatcatatgtgcgcatggatgattatcgatggattaaaa

SEQ ID NO: 42096 - DNA, 1752 bp, Oryza sativa
  unsure (1)..(1752): unsure at all n locations
gaccaggggcggtcagaccgaccacatagtggcggtctgaccggcgtaccctggccggtctgaccggccgcaagaaggcggtctgaccggagcataaggccggtctgaccggcggcatttgcgcggtcagaccggccccctggaggccgggatggtgctgctcgggatggccgatacagagccgacggagccgtattcggtcagaccgagccgaggccggtctgaccggccaccccatgccggtctaaccggcgaggccggtggggccctctgatagggctacaacggctagttttctagccgttgcagagtagcacggtctgaccggccacatacctccggttagaccggcagagcacagagttgggggatttcgcccccaacggctagttttggtggtgggagtataaatactcccccaccagcagcaagggggctctcttggcacccaattcaattgcatacaccccttgcacctctctcacactcacttgagctttgtgttcatccatctagtgtgttagagggttgtttagccaagagtcaagtgcatttgcttccattgtagagctagtgtggcacttgatcgtctccacaccgggtcattgcttgttactcttggaggttgccgcctcctagacggcctgtggaggagttgcccagtgacctccccgagaagattgtggaggaggcccggcgccggtttgtgagtggtttggagttcaccaccttcggagtgaaggaagaactaccacgagtgatcgaggcttgggtagtcctctccgtgggtcggctcccgccttgcccaccccttgacgaagggggcgtgcggtggcttcgtggttgagcggtggagttgggctcgcctcaacggggagtaggaaaccggcgagtttccgaacctcggtgaaaaatctcttgtctcattgtctcatttgattgtcgcatttacatttgtgcaatttacatttctagagacacacttgagatcatatcaccctaggattgcaaaacattgacataggagcgtgatttactttcctagagatataattgagccactatcaccctaggtttgcaaaacataacttagttgcttagttagagttcacccttaccaagcctagcaacttaggttagatttgattaggtgttatttagttttaaatcgcctattcaccccccctctagtcgacatctcgatcctacactggtgggactgattagaagtcaacaagcaattcttcctcatggccgagaagccaccgttgtcgccatcctcggctagcccaagcactgttaaataaaagattcaaaagttggggttgactgacgtcaatgaaggaaacgtcgtgcccatcgatccggagaaattcacacctgagcagaagaaggattttgaagcaatgttgcagcaagcccgggatcagttcttgaactcattcatgcagacccgcaagggaacattggttcagaagtatatattattttacttaaaaattaagctcggtagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 42097 - DNA, 11331 bp, Oryza sativa
  unsure (1)..(11331): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttgaagaaataccagtaggcttctggatgcaagaggtccagccgaatagctgctgctgttcccagattctcgatcttatctgacctgctggtgatgattattttgctcccacgggcccagcaactcatcgaagattttaagctttgccatgtttgttcactgatatcgcaagctagctcaataattatcagcaaccttttgcatgaagaatagttttggtgcttcactacaccattctctctcagatttgccactcttgcatccttcaggttatttcctctaaggaacaaaatcaaagagtagtgattgcgcaccctataatcacgacaagcatgctcgactagagtgcttttcccacattttcttggaccaattattggaagcacaggaaaatcttcatcaccaagaccatctgtttgcagcaagaaactgagcacctgctcatgttccatttgacggccaaacatgcaattttccaaaactgaatatgtgtcacgaggctggtggtgcactactcgataattcctcaaaaatacaacaagattcatcatgtcagaaatgcctttttctatggtagcaatcattccttgtagctgttttatgctgttactaccaaaacacagtgttcttctatgactggagaaacgaagacgcttggctggattgaacttagaaaatgaatagacatgactcacctcctcatcctttctgtcctcttgaagggctggatatttatacctatcaagcaagtagtggcctctgtacatcccctctattaacatctgcaactgatggagcatcccttcattggcaatacactttccctctgcctcctcaatgatggtctgggctcttagtagcagtcggtttagtgtctccagagccacctcagcatctggcagttgctgatatttcttgatggcaaaggttgtgagtctataggcaatatcacttacggctgcaggaaccagcatattcatggtgattggtgaacctccccaaaagatggtgcagtgaaacaaaaatataagggagagatcaagcagagcagtggtgctctatgatgctaatgtgctgtttttctacagtacttcacgcatcgcactttcctcagtaactttcttatcacatcactctcatggccgtccaaaatacatttaactcgcttacaagggagcactgtggataaactaacaagtatttctttaaagagaacttctcggctgagaaattaacaacttctcatcgaggaatgatcctgattttcctgcattgagatttgactcgagggtccatatctgtttagtaaatgaggcgcaagataaacttgttttctaaatagagaatacatttcctacaagatttctctttaaagttaatttaaatataatctcctacaacaaatatggattgatatgcagatagatgccatgtcagtatgtcacatcattccatggtcaactataatactatacccaataattgagcattttttgtttctagcgttttaaccgcaagaatcaaaacgtgctatgatgtgaacatccccaatcgccatccaggttaaatccaatacaatccaatcaaataacgccgtaggagagcaaatcgatgaaagagacaaacttacgggccctatacgctcgttgatcgtctctgccagtaattgattagttaccagtcacatcggcgccgccatcaggtggggtgacgccgcatatgggagacaggtgaaggaagcttccgggcacggggaaggagaggaggcggggattccacctgcggcggcgccggcgtacgcgaccaccgcgcggccgcgggtacccgcgcgcccgcgcccggcgacgccggacgctgtcaccggtcgcgagcatttgcggtgcggaagggagcggaggccggaggggaggtgagagtctgagagacgagagaatgagcggtcgtaacagaggggatgacgagagagagggatggaccttcttgggccggagaacttgttaggtgagctcttttcgctagttgggccgggattcctctcttgaaggaataagttcaccagacatccctcaattttacgtccagtttgtatgacatccttaatcctcaatactagaaatcttcacccttatactatacaaaaccgtacaatttagttcccataacagtatggttctctggtttcactgatgtggcatcctagtcagcaaactaaaaaataaaaaaattatgagcccacatgtaagtgagaaaaaaaagagtagttaactagttggaccggatcctagggcctggaatctcctgcccaatagctctcccttaaaatgatgtgctcatgggctgctttggtcgacggccgccgtcctcctcaccaccccacatggaaagaagagagatattggtgaaggcagagataggtgaagatgttctgacatgtaggacccatgttgactcaacgctgatgacttgggtcaaattgcgatgcgggacaaaatcgcctcgctgtactgccatgggacctatattgcaccggtttttgataattgagagacccgttgtatttggtattttggttgaaggatgaaaatcgatctcgttgtcgagttaaagggacctaaaatgaacttattccaatttttttatcccatcaactatttgaaaatttcaatttgttagggttgtgttcgacagtgatagctgagaactaatccctcgtgcacgcaaaacggatagacttattagcatatgattaattaagtattaggtatttttttaaaaaaaaaaggattaatttgattttttaaagcaaatttcctatagaaaacttaaaaaaacactgtttaacagtttgaaaagcatgtgcgtggaaaaaaaggaatatgagttgggaaagaagggggaagaacacaacctatattgataacccactccacatagggcactcccctaataataaggtaaatgctccgatactacttgaacaaaacaaaatatttctgccgtagttagcagtcaaaccaactctacctttgattcctcaatatttttttattaattactccataatcctttccatataaatattatttccttcgtgggtctgttcccctactccacgatacgccatcatgagctttagaaatattgttgattaattccatatttaccaaatcaaccctctatagtctatcctaccagaaaattggtgaatctttcacaataccaacaatttggtagggtagagaaccaaacttgctcgataatgcgcatcatatttatcaattcctttttcaaagaaattaattaggagcatggaaaaaatcagcatgcatttggcaaaccttgtccatatggaactaaactctcaaggattttagttagtcctccacaacttagtaaaattttgagagcctcctctgataggttgagctagagataataagctgtagaaaattgaacaaagcaactaaaatagtgtgtatgtaaaatttttaatatgtattattagcattttaaaaaccaatgccgaataatagtctatcatgaggaaaaacccctaagaatcaactataagttctaaaatttaaatttttgctgcatatgccaacaaacagacgacgagtatgcaggtcggtttgaacatttggaaggaaatggaagaaacaggcgaggtttgcaaaacgaggtaggtagggatgcacagcaacggccaaaacagaaggatgatcatgccgactgtcaccaagagcctacaacaatcgagcatcaagatggggatagcctttaagttcgtcggtgaagctctagaccccttgggaaaatattctttaaaaatgcaagttgcgacgctattagagtatgttgagagaaaggatccatcgaacaaaggttccatttgacttagtatatattcagccattcaggccttcagggttgcaagcaaagcagtgacgaaagcagcactgctttcagttgtgtatggattcaagcgaagcactgacgaaagcagcggcgtcttcagtgcgacggggtcgagacgggatcactcaaaaatcggctaagatggataataaactatggtggaaactggaaagcatcagtcgttttcgagaaatctatcatgtatatgagcaattctacggtatttaaggaggtaccatgaggtaccaaaattttagtgtaaattttgatacctcatggtacctcacagtatctagttatcacgagataccaaatttataatagaaaaaatggtactttatggtacaccctcaagaaccgtaaaattgctcaatgtatatagtcttcgagacagcagcgacgaacagcagcacgcctaaacggaagcgattaatttcaattgccctgaaaaaaataaattagtacagctagtgcatgcaaagacatctgtcactgtttagttgcgaaagaggcatatctagtaatggcagtgtcaaccccaacaatgatttgcattattgctgtttttagaataataaaatgttattctcaacacatataaatcacgtcagcagttcagcactgtcccataaggtaaaactctcaaactggccgagaggcaaagtctgacgatcgcttgaacaactctagctaggcagcagaagatgcccaatgttgtcaatatgccatccagcaactgctccggccgtcacagagaagcaaaagctgtgtttccttctcctaggagagagccaagcggacaagcctggaggttggctgctaatgctatggagcgtccagttgccaatatttctgctaggcactgtaagcggccataggccggttggtgtgaaaacgcaaagatccccttcagggtcgcccacaggaaaaacataaaaaccatgtgctcaaaaactacacagccatgagcagatgcgctactcattcgaggaaagtaaattcagtgcaacaaaaggattcatttcgttaattcattcctgaaaaatttgttgctgtgctgaattagtaattggacagcagacagcacgcttgaggcttgacaatctttactcatggccgccgaattgccaatgtacgttttccctgaaaaaagtgaccactgaccatgctaacatgcagctgtagatcctttcttgaggttctggacaggacagatccaaagatgtttcactgaagaacatggaagagatcgactagcaagtctcagaaatgttcactgaagaatatgacgagtcccgtgagttcagaattcggaaatgtgttcaccgaagaaaaacgaaagttcagaattcagaaaagctgactattttattttttgaacgactcgcccgagacgatacggagttctattcatagagcgaagctgactattttatcacctcctacgttgttattatgactagataagcaaacataggaagtactaatgccataggagctttcaaatggggctattttaaggtagtggatagtattacattccacgagaccttcgcaaaattacaaagtgaacatccagtacaagtgtccggagacgagcacgacaatgtgcagtacggttcaccttcagctcgccggagcaaagcttacagccattacaagcaaaaaagaaacacattgtgctattacttgtagtgttattaagtaataacaccactagtaccagttcaagcacagctcgaaacaaggagaaaatttagtagcgcatacaccatgtcctgctcagatgctgtagtccgaccattgctggatgaaggaggtgtggtccatggattcacccggcatgtcgtcgcccttcttcccgccgagcagcctcgccggattccccaccgccgtggtcctcggcggcacgtcgatgagcaccagcgacccggccccgatcttggccccggcgccgatcctgacnnnnnnnnnnnnnnnnnnnnnnnnnnnnnngaggacgccgtcgccgatcttggggtgccggtcgcccacggccttgcctgtcccgcccagcgtgacgtggtggaggatggagacgttgtcgccgatgacggcggtctctccgatgacgacgcccgtggcgtggtcgaggaggacgcccttgccgatcgcggcggcggggtggatgtcgacggcgaacacctcggcgacgcgggactggagcgcgagcgcgagggcgcggcggtcctgcgcccagagcacgtgcgcgacgcgctgggcctggatggcgaggaagcccttgtagttgaggaggcagtgggagaagccgacgcaggcggggtccctggagcgcgcggcgaggaggtcggcgacgacggcggcgcggagggtggggtgcgcggcgagggaggcgacgaagaggtcgtagaggagcgtggagagcagcgtggaggagcagagcttgttggcgaggtggaaggcgagcgagcggtcgagggaggggtgggagagcacggtggcgtagaggaacgacgcgagcgccggctcggcgtcggcgtcgcggcgcgcctcggccttgatctgggaccagacccacgactcgtcggcgtccgactccgggggcgggtacgccggcacgacggccgggtggagcgccggcgggctgtgccggcgtggctggggatcgtcccggagaggctggcccgcagtcatcgtcgccgtcgccgtcgccgtcgtgtcgaggtgtgtggatatgtggcggtcggcggcgaggaaggcgtgtggcccgtgccgaggcgagagcgaataaataggcgtgtgccgagtggggacacgtcagccaaccaatcgaaaacaggtaaactttatctctgcgtgggcccggagttaagctggtacacacgatgagcacgagcccgagttggcgcgccgtggacgcgtgggcaagcgccaaggcggatcgagcggcgacgggcctggcccacgtttcgtggcctagctcggccctgcacaaacaccggatcgagcgaactggatccacgcggataaccgcgggtggcggcaggcggtgtcgagtttgtgcacgtccacgtcgtgatccacctgaccacctctagccagaaggcgccggttgatcgagccggagatacctgcgctgacgcgagtacgcgacgctaagctggtcgtacttggttggttgaatacgatctgatcgcaatattgttgccatcgatggacgaaaatcacacgattacacgagcaattatttggttgtgaaaccgtgaaagcatccaaatgttccatataaccgttggattaacgtgcacgggacggcccgacggggagagtgcatcgataagagtcatagtatagccaactactcattccaaattatctataaccaatctaacagcatatttatacaatagttatatactacactattaatatatggtccaacctgtcatacacacattgtgtcttgaagtctgtgctacagctgactataaatctataacccgctgctattctctcttctcatttatcttcttaaaatatatttacagcctgctattgtaatccctccgttttttaatagatgacgccgttaactttttctcacatgtttggccattcgtcttattaaaaactttacgtaattataatttattttattatgagttgttttatcactcatagtactttaattgtgatttatatcttatacatttgcataaaatttttaaataagacgaatggttaaacatgtgagaaaaagtcaacggctattaaaaaacggagctaatatttgctctaactgggtatggatgataggtcacgccgtcacgtgccaaagtcagagtgggccggtcccgatactgttgtcttgcgccgctgagtttctgaccccgccgcggcctccgccgtttcgtacgccttctcctctcccgcgcgcacccgcctccgcctccgccttccccggccgccgccgccgccgcaggagaggagacgcaggccgcggcggcgtcaaccgccgctctccctttgccaccatctccgctcccgacacacactccactccactccagtccacagcactaacccatcggtcccggcgatccccactagtgcccctcctcgcccgcttgccatggcggcttgcggcgccgcggcggcggagtattcagctctcctgtccctctcatgtgggcctatcactcgccgccgtttcgccgtctcctgccgcgctcgaccgcccggcaacctcaggtgagtgcctgaccaatctgctgcttcctgcttgctgggagtagctgggggacacgcgatgtgttcgagaaagtgtccatgagcgaacgcatttgggattgcgcggtcgttgcgtgcaaacgaggccgtttgtgccaaacgttctctcactgttccacccgctcgtgcaaaatggatgtcgccgagcatcgatcgtggcatgttgtcgtgtctcaacccattagtcgagtaggaatatctgttaatactctgtccagtggtgaacgaatctaagctgacttagaggctgctctgcacggttaatctgcagtgctcgagctaatgaaatttcacattaatcttctgaaaaagcagtgtgtttcagtgtgctaagtcattttgcaaaacatggtaaagtcgctctattccatattggtctagaaatccctgggtttgcgcattctagttggtagagttcacatgaaggtttttgcgcttgactcatgactgacagcttctgtgtggtagtgcacagcagaagaagaagcgagggaaaaacattgctccaaaacagcgctcttcaaatgcaaaactcttgcttactactgaggaaaatggacagcttccaagtaccagtttgaggacttctatggaacgtcctcagaagagtacatccagtgaggacgataccaatggggctattagccagatagatgaaaaaattgcagccattggtaatgaacagcaagaggtactgccttactggggtggtcatatacttatatcagcctatcagggtatcctggtgcacttccacacctccttcaaacaagctagctaatttaaagagatatgcttctacattcatagatcaaggattattgaacttttgtttatgtgacttctgtgcagtatgtcagaaaaaaacattaaaaagaaaaggcacagtcatattgcagaaccatgataacataggattaaaacatttaaattgctattcatttcctttggactgattatgcattgtcgcttcctaggagggcaaccttgttataaatgtttttccctatttggaatagagttcatccttatgtagtattatgcagaaattcgtctgataaaggattgtaatgtttattttcactcctcagtttgccatgttcatccttatttagtaccaataccaatatgctaaattgcctctcaatatcttagcagttatcaccaggccatccacaataaccttagagctcgcatcgtctccaccagaactagaatgatactgctttgagcgagacactgctacctagttgtactatgcaagcgtgtagtctttcttatgtccttcagaaattgtttcatttttcataagaatttctcctcttatatattaacacagaggtcaaaggataaacatttcgaatcagactttcaacttgaagattttggggaaatgatacaaaacatggaaaagagtatggaatgctttcttctcaagtgtattcatacattcatgcatgatatctgatgaaaatacatgaaaaataatttttaaaaatctgacatggctagatattctgctcctaaatcaagctcgtcttcaagcaattgaagatgttgacaaaattcttactgaaaaggaagctttgcagaaaaaggttgacactctagagatgaatttgtcaaaagcacttgcaaccaaagggaacataaatacagatatccctggtgatcatttagagaaatttacaaaagaaattttgatagaaagtgctctaagtggaggcaatccagcacatttgtgtgagtctccacttttcatggagctgactgttctaaaagaagagaatatgctacttaaggctgacgcacaatttcttaaagcaaagattgttgagtttgctgaaacagaggaattcctattcaaattggagaaagaaaggtcactgttagacgctacagttagggagctggaagctaggtttctagttgctcaaactgatatctggaaagttgtccctctgcaatatgatgtttggatggagaaagtagaaaatctgcaacacatgcttggatgtttgaaaaatcatgtagagaagtatgctgcattgttggatcagcatgatgatctgcatgacaagattgatgagctagaagcatcactaaaagaagggaaaacatctgagttttctccttatgttgttgaacttctgcaacagaagttgaaagcagcaaaaagccatcaccaagcaggccatcaagaaacaaacactcacattcaagtatatcagcagttaactgaggaatttcaagataacctaggtaaactaatagaagaaagtggcagactggagcattctgcaaatagtatgccatcagaattctggagtcacatcctgctcatgattgatggttggttccttgagcggaaaataccaaatactgatgcacgtatgctgagagaaatggcatggaagagagatgaccgtatctgtgaagcctactttgcttgcaagggtgcaaaagaaagtgatgttatggaaactttcctaaagctatcgttatcaggaaacaggtattaaatttatcttgtgaatcactttatttttgatgggttcaaatatgaattagaaaacttatctgcaattttttcataagatctatactactttagtggtggtgtccaaatctgcctccaacgtcacgagcaaacgtgtggggccataaggtctcagcacatgaatgcttttgctttgatgttatatgcctaattaaataactatgttataaacttgtaatttttgcttgtgcttttatctcttgtaatatccattacaacacacggacctttagctagtatt

SEQ ID NO: 42098 - DNA, 6821 bp, Oryza sativa
attgcagccttgcctgatataatccacacaagcttagctctatcttgttcacatctgcagttatttttgcctagtagttgtcaacaataatgccaacagccaagtactggcattccattttgagttgaaaagattgtatcgagactttgcaaccaacaagaacatgcaaaataatggagaaatgcactgaaaattgtatttagcactaagttcatgcatctcaaaattcaattggaattatgtagaaatttcttggttgaacttcacattggctgaaaattgacttagaatgataacattatttggcttacctttacttattaaatgcatacaatttattcaaaaccagttataccaacaactgattagtcagaaaagtaatggaagtcacccaccacaaaccatgccgtgttttgcactagaaattccatccgatatttgctagtaggtgccacattgcctgcttagtcagaaaatcaacatgcctgcttgcttgctagtaggtgccacaatgctgggcacattaaagttggtgatgatcaacatggccctgatcaagcacatgagtagggaaatgagtgatttgattcttaatagttttctcctatgtaaagcgttaaatatttgtacatgaggttgaattcatcttcacatcaaaaaccaagtacttagtcatataatacaggaataatgggtaggattagtgtgctgtattgtttgacaagaaatttcatagcattaatgaaagttccccatttgttaggaacttgcattgtataattgatggaaaatttacaagaacaccctaaaaatattttatgtattggttatactcctgaatttttagtgtagattcgtgtcaggtaagttcatctctacatgaggtcttccccttctgaatgaattttcctatttgctactagcgttctagaaggtgctaggtttgttgcctgccttctagaacaggggccactaccagcagttttcttctatattaagaaatagaccataaagtcataaacattatatctgtgtatgcaactgctcatagccttaaatcctagttatgagaaagattaattggctgtggaaagtagtctgctggcaatttcatgtttcaaaatcaaatagattatctcaaccagaccacattctgactggaagttgaaatgagataactgttacatgggcagttatattgagaaatatttgcagaaattcttatgtaattgtttatacttatctttccatgctgcttggatttgaagtattgcttatactaatcagcattttaattgtgtaatctcatttaagtttgcttaacaaaatggttcttcaggttggcggtctggcagatgtagttgctggtcttggcaaggcacttcagactaagggacatttagtagagattgttcttcccaaatacgactgtatgcaacttgaccagattactaatcttaaggtttgtgcttgttggttagccatgatttttttttacatggttttgcatctttaatctgagcctctgaggtaagattgtattcttggtgatcctgcaggttttagatgttgtcatacaatcctattttgatggaaatctattcagcaacaacgtgtggacaggaactgttgaaggttctaagcaactctattggaccttataagaactcaaaaaaagttaataattgtttgctaactgcaattccaatatacaggtcttccagtctattttattgagccacagcatccttcaaaattcttctggagggcccaatactatggagagcatgacgattttaaacgttattcatactttagccgtgcagcactggaattactttaccaatctgggaagaaaattgatataatccactgccatgactggcaaactgcatttgttgtaagaactgaaattcatttcgcttgctttttcatcaatagctgaaaacatataaattttgctgttattcatttgctaagttctgggtgtcaactattctctaccgtgttcaagaatattgtatcttacacttagatttcaggcacctctatattgggatatatatgcaactcgaggcttcagctcagctagaatttgtttcacttgccacaacttcgaataccaaggtacagcacctgctcctgatttatcatattgcggccttgatgttgagcagttggatagaccagacaggatgcaagacaatgcacatggaagaataaatgttgccaaggtatagaatagagaaatagcagttgttttgaattctgtaccttaaaagtcatgatttttatatttttgcttcttattggtttcagggtggaattgtttattccaatattgtgacaactgtatcaccaacatatgctttagaagtgcgctcagaggtaacaccagcaactctgttttctaaacaactattacaaattcaatatcagcttcacacactttagatgttttctttcaactgtagatacatgatcaacctctcaaatagtacatatttttttttgtaacattagtatttatacttagagtaattgactacacaaaggtcgatgtatttatctgatagaccaaatcttttttcgaggcaacatttatgtaagctgttaatgtacaagtaatgtgaaaaattaatatgtttatttgacaggcacttcttcatctaaaacaagtggcatttcttagtccatgtaggattaactgtctgcatttgctgtccttgcttttcttttggcctttgccccagagtaaaaattgctagctcaaaacatatggcataagtaaacaaggtttgaagagacttcagtgaaggccttttatgtctgacattgttatgcaattttttttaattgttttaagaattttcaaggcattttacttgatatgttactaatgaattaggggtctgatataagttgcccatcatgaccttttttattggtcagggtggtcgtggtctccaagatacacttaaaatgcattccaggaaatttgtggggatacttaatggaatcgacacaggaacatggaacccttccacagacagatttcttgctgtgcaatatagtgctactgatcttcaggggaaagcagcaaacaaagcatttctcaggaagcagctagggctgtattctgaggatgcctctcaaccactggtatgaatttcagttctacgcccatcttaactaattatatggctatctattcatctattgtagcctttttaatgtaatcaagtcatttcattgttttttcttgaaaacgccagagaattgcatttcatttcatttaggggaagagaataaaggaaaaatacaaagtaggagagaccaaagcctcctacacacccaagccccggccaactagctgcctaggtttgccgaaccactaagaaacttttggagggcagacgctccactatacaccaaagattaccctcattctctaccacctgcaagaccgttgcaacattaggactggcgccattgaaaacacagtcattgcgatgcttccaagtctcccaagccactaagataaccaaggaattgagcccttttcgcacgtcctttggccagtattttgtatattggctccaccacagcagctttttataacaagccccttgatttgtttaaccactttttataacaagaaagtacttctgttaggggagaataccatttaaaaatcacatatctgaactctgttttctccagttcaagaaaaccccttttgagttttgaactttatatcattttcattttttgttggtattattcgtttagattagctgtctccttttgttttgtttcttggagtacagtctctattgaaatgaattagtctcgtagtttatgttcagctttgatcctcattttgtgccttttaatgaccatggttttctgaggcaggtagcctgcattacgaggctagttcctcaaaagggtctacatcttatcaggcatgcaatatacaaaacagctgagttaggaggacagtttgtactcctgggttcaagtccagttccacatattcaggtctgtatactcatcgagtgcctcattttattttctcaactgcagctcacatttggccctatgagttcttgatttgccatggatatgtctggttccatagttttatgtatataatttattttcttctacatcttggctgatcttgttactgtgaactgatcgttgtgcatttgtatcacagagggaatttgagggtgttgcagaccaattccagaagaataacaatattaggttaattctgaaatatgatgaagctttgtctcattgtatttatgcggcatctgacatgtttatcattccatcaatgtttgagccttgtggccttactcaggtgatctatccgtacatattaaattatagatcttccatttaccaaccaaataggcctacaattgctaaatgtgcgccagtgtgcccacatagcttgcttgggttcaaattggcatttgtgagctattatcacaaggcatggatttagactaggttttactttgatctaaatatcccatacaagtcttacatggttgtgtcatccaaataattttcttttatgaaattagccacattttactaaccattttacatggttgttgacattttattctttttcatgcccaagtctgacaagtttttatcaaccagatgatagctatgagatatggttctgtgccaattgttcgacaaactggtggattgtgtgataggtgatttctccctcaaacatttcctttgcatagtatattctgatatatctgttgtgttctacttttccagtgtttttgattttgatgatgaaactatacctgtggagctgcggaatggctttacatttgctaggactgatgagcaggtgagttttacaatggaatgcactttcaaatttggatttctaatgttttatgggtagagctcacgtgggatgcctattttggtaggatctaagcagttgcttggaaagggcattcagctactacagcagaaaacctatggtttggaaacagttagtgcagaaggatatgcagattgatttcagctgggattctccagcttcacagtacgaaaacctttatcagagtgctgttgctcaggcaaggggagcggctcaaacataaaccttttcatgatgacattgtgagcttagattctcccaagcgcagagacaatcgtcagttttatcatatctgaaccaggcatatgctgaagaaatattgttcttctcacattcacagaattcacacatcgtgatccttgctgttgccattcccgaaagaactgagaaagagtagtcttacagttgatcaagatattgcattttgcagtcagtgcacggaactagttctgggtttaatggggatgagtaatcataatctatactggattgcccccctctaaattccccccaaccgttagtttttgtgggaatgcaagaagtaaatatgtgcactgtagggtgacattcgcatacatgatactgtacggtttattcagatcaacgtttgggtaatgtgactacttttgagtttgagagatttgcgtgctccgttctaaccttctagggtgtgtttagaaaatgggttaggagaggtgggattgggaaatggaaatgaataaagggataggatgaaatggggtgagaagaatgggtggctaagattgaagcttaccctttaaggggtgggaaatcatatcccaaacccattttccaaacacagccccaaggttataaattttttttttgagggaccaaggttataaattcgtcgtctgaaattgacattttgttttgcgtttttgcatgtgattatttgagtccgcgtacatttccatgtaccatggggtattccgttccataccgccaggcaaactgatttcccaggaacaaatcagataaaaattattttacacaatcaggtccattgtacttctttcatcaaccaaccagataacattgttttacacaatctgaacgaacgaagcaaatattcgggtacgcggaaagaggagaacgtcgcgcgtctcaccgcagcctgcatgaaagcaatggacctcaccgccgttgctcgccggagatccacactcacttgccggggacgaagttggtggcgtaggcccatgcgttgttgttgacggggtcggcgaggtggtcggccaggttctccagtggccccttgccggtgacgatggcctggacgaagaacccgaacatggagaacatggcgaggcggccgttcttgatctccttcaccttgagctcggcgaacgcctcggggtcgtcggcgaggccgagcgggtcgaagctgccgccggggtagagcgggtcgacgacctcgccgagcgggccgccggcgacgcggtacccctcgacggcgcccatgagcacgacctggcaaccccagatcgccaggatgctctgcgcgtggatcaggctggggttgccgaggtagtcgagccccccctcgctgaagatctgggaccccgccttgaaccacacggcctcgccgaacttcacgccgttgcgggcgaggagctccgggaagacgcagccgagcgcgcccagcatggcccaccggcagtggatcacctccagctcccggttcttggcgaacgtctccgggtcggccgacagcccggcggtgtcccagccgtagtcgccggggaactcgccggtgaggtaggacggcggctcgccggagagcgggccgaggtagagcacgcggtcggcgccgtaccacgggctccccgacgccgcggcgggcttgggcttggccgccgacttg

SEQ ID NO: 42099 - DNA, 29543 bp, Oryza sativa
gtctcgcaaaatagcctaggggttatggaatcggttttgtcggtaatctacgtttaataatcctaaatagcaagattccagagggttatttaatagcccggaggatccaaacaaggccttagctaggctaatgggctaatatcttgttcggacaaataacccagcttggcccatgggctataataatccataacatctctcttcgtttagctttggaattcctttaggctgcgtttggctaatgggttatgtctaatgggaaatagaaatgatatcttgttggaatgaggtggtagattatatgaagagaaattgtatcctatgtttggttagatggatggaaaaggaagtttctagactaatgaccaaaatacccctccttgcaataagtggcagaacatagacagatagaaaggggtcaaaatggcaaggggcaatatggtaatttcgcctagcactctatccacccctcaatccagcaggattgtgcatcccatttccaatgtatccaaacagcataaatctggaaaagggaaatgatatccatttcccatcctcctaatcccattagccatacgtagccttagcttttatcactcgtgtcagattatcacacgcagcttgaagaggctattaaatactctgtagctaatatagtactctcttcatcttatgagacttcttagtcaaacgttttcaagttaaatcgaatttatagagaaaatagagtaacacttttaacaaaaacaaacatagtatcaaaatctattcaatgttatatttaataaaactaatttgatattttacatgttgctaatttttctataaatttgattaaactttaaaaagtttgattaaaaaaaaagagagtcaaagtgtcttacaagatgaagtggaaggagcagtaactttgatatattgaaaagaaaataccatggttcaagcctattcattattgtcagtgttacggataagtcatatttcctatacttaggttcgtattgtgtggaagtaccatatacctaatgttatacgagagcggaaaggtatatccaaacaagttaataaagtgagcctgaaaggaaattatctttgccggaatagaaagtgttaagagtctaacctagagaagacaagcttcttcatgttctacttggagaagaaggcgcttactagtataaatacaagcctcccgtgaagggatggacatctaatcacgtctcacaagtcatagctagagcctcatatagagacaattcggaggaagtcgaagccctagtccaagtcatagctagagcctcatacagagacaattcggagaaagttgaagccctagtcattgataagatcttgctgagccgtaagattatattcaacgggtcagattagctagtctactccatccatataatccgtgtggtacttttctcagttcattacttataataagggttattacttagcttgagagctcaaatcagtataaatccttatctcttgtcttcttgatatgatcttgcatataccttgttctaacgtttttcatactctacaaatattattgacaactatcatgaaaaaaaaaaccatgcaaaatgtgcatgttaaaagagaagggaaatagctagaggagcactaaattccgcatagcaaagtttatttctgcaggtcttctttggcgatttgtcctgaataattgctgggaagtgcacctgaatgaatccctgatacaagcaagcaaagacatcgattcacgtgagagcaaataacatccataattaagctgtgtgttcggacgtccattttctcaacccatattgctcgttttccgcacgcacgattttcaaactgctaaacggtgagttttttgtaaaaagtttctatacgaaagttgcttaaaaaatcaaattaatctattttttaaaaaaattagctaatacttaattaatcacgcgctaatagatcgctctattttccgtgctactgttccaagttgggaacaacccatagggaacacagcctagtttagctaaacacaatgcaacatgtgtttgccataatgcaatcaatctttggactgaacgtctgaaccctttcgaaacagcgcacttttcttgagtgttctgtgctaatattccactccagaagcgcccaggttcttatcgatgccacaacgaaaatgcagcagaatttctggcttactacctctctgcactagagcattatcacaacaaatctgctactttgatagttgatgcctggtagtgacaagaagcacgaatcttaccacgtacagtgcgcgcatcaaccacatgaaaagcatctactcacggggatgtgtcggctgtcaactgaacacaaattgcaggggttggttccttccatctgctttctccacaagtgaacattcacatatggtgttccatactttgatccgcatctgatttatagccatgtgttgcgaatttgtgaatacctcgccatattcgcaagttggtgaacatatcaccaattgtattcgagaatatagttgattacaagccgtaacgtttattagtgactaaaaacaatttatagataaaaaatttatatatgtacgtattattagcgacttaaaggttaatgctaaaaataattcactataaagaccatcaaattcaactctaaaattaagtttaaattttagctacaacgagtaaacattggagctaatcaatgtgaagccttctagcctttgttatttttggcgtggttttgcaagtgtctgatctcataatttccaagtgatggataattttaaaattttcccgaatcttcatccatttatttatgtatttattttgttatggatctttttacgtgtcaacacatgagcttgggacttgggagcctggccaagtggtgctagatactaggaatagtgtacaatgtatacagaattataagaggtgagccacgcaagctgccactaactacgcgggttaaacggaatattccttgctagtaagatacaggagaacttgttctttttcttaacctgataatgtagaataaggtagcagcaactaggagccttcccaagtgactaggagtaggcttctctcacatgaccgatgtctcgatacacacatggcacatggaaatgaaacactgcttcttgaccaaaaatctgggattggacctctgtttatatttcagcctgctggattagaagggaaggaaaaaaaattggatggaaattgacagatagaccagccaaacgatccagaaaccaactccctcacgttgtaccagtggttcaaaatcaaaagaggcaggcagaaaggaccaacgaggcaacgatcgaatcgtgtccatggtctccacctcacgggagattctccgcatccaccgaatatccactaggcgacgcccccggcaaatgctcccaatttttttctcacatgcactttgtcacctgtcagaaacgtgacccctgttatcctgtaccataaactacagtatttgtacttagctcctggcatccaaaaattatcattttctctgcactatacccttatatacctcgtgcgtaagaatatctcaattccttttttttcccaataagtactccaattcagccgcgtataaactcagaaacacgtagagattgtttctcaccgcagcagattgtggcaacccaactgcggatcaaaaaccaattgttccacacatataccactcgcctgggaaaccggcagagccacccaaaagatagatgcgccgaaagcgaccgccaccaccggtccaccgcggcacacgcgacgcgagaagcagagaaggatattcccctcgcggctcccctccggatccttcccccacacaccgcaagtccgcaacgcgagccgcaagcgcgcaggcgcgcaaccgcgcaacggccgcacgaaaagcgaaaccgaaagacacaaccccgcatcccattcccgcgggcctctcggctgcttccggaaactcgtgttttctctcacaatccctactcccacccgcgcatcttcgtaatattcgctcggcatctcccccctcgccctcccgcgctcccggtatataagccgacccccccgcggcctcccattctcctcatcagatcaaagcaagcaaacaacaacaaaaaccacttctcgtgggtagaagagagagagagcgaggcgatttcgaccaagaagatggccgggatcgtggtggtgttcgacttcgacaagacgatcatcgacgtcgacagcgacaactgggtcgtggacgggctcggcgcgacggaggagttcgagcggctgctgcccaccatgccgtggaacaccctcatggacaccatgatgggcgagctccacgcgagcggcaagtcgctcgccgacgtcgcgggcgtgctcaggtcggcgccgctcgacccgcgcgtcgtcgccgccatcaaggcctgctacggcctgggctgcgacctccggatcctcagcgacgccaaccgcttcttcatcgacaccatcctcgaccaccacggcctcacgggttacttctccgagatcaacaccaacccgagcgccgtcgacgccgccaccggccgcctccgcatcgcgccgtaccacgacttccacgccggcccgcacgggtgcggcctcgggatctgcccgcccaacatgtgcaagggccaggtgctcgaccgcatccgcgcctccgccggcgccgccggcaagagggtcatctacctcggtgacggccgcggcgactactgcccgtcgctccgcctcggccgcgacgacttcatgatgccacgcaggggcttccccgtgtgggagctcatctgcgaggacccgtcgctgctccacgcggaggtgcactcgtgggccgacggcgccgagatggaggagacgctgctgcggctggtcggcagggtgctcctcgaggagaggaacctgccgccgctcgactgcaagctcgagtcgttgccggccgtcgccgtgcaggacggcatgcccatgacgctccggatcaagaactgatcaatggcggcgacgaacgtacgcatgatttcgagcgcgaaacggctagctcgaacaatgtgtgtgtgaggattgcgatacgggtataattttaactattgactgatttttgcgctacgcgtgattgagcctgcgattagtagaggctcattgtatcttgtccgatcaattgaagtaaaacatttggcttggctctctctctatgagatgtaatccatttctattatcttaaaagaaaaaaagtaaaacattcagaaaaaaagtaaaacattcctgacagtgaattgactagtctgaattttggtgataattaattgtctgtcgcctaaaatgttttacccatttcgtcaaaagaacgtgctcacccaaagtcggtttggttaatttgtgattattgtatactattagtagaatcttcgtctcatatacttatatgcaaggaaagagatggttccgataacagtggaataaagtagaagcctacgaagagctataaataaaaacatgcgcataatacaattctcggtcactcagcttttgtcttttgtgtggaaaaaaagcttgtggctcggatcaactcgaacttgcagtcttaaaaaagttaagcaagctaggctttcagtttgtgaatcaaacaagctagcttgcgagccgctagtttaacttgttagtacaatagatcaccatagtttttagtgcttatcaactaatgtttagtcacttaattacattcaaaataactgtatttaataaattatttattaggtagtagtatttattatttatttatgataaaatagtaaatttgaaattatgaaggtgaaataatatgttaaaaaagcttaataggtcagcttatgagccaagccgagatagatttttagctcgttgaggataaagagccgagccgagccgagataagatggcttgttaagatgacaagctcaaacgtaccgagcaggcttattatttgcaagctggataccgtactccaacccataagttcatctcatatttttagcttaatagactagatcagtttagctgcctgcggatgcccaaccgcacagttaccgtcctaacatgtaggtccaatatttccatattcttaccgaaattttgagatgttccacagctcgatattcgtatttcgaatgtttagcaaagatgtggcgcgagaaaattcatctagcaattcggaaagcgccacacgggcggcggaaccgccatctcctgcgctttcaccgagcgagaagatacgatgatatcttcgcgtatccggtactcgtgaacctgaaagtttggacactgattgaaagagatattccccggcaggttcgccaccggattcagcttctcaccaaattttaggcacatattctaggcatatgctgggcatcgtttctgctcccctctctgttgcgctcctcgtcgatccacgagaaaggtgcagtggacgccattgaactgcagccactggctcccacagctcgccgttcacacacgtgccaccctcccattactcgattccgaccctcgacgacggcgacctcccggtgagtgggccgcgacggccagcttcagcccacgtcgtcttcgtctttgcaacggcccatcaaacgatgggcctcgtcgagagataagcccacaatggaacgggctattgttgggtttgggcccatcacgcagcccggcctctctctcgcgtcgtgacgcacaccacccatcgcctctcctctcctacgcttcctctctctctccgacctcctcggatccgcctcgatctcctcctcctcctccacgcgcgggcggcgaggaaaccctaccgcgaacgacggcgatggcgctgctcccgcggacggcgcggctggcgctgctctcggcgccgcgggcgtactcggcggccgctacgggggcgggcgcagccccggcgaggtacgcgggggcgccgccgccggcgccccagtcgaaggcggccgagttcgtgatctccaaggtggacgacctcatgaactgggcgcggagggggtcgatctggccgatgacgttcgggctggcctgctgcgccgtcgagatgatgcacgccggcgcgtcccgctacgacttcgaccgcttcggcgtcatcttccgcccatccccgcgacagtccgactgcatgatcgtcgccgggacgctcaccaacaagatggcgcccgcgctccgcaagtcagtaccaccttcctcccctcggctgctcagatttcgcgttcctgtgttccgatctgggaatttggtgttgcccagcttttagatcttggaaattatcttgccagggtgaaaaagactcaatagctaatgtgatgtcattctgtagtgtagaaaagccataatccgaaaagccttaatccccacctttaatgtcatttggaaacttgccacaaattcgacacaagcaccaatgttctgaatgcccggacaggacaaatgggatagtgcggtgaataattgaaacctccttccagcatcaatagtgcattagtctaaatattttggcatgattcaaagtatgccaatgaagattgtggatcattcaacccaccataacttaggataacttagcatacgccctatatggccttgcagatatttgagaggataaatcgacttgataaatatatagggtcaattcaatggcttggtgttaaacactggctggatttgattttagaaccataaaccactgcctgtggatcccgatttgatggcttggtgttaaagtcttgctggatttgatttgaggacctatgcattcatggaggatcagacttggaatgcttatgcgttcaagcttcagtagtgctaaatgttaacttaattaaagcattgcgtttgacttccaggatatatgtgtaacataaattgatttgatgtttacgttgtcgattactcattagtgaaaaaacatatttgctggtgaattagatattgtgggtacatagcatggttgttaaggcattgttatggcatcgccatagtggtaaaggcggttgcaggatatatgttgttgcagatcccatgccactaccatcagatctagctcaagatcgcagttgttgcagcttgctggagcctttgaatctctctggtggcggcgacggacaatgaggtgagcagaggcattgagctctaatgggccaatggcgccatggcagtggtagcagcctgagatgttgagctcatgcaaaggtggtcggcagccagatggcggctagtgcctcctctgctgatggctggtggctggtggctggtggctggtggctggtggagtatgatgcctcttagggcatacgtagaacatgtgggtatgaagctaatgttagctttggtgggttggctgcttggcttattgggccttttatcaatttcccctttgctcttgctgatttttctacaatattctccactaatcacaccttagtcacctcatatgacatcacaattcacaacacctcatgccctatgatgctgaggcggtggtgtgcaactgtgttgcctcaaaacaccttatgccttaacaacacttgtacctaggttatttaagatttgcttgtctcgataccaattttttcaaaaaataatatagtgctccacggtagaaaaaaaaacaaatatatgccctgattatttgcataagcatggatttgcttctccaagaatctataactctagaaagcaaagaaaaatctaattctgatcagcaaggtgtagtttgtattgatgtgcttctctgaaatgtccagaaaccagcaaaaggagtggcgtgttgttctgagtgtttgaaatcaaataaaattattttgttgtatgaatgccatggcctttgtggaaatcagtgcttttcttgtgtatcctctggttatctgctattaattttagggtgctacttccttcttcttttttttcaaacatgctttttaagatttcgtgaagaacttctgttgtgccttttgctatttaggaatggttttgtcaaaagaccattcaacctttcttacctgctcacaattttataatgctaatggcattggtaacttcttccacagggtttatgatcagatgcctgagcctcggtgggttatttccatgggcagctgtgccaatggtggtggatactaccattactcctactctgttgtgcgtggatgcgaccgtattgttcctgtggacatttacgtccctggatgccctccaactgctgaagctttactgtatggtgtcctccagctccaaaagaagatcaacaggcgcaaggatttccttcactggtggacaaagtgaggcaatgcttgctactgatcttggttgttttatttctttcgaccctaattttcatccgaaataagaatggcgttgtgctcggatctgcaaacttattgttgtgcctggaaggatgtatacccaggtcgtgttgatgtcagttccacatcaatggacgagaccagtgttggaacgagtttttctttacattgtaactcaacatgttaacttcgtttatgcaaagattcgccttaagcgcgatttgtgcgctgtatctttacccttcactaaacattttattgtgtccattattggagcttcctggcgcgccgtgttccctgtgctgtcataatgttcatagtcccattgcatatttcaattcaacagaactagaaatggcagtaatacaactgtccaaaaagtcacctgatttagatattgtttaggccccttgcacatgcgtttatgtttagattttctgaagacaaagtggactgatcatcaccttttagagagagtgtggaaatttcatctgcggatgttttaacacggaaaaggtgatggcttactcgaacaacgacgtttgtgtcatttcagcaggcatcctactcaacttctgtgtcgtagaattatcacttctgctgaagacaaccctgagttgaagacccatgcatcgtcaggccagtcataaagcatttgcatcctatggagtaaccttgtgctcgagcttccaccgccgcagcctcgctcatcgatcggtggagaccggagagggatcggcagagaatgcacgtgacaccaagggactcttcaggtggtcaccgaagttcttcgtgttagaacttggaagtgggaatcgtgctatggcaggggtactgtaaaagagattattattgacaactctcaaaaagagatacatcccgttttgttatcgtaggcttaatggagttcccttggcaaagcgggccctaacctctcctccaagccaagagcgccgctacaagaacacacaccccctctgccatagccgccacattgccgcaaagacgcaaattaaaccgtcctcttctgccatctcgtacgtcgcctccttcctccaatcccggattcccggtgatcaaagcgaaagaaggtaataataaccagtgatagcttcgaatctctgtaccgccggtgtttttgttatttataatctctaattataattgcgatctaataatgatccggcttcgtgcatggtggtagtagcaggattgttcgagcgagatgaatccggcggccatggcggcgctggggtcgaagctggcgacgctggggtcggcggcgcgggaggcggcgagggtggcggcgaggcaggggtgcgcgtacaacaaggcggtggtggaggggagcaggcagctgcagtcgagggcgtgcgaggcgacgaggagcgcggccaagcacgggcgcgcgttccacgaggagctcatggagcggaacaagcgctacgtcatcgacccgcccaccatccagacgtgccaggagctctccaagcagctcttctacacccgcctcgccaggtcccctccctaatccctatagagtgatagatcgatcagcattgattttgattgattttggttagctcgatcgatcttttttttcttttgcgctccattgacgtacgttgattagcttctttgatgccaactgaacttttttttggtagatgaacatattaattaattaattggtgcgattacagattgtatagttacaaccgaaacctactactaaggatttataattgaaaagtagattggttttacggttcttgacactaaaaatttgataacaaatattagagtagttttaatcttaagtctgaagacatttgattaaactttaatattgagtggttttacagaaagatacaaaaggtttgtactgttttatgataccggccctatgctttttgaaggattgtgaaaagagaatctcaattcattattatgagaattattgtcgcgccaagaccaccaccatgtttttctccctccgtcctaacactgaagtatttgctcatgaagagcttattatttttagatgtggggttcttcagtcctttttttatatatatttttagttgtagattgccaatgcatctccaatcttcaggtgcaaacgttattaattagggtatgtttagttcacgctaaaattgaaagtttggttgaaattgaaacgatgtgacggaaaagttggaagtttatgtatgtagaaaaattttgatgtgatggaaaagttggaagtttgaaaaaaaaagtttggaactaaactcggcgttagagaggttggacatgccaaaagtatagtcgaatgtacaagctagcctagggagaagatggatgtcatattcgtcttttcacatctactaaatatttgactgctaatactccctccgtattttaatgtataatgccgttgactttttaacaaacgtttgacatttcgtcttattcaaaaaaattatgtaattataatttattttattatgatttgatttatcatcaaatgttatttaagcatggcataagtatttttatatttgcataaaaattttgaataagacgaatggtcaaacgttgattaaaaagtcaacggcgtcatacattaaaatacggagggagtaataaactttctgagggtcggagagagtaaatcatagatgttgaatgctattttcttaatttacatacgagtttgtattcatgccttacttgttgagaaggaactctgtattcgatcatgtttaggaaaggtagctgatggtttcaatctctctgcgcaatcttttctagttcggtatggggcttgtgcaaggacttcgtttatttcttctttgaaaacatcggttttatgtgagcttactttttttgtacaataataaacttctttagatgatggaagtgttacgctgtcggccgaagatgaactcaaccacaacaaaaaaaaagttgaacataatgtatttctttggaaaagttaaatatcaccacttactaaatttgtttgttggcttattagccgcaactaaaatttaaattttgaaacgtaatttaatcgatttttgaggtatttttcatcgtattttattttcactattgatttttaaatcgttaagaacacaaatataaaaaaaattctacttacaaattatttttgtttactttgtttatgttttttcatggtttatcagccatcgtacaccgatgagatactaacaagttgatgtttcgatcttgcagcatccctggccgttacgagtcgttctggaaagaggttgatggcgcaaagctcttgtggaaaaacaggaagaatctaaatctaaaggccgaggatattggcgttgcaacattgtttggtattgagttgatagcatggtttgctggtggtgaagtcgttggtagaggatttactttcacaggctaccatgtctaacctcttacttctagcaagaacgaccacacactagtcatacatcatcagtaagatattgtgttaatttgctacttagtagaatatgtctagtctgatcttagattcctataattcaaggagatagtagtagtttttctcttcggcacgatacaagttttgttattcttgttatgccaccaaacagcatacatgtgaaacagccatgacaaactaattggtttatttattatatctatataacatatggtttatttattatactctgtttggagtttagacatgttagtgtcctggtgtgtgtgatcacttgcaattgatttgcacattaatactgctaatttaattcatgaaactgctgctggccagaatccggacctcaacgggcaatctattcaattgattgagtatttcaatggccttcactctcaaaaactccatatttcattaacactgccatcgcattgctccatccgtttaccaccttgatcaccacctcgccctcctcaatggcgccgctcaaaacgttgctcctcttcctcgtcgtccttctccccgtcgccaacgcatgccagcctccaagaacactccacgtcccggtcttccaccgcgacgcgctcttcccgccaccgcccggcgccaagcgtggcagcctcctccgccaacgcctcgccgccgacgccgcgcgctacgcgtcccttgtcgacgcgaccggccgcctccactcacccgtcttctccgggatccccttcgagagcggcgagtacttcgcgctcgtcggcgtcggcacaccgtccaccaaggcgatgctcgtcatcgacaccggcagcgacctcgtctggctccagtgcagcccctgccgccgctgctacgcccagaggggccaggtgttcgacccgcgccgctcgagcacgtaccgccgggtcccctgctcgtcaccgcagtgccgcgcgctccggttccccggctgcgacagcggcggcgccgccggaggaggctgcaggtacatggtagcctacggcgacggctcctccagcaccggcgacctcgccaccgacaagctcgcgttcgccaacgacacgtacgttaacaacgtcacgctcgggtgcggccgcgacaacgaggggctgttcgactcggcggccgggctgctcggcgtcggccgcggcaagatatccatctcgacgcaggtggcgccggcgtacggcagcgtcttcgagtactgcctcggcgaccggacgtcgcgctcaacgcgcagctcgtacctcgtgttcggccgcacgccggagccgccgtccacggcgttcaccgccctgctgtcgaacccgcggcgcccgagcctgtactacgtggacatggccgggttcagcgtcggcggcgagagggtcaccgggttctcgaacgccagcctcgcgctggacacggcgacggggcggggcggcgtcgtcgtggactccggcacggccatatcccggttcgccagggacgcgtacgcggcgctgcgcgacgccttcgacgcgcgtgcgcgcgcggccgggatgcggaggctggcgggcgagcactcggtgttcgacgcgtgctacgacctccgcgggaggccggcggcgagcgcgccgctgatcgtgctgcacttcgccggcggcgcggacatggcgctgccaccggagaactacttcctccccgtggacggcgggaggcggcgggcggcgtcgtaccgccgctgcctggggttcgaggcggcggacgacgggctcagcgtgatcggtaacgtgcagcagcaaggattccgggtcgtgtttgacgtggagaaggaacggatcggtttcgcgccaaaaggttgcacgtcttgattcaacttaatacacttcttgagttagcctgaagcacgtgtaattctactacagttatcaaatgttgtttcagctcgtacttaaatgtgtgattccgatgtattttggtacatttgtaatggtctaaaaatattttgggatcttttcccttccgtcgtgttaaatgttagactactaggcattacaacactacgtggttatggtgctattatcacggttatcacgtacaataatcttttcagtttttgaagccacgctatactgcacgtttttgaagccacgctatacttcacggtaaccgcacggtttttacggtaaccgtcaaaccatggactaacggtaacctcatcctaaatggtttggtaaacactaaaggccacacgctatagacaagggggcatcctctccaggtttagaatcctcccccataagagttcatgttattttttacccaaaaaaacttgcacaatttttttcttttagcaaattcccttgctgatttggcactttgacaattgacacgatctatcatctatggagttggagaagctgcggccacgaggagtcgaggaggcccccatgccatgcgcctccctagcggctatggccacgcctcgagcacctgatcgagcttcatttagttgatcgatctgaaaattaacgaaacaagagcacattgtctctacaacttcttttttttttaaacacggattgatgagttatcgaaatgacgaatgaatccctgatcgaagcatcttttccccgcattgtgcagatcgaatttcaagctttattagtagtaatgggcggcgcattccagcgccaggtccggcctccaccactggtggatcccgtgcgccgccttgaagtccggcgacgcgccgcggttcaccgtcaggacggcggacgggaacaggtgcagcggctcgcatccacccgccgtgccgatgcccagcagcaggtccttcaccgagttcctcgtcgccaccctccccacggcgcccgcgccgatgtcctccatcttcttccggtggtcgaagtaccccacgtactcggcgctgatcgggtcccccgggttgacgaacacgttgggcacccaccgcgccagcgccgcgaaggcgtcgtagcctccgccgccgctgccatggtgcaggagggtggccgcggcggcggtgacgaagctgttggcgatgcggacgccctgcctcacccgcctgtcgccgatcctctccaccggcgccgacgggaacggcgcgttgaagaggaacgtggggagggcgacgcccgccctggccatggacttggcggcgagcgtcgagatggcggagcccagggagtggccggccagccagacgcggtggtgatgctgatgccccgccgcggccacgacggcgtggacggtccgcatggcggcgtggaagcgggaggtgcggtcgaggccgttgcggacgagctggaggtcgagcgccaggtcccgggacgccgaggccttcttggtgatggtgccgcggaacgcgacgacgtagtgcggcgcgctggcagcggcggcggcggcggggtcgaggaggtgccacggcggctggaacgcgtagacggcgccgaagatggaggagtcggcggcgtccacgagcacctctcgtacctcgaagtggaagaacctccaccacgccggcgcgcgggcgtcgtggccgtgccggttccactgccggtcgcgctccatgacgtacacgccctggacgaggctcgccatgacggatcgctggtggtgcgggcaattcctggccggaggaaaaccatcagaactcaaaggtgatcagatcaatggttcccaatgcaggttcctgcttgttttctttcacaaaatatacgatcttttttatgcttagttgctttcagcactgcaagttagaaatctcggggtttcaaaaaaaaagttagaaatctaagcacggtactagacaatgcaaattcttcaaggaaacagagcaatctgcaaccaaaaactggaaagttttttttaaaaagtaaaaaaaaaaggaacaatggaaaagagggaatcagcaaactaccaattcacatatgtcaagtacgtaggtcctgacacctcaaagatgtccttctgtgacggcattttgcccatctttttcttgctcggttgctctgcacaacaaagggaagaaatttgcatgttagtctcagtgtcataggacagaaatttacagattaaaccgctctacttgattatatgaccaagattcccactttcctcttaacttaacagctccactctgcagtatcctgctgcatggatgtatccacattctgtacagaacctttgtgtgcagcaggaagagaacttttgtctaatcatattctctagagctcaggatcgacagtgaaccaaatagttgacaatgtgatccataaatccgtgatacatcaatcgcgtattcacaatttcacattacaagaatcagaggagaaactaaagaaaagcagcaagaacattacccggagataaaaactactctttgcatatcatctcctgctgaggatcatcctcatcttcattgcacttctgactctgaaatgaattcctcatagcaagagcgtttattagccaaccagacgacttaagtttcaagatcaagtcaagaaaggaatctaactttttttaaaaagcgatgaaaacaatagtttaaaagattgtgcgggcaacgaactgcatcagatcaaatggaagctccagttgcatgatttgggcaattttttgttggcgctgactcaggctgcagaagttaagaaagggttgtatcggaagagcaggaaaccagaagactttatcacttatttttttcaagaaaaaacttatgagcatgaagtctccggttttgtacagttggtcggagcacaagtggcttaaatttataaagaacatatcatgtgccgtgcagatttgcatagcattacttcctcttcacatcctttctggaggagcaattagagcaagtttaataatgtagccaactactaactctaaaaaatgaaacattatctatagccaacctaataatacactcatgcaataattatttgtacatataaaccgcatcattaatacctaatccatccatctcttacatagttattagagcttgtgttgcagccaactataaatctataacttttcttgtctcttgtctcttctcttttctctccttcacataagcacaacttgtacaactcatttatataaatcccattttactcactcttagaagattgcaattaatgaagacatctttttttttggattcctaattggatacaaactttggactggttctttatgatatttttgctgacaaaaacatagctgagaggtgaggtgatattgcttaaggctagtgatgacatctgaaaagtctaaacgtgtcgattggttctctgagttatgcaacttcaaaatttttgtatgacgggcccggttgacaaaaccagaactggtaagcaaaagtgcttccaagttttttttttttctaactcgtcgtggaagaatctaatgtggtcgataactagaatgaagtgtggatcttccagaattttgtgtagctacctggcaaatgatagaacaaccctgttgtttcgcttatgcttattagccaaactttgaattttaaaacttaattttaaattcgattttatggttttctttttcatggtttattttatattatttgtctttgaatcgctaaagacatgtatattaaagttttacctacaagttatttgtttcctaataaactgtctggataagagcaaaatgatatagcttgaaatgacttcggaaattactaatagagataattcaataaagttcattagcaaattgtaactcagaagactcttacatgtccttttggtcgatatgtggaatatggatggtggaaacacatcttgaatcccccttttcagacttcagagcatttcaaatggaccaaaagtaagaaaaaacaatgccttctattccaataaatattgctcattgtacactgttacagtaatcacacttcttttccctgtaatcctagaaactctgaaagtcgattgtatcaaaagtttgttttcttgccccttctgactgaacattatctctactctatcatgaagagactgctgctgttgttgcacgaggaacatccacaagcctctcaagcatttccaattgatcataaggtgctatctgcagagaatcagattcatgttcatttcatctccatttaatccatctacatgaatttcggaagtctactgtacatgaaataatctttattttgtattacattacctgagaaaaaccatcaggccaagttatagaaactgcgtagtttcccataggacggatctcttcaggttcaatgtcttctggtatatcaccatattgtactttctgctcacctgtccattcgtcctgcagacaagaactacttagtttgtgcaaaacaagggcaactgtgaaaatattggtttctgaaaatacagactacatgatttagtttctgaaaattataagcactgtacacgccatttgaagtcgatgccagtgttagaataatacacattaaacggcgaaaaggtatacccaccacactttgagcagatcggtcattccttctgactgttgctggatgcaacaagaactcttcatctgaatctggtactttcactcggattgctctaattgatctatcataggaaactgctgttgaaactggcaaaatgaaaaagattaacacatcattacaggagaaaaacttggtaaaaaaagaaacatatctgttttgctgtaatacattttttgaacaaaagctggcagtatttattttttttgggaataagaaagctggcagtatttattggtatacttctttcttcgttttgtttaaattttggttagttcgaattcaccaagaaaataaattgtatgaactacttttacatattctaggttgtaatttgtgaactgctaacttaccctgttgtctgattttagcacactgctgaacaacacaaactccaagattctgaaacgtcttagcaacatccccttgtggatcagccactacttcaggaattccagtatctccagacgctgaaagctgtaaattataccaaactgtgatcattgcactcacttttatccttgtacaagataggtgggattgagcttacagttggccgtatcggcaaatcgaagaggtgaggtattccaaactgctgcacaacctgaaataattgcaatgctgacgcaattcaaaaaatattcaagagaatgtgctaaatgtgcatcaaaacttttcttgcctgagctccagaaccttgcccaaatgggtaaaatcgttttccatcagcatcgaagtagcacatgttctcaacaactgcaacgcacggaaccttcacaaagaagatgaagatgaagcagaaacaaattgatgcacgaatagtaagcacggtagattacaattaaaatgaacagtgatatgaagattacacaccttcagcttggaaaacattctaactccctttgcaacatcgatgaaagcaagcttctgaggggtggtaacaatgacagctgcagtcaatggggctacctgatgtttcagacatgttaaatttcacagtgcctacaagcatggttgatgttaccacgtgtgatttgtacaatactcaggctagaggtaccacctgacagagtgttaagtgtatatctcctgttcctggaggcatgtcaatgacaaggtagtcgagttcgcccctttatgaaaagaagaaaaaaagtcaagttttttcaacggaacccaataatattattgggaatctacgaaaggctaagctggtaaaaatgggctgctttattatgttcatcagatgccttcataaagatgtcaagtatctcttttgcataccaatcagtagtggtcagcaactgattaatcactcccgaaaccattggaccacgcattatagctcttccttgtccagcaaagccaaaagacaccatcttgacgcccaaatactcggttggaagaatacttctgctttctgggttctaaaggtaaatctgtttaccattattagtgcaaccactaattttttgttaacacaattattcaatcagcttaccatcactagcagccggttttcaggagaaaccatagttggtaagctcggaccgaagacatcagcatcaaatattccaaccctggcccccataccagctaatgtatatgcaagatttacagcaactgtagactttccaactcctccctgggaaaaaatgttttttagttacttactactaaaaaggactgatttattattatcctgaggtcttgccttgcagcttgaaactgctatgatattcgaaatcttctgcaatccttctggaagctcccctgcgtatgctggtcgtgcaggttgcgcagacattgtaacattgaccttcttgacccaaggaagtgctgcaacaacctcatttgccttctcttcaaactacaaagcaaaacaagtcttcatgcaattttgccgcaaattgtttttccaacccaggataggacagcatttttacaaacagataggagtataaaccaatcagttcacatttatacatctatctcatcagatgccaatgataagcttaaccgatactattatctcaaaaccaatatagttactgctattttgtttgagacaactgaagataaagagtgaatagttccacggagataactgaacacgtcaacacaggaactgtactcaccatgtccttgatcgggcaggcaggagtcgtcagctccagacgaaacgagacctgaaaaagcagagccaaatggagaccaaagtaagccaaatgttcgagcagtgcatccaggcttcatcagcaagtgtccttcaacttaacctcttccaaggcctcgctaatctccaggtccttgacgaacccgcacgagacgatgtccgtcccgaagtcgggatcgatgatttgggagagcgccacgagcacgtccttcttggcgtcctccaccgacgccactgccacacacaccagttcgaaaatcaaatggaaagcacacacaaacgtaaaacaaatttcgcagtttgctgagaggagttccgactgacgaaggttaccgctcgacgaagcggctcccgcgcgccgccggagccggcccacgcgccgcggcgaggggcaccagccatgcgcctgggcggccgccgcggcaggagaagccttcgccgagaaggcgcctgcaagaaccatgaaatccgtggagttagctcgccggtgagagcccctgctcgggcgcgtcagagcatgagcacggagtagaagctgaacgcgagacaaggcaaccatccaaccgccgtgtgcgctcacctcgcggggttggagtcgacggggggaggaggagagggggcgcgggcggcgcgaggaaggaggcaggcgcggcggcgcggaggttccgcattgcgggccttcgacggcgaggcgaggagatggcgggcgcgcgcgcggcgaggaagcgtggcgcggaggagcggtgggagggagtggccgtctctgggccgctggttgtgtggatttggtttgcctttgctcgcttgaagattagtggtacaggcagatggcgagagcgtggcggacacgggacaccgacgagtgggccctgttggattacattttttaagataatggaataaaaatcccagcctctgcaaatttttggattacatatgccacaagtagttcgctcgagtgtcggtacatccatagaacgggagaaggcacagcagctaggtaaattttgtcgctaagtttgtcaagaaaagtacgtattttgcacattatttttttcccgagtttatacgtggatagtaaaatgtagtggtcaaggttagtagtatcgggaaagtgaaatcatctctttcgtgcacgtcacctaaatagtcataaaaatatgaaaaaaattggcaacatagattaatatgaaatatatcactccacaaacatgcaagtttaaattcaacttctacaagttgtaacaaaaataacaaatatagttgcgaatgtgagataactattttcagtttaatttgttatttttgttgtaacttatagaagttgaatttggtcttgcatgtttgtggagtgatatatttcgtattaatctatgttgttaatttttttaaattttttgataactatttagatgacatgcaaacaacgagaggatatcctctcgagagataaaaatagtgttgtttcattttatagatggagatgggccgaaagttctaaacgcacacgaagccaccaacagctcggacaaggcacaaggtaagcacatatgtgcatgggaacaagtccgcctttgtccctcgtcttcccgtggagtttaaattctaaaccataataccagaaattttaccaccccttctccccaacttacaaaattggattaaattagatcctatgataggatggatgaccagtttcgctgacgtggcatcctaatgagaacaaataaaaaatttggggcccatatgtaagtacacatccacctctcccatctcttcctaggagctcattggtgaggagatgagcggggtggtcggcgagatgatcacgaaggcaacaatggcagtaggaggtcggcaaagaggggctccagtggtttgtggcaacacgggaaagaggagggaggcaagggagacagtgcattgtgagtttgcctgtgggaagagaagcagtggtggcggtgccgacgagcccctgggagcttgagctcgtccgcccttcagtacgcgaagggatccagtggcggcggcagccagcaagccctacgtgagctcaagctcggtcaattgcttgtgcgaagggaggcttgcccaagtcctatcacaatcagtgaaggacacccgtgaattcgacagaggatagacaaatatgcaatgacaaacatgacggcatcgcaggtggtgtgggtgggagggctcgctgcatcgaaagcaataattgtacctgcgcccacccaagatccgtctcccgtcctcgatctccaactcaatagcgttgtttgggcccttcccgacgatgcgttacaacttcaataagaaggagatggcgcctggcgacagcctacaggcgagcaccttgaggagcacatgctgctccactttgtgaacccatcacccgccaccagagacaacatcgacactgaccgcaatcttcatcaagggtatttggcgtatagcttgtcgtcgacaccgatagtattgagcaagttggcatggaggagacgagaagaagcataggaagaaggtgaggtggtcactttacttgcgagccccacaaactaagataccacatcagcgaaacctggctttgcgaattggtggtggtggtggggggagtgggggttcaggatttccaatattgaggtttagtggtactatttaaaactcgacagaaagatgaggaacgaatagtacacttattgctatgtccatgctatgtgttgcagacggtccatatacgtagcccgtgagcgtctcggccctggcccctccagcactcgccggcccattgccagacaccacaaccgcgtgacgcacctttgctacacgcgacacaacaacttgtcctcactcgcgcccgcgaacgagtgggcattggcccaagcgcgggacggagcgccgcgccggttacgcaacgcgaagcgggagccatcggttggcttccgcttccgcccccgcccccgtccccgcgcgcgcgcgcgcggccaacgccaacgcagcctgtttatccgggtaaagccaccacgaatcgaggccactgccggtcctggcgtcgaacgactcggcaagtgtacatgatccaaccggagatggtcgatcgtccaatgcagcagcgacgggcaagattgtgatggatgagtagttgaggaccaatttaaccgaccgatgcagggaaaacacatgcactgaaaatggcgcttcttccctagttacatttcctgatcaatcctgacggtgcttctgtatatgtgcacgcgatgcgttcaagaccgagacggacgagaaggcacgaccccatggcgtaccatacacttgaatacttgacgcgacgagatctcacatatatgtattatccccgccgatctatcattctactactagcttagctagcaaccttgggagttgggggccacccacagctctgcaaacttcatcaccttggagacgctcgccagcacctcatacggcgtgatatcccctatcaccaccaccttcttactctctagatctacctcaaacgacgtaacacctgcacaccacacacagaaagatacatgttcagatgcatgtaatgcagagttcattcagactaacttgaaagttgaaactgacaaatcccttccatttttcgcttgatccggcaatgagccgacagacggtggcaacaaaccatcttttttgtagagtgaagtaaagttttactaccaaaatcttgggtaccgactggggtggcgacacctaaacttctttccagaaagggtaggcaagcacaggcaggaaggcagccatgcacatgtgtacagtgcaaacatgtgctgaaacctgcatataatgcatggatgcatttggcctgcgtgcctgcacaagccgcaaccaaaacgacacgaaagccaactcatgagcagcggatgatcgcacattttcgagctccgtgacctgtaacaatactacttttcttcagaaacattttcgttttctgaaatgatagtggctttatggagcagagcacattgctgcttggttgtgttcactgttcgccattagcgaaacaacgagggaaccagagtagatcgctggggttgggttcttcgctttgcttatactgaaatcattggaggtgtacaagggtcaaccaccggggcgagtttttcttccttgcactgacaggcccgtcttcttgcagcagctacgaattcttctgaaactctgaacaactcactgccctctctgactctcccagactctgctcacatcccaaagatgcccatgtggtagcaccaggctacgttataaaattctcagatgtacgccatttcataacccggtgatttttaaaagataacaccgactcagtgattgattcgaggtcctagatagtactaaaattcgacaaatatgaatgcttcgcttgactaatactcctaagaaatgtacacacttgcatatatgcatgaagtacgttgaagagatgttgagtaaaaaagatcgaggcaggattcaactccaggatttcaggtattatcaccttttagactagcggactgtcaaattagttgtcacaaattcgagtcccctgcccctaagttattgctgtgccattgctattgttgtgtgagtcacagagtcctcaagtaattgcaacgaagaaaaacagagagaaagagaacgaacaagtgggttacttgttcagttgttcttgggggtgaagaatcatgagttcatggcactacaaataaagttcagaatgatatatcggttcaagtagttttgttcgtttggtaaatgaaaagtgcaactttatgataacgagtacttcaaaatgcatcctttttagcactagggcctatcaaaagaatctgaacaccgtcccaaaaaaaaaaaaaaaagaacagaggatcagctgtctcataccgtccatcttggatatatgcttctgaactttcttggcgcatccgtagcagtgcatggacaccctgagctccacggtctgcaccaaccaaaaaacgcaacagatggaacagagagaaaagcatcagcagacagaatgttttgcagacatgtccttaatagaacaggggagaggagttcatgttcatcacctttggctctagatggaaagcgagagtcttggctccgccgacgagatccttgagcttcacaagctcttccagctgagagctcaccagcgcctccctctcgatggcctcctcctcgtcgtcttccaccgaatgtatgcagacgcaggcgttcgtgcagagagcgagggagaagcagtcgaggaccttctcaaaacctagcttcctccccatctctcacaaagtgcaatccttttgaaaaaaaagcagccaatgtctactgcctctcgccaagattggctgggctctgctgcgcaggggataatgtgaagaatggcacagctttgcgcgagaagagacaagtagatatgcgagctgagccagtagacctaccaaagcgcttggaatgaggtcagggaagaggcatatatacaagctgtagcagtattgaagtgggctattgcccaaaagtttgaagcaacttcctagaaatattattaacttttgttcagtgcaagacatggtcaggcgccggttttacaacgagacaagctggtaagctctgcatgtgacaatgtgcttgccgattggcaggtactagaactggtgcaattatgcattgcagaacacattgcaatgtttcttttagataatgagaactcactgcaatgtgataatcattcctggtctggtaggatgtatagaagagagagtcagagaaccaaactgagggacaacacatttaggtaaatcataagatacaattatagaagtaatcatgctaaccatttggctagtaattaatatacataaatactccatatgcaagtaactgaaaacatagaaaatctgcagcaagacgtcgttgattcacaaattgccacataagtgcctttcacttgtccacatcggaataatgtatgtatttgatcgtttcattcggtggggaacacatgccaacgtaagctgatcagcatagagaatacaggcaagaaggcatcagctaccattttaccatataaaaccatatccacttgtcttgcgccgaagagaggaccaaagttataaatttggtcggagaatatgaaatgcgagcaggtcaccttcatagacgcatgccacagcggttctaatctttgtaggccacgactttgtaagccacgacgacctttagcctctaatatcaaatatagctacgcaattaggaattgatttgttgccagtcatactctaatttgctcatctagacgcgtctgatcaatgcaaaattaatcgctaaatcttacgtaatcctcccattgtcttctactaataaaaaaagaagttataaactagtcgcgcatcgtgtgttgtcacctttttactttccgaaaggcatgatggatgcatcggtgcgcatcgccatttgacaagatcccaaagggctacacgtccaattaggggagagagacgagacatgattgattagcctgtaatgctttgtgcttatgtgcgacaccgacatcttaatcggttgtactcgcaaaaggggaaaaaaaggacgtcttaatcgcgtccagctctgaagaacagtggcggaatatggtggcgggcctcgtgcgattcaactgttttttcaaggaagcgcgcagcgactggatctttcactatttaactctttttgaaaacttattttatgaatataccctaatagaatttatcccaaaaacgacttaaatctcggcagcagggttgttggtggtgctgatttccaacgtgtatgtgccaaagatcttggcgccaaaaccctggtacattctaagggcctgttcactttgatgctattttcagtcttactaaattttggtaaagttgcaaaaaaaaagtggctacatttagtttgcttccaaattttggtaactatataagaaatcccggcaactatgctaaaattttatcaatgccaaaatttgataaggttgaaaatgacatcaaagtgaacatgccctaattcttaagaaatcaacaccaccaaacaagcataggtgcatggtgtagaagtgagatatccagactgctatcctagttaattgggtttgattaatacttgttaacttcttaagagaactgatgagctctgtgccaaaggactaggatctttggtgccgagaagttagacatcggctctaaattttttggtgccaagatttgagattaattataaaataatttcgtcagaatctatctataaaacaagttttctaaaagggataaattgtgaaaaatccagcgcgcaacgatgtgcatccactactgaataccgatgcatctgatctatctgaaaggctcgtggtgggtggccattgggcaatgggcaaggaggggggggggggggggtggtgctgaggcagacatggcaggtgggcccgagcgccgaattactggctctcagtggggaggacggatcatgtcgtacctcttacccagcatggattgggttgtgccatttgctttgcctcgttgtgaattgtcctggattccaagcaagcaatgcgtgccaagttcttaggattctgcaattcgccgactccgttcggagccaccaaccaaatagagcagtaggattctgtagatgcttcggaccccatgcattatggtgattgtgaaatgcgattgcagcgcatcgatatcagagtccatgtccaaggtaaaacacagtgtgagcacccgtctcgcgctagcgaagacgacaccatggaaacggtggcactaggtgactgcactggtggagtggctctttcttctgaacttgaggagaatacatcaagtgcaggggaaagccggaaaggccattgtccagtctccatcaggtgggcaatcagctaaaacgagttgctaactcggctagcttagtggtctgtagaagtgtagattgccctgtgccccgattttttgagcgttcgccatggtgatgactgatg

SEQ ID NO: 42100 - DNA, 3271 bp, Oryza sativa
aggttaggctgtcagagaaagttgccaccaaacacattctaccaattataaatcaaagcacaagaattcgagaaaccagaatcagactggaactcagcttatctgctccactagctagcagacaacttcctgggaacccataaccaggccatattcagctggaactaaaactcactgataacttggcacaattcaaattttagcagtcctctgtgtctgcagctcatttaactaaccagccatttatcaccatttttcttaaaccctgctgggcacaccacttagcaatccaatcagaactatttgttgtcctcgttaagaaattgccaataccccaggtggttatgagcaatgcaaatttcaaaatggagtgcttggctacagcaagccacaatatttaaagaaagtggaatagttcttccaaaagttatgcaagaaaattaagtcctgcataccatgtcatttgattcatttcagaactgccaccgactagttgtcgaaccacaaatctaggcagagtcctgccaatgaaaggggtatcaggtcccctaggatgttgtccactgaactgcaaagctgtggaggaaagagaaatgagactgggaagtccatataatagagtgcctgcaacgaaaaatatagaaagaacgaactatatgccatatgagagtacagagaatctccaattatagcacatgaccagccaagaactctataggaacctgcgagtaccatgatacctagctccaatccttattattgaaataatgtcaaagagtaacccctaaagatttccataattgttgtacacaaatgtagtttgtctgttgatagataaagtcaaacaatgaaatcaaatcaaccattttttcatcctcggtgaagtgcatggctacataaagaatatctgcagtgaataacaaggatactttgcatggttgatttctttacagctttttcttcttttcatatcccactatatgttgcattttgtattactaaactgacttaccctgtgaaacaatacgaatctaaaataatgatggaggtcgagttgatgcaccctagctaacaacataaacttggaagtaatgctggggatcgagtgaaaacctttgtcactgagtgtaaggccccttgctcctgtaacaccatgaacatgaccttcatcataagtaaaagagggcccctccacctcctcttttagctcagtcttcactgcagatgacactaaagaattgactaaaccaggggacatacttgtctcaatatcttcatttgaacttgtcacatgagattgaatttgggtggtactgagaggtttcggacaaaacaccagagtagacacccttgatgtggattgaaatggtcgatgaattgacctttcctgataaactgcattataggactgtgcataagagccaattgcttgaccatttgttgaacaagaaatgctctttgtgcactaaaagaaaggtcaaacctgttcctttatcactggattttgaatattggatgtagttgtctgatgctgatccagataaatttgagccaggattatcaatttcctccatagcatttgtgctaagagaatcaagagtgttccctctaccagatggaacaacagccttcactctataaacaggacgcgattgtggcttcagagaattatgagccatacggacagaggatgtgaagagtttactaaacatcacagctcgcgctttccctctctgaataaaaggttgttcctgatgagatgatctagaatggtaaaaggatggtgaagctgaattcaagtttgatggagaagtttgcttcatgggaaagtttttttcagtttggaaacccagagtttgagagggatacttttcccccttctgcattggaagaagcctcttcattctgagatctgcaacagtgaagcatagacaacaacattgcttaatgttagattcagctaggtagtcagagtaaaaggagcaaaaatggaactttcgctgacctaatatattgtcctgaacatatctctggatcactcctccaatgagatacatacgggttagaaactccccccctgtaaccatcgtgtgcactggtgaaatctttagcattgccataataggtatgtgattctctttgaacataggcaaaattcttggtatcaccatgatcatagtaagtgtgaaatttacttggaactcttttgtagttattggcactgccatacatattgttggattctttcagaaagctaatgtggtccctggtggtagcaaagaaagtacgtggttcctttgggacatacttgtactcttctctatcatcatgatagtaagattgggataaagttctttcaagatagccatgatcataacgatgtgttctatccccaccccatgctctaaaagagcctcttggtccccttccctaaaaacaacaatacaaacatagcagcactgtcaataagaatagacacaaaaaagacatagtgacaatggcatagtacctcgtttctcaaaaaaaaagaggcatagtactcacactgtcatttggagagttatgggagttcgtctcataaagcctatcatgatgggaattcatctcataaaacctatcatgcgcccatacgttatcatctttaggataccataacttttggccaccgaaatttttcctgaattatgatcattggatgcattaggcagcaaataaacgtgtccagatcaaactgaatattgttgaaactaatttatagaaaaagaaacacatgtcaagcgctgccattgccattgcccaggaaatgcacttaccaaccagttggtgaatgatgacaataactaacaaatgaaactaaacaccaatttatctgttcaaactctttagacaaaatacattggaatatgcatgctacaggcttccagctagacagtttgaaacaatatacccttttggcattttctatgcttattagccgcaccaaattatacgatcttcactctcatagtgaataattcagtcattccagtgcacataatacatatgaaactgtcggaattttgcacacaatggggttaattgattgataaaacaatcctgggtgaatagatgaggaatctaaagcacaggttgtggctataacctctattttcagtttgtcactcagaactatactaatgtccggataaacaacggaaaaatagaacattgagtcattgaatcaaggatgaagaagctagaacctttggctcccgtgcctgccattctccgg

SEQ ID NO: 42101 - DNA, 29361 bp, Oryza sativa
gtacatctccgcggcgccctgcccgtcggagtcggagtaggagtcgaggtccgaccccgccacgctccacggcgccgatgaacccgacgcgccgccgccctcctcgtcgtcgctcgccgcggcgcgtcgcctcaccgccggtaggggcgcgtcgtcgaggtcgctctcgtactcctcctcatcctccacctcctcctccgcctcctccttctcggccatgggcgccgtcgatcgagatgccgcgggggcgaacaatcgggagaggacgctagggtttaagcttagggtttgggggaatctagaaggttcgagaggcttctcgggctcgcgttgctgttccgcctccgcgcattggctcgattaaccacctttttgctttccagctgattgatcagctcctttggggggaaaagagaaggggttggaaacttggaatcattagctacgccaatgacgccaaaaaccattggatcgttcaaatgctgggaagtcgagacgccgacaagtggggccaccggtccaatttcaggtggattttcatggtcccacatgtcatcgaattatccagtatatgctcttatagtagcgtgtttttcttttttgttcttttttttctgctgcttctcatgttttggcagtcttagagcaagcttaacggagtggtatagctaactactagctccaatttatttatagccaatctaatagttcattgatacaacagttatctataagtatatactacactattaatatatggtcccatctcttatacacatataatgtattgaatccgtgctacgaatatgtagcccgttttattctctcttttctcttctctccttcacacgtgcataattattgaaatccgtgctataaatatgtagcctgttttcattctctcttttctcttctctccttcacacgtgcttaccgttattgtattacagatggtttcaatcacctgcagactacagtactatcttgacatatgactcggcgtctcagccaagcaacggaatggtcactagtgtccatctaaaaaaaattgatcacggccatgaaggcgaatttcttgactcttgagcggtactggaagcgaggatctctcggaatgcaagggttcaatcattttatcctggagtaatcataccatgaacaattcagacttgatcgtacagagcgtcttaagccgctgatcagttgtgtgacatttcatctagtaatacttggatctaggatcatttgaaatgccagagcttgtaaatttcagccgctacaagtattggacaaaaaataataataataattcagtactactaacacagaacgccttccacgaacagcggcagagacaacagaattgttcctgtcagtatgtgtgtttctcttttttaaaaatgaaataattcggtgcagtgtcatgtctatttcctttcgatagttctcatttatgtttgttgagggaggaggatgctcatacagtaatcaagaaaattgatctaaataatttattattctagcagttcaagtagtgaacaagcctttcaccctgaattgagcaatgcaaccctgaaggcctgatacatgcaaatctatgaacttctctgtaaacccagaatataaactagtctatacacgaacactggttccatcctcctcactatattccccattgcccctaatcaacaaatacctgaaattaccatgatactccacaattcagaacatgcagagatcgaccaacaatccaaagcatctagcaagtactacttaatccatgcgactgaataaactgttactagctcgtggtactttctgaatcttcctcataccctttgatagtggagcatttcgtcctgcttgccttgcctgcccattgcccaagtgtctacacctataatttctaaacagctctacgcaagaaagagctccctatacttcgtcttctcccttatttctggatatctgcagcgcgtatcgacacgccgtgatggcgtccttgaccgtcaggaagacccactcatcccctaagatgtccctgacgtatccagacagcaccagcttctctgttacctctagcctcggattcgtcagagctatctgcaatgaccaaattaagcatgtgaaaaacagatcaaattctgcggttaagtttcagacttcagagtgagtgatgagctgtgatatcccctcgaggatatcccctcgtatacctttttcttctaaattcgatgcaaatagttatgaaaatttctaaaaaaaattgacaatatagagtacaatgatacctactagtccaccaaaattcaagttcaaattcgatttacacatcgagaaacaaaaaagacaaatttagatataaacagtacgctactattcatacgctgactttgtcttttttatatcttggcgtgtgagttgagtttggacttaagattttatggagttgtatatatgtgttatatgaatgttgtcaaatttttctagaatttttcataaccgtttagatggtttttaagcaaacgagagaacatctcctcaagggattagaatagtttcccgtgatagatagctaaccgtgatccctcttcgttcgaggctcttgtgtacttctagtagcatcccaactccagagttgtcgacagaagtgacacctgcaatgttcagacatatgccaagttagttatcacttatcagtggcctgaattctaggatgagagtcgctacgctgaaatggaagagggcgaagattcagacagtcataccaccaagatcaagaaccaagtattgcagatcgtgcccgacgctcttgcacaggttatcctcatcttccacccatctcaaaatcctgcaaggcagggtaagttaaattagcatccaatcgagagagaaaaaaaatgatcagcgatgatcttcagcgtcctgcattgctgtcacctttctcgcaggtaacccgcattgacgaagtagatgggagagccgagctgcaagacgaggatgccagggatgctcttcgcttgggggtattgcttcacgtcgcggaaggtctcgctccctgctatgttcccgagcttgcaggtggcaggcctggccacgtacagcaacgccctgacaactgacaagcctacctgcaaaaatgcacagccaaggggagcacatcagcatcgtgcagagaaatgtgctacggagtagtatctaatcaaggtttaagttggcgatgctcacggatgcgctgaggcctgcgaccatggtgaagaagacgacgccgaggaaggcgaccatgcagatgcagaagtcgaacttgtcgaccttgtagaggtggcagaactccttgaccttgacgagcccgatcatggcgacgacgatgatggaggagagcgccaccagcggggtgtacttgaagaggggtgccaggaacagcagcaccagcatgatgcacaccgacatcaccacgttcgacatcggcgtcttgcacccggcgtggaagttcaccgccgactttgagaacggccctgaaacaagcagcacatcgtcagacaaaatgttgcaaaatgtatcatggttctggttttctgaacaaaggtcgcagaggccaagatttatacctgtcgtgaggtagcaggaggtgaaagaaccggcgatgttcatgataccaaacgcgatcatctccttgttgccgtcgatctgctcgttcttgaccatcgccaagcttcggccgacggctattccttcctggagaagcatcgatggccgccgatcagaaactccggtgaattagagtgtaaagtttaagtgattgatgagggagtttgagtcaagatcatgttcgtactgccagtgctaggatcccagacaagagaccagctttcactgccgtcttcatgtgcctggactggaacgttagctgcgcaatggacaggggattgatccctttattcaggttaccgacctgtcccaagttaagcagcgttttagcgcatgttgtcaggaaaacagaaaaaaaaatattgatgtttctctgaagcttgaatcgtcttggcatggacgactgacttactatcggaattccatgctcgtcacccttgacaaggaaagcgaagatgcctccgatgacgacaaccatgaatggcgcaatggccgacacccagaacaactttggcagtttctttctctgaagttttggagaaacaaaacttatatgaatataaaacggtcattctataaagaagcagtagcttagcgtatgggtacagttgtttggctagattcatcagtctcctgattcccccacttaccaggtgcttactcgacatcaagaacaagaggaagcatatgccgagaactgcactctgccatttccactgcagagttaaaaaaaaacataaacaaaaggttcagttcagaatcttattcctgcaatttttccactctgaaatcatttacccgcgattacaaagaaaaaaaaaggaacatatgctagtgtgctacacgtctggtgtttctgaaaaatcgcaatggcatgtaccattcctcacatgacattgaccaaggtcaacatggcatgtaccagtattaccaatgtactggccatataatgctggtaaaaaaaatcttcagaaagctacgggctgtacaacagaaagagagtggattaacatgcgatatatcacttaataaatatataatttaaaattcaacttctacaagttaaaaaaataaattaaactacagctagttaacatatactaacaaaacatgtagaaattaaagtttaattgtggattgatctatcatatattaatgtatcttattaaatttataaaaaaatataattatttaagtgacatgtaaggcactatttagttctccaacaaaaactttttacactatcagatcgaatgtttcgacatatgcatggagtattaaatctctactattataaaaattaaagatgtttttgctggtattttgatacgtcatccgtgtatgagtcggtttttaagttcgtttgcttttgttaatacatatccttatttgagtcggtttttaaaatcgttcacttttgataatacataagaaattatataaaaattctgttttttttaaaaaaacttgcatgctaacttgagatgatcggactcctaactgcaactcatgattttataaaaatatatatatccaagtgaactctcacagtgaatttcatcttaactaaaccatataataataataagattaaaatagaattcacccgttgcaacgcacgggtattttttctagtataaaaaaaataattatacagattgcgtgcaaaatgtgatatgaatattttaagtctaattgctccatgatttgacaatatggtgctacagtaaacatttactaacgatggattaattaggcttaataacttcatctcgcagttttcaggcgaaatatgtaatttgttttgttattaatctatatttaatattttaaatgtgtgtccgtatatccaatatgacacgccaaaaaaagatactttaaatatatgtccgtatatccgatatgacacgccaaaactttttatctcgcaaactaaacaatgcctaaatagatgaaaaggacgacccttgagatagattttaaatagtttcccgtcaaaaacaatcccgagcatttcctcggtgcacgcaaccggtccagcgcacaaactgtaggcccaacaatgattggtcttttcttaaaaagacaagatccagcgacacccaaatagtattattgtttgtttgcacgtacgcatcatcgatgcaaaccttgttttgatctgaagttgttaacgactcgacacgaatccagccgatatactaatcgagaaagtcctagctgcaatccagtcgagattccttacgctagtcgcggttatttctcggagaagtttacaggagaggttacaacaacaccctcggaattcggaaatactcaactacttcgcagtttatccctctcgaaacgtgcggctgcatgctatttatagcggttacacatccaggacagcgaggaacaatcgccgttaaaattcttaagaaaaaactccaaaaatacgtccagaaaacacgggagaagtagaagtatggagaagcaaaagaacgacccaacttttctttatttcctcctactagtgaagtgaattgttttttgtttattttttttaaaaaaataggtcttagtgaagtcattactagtactaatcacggagagatttaaattacgtgatgaaattgaactggtaattcgcattgcacctcgtgccggtaatggtaggtggagtgcaggacggagatgatgtctgtcttggtggtgaagtgcttcatccccaggaggcccttgaactgctgcagtatgatgatcatcgccgtgccgcccatgaacccggtgatcgtcgaccgcgagaggaaatccactattagccctaaccttcacaggccaagtgtaacgtaatagtaataacaggttaattaaaaacgtcaggccgggttaacgagtgatgaattagtgaagagagatgatggaagtgcgattagtttggggtttgattttaattttttttatttttacctaaagacgcctagcgcggtctggaagaggccggtgaagaaggcggcggtgtagaagagctgcaggtacagctgcgggttctcgtccgccgccacctccgtctcgatgatggacgccagcagcagcgacgccgccgccaccgtccccaccgccaggttgttggagctcccgaacaccgcgtacatcaacggcggcacgaagctcgaatctggcaaccccaaaaaaaaaaaccaattaattcatcgggtgtgcgtgcgcatacagaaacgcattagtaataaatccgagcgcgcagtacacgtacagaggccgatgattggagggaggttggcgaggcgggcgtagctgatgccctgcgggatggcgaggctggcgatggtgatgccggcgaggaggtcgaacttgaacttgtcgaggccgtagcgcgggacccagtccagcgccgggacgaagtacttgaccgcgcaccacgcgcgcctggccgggggcagcgcgccgaacccgcggaacgggtcgtcggggaagaacgtctccgcgaggtccgaccacagcttctccgcgaacgggcggcgcccggacaggttcacctccgccgccgaggcgcctcccacgccgtgcaggtggcgcgacgacgcggacgacccgcggccgggccggtggttgcggccgtcgacgtcgccggcctccgtccccatgtggatgggtggggtacgcgatcggtctctcgatccgccggggccggggccgagatctggctgctactgccacacacacacacacacacagacacacacagagacgacgatgatggagaggagcggagcggaggaagggaaccgccaaccgcgcgcgcgcgatcgagtcgagagcgttttgctctgatcgactcggtgactgctatttcattggctcctaattatggctttgcatgcagacagagagagagtgcagagcgagcagtggctacagtagtgtgagggttaattaagtattacgcgcgagcaccgaatggcggtggctgtgcgtacatgtcgcgcgttcgcgattacgtgcagcgtgtgctcagaagcggggcgcatggcgcggtttatataggcgatcaacaaggagaggctacgggccattctaaattacgttttggattggctcatttcttgatttttgttagcatattttaaactgctaaacattatattatattttgtacgaaaacttttctatatataatttattttagaaaaactaaagaaatctattttcatattttttttaattataaatattcaattactcatatcctaaggcaccgttcgatctccttggtgagagaaaaattttcaacgcacttaaaacgagaaggctcattagcatataattaattaaatattaattattataaaaattaaaatagatttatttaaatatttttaaataacttttatatagaattttttttaaaagtaccattttactgtttggaaaacatactaatagaaaacgagaaagttgtagtttgggcctaagcattcgtttgtttgcataggaattgaactttcaagaggcacggaaactggagcaagcaattaacacataattaattaattattaattattataaacttgaaaattaggttcatttgaatttttaaaggagcttttacataatatttttttaaaaaaacatggtttaacagtttggaaacgtgctaatgaaaaacacgtaggaagtaggagtttagatctgagcctaattacgtttatagttcgtttcacgtacggctaatcatccaaagtaacccataaaagggatgtaggcttatggacgcgtggtaggaaggaattaaattaatcgatcatcgggaagatgacgatgacttaattatatcgacatgtaaaagcttttacgcgttaggcgaaagaaaatgacgacggtggcgacgtggggacgtacgggcccgggccggcccggcaggggcgcgcgcggctgcgagtagttcggtggttctctcgatcgatccatatacaatgcacgtaagatgaacggtggcatgtgacacaattccgtgcggttgtacaagtttccgcgccgcttcgatcaggatcaaatgcatatcgtttttatcatgcatgcttgctgcttactcccaccttttcaaaatatttgacaccgttaactttttagtatgtgtttgatcattcgtcttatttaaaaattttaagtaattatttattcttttcatatcatttgattcattgttaaatatacttttatgtgcacatatagttttacatatttcacaaatttttttaataagacgaacggtcaaacatgtatttaaaaagtcaacggtgttaaacattttgaaacggagggagtatttagttagacagagcccaggaggccagaaatacggaagaccaaatcattctgtcgctagcgagatagagttgaactctccgatcgagctctgaagataaatccgccccgtttctttccatttcttcttcttcttttctccctttgcatgcatgcatggttgcatgtagtgagctagatgcagatgtggatatgcccggccggttgcaattatccgtcgagggttaattaattgtccatgtatatataggtgccgttgtatatgtagtgtattcgaagataagctatgggaatgatttttgtcacatgcatcaaatttatacgcatagacttctcaccaaaaaaagaaaaagtacttccaaaatataccgtctatctatctactctctcgttccctaaatgtttgacgccgttgatttttttaaacatgtttgaccatttatcttattaaaaaaacttttgtgaaataagtaaaactatatgtatacataaaagtatatttaacaatgaatcaaatgatagaaaaaaaaattaataattacttaaattttttgaataagatgaacggtcaaatatatttaaaaaagtcaacggtgtcaaatattttgggatggagggagtataaggtaagagattctctacaataatatcgttgcacgcggtgatatatggttgttaataattattgcatgggcggtattgcggatgatatatggctgttaataattatcgttgattatgtggatataggatcatatatcatgctgagagtttgtgataaaaatgggtgaatttcgttttgcccttcaatacggtctttgaagttttgctctaggtcagtttagtttctaagatttcaaatcaaccaagcaagttctcaaaattaatcatatgacttaatataatccttaacccatcaaaagtgccacataagcgtgccacgtcatcctcgcatgaatggcatggttttggaatgatcattctaatctaccctacatatgtactccctctattctaaaatataaacattttcagcatatgacaagtcaaatatttttaactttgacaattaatagtaaaaagaaaataaaaaagattaattatgcaaaattgatggtactagatttattattaaacaaactatcatattatgtaatatttttatttaaaacatcttatttttatagatattgttgattaaagtagtatatcggagaccgtgtcagagtctaaaaatacttatattttgggacggatagagcactacgttagaaagaaaatgaaaaaataaaaaggaaaaagaaacaacataaataaggctggcctattattaccctatcgggttattttctctgtttaaacctcgatagggtttgggcgccgacgaacagcgcgcggctgcgtcgttgcagcgttgcacggtgattgctccagttcagctgcactgccgcgacatggggcaacaccaacgtaccattccaataaacgttgccaatttctcctgtggtttgttttcttttctttcttttttatatggtagataaggtcagaatggtcatttcatccttactgatgcatacgaggatgacgtgacacacttacgtagtattattggtgggtccaaggaccatgttaagccaaacaattaatttcgaggatttatttgaacatttgaaaccttatggactaaaatattgcaattggttattcacccataaaaaatccacttggtaataacatgtattctttaattttattttatccaaacaacactatcaaaatttcagaattaataaatatgacgttgtatctactctcaaattagtattttattaatttaatttcgaatttcaaaattaataattaatcatatgtaagtctgtaactgacatgtctgaaatattattagaatgttaatgtttataacttataataataataataataataataataataataataataataataataataataataataataataataataataatagattattgactagtcattttaacaggttttataaatacttaaaaaataattgctggtctgaatcacaatattgtccaatggatattttacagtagagcaggtacaatagtagtctataagccaactataaatatattttaaagagataaaagaaaagagagaagagcagcgggctatagatttatagccagttgcagtacgaattccaagacataatgtgtgtatgacaagtggaactagatattaatagtatagtaagcaactattgtatgaattaactgttatattggctatagatgatttggagttcatagttgcctataatattaaacttgctcgtagtgcaactgtccaataaattggcaggcgctaaatcgaagaggaggaagttttcaacggagaaactcagaaattagtacttgcccgcgcatctgcaaaaggtggcatcaaatgtgatcacatcgatcgtccttttgactccttttggaaatgcgagcaaatagggacacaacaattttgaaacatgcttggttgagttagctagctaagcttacctcagtcaagattagctagagcattgctttaatgttgatgataagttgcccccaaccaatcatcatcaatcaagtataagaaagctttgattttgtacgctaatatctccatcgtcacaagtgagcagtcgtactagccaacttcctgttatactaacaaaaaccaccgccgccgacgagcaccagtctatgtgccgtgctgtgttgaacacgcgactacgcgagtagaaccaagtgagtcgccgtcggcagctgagagtcgtcgatcacaccgtacacctccaatcagttcttcatttatgcaatgatctgatctctgcgaccggataaaacaatgatttcgagtgatgctttccagaagcacctgtatgatcacctaacaatctgaaactctccaggaactgcacttgttcattggacggatcggaactgatcatggcctacctgccgggagggattcactgttctactacttattacagctgaatcaactgatgatgactcctatttagatccgggggaaaaaagaagtcaggccaaatgggatgttcaacagaagatcaatttactgaagataatctaatttctgcagaaataagaaatactcaagttcaggctttttggaacgcaaaattttcaaaacacaaggataagaaaataacagaattagagtgcactgatatatcaaattctatggatgaaaaaaatcaagaaaaaaaactatagtaatgactatttgaatgaagcacgaaaaacatggaaatgaggcagacatgaaattttcccaggagattaaacctcgtgttgaaaatcctctagaagttctatgactttaggcaatcctaaagaatttgagagccttccattgttccaaataccaccatataagattttgtttcccattgaaaatcaatccctcaaaatttctcaaaaatttcattgttcaaaaggagctcttactcctaacggttaggatcaattttagccaaaaccatgtcacgaaagcacaactccaccatccggatataaggccatatgatcgagtgcaataaaatgatgtaagcggactatacaagttgtcacatcatatttgtgttttgtggaggggacagagaggagagagaataaaaagtgggctacatatttgtaactaattatagcacgagctccaataaaatatataagagatggatggattaggtattaatgatgcaatatatatctacaactaactattgtattagtgggctattaggttggctatagatgatcttgtggtttttagagttagaagttggttatatttttaaacttgctctaaggtctcctttggaacaaagtatttttttttatgttttggccttttttgtttttacttttaaaagcaaactctttcaaaacttatttctaaatccaaacctatttttcctgtgtcaccctgcctgatgtgacaaaacaacactgccgcgtcattagtctggctggtgtgaccaaataacattgtgagagctttgtttcgtcacgcaatctgactgttatggctaaaagttcatatttggaaataagttttgagagaattttttgaaaacaaaaaatttaaaaggtaaaacatatattttaaaaaacaataaaatctattgaaaaattttcctacatagtcctttgggacaaagaaatggctttcccaaaatcctttgcaattcttatgtaagtacttattttaggggcaaagcccaacgaggcttagaattgaagacccattggggtgtacaatattccaccatataatttttttaaggcaagaagattgccttatatattgatagagtaagtaagcaaagttatatacaagtcataggagttatggttgtcccagaccagtcagaacactctattctcacaaagggtacatctcacttaggtttttcgcccccgcaactgcccattggcgagcttcctcctttattctcgaggatgagggatgggtgccggccaattttctgaagatacacgagttccattctttccataattcctaggagaccaaaatgactgtcgacttgagctgttcttgcgaagtgttcggagctgcggtgattactatccaccatataattaccaatatcatgcaaggtccaagtctctctatcgactgcccgagactagggccaaccccgactcatttcatatgaactttagaggaagaccagcatgaggctagacctcatgttttctttctcatgattcagttcatttgttttttctataatgctaccttaatgttatcacaaaaagatcaggataggatactatgtgcagtggtgctatactcttgaaatcggtaaacaaggatcttttattctattttgaatgatgcatacgtaatacctaccggatatgacatgctaaaatttatgtgattttagaacttcttttagttaaacttggttaaagggaattagggtttgtcccatcaccatactaaaatttatcggttgtgtgccttaagaatgaagatgtaaaacatttttattatagaaaaataaataataccttttataaaatctgttgtgccctgatatcctatttcataagttttattatttttgtgtgattcttgtgtttttagaatcatgcgttcaagcgaccggtctctattaccatgttgtctaacagaacgtaatcacgtttgcaaattgcaacacatgagacgccaccatgcatcgtggctcgtggggaagccatgaaaattaacatgtgctgtagcagtgataactgtgataatagtgtaataaccgtacggttttgtaaatcccgagctagagctccacaacagctagctctgcaggctgcagctgccagctggtgaacagtgatatcctctaaagaaacggtaacgcacgtcctcttctggggaagtagagttcagaggcaggcttaccccgtgcgcgcaaaaccagcgcagcgccgttacgacatcatggactggtttgatttaagatctaaattagttttaccaatatttgttaattttaatagtgtttagtgtctatttggtttgaagccaaattttggcatgcctaagaaaataggccatttcagtagtgaacttaggctattttggtttcaatccaaacacaactttgcattaccaaaattagtcatgccaaaacttaccaaaatttgacattgataaaatttagtaaggtctatttagggcacaaacgaaaccaacctcatatgtccataacaatggtaacacgcatacatctccatcaaaaatcgcttctgccgagcggtggtcgaccaaaagattttaatgcagatcatgcaacaaccttttctacagtctcttttatgtggcgttcatttggttggctagctagcatcagcctgtagagtgtagacgggaacaactaacgacagaataaatgagcctgtttaacaaccatagtacacccctgatcacggaaaaatcatttttaaggatgaatattgatatacttgtcctaattaatccttagaaaataatttttaacaaaggaagtacttcctctgtactcgtaaataaaatcgtttaggacaatgtttaagtcaaaccttgggaatataaattatgaataactctcgagttgttgagtttaaaaatataaaaattatatgaatagatttgtcttgaaaaatactttcataaaaatatacatatatcacatttcaataaatatttttatataaataagaagtcaaagttgtgttttggataccgtgtcgctgtcctaaacgacttattttatgagtacggagggagtagaagtactcattaaacatgacactatctatgacagaataacttaattaagggaaattgatttcattcctcgagaggagatatcccttcgtttcgtgcatgccatctaaatagtcctaaaaaaaatttaaaaaaattggcaatagattaatatgaaatatatcactccacaaatatacaagtttaaattcaacttatacaagttgtaacaaaaataacaaatataattacgaatgtacaataactattttcagtttaatttatttattttttgcaactggtagaagttgaatttggttttgcatgtttgtggagtgatatatttcatattaattaatctatgatattatttttttaataactatttagatgaaaatccacttcccttaattaagtacgcacagaagcgtccctgtatgacagggtactaacagagtagtacgaatagagggtactggccattctggtttatttgatttggatgagaacacattacatttgatgaggtgtctctgtagtctacacacctatccgcaacacaggcaagaggacattggagaatttgtgattcggtcttcagagcaactgtgggctcagcttttagtgatttcagcaaacaagcatgacatgcatcagtgttgtcatgcggagctcatatacgatgaatcctggatatggtggaacccagtcgtgattgagagcaaccgtgcttcaccaaagtacccatgaggccatgacaagcatattttgtggcattttctgctcgacttcttttgagcagtagaaaaaataaaatgtattgcatttcagagttatgtttcatctaaacaaacatgttctcgccgttttcgttacagtgcgtctatcttggcatcttgcactatctaaaagtaagcaagtatagcatgcagcatctcctgaataatcatgatggcttcacgacctaaacctgaataatctgacctctcgtatcacctaaagccattggattggttattattgggggatgcagtttctcccgatgaagaaaagcttggcgatccagaagaaaaggattgttcacttcctccttccatgtcctctcatgccaagtagagccatatggttctgttagcaactttttgtgacaagttgacaacgacgatcgcagcaccttaagccttgcggtgatcctagagtcgccaaccacctcgatctagcgaaaagctaacctagatgggttttgataactaaactggctagcagagccgatttctagataactacctgtctcgtaggcaaaatggaaggttttcaggacaaacctacaaagaggtgtcgcactctcgcagcggcggcggacggtttacggcgcaaaccgacaaagatggataaactaagagaaaactaaaagcaatatgaaaaaacgattcgattgattgactgtagattgtttttttacaatgaaccggccatgtcccttatataggggttggtcttgccctctacaggccctcctccacgtccaactcggggtagaaactaaaggaaacccgaaacatgccttcccgagcaaggaaacctcgaaacccgacgaaacacagtcggattcagacctgccggtcagaccggcaacacactgccggtctgaccggccctcaaccggcggtctgaccgcccaacacacggcggtcagaccggcctactcggaggaaaccggcagacttccaaattttggcaatcttttctattttaatcctagatgctaaatttgggtgtaaagaggttcttgccaaatggttgcttttccatgccatgtaatcaagatgtaaacttgtcatgcaaatgcagtactgctggcaccacaactcattagatcaatagagaaatgttgacgaggctcacttacttcttcaaaaagtaataacgtaacgtaatgaaattaacaaacaaatgcatgttcaagtttgaatcatgttattctgtagcttttgtcttgtgggggtagtttgcgcttcttctgaaacatccggtgttgacaaattggagatagggcaggaaagtattgttttctcggcctatcctaagagtgagatgagctagaaaagtaaaatcccatatgttgtatggtactgatatccatgatctcgtgttcgattacaagattgggatggcttatagcctccggatatacaagtgaggttacagtcctacccctaacagtgtctagtaagttactacaatacccatgtaaagctagaaactctaaaggtgtggttgtacacttgaaggagtgtagttgaattggtccccgcagtatctttttggaaatacttctcgctaaacaacataacctttaggctttaccagccttggtcgaatggtattttcctcttatggtaagttagaataatccttttcagaccgaccggtctattagtatttatctgtcgcattatcaaaaagtatttgtcacgagtaaaaacctctctggcaaatgagtgagagtgttttggttgaattggaagtggtgtttacctcctgctgcaacatccggtaaaaatgcctacctgacatgcacatatatatggatgtaagtattatatctttcacgattcttgaggagttactgaggtgaatgattaggagttgtgaattcatttgacaaaattaaccaacaagcactcaaacatattcactggaatattactaacagcaccacttttttctttttttttgtttgtgtttgtttagatttatttttgctatcttgaactttttgtatgagttttcttctgtgtgagttctgtaataattggttgtaactctttgagtaaaggccaaaatgttatattctattatcttaaaaaaaaactaacagcactaccaacattattcaatgatctcaggcaattccccgttatgcggttccctcggctatacaacaataaaatttgtcaatttccaacacatttgggagaagataacatatgttaatgtccccctcaacgcataatggagctcagaatctccctcttttactttcaccaaagcatgttaacctcttgctagtagttaattagtagtccactaacatacacccacgcatatggtccatgcgtttcttctcctcctagctttctaaccacccctgtcgatcaatagggaggaagtctcaaacacgcgcatatatggatggatccgtcatctccttcaacaggataaccgaaccaataatgcgagcaaaagagagcctgcagtgctgcactttcttcgaatccgagtcactcgtctcgctgaaaacatcacgcacgagagctcgcgctagcccccacacgccgaagagggtcgtggaaaattttccccagcatccgttcgtggaatgtagtcactagccaccggcgaatgatacctccctcggatgaatcaaattaagctggtagtaggagtaacgaacacaccatatggcttgataccaagcctctgcatgagtgcagtctctgtggctggctgctctgctcggtcatgcatgacggcattttgactatactttgagcaggcagaaagttattagcaactgtatagttgattgatgattcgctgctttttatcccacttctgggatgacctgcagaattgccgaagcagtaggaaacggcacctgagctgaactgatttgtccttgtagtatctttctggatgactatttgcaggggtgtaggattgatgcatttttcacatttttgatctttttagaaaatttattcttcaaataggcctttaagaaaacttattatagaattaatattttacgacgccaatattattggcgccgtggtccaacatgacagcgccaataatattggcgccatccccctaaccccttggtggaaggtaagtcactaatatgaagagggatgatgttggcgcttaggaccaatttgtttttttaaatgaaatacccatagtacaaatatttacaaatagatcctcaacacaacaatattggtgtcgtccccttcacattagtgacttggctttcaccggagggcgaaggggacggcgccaacgtcattggcgctgttatgttggataactgtgtcaatgacgttggtgtcacggaactggtccatttctagaataagtttttctataaactatttatagaataagttattcaaaaggactaaggtgaaaaatccagtgtgtgggattgtgggaagcatggaccgaacgatctagaagtttattttttaaaaaaattcaggacgtgaattcggtcggtcagtctatttccagaagtcccattatattaattctgcttctgtgcggttattaaaaaagcgtgcaccagaagtctaaagcccgtaaagtgaattttgttacaccaaaactcattacgaattcttgttctgatgctaacatctaagctttggagccttgactaatgctagtatcaggctttcagcactacagtggtcaacgtatgcacaaataaggctggaaccgacattactaaaacaccatttttcacaggcacctctttttttttttggcgaaaaagaaaactatatgtgaaaatgtataggctcttcaggctcgtatgtaaaaacaaaactaaacaggtaggtctattaagagctcgtcctgtgaaaatcaagattctcgtagctagggccttatgctattttacaagcagatctctaaagaccgcgtggagtgttgtcatctcccaatcatatctgctcatcaccactctagtacatgtggctacggaaaaggcagattcatccacgacatccaagagagaggcggatctgccgccagtagcctcgggatcggtcggtttggggcttcattgaccatcgggtgcggtgatgatttttcgtgcattttctagaacttttttgttggggagctatcatttttggaattcttgtgaactttttttagcttttttcccccaaaaaacttttgtagtcggatgtcctaacgctctcacctaaaaaattaatttttatgtgtcattgtggtgcatgtgaaaatttcgattttacatacatccagttacaagcgggcaccccacctccctatgaacgcttttgaccgaatgagaaaacgtttatcgtagtgagatgagagaaattgtgactgtcaatcttttcggaaagaaaaataaatgggggatcatcagaccatgcataaacaatttgatatatgatcagacgtacatacaaaatggcaacggatcaaacaggctgatataacacgctgctgctgctcgaggtggtatagaacggcaacttgtggctggattaggtcagtcagacaagaaaacacagctgttacccacatttttatgattcgagaaaagctcggatgttcttaaaataattacagtgagaccagtctctatttaatactctactcaaattgtgacacgtaagcctaacggctaactaaaaaagcttaattttaggataggttaacgctttgaacagagtctaaacttaaacatagaatagagtgctatcataggattattttcaaccataagagatgtatggtgaaccaacctcctatatatatttcatttaaaaaaaactcctatatacacgatgatgacgaaggccaaagctccgaacgcagaatcaaatgcaaaaatgaaaaccacatcctgtaggctgtagtagccaataggaaacacaaggacgatgatcaatcaatccaaggctaagggcagttcaaattgatgttattttcatctatactatttttttaaagtaaagttataaaaaaatgttaacatttagtttattgtcaaactttgataaatacataaaaaatcttatcaaaattttaataatatttttaacttgctaaatgtttattttggctataatctgaatagccccaaatcttcgtttcgattaagtattcaaatgatgaacggaaggatctcgccacaattatgagaaaggccgaaatctacggagggatggataacacagcctgaaagcaacatgggccctcctcacttgtgtgggcctaattgaagggaatcttctactcattgcattttgtcggcctaaaatggccttctgttgaatctgccaaaccttctattttctcttctttttttcacggtggataatctgatggagaaaacatgaagaaacagctagtcatttcagcctcacttgctcctttgcagcgcaattctggccggcaattgacattgatccagacatcaacgatgtcagaaacttggagagcatagcacggccagggccagcgagcctacctacggcgcaccactgctcgttcttcctcctgtgcttctagggctttggaaccacatgcacgcggggtggttttcttttctttctttttttttttagcgaacgccggggtggtttcccgaaatgagcatccatgtgtacaacgcctacttcgacttggctgtgtttagttgctgaaattggggagaaatttagtgaaagttagtagtttggaaaaaattagaagtttatgtgagtaggaaaattttgaatgtgatgtgatgtgatggaaagttggaagtttggtgtgaactaaatagagccattgcttgggagatgcaaatccctcataaagatatgttgtcacggcttggaaacaagacttctcccatcccctcaactagatcacactgtaaatgtaaaacgctgaaaacactttgtattctttatcaaagaaaaattcagatgaggaaactctcccctctagtgatttaaaagaaaaaagggcttgtttagttcacgaaaatgtcacatcgaatgtttgacaggatgtcggaagggcttccgaacacgaatgaaaaaaaactaatttcataacttgtctagaaaccacgagacgaatcttttgagcctaattaatcagtcattagcacatgtggattactgtagcacttatggctaatcatagactaattaggctcaaaagattcgtctcacgattttctccctaattgtgcaattagtttttggctgccttagtttttttatctatatttaatgctccatgcatgtgtccaaagattcgatgtgatgtttttgagaaaaaaaatttgggaactgaaccagacctaaaattaaaatgaagagaactccaacattctaatgggcccttaaaggctagacagcgaccatttgagcccaaacatggaatcatctgaggcgttaactctactcgatagcggatcattctaaggaccgatcgaggcgtcgtcacctgtcctcatcaccgtcaatttgtcggctgccctctgccgtgccgccctctcgcagaggcagagagaccaccggttgatgtcacgccgtacaccaccatcccggtgcccgatccccctcgcgccacgcaattcagaacagccacatcattatgcttctctcgattggctaacggcgaatcaaagacgtacataccccctattgatgatacacaaataattggccatgacctgtgcatcacaatatttcgcgttctaccagtagtttcctgtagagcaatcatcagcgcgtgaaatattcatggaagagcttatcaagtacggctggatgattgatgttcgagtcaaacacgccggattatagaacgaccaaatgtcctagttatcaccttgagtgttcgccatagccattagctcgtctacacgtcccccgccctgccggacacgtcgatggcccaaccccaaacggggacttggggttgggggaaggccccccccccccccccctccccgagcgacagtctcgaccggtcccatccgtgcctatccgcctcggtgatggtcagcacgcgtgcattattactaagcttatcgcatcgcgttacacggcacggcacgggcgagatgcaagcagcgcaggacgtgggcggtggagtcccggggatacgtgtagcgtcgtggcggagactctgattccgccaaatccggccgagatttggatgaacaatggcagtatatatacacggcgacgtgtacgacagccgtaggccattcccaaccctatatatagttttcataaattctacatcatactagacactacttttttcaatacaaacatcactatacatatttaaatttaatgttagttcaaacatcactatacatacttaaatttaatgttagttatctcacgtaatatcttggatgcagtggcggaggaaaaaaaaagagatatgtctcatggacacatactaatcgcactatactgtacgtcacaacattgtatcaatattcagcaaggcaataatcaattgaatcagggagaggatagatatgcatagaatctgaaaaaagaagagcaaggattgattagggacgattgaatcgggaggaaggccacttgcttcagcttaccttgctgctgctgcttgccttccgcctcccacatcgctcctgctgcctgctggctcgccgcctgccacgcgcgtgtccctgccgcgtagccgcgccgctgcacaccagctctcgtgcccagtcgccgcttgttgatctcatgcggggagctggatgcggatgcctcccgcagttccaagcggccgcgccgtcgtcgcctcatcgtccgccgcggcggcggagatatggggaatttctgggctagggttaagtctagtgaatcacccacatatgcccacattaacacaaaacgagcccaatgggcctacgattcagtggagagtggcccagcagcgagtgctctgtctttgcccatcgcctgacgccgcacttcgcctctgcgcctgactgccgtcagcggcctgccggagttggaggttgggggtgttggtacgagcgggcggcgcgaggtatggcctcgccataccgagtcctccgtcactgcttggatgttgtgtaaaaactatgtcttatataagacatgtttttttctcttttctcatttatttacttgtcacattattttttatactagatggcagtctatttaatattccctccgttttgaaatgtttgacgccgttgactttttagcacatgtttgaccgttcgtcttattcaaaaaatttaagtaattattaattattttcctatcatttgatttattgttaaatatatttttatgtaggcatataattttacatatttcacaaaagtttttgaataagacgaacggtcaaacatgttctaaaaagttaacagtgacaaacatttcaaaacaaagggagtattatagacaacatattagttattgggttggaaatggccttacaataaagcgaatcctcatccctgttccgtaggagtaggccggatgcgcaacaggctgttgccaatgggagcaggataaggccgagattaacctcatccgcggcccactaggcgacgtccacgtcacccgaatcctctggaaaccgcgtccccctctcccccgccgtttaaataccctcctccttaagcttcctcttccgaagccactcgccactgcaaagcgctctctctctctctctctctctcgcatcgcgcgcagccttcctcatccccgtcctgatccactccacctccctaatccacagcgcgcgccagaggaaatccggcgccggtcgaggcggccgcgccgcgccgccgtcacgcccagcccactcgattcggtcgcgtgtgcgctaggaagttcgtcatacgcctcgcggttttcacttcgtgtgtttttcttttaaatttttacctgtgcttcgtttaaagcctctcttgatcttaggtatagctttgctcgatctgattataggtatgttgtatgtttctggtctcccgtgattgcgcgtggattgtgattatgactaatttgcttgatctgaatatctgattgtggtggtggtgtgtgtgtgtgtgtgtctgatttgtctgatctgttgtggattattattgtatgatttaccgtggttttatgttgtttatatataagcgtttgccatgagtctgattaattgtattgttgcggtttttcctaggtgtcatactgtcatgctcgatttttacaaggtttagtgcaaactgatagatgatgtccatccccaaaactccgtctaccagtattggttcatgtgcgagcacacgggatagttcgagttcctgtttgatattgattcgctggcgctggttgtttggttggtttattagctagagttgtttgtgtgcaaaggtgggatcatggttgcaaaggcatattgatgaatgacgattcataagcgtggaaagcaatctctgtgcaaggggttattaggattctttgtgcgtattcactctaaaccgatagtcttgtattgctatcagcaccacgttatctatttcctaaccaatgttttctgcatatggactctgcattttgcttcctctccttgtaccacacccagtaccctatgtttgtgcctctcccatggtccatctctcctgttaaaaaataaaaataaaaataatagaatagaaaaattctagaccaaatacagggaagaaaataaattttgtcaggcaagagagcgacgaggcgatggggaacttattacttttctggacaaatccttcaatttgcctcatctatatcaatggaattgggaaagcagtggactacttaccatgtattggctactaatttccaccactccttgccagagaattgggaaagtgaattctcttatgcaggttctgtcagagtattgtaccagtcattgagatgactgtattcagtagagaagttttgtagataggttaaatttcaggtacaaaccaatgaagtaaaaaagtcttagtatgatggatgtgagaggctcaagaagttccctgattggagaagcaaaggaataagttttttatatggatgtgctatggattttaattaaaagaatggagaagtttcttttgttgaagatgaagctgttggcagctggaggtaggctcccttatgatctaacgtcctaagtaacgacgtatctgattggtgtaagctaataaccaaagccttatcatgaaaccgtcacgcttgtttttttcttttttctttttcttcttgtttcctggcatttgatgctgttacgtgttcctcttgccagagaatgggggtggacaccacagtaagtttgatgcagatggacactgttcgaattgcttgggaactcttccatggaatctggatggataccttattgagtagtaaatttcttaatacagctcgctatccagatagtgctagctgtgattgtttggtgatcaatctattgggattgtgccgactggagctgttcgacattgctttggtcttttgttgatttgcctggagttcggcagtatacagcaaccctggagtgcatgcagtggtttcctcattttttaggacctgactgcattctgtagtgagaactatcctgctaaatgcataatacttgcaggtgttttctgttgtattggcaacgtgatagtttttgtggtgcaaaacattcaagatgggcgccatggacgtacaacttgagtctactgctgttcaacatggacaagctaagataaatgtggaggaacatgctctagtttctctgttgtctgatgagaagtacgcaactgaaaagaccgaagatgtggaccctgatgattatgagaaacttgaggaagggataatgcagtatgggtatgttttttttttttgttctctggttaggcgttcttgataagctccttaagtgccaacaagtttgtgcttaatgtactatgtcaggtgtgcacattatcgaagaaggtgccgcattcgagctccatgttgcaacgagatttttgattgtcggcattgccacaatgaaacaaaggtatggttttcgagttgatgtggaagtgcaatagttaaaaagtatgtactcttttatccatactttcctaggtggttttgatgtaggaatagtcagttactcacaaaggctttgattaactgctgttcatattaatgcatatgtttgaagagcactagtgagtataaaacgtttcctttaaaaaaatcaaatagtgagcataaaatggtttaaaaaaacctaacaatgttctgatcattaactcattttatagctggatatgatttagaaatcagataaatggtatggttgtgacataaaatgaagacacagaatagaactactaaactgctgccagccgtccattatgactttggattatcatccatctgtaacagttgaaatctgttgtattttccattcttacattgaaacagtaatttgatgtatttgcttatgggctgttacatgtacacgacttatttgtattgtaccagcaatttgttggcaactataatatatccttttgttcttttcctggtgaaatatctgaatcgtcactgttttggtttatactgcatacttggaccttccttgggcagttcccaagctgaactatacaagtatctattctttatcatggtattaactgttggtttaaaaatgtggaaagttgttgacatccaaactgttttgacagaattcaattaaaattgatgctgtgaagaggcatgaactcccacgccatgaagtgcagcaggttatatgctcgttgtgtggcacggaacaagaggtacagctgagctatccttgttgcttgcattgtaacattattaattatctggcatctagtgtaatcacgataactcttttatgttaccaggtacggcaagtatgtatcagttgtggtgtatgcatggggaagtacttctgtgaagtgtgcaagctctttgatgatgatgttagtaagaagaataactattttgattgccttgtctatttgtaataagtagataggaaagcataatgacacttctttctacaatgtcaggtttcaaaacagcaatatcattgcaatggttgtggaatatgcaggtttgcatctcttttttgttgtgcaatcaatatgaactggaaaatatacttacattcgactatgtttgcagaattggtggcaaggagaatttctttcactgctcaaaatgcggtaatgcctcttgtctccaacgttgcattccgaagtactataatttaacatagcgccatttaaggaataaggattcttttagtccctgaactcttaattgatgggaaaaggatactgattgatataatgagagatcttgtttatgctacttttcccgatagagatatatgcatcatgcatgggttgtatggacttctgctatgataagattgcagttttttttcccaaaattttctctgttatacactgtatattactagatgaatatcctctacctttctggaagtctactaagatcttgcatcgttaacgttgactatttaaccctgttagctgaactagttcaaaccctcacttgaattttatgacttgatttctattatttatatgcatatgaatgaattttgctagtcacttctcttgatttgtgttcacctttgttatctgtttcatgcaggatgctgttattctatagtattgaagaacagtcatgcatgtgttgaaggagcgatgcatcatgactgtccaatctgctttgaggtaggcattcactgttcttttatgaatggttatatgcagcatactgtggattatattgttgatgagtgacttatcaccttgttttcaagttgtttcttgagtgctgatcttgttacacatatttcagtacctttttgaatcaaccaatgatgtttccgtcttgccctgtggtcataccattcatgtcaagtgcttgcgagaaatggaggagcactgccagtaagtcaatccttcttggccctttgttactatttgtaatgatattatgagtggttgattttgacagcttaaaattgatgctcagatttgcttgcccgctttgctctaaatctgtctgcgacatgtcgaaggcatgggagagattggacgaggaactagcaacgatatctgacacctgtgacaataaaatggtaatgctctcttctctgctcttctgttgtcagtaggaactaag

SEQ ID NO: 42102 - DNA, 12894 bp, Oryza sativa
ccatgtcgcagactcagagtcctgttcagcttaagtttctactagcactagccgagataataagtgcacgtctactcaagcttctgggcataaatggtggctagcttgtgtgttatggtgtgtacttgttgagtctcgggcaaacactgtaacggttagtggcatagtattacttcttgctcgtgtgcgtgtgtagtaggatggcggattgcaggacgtgggtgttatttactggtaggaactgtggtacttgcagtagccaccatttctcatgttcaatgccggtcccatatgccggtcttgttcagttcctataccttgctcggttgagaaaaatggcaaatctacctcagttcattttgttctgattatttaacagagggccaagtattgaattctttgggtttgcctctttgatggtgctagtatctgggctctagtagggataatggctttttctatcttttgacttgtagcatgtagcatataagcaactttgaaagttttaaattttaaatttgatagaattctaatctatatttttttatatggtcctttgaaataaatgattaaaaactattgaatctatgaaaattataaggatgtctcaattcatacaagttgtagaggatttttgtttaatcttatgagaagttccatatgtgtctatctcttatctaattcatacgtttttcttgcggtataatcaaatcttatatttttatcttttgacgattatctgttttgcccttgaacttttgtgagtccttttttctcttatttatttgttttcttaaatcttgcgtttcgaagaagtactcagaactgatttagatgttacttgctgtgtgaaagcgcttcctgtcgtcctcgcgcgggcaactggggacgaaccctagcccccgccgacaccacccttccctcctctcccccgccttcccgcggccgaagcgtgtcgtcggatctaggctacggcagtgcgggcgtggcgtcatcgacggcgagacgaagtgtgtgctggtgcggcatgacaaggtcggccgcgcgtggtggtggtggccggcgcggtggcctgcgcagcgggaggtgaggccagtcgaggcagagcccaatgaggtgacatcacgtggagattagccggcggggcgcattgtgcaatggtgcccgtgcgccggctgaggtttagatggcggtggagcaatggtgcattagtgttagatcggcaggcgatggacggcaggtgaaaacctaatacggccttgggcggaccagcaacgatgacgttcaagggtcattcccctcttgagggcgttgtcgtgccgtctcaccccttaagtgtggctgtcaagcgaaagcccagtctcggttctctttgcaacgttgacgaatgacatcggtggcgttccgtcgagcaattggtgcaagctcgctctagattcatatgctcttgtgtcggtgtcttagcttctggaagttgaccacgtcagagggcctatgaggggagaggagttccatttttctctcaccctccctaaatcgtaaagacttagatagagtggggttttgtattgattgttaggatcgggttttagacgatcttggctatgttccgtcgttggtctaggcggccagttctgtgctagccttttcctgagtctgtgtgttgacgttgttagtgtgtgggtagtggtatattacgatcttttagagttgtaatcttataattttcttatgctctatcaataaaaccgcgctaaaaaaattggatgttacttcatcgaagtggttcggcttacccggatgttaattgccgtagccattgcccattggataccttctaggcctttcgagtacggcgcaaggccactactgattgagccaagcaggcaggttttttgcgttgtgtcctcgcgtcgatgtaaacaagccactggagctcaacaggggagcagagccaacaggcactacagcacaatggtcttgtttggatccttcgggctattaaatagccatctggaatcttactatttaaaagtattaaacgtagattaccgacaaaatcgattccataacccctaggctattttgcgagacgaatttaataatgtatactaatccatgattagcaattgattactgtagcatcactgtagcaaattatagattaatatacctcgttagattcgtctcgcaaaatagattagaggttatagaatgagttttgtcagtaatctacgtttagtactcctaaatagtaggattctaaatagccttccgtactcctaaatagtaggattctagatagccttccggatccaaacataccgatgaatgggatgccgataattgcactgcgactgtagttagtgcctctgacgcctcaccaggaggccggccctgagcttttgccaccttttccctttgggagagtctgatccctgcttatgatgcacagaacacctccaagctctccttttcactgctcgaagggcacagtgacccatcatcaaacatcggcatgatgggcaagcgcaccgacggaagattcagaaagtaaaatgacgaaccaaccagaaaagaaagaaaaatgctgagaaacaaggagaagatgcagtgagaattcagcagggagaactgtttgctgtgaaattatggggggtttgctcgtcttacaggcaaaatggggaatccccacacaatccatgaaaatcatttagccgttgcacttctgtttgcacaaaccggctaaattaaaaacttctccattcagaaaaactagaacgggaagcatgttttccttcctttccctaccaaaacctgaatctccatccaaaagaggtagtagtcgctttcctgcaccaccactcaccagcactactactactacttctagtcatctactgccgattttcaccaagccaagagggcagaagaaccggcagaatccagcatcatgagctcctccacctcctcgatctcctcatcgatgtagtccctcctgcactcgttgctgcagaatgccttctctcccctgcattgcaacaagccagcacaaaggtttagcaactgagagtgagatataaacatgcaagtatctcatggaaatgcaggctacagacgagttcaggaatactcacagatacatgtagatatccctgtcctgctgcagcctcttcctgcagtagcagcatgagcgggaaacagcacacgccagcgtcgacggcagctcgccgatgggctcgatggtgaagattgacttcttggaactccttgggacacccttgcacacctccagtgtctcgtctcccagaatgtgcgtcgtcctcgggttcgggccgtgctcgatcacacaggtgtactcttcagacagagcaaagtctgcaatctcgtccagagtgacgctacctgaaccgttcttctgcattgcagcatcactcgccgccttcggcaacccgagctcaagaaatggcctgatggaatcaagaaacgagctcgtgacacccaagcacgaggagctctcgtcggcggtgagggcgtcgacgaggccgaggccgactctgggagggttagttctgaacttctgatcagcctcgacacccagtagcccagaggatttgagatttgtgcttccagtgctcgatgacaggttcttgaaatccaatggagaggttgggctccaggcagaatcagggtccactgcgttcaatcctttgctgctcagcctcacaaagaggccggggaccctgaagaacccagtgggggcagtgctcttctgtgcaaggccctgatcattggattcctccatggcttgctctttgatgagcggtggctgtcgtcttgttcacaagcaccaaagatgagagtaacctgtccctgaaaatagccaaaatttttgttctgttgcatatcaggtcggtcaatgatgatggaagcgaacaaaagtgaaaagaaattccagcttttgtgcttttttataactcatcaagtcaaaggtgcaaagaagagaaaagatgatgatgatctatgactatgagcatcataagtacataaacaatagtaaaaaaaagttagtacttgaaaaaaaggtggtttggtttactgatggcatctgtgcggcaggtccaaaaagcaagaaaaaaaatcactggttacaacaacgggcatctatctcatcttctcatctcattaatcaagattgcaaactaaaaacaagatcgtgtataacactcacttgatcaacatgatcgtgaccagaaaaactagaacaagcaaacaagcattcaaaacaagaaatcaacacgaacttctccccaccatcccctccctattccataacagcccagatcaatctcaatcgctttaaagaggacttcatatatggagagatgcggcggcaatacaacgctgtgcattacggcgaccatgaaagggaatttacatcaccaccgccagcgccaccgacccaagaatcccaaccgatacaaagacaaccgcatgcagtcccaaatcaccacctgatgaacccatctaatctcacgccggaaacgaagacgaacccaaccggaagaccaacaaactagtacatacatcccatcgatcccagtgcgccaacatccatgaacaggcaacgcaacagtccaagaaacgagcactagaagcttcaagaaaccaaaccgaggctgtggtggtggagtgctttgttacctggcgaccgggggtcacggcgaggctggttctcggcgtcgaggcggtggtggtggctcctctcctctctcgcgagacggggttaagaagggcgaggagagagaggcaggggggaggaggaggaggcggcttgcacagcaatctgcttcttgctccgctccagagtcctgaccctccgctggctgggttgctgctctgctttccgtgaggtttcttgtgtgcgtgggtgtgtttattgggaagaagacaagtgtccccgcgcggggcggcatgcagcgcaaaggcaacgggcggggggtgcggtggcttctccagggctcaacaccccacccctcctccgctttaccactaccatctctctgtgtctgtctctgactctcctagtttttttttaatatattttttcgtctttgaattttcttttcccttgcttttctttttgtttcttggaagacactctctaaattaaaaaaaaaaagacagtctctctctactctttggtagtgtgactgtgtgagacatttttgttcctttttttttccttcttctttgggtctacacttgtgctactctattgtttggttggagggatttaagtgggacttatgtttttgtgtttagcctctctctcccaaacacctacttatgtggtgtttggttggaggactaaagtagggctaaactttagtccctctcacaaaaacataagcccctattatagggacttatacttttgtgagagggactaaatttagtccctagttctcaaacacccccttactaacccggtttgtcagttgtcacttgggttgtttcatgagaagatatagtaaaacaaaacaatacagaacaaataattttgtacttatgcgttgcttttcaagctctcttgcgtgtcatgagtcatgaacgtaagtatcacgtcatacaaaaatgaccaaaaaaaaaagttcccgcacttcttgcagtgtttgttccatgagccatgactcgctaattgcagtgatttacctgtgacagatactgctttgcttaaaataactactcctactccagtataatactcatacaatgtgcttgacggagtaccaaacattgtactactctttatctgaaaagcaattgtgcttgcacgtgtggacgacgggaggtggcaaacgggcagcgttacaatttcttttttccgtcctattttgaccgccacggtgaaaacgttgaaaccaatacgtattttttgtcgccttgtgtggcgagggacagctaggcccgacgcgtgtacgacgttggcgtgtatctcgaggagcatcgtacgtctgtggagtagggacccgttgctttcccttttttttttttacttttcccatcttttaccgctaataaaagcgattggcacatgctaattacgctggtctgtgtctgacgcgagacagaattcgtacccccagtaccccacacaagttaaaactcgtagaacatggcatcttctcgtcctcttgtgaactctacggtataattaaggaattaaatttgaaaatatattgttcatttatttttaaaaaaaaatattcgggatacaaaatcttttacataaatataccatcagtctcgcacaatcattacacgaaaatggtgtggaaatgacatcacgatcggtatcgtgcagtgaaagtgcgagaccgcacagtcggtgcgagaccgcacggtctcgctcaagcaaccagcgataacgctccagcaaacaacgctatcgcccaagcaaagagcgatagcgtgccttgccgatttaattagcagttaattatcctgattatcactaattattattagttaattgttaattaagtaattaatcactaatcaaatgaatcctattgacaatgtcgctaattgtttctgcgagaccgaacggtctcgctctcgtcgagcgataccgcccgagacgtcatccccgcgtcattttcactcaacgaaagtgcgataagtttttgcatcccgaatatttctgagaaaaaaattaaatgaacagtaaattttcaaatttaattctataattaagcatgcgtgacatgcatgcttaacggttgaaacatgctgtgtcatctgttcttcgtggcatttgcacgttgccttttgttctttcaattgatcaatttacggaaaatacaagtcgtcatttgatttcgttggcgatagtatttcaagcaggcaactaaggcaagagacttgtctatcctgaccgtaagggcaacaacaatatatatggtaaaagtagtctataaagataggacccacatatataaacttaaactattgtaaccttcacagtatatatggatagcaaatagtattagtaggagagaagagatagagacaaatgatatattttattctctatgggcagctcatatgcttatgggtagcttttgttatttctttcctatggactagttccacaatgttggtaggtggctgaatcaaatattatacttgtattgcttatggaccacttttagagtacattgtggatgcccctatgacatgggtggaattcacctgtgtttgcacaaaattgtgttaggttgaaatgcttctaacaaaagccactctgaaggtgcattcttaggtctgttttagaacagatgattagtcacatgtaaaatgaaaatgaaagtataattagtatatgattaattgagtattagctatttcatatgtaaaaaaattataagactgtgttctttcctgggtgatctaggtgattgtgagtgagttttatttcgttttccacgcgcacgcttcccgaactactgaacggtgcgttttttgtaaaaaaattataggaaagttgttttaaaaaatcatattactccattttttaagtttaaaatacttaattgtcaattaatcatgtgctaatggctcacctcgttttacgtatcttaccaatctcctctatctcctctcctcaaacacagcctaagaagttttagttgaatgagatttctatatagtttgcatatgaaacacgccatttaaccgtttaaaaaatacgctaaaaatcgagctagtaaccaagcccatacatagtttagaggcgccctaaagccctaaccaggttaataatttttctttcgttttgagcttacaaccgggcaaatgcagtagtacgcacgtactgtcctatggtttcttgagattcagactagatgccaagtagcatggtgattagcgtccgtgcattaggtcatggggggcaggtgtcgattcccaacctgtcgttatcgcgtcggtaaccgtgtatcagcggcagtaaaatcgcctttaccttcgtgctaaaccctctcgtgcggtacgatgattaaggcaaggccggtttagattaacccgatccatgtcggcagccacgaaaaattccctctcgctcggagccctcgccctgtaccctctctccccaccctccactttaattactcgttttttacagtggcctttttaacttttccttggattgattacattttacacaggctgcagcagtgactgcattggcgctgtcactgcgtctctctgtgtgtgtgcgcgcgcgcgcagtatattttatttagcctgatgacatatctatctctctgcatctacctgcagcaacgcgttgtttgtgatgcaaagttttcaagcccacagttgtctgcacgtaaatggcatcgatgcaacgttgcagttgcaaagttttcaagttttggtttcactttcagatgctgccatgagcggattggctggccggcctttctctgtgttctcagcgaggaggttgaagactgatctgatctgtgtcctcgtgttttgtttgcacttagcacgatggcgttgtaggggtactcctacgtcgaagtgattgggcagcgctgatcgagaagtcttggtggtttgactagtagcgtcttgggctcgcacacaacgcgatgctgctctctggttgctggaggaggacatggctgtgtggtgtgtagtgcagccatggcaaaaaacaacaactttaatcaaagcaataacagaagtgcagtactttctctgtttcacaatataagtcattataacatttttcacatttatattgatatctatctagattcatcaacatcaatataaatatgaaaaatactaaaatgacttacattgtgaaacggagggagtagtaggagtataggtataaaaacagctttgcagattgccgaaacaaattgccaagctgctgcaggaatgattggaaccgcataaatataaatagttcagctcgatctgcaagtgtgcaagaaaactgcccttggtttacgggtgatgtctacaagtaactgaagaaacaagtggacgatatgtactcctaccattacatggcttaacttgtgagtgcttccaaaaatccaaagctagatagctacacgcttgcttttgcatatcaagaagctgtgctgatgcatgcttggtcgcttggagcaggggaaaacacgccacatcgtcatcgcatggaaaagttcagtaattcagtggctgaagaatcacaggtggctctctttgtcatgcggtttcaggtcgtttttctgaggatcattttggctacgaagaaccaggttcgtagcccatcagtagtactgaagtaccaataatctaccattacagtaactattaatacttcccgaaagacgaattaacataactttaggtataagcaacgggtcaaagacgaattaacatcacttatgaatttctgatgctctgaattaacatcattgcctcccggtgaaaccgcttattttcgtcttaaagtgaaaagcgaagagtaatatggtaggaggggttaagcactaatgcaactactgcacttgcatgccttggtctccaagaagaagcatctgaaactcgcatatgcagatatgctagctgctctgccttggtctccaagaagaagcatatgcaacttaatgccagcacactactgcatgatttattttcctgaacacctttccattttgttttcatgtggtccgtaagtggaaccgcacgaaaaaataggggaccggtaccgggatatcacctgcacgggaaaacacattatcccgtgcgggcggcttaagccaaccgcacgcgaaaatcagctcgcgcattttataaccgtgcacgcactcagtccgcccctacctccctccccactcctctcctcccacctccctctctcctctcctcccactcctgccgggctgtcgctcggccggcggcgcacggtgccttcctccctctccctcgaccgcggcgacaccgcgcaggcggcggtggtggcggcggcgggcgaccacaacaccccctcccctccctacccttccagatccggcggaggggaggcatgggggcggtggatccggcggcgcgccccccctccccttgcagatcggagcggcggcggcggttgggaggtgtctttagcggccggcgtggaggtggagccgtcggcaggaggtgcgatggcgtcggtggctgccggcaggaggtgcgatggcgtcagtggccgccggcaggaggggtcaacggcggcgggcctcggctaggcagcgacggcggtagattagggttagttttttttctttttttttgattttttgtttctccgtgcgagcgacttaagcccctgcacgcgaaaatcggttttcgcgtgtgggtgcgccacccgcacgtgaaaatcgtgattttcccagatgactgggtgcgtgtgggcccgcacgcacgtgaaaatcgtgattttctcagatgactgggtgcgtgcgggctgtccacctgcacgcaaaaattggctcgcccgcacggaacaatcggtgctgtagtagtggcaccagggccagctcactcacacgtctacaggtcgcttgctttctctgtggtctgtgccactgcggcgcagcctgcgcttacatacgttgcaactcacgacagattcattttccatttgaacaagacagactctcgtcaagcggacggcccatgggttctcgtgacgagggaggcccagatgaagttagaagagcccaatcaagcccatttggagtacaaaagaaaagctagtagtagaaaagtctagtatacagtagcactactagtacaacagcatgtagaggcccggagataagtaggcgtatgtgctactctaaactaagactagtttaccacggtcagcctcctcagtcctcacgtcacgcctggcccaccttcacgtgcacttagaatatatttaaatcatgaaaaataatggttcacttataatttatcctgttgtatagacgatgtgtgcacaccgacggatctaccgctgtgactctctgtgtccatacatccaaatgcacgccgaacaactcggccctggtcattgcgcgatgtgcaacatgtagtgcaacgtaactgcaagatagaggatgttttctagttcatatatagcgcacgctctctctgtgtgtgtgtgtgtgattgagaacgtacgaatgttttagttcatgtacatttctctttcggtgatcgagaacgtacgtctttgtatagttgcccattttcatatgcatatatggtgcgcacgctggcacgtgtgtaggactcttccatcaatcaatggttagttgaacaacagtatataggactacactctacggaactttagtgttgtcatgagtcatgcatgactgatgactccgacccgttcttttctccagcaagagttgaatgaagattaagattttcatggcatgttttttaaactgctaaacggtgtgtttcatgcgtaaactttctatatgaaagttgctctaaaatattatattaatctatttttcaagtttataataattaaaactcaatcaatcagacgttaataccaccttgttttgcgtaaaaaaaaacttaatcttcattttcatgagaaaagaacaccactaaaatgcataatcaatcatcgagatgtatggtgcgtttcatgcgtaaactttctatacgaaagttgctctaaaatatcatattaatctatttttcaagtttataataattaaaactcaatcaatcagacgttaataccaccttattttgtataaaaaaaacttaatctttattttcatgagaaaagaacaccactaaaatgcataatcaatcatcgagatgtacgcaggaattggccaccgaaatgtacttgtatatgcataaccacgagtactccttttatactagtataaagtactccttccattcttaaatataagggatttttattggatatgacacatcatattacaatgaatttggacataaagcttatacatattcgttgtactaggatatgtcacatccaaccaaaatgtcttatatttaggaacggagggaatatgtccgttttgaaagtaccgttagaggtgaaaatggttttgaaaattcctgatcgacctacgttcgttttcttttttacttttactgctcgaccatgtgaaaatagttaaccctgaaaactaagatgaaaatggtaaaaataatatgaaaataaaaacataaattatttcacgttatactggctgtttttgaatcttaccatattcttaagaaaattaacgtatttctaaatgcatctataactatcctctatttctttatttgacctatagtgtagatacccatcaactcctcaatcaaatctttaacaaaagtgcatggttaaaaggaatcaaatccttaactaaagtgcatgattacgaagaagaccgtttgtttgtaatttatgtagtgtaaccttgaattagtctcatcatattatatagttatataaagttgtgcggttttataattagaattttgccttatttattactccatccattctaaaatataagtatttttagaatagtgctaagtcaaactttttaaattttgactactaatagaaaacaattaaaacaattaatcatgtaaatttaatgttactatatttatctttaaacgaattatcataatatctaactctttatatttaaaatattttacttttatagatactgttggttaaagtagtatctcgaagaccgtatcgagctctaaaaatacttatattttgagccagtatgagtttatattaacgtattttgttcattatatagttttgttttcagtttttca

SEQ ID NO: 42103 - DNA, 29058 bp, Oryza sativa
  unsure (1)..(29058): unsure at all n locations
gccgcaaccgcatcgacaccctcaggaagaagtacaggaaggagaaggagaggatgcgcctcgccgcccgccgccccgaccgccccgaccgcccctcgccttccaagtggatctacttcgacaagatgcagtctctcatgtgcccaccgccgctcccgttgcagccacccgtagtgacgcgccgccgagacacgcagccggtgccgcgccaatcttggggtctggacgccgcggagtacgtgctgggcgggtgtgagaacgcgggaacaagggattctgggtctggtgcggaattgggtgaagagcagccaaacgaggctggtgcagggaaaggggaagactttgagttgctcgtggagtcgattcggaagcttggggatgtctatgagagggtggagagtagcaagaggcagcacatggctgaggttgagtggttgcggagggatctccaaagggatcttgaggtgaggaggagggagattttggagaaggcgcaagcagagattgcgcgtctcactgaggaagatggggaggagggtgacctcaaggagggtgagggtgatgataacaagaggtttggggatgatggtggtggcgaagagtagagcaatgtcgccgtgaatgcttattcttagcctagggtctgtaagttcgggaaatcaggttggtttactcatacaggattatcactcatcttgaatacccatccaagatagtttgtgatcttgaatttagtgacaggcctgtttcattctagcatcacacttagatttgttgtgtttgatattttgcatgctttatgtggttatgttgaactagcatccaagctcttatagttgtatatgtcattagaatatcatgttaagaggaaaacttttctggtacagaatatctcttcaagaaggatgttcacttagtaaaatacactgctttgaaatttttgtggtagaaaatagggcaaataccctttgcaactaaaccataagcttcgtactggtattgttatggaaaagattgaggcaatgttttagcagtgaatttgaaatgttgctgaggctgagcaacgttttgcacagtagcaatttgactctgttacccaatcattaaacgggaagttgtgcaggcacataggatttatgtagtgtcagcactcttttggactgctctatttgatagctacttcagaaatgcagttgttaacatactctgtataccattcctggattaattttttgttgctcttgctgctcataaatccttatactgtaaactctgttggaaactatattaatttaagtttccagtcttccttggaagttgttgctttgtgagcgcattgcgggcacatatccatgaatgtatctttatcagtccctcttgacatcctgcttttatctaacattgttatgctgtcccttggttgcttttcaattgttattttttgaattctgatacctgcaagcatcgtacacatacttataaacctatgttttaatttcgtttgtggatgtggcttgacatgccagttgtgtccttgattttaatctccgggtcacaattgttctgctggcagtatgttaggaaaaacatcatgttaatattctttcagcaggtccttagggtgtttttgttgtatgcctcgacttgccttttcaattgtttgatactaccccttgaatttggtcttatttggatggttgctaaaatttgccatgccgatgtcctgttagagtttggtggcattccatacatctattgccatattggtggtaaaaagataactttgggaacatgatttgttggcttgttatctagtatctaagtttttcactggaatgcatgcttgcttaagcaagtcttgtaatataagcaccccatgtcttggacgttgagaataaactgtttaattttggtatttcagggctaaaacatggattttgtgttagtagttggatccacaaggattgctgtggtagtcgaacttacatctgtaactttagatattatatgattttcagatcccttgattttagattgatttgatcagcttacacgactacacccagtgcagattgtggtgtaggtctcctttgtatttcttgtaatcaaaatagtggttctcatttaattgttgtatctgtctctttgggattgatacaattagtccattactatgacaaatcagtatgtattgggttcattaagttttggacctataatcataggcaatttgtacttcttgcaaatgcacattgtacagctgcatttgtaaatctcgtgtcaacccagggttatgtttggcgcttcctgcggttgtaccattgacagggtatgttagtatttattgataggtatatctatctaggaatctcgccatattgctgacggtatcgtatacaaaagatggcaggagaaaaacaccaaacacatcactgaacgaactaaccaaatatccctatcaattacaggaacagaaacatcaaaaacattaattacaactaaaaatctcagcgttgcaactacgggctagattctctcttccatcaggcgtagaattctttcatcaggagcagtagaattgcttgccacagctagatgatactccggcccgtcggcggcggtacatcgcaataagccatgcccacaaggcgatcgccccggcattgaacacggcgatgacgcaggtgagggccatgacgacgcggttgtcgccggcggcaaccaacacgacgctttggacgacgccgagagcgaggccgacgccgacgaacccgacgctctggatggccctgtcgacgtgcgccggcgtgtgcggccgcaggtacaggctgacgtaggacctgacgcaggagaccgtggacaggtagacggcgaacgacaccagcagcggcagccgccacgggacgctgccgaagaaggaggaggcggcggcggcggcgccgtacgactccgcgaggtaggcgccnacnatnaagcacggcacgacgacggcgcacgcccacacctgggcacgggacacgcccgaccgcgcctccccgaccgtcaacggcgccgccgccgccatggtcgagacgatcaagctcacggaatgctcaacgtaatgtttgagttatgcagtttactacaagtctacgacgctcgccgcgtcctccaccgagtgtttttgtatttatggcaaataactgtaagtccgaatcggacaatgggtcctagattccaagttgccgaccgcgataagaatacgattacgaattgacgcgagttggcggcagccatggacggatacggcacgctctgtgctggggctacagcaagattctgggtttagacccatggaatcgggaaaaaggtcaattttagcatttaggtctctcaactataggttgagtctcattcagttattagtatcattttcaaagtacgcaacgtaggctactgcaagatcgagaagagtgcctagaatcaccatgtgaaaatacaattcttctgcaggagcacattagtacgctctcaagaaaaaaaaattgttgagagagtaagtgttctctaaataatgttctgccaaggcaatatggcttatcctaccaactaaagaacaggtgatcgccatctcttatcacttcaatgtcctctacctcggcacctcccacggtgagaatccctctcgctgccttcccaaacttcttttctgcaaaggggtatccattcacaacgatgataaatctgttgcttgatctgaacatctgacgatgttaatctttatgcagagcacaatttacatacctgaaagtttcatcagatcttgcatagaatctggcagtatgacgagcttcccagatgagccgttcagtgctgtgccagtcccatttaagaggtgttcatgaatagatacccgtttgggttctttgcatggcaacattttgtgagctgactctttggattcatctacatcaaacatggttgcacttcctaataccgtggagtagccattgcgaagatgatccctaacaaaggctgtttcctttgccttcaccttcagagattcaaggtactgaaaaacgttgtgagaaattgtgaactgagaaaaaaatatctatattgcattcttgaataaaatcaaataccagaacaaaattggagaatacaacgaccccatctgcagtgttaggccggatggtcgagaccatatggctgtggcttatacggacgagctgcgtgagctttctgctccggatggtgaacggctgtgggatgttgaacatcaccccaatttcccctgccattccccgtggccctattctcatcacttgctgaaatgtcacaattttgatcagaaccttttcaggtcagtatgcaaatgccggaaaaagttcagtatactgagaagagtaaggccgtgtttcgttctttggccaaattttttttaaatatacggatacacttgaagtattaaacgtagactaataataaaataaattacagattccgtctgtaaactgcaagatgaatttattaagtctaattaatctgttattatcaaatgtttactgtagcatcatattgtcaaatcatggcgcaattagactcaaaagattcgtctcgcaatttacatgtaaactgtgcaattggtttttttcgcccacatttaatgctccatgcatgtgtccaaacatttgatgtgactttttttaccaaaaaattttagaatctaaacacaccctaagcttgaaatggtataactgatatactaagtgcgtcaactgggttctcgtgtgctttaccttctctgtaccatcctcaagggttgtcaatacctcctgatacaaaataaaagattaagagaaatgcaggttgtcagagcatgaacagcgaagagaacaaacgtcacacgaggcatgttcttaccacttcaccagacacgatgatgtagcagtccgtcgaagcctcgttctccaggatgatatccgccttggggggaaatgactctgccttcatctccgcgacctgaatttaccacgttatttagtcagtcacccaaccggtaaacgcagagctattccgaccaaggcgtttgctactgcgtgttcaattaccagcggcaggacgagcttgtcggagacgccctggaacaggtagcagctctggaccgcccctctgaacatgtgctgcgcgatgcctgaccgcacggccttgggcagctcggacagcatctcctgctgcagctgctcctccgccctgaacctgagctgcaggctttccatcatctgctccctcatcgccaccggcagccggttcgttctcccgaacaccgacgtcctctgcaccatgtccctctgcacacaatgccatgatcaccaatccgtgtcaaaagaaaagaaaaccatgatcaggttttgccaatatttaccatcttgaaggtgttggtggtttcgtggacgacgaggttggtgatgttgccgatgatgtaggaggtgaggcccatgttgaagagcatgaaggcgatgctgaacaacatctcgcccgtgttggcggcgtgcaggtcgccgtagccgacggtggcgagcgtggtgatggaccagtacacggcgcaggtgtagcagaaccacacgctgcggtcctcgaagccgtggaactggctgccgatccacgtcagctccttcgccttgtggtggaacgccatccacaggtagatgcacgaggcgaagtgcactgcgaacagcgtcacctgcattgcaatcatgagcacacaagatttcgtagcaagttatttgtatgaactctgccgaaatatagtactccgggtggaacggcgtggccttacgtagaggagcttgataagcctggtccacaagtaactgaatctaatgtccttctccaacctgcaagattcagaatttcatatcggtcattgatgaatgatgatcacatatgcatactgtagttattcatatagcattacatgccacccattggtgaatcatgctaccaactcaaagtcacgtagtgtatctgcactactactgtactacagggatggaaattgaggcggccaagctttctagaaatttatttattgtatttttctgaattatttaagacaattttttgttaagagctagggaactgacaaatttttgaataattttagcttaaaaaaactgatcaatcggaggctcggagctacagcaattataaaccaagccacttaaacgagctcttttcccccacactcgcactgaagataaagacaaagaaagaaaagtctcttggtccactcacttacaaggttgatatcatgaaagaaggtactctccgttcttccaaagacataagaatttctaggttatttagcagatattaagattaagaaaatatatattgctcgtcattaaatgagagattgataggagtgcgagagtgggagggggtattaaaatagaaaggaatttgaatgacgtgaacgatggcacaattaggctatattctttaatctattgtcccaacttcatcttccttgtttttcacgcgcacgcttcccaaaatgttaaacgctgcatttttttaaaaaaaaattctatagaaaaattgttttaaaaaatcatattaattcattttcaagttttttgctcatacttaattaatcacgcactaaaccgtcgtttcgttttgtgtccaatggtggaagagttctcaactcgaattggcgaacacaacctttagttagtatatacaaatgcttataaatgcatatattatgtacaaaatttaaatccaagaaatgtttatatttgaaaatggtgggagtactatgataataaattaccttataagtcaggccagtagtgctaaggcctcctttggatttggagggtttctttttggatttgcaaaggatccaaatccttaggattctattcctatagtgtcctttcgattgaaagaatactacaactttgaaaatcctatagatttaatttcctatgcctcatttcaaaggaaaataagcactctcttcctttctctctctactctctctctctctctcactcaaataaatttcctctagaattcctatattttatttcatgtgaattattcgaaggcactagttctggtattcctgtgttttgaaatcctataggttttacaagagcatgatattcaaatcttatattttttcctattcctatgttttgagaatcctatatttcaaaggagctaattaaatcatgctgcgtacaaaaagccatacgtacttgatcacaactctacaagtctgcaatacacactcacacaaagtactgcacactcacgtactaatcattcgtgcgtatatgaagttatgaactcacacacaatctatttgaccgagatcgtccattggatgtggagtatttaccttgcaaagagcttgctgacgcgccgtaatcgccagagccggagaagattgagcaacccatacaatgcttgtcttttgccgctcactatccggtagatcatctgtaaaggaatcgttgaggcgacatccagcgccaagcatggtcgtgccaggtgcctaaaaatgcaagtccatcgataaatattgaactctctgacggagatactccctccatttcaggttttcaggttataaaatgttttaactttggttaaaatcaaactagtttaactaagtttatagacaaatatagtaatatatataatactaaattagtttcatcaaattaataattgaatatatttttataataaatttgtcttgggttaaaaatattcctactttttcctacaaatttaatcaacttaaagcagtttaactttgattaaagtaaaaacgtcttacaacctaaaatagagagagcagcaaaaaggaaaaaaaaatggacatgcagtgacggatcagcatcacgtatacctggtggcgatcttcttgcggtcggttacgaggaggccggtggaggcgtcgcggtacgccacgaagaaggagacggcaatgtcgacggcgaagaaggcgtcgaccaccagctccgtgacggcgagcgcggccgaggccgacttctccatggccagctcgaacggcgacgcccacgccgtgtacagcaccagcacgatcaggaacttctgccaccacctggagtggaccactcaaaccagaccgatcgatgtacaagagttcagttcagttcagttcgtgatcgatgtataatggatgcaggttgttcgatcacctgtagctgcaggtgtgagggttaacgacgaatggtcctagcgaaggagagggctcgccgaatgccggccggagaagctcgcttctggaggcggccatgccgatattcgtcaccggtagtatggatgcccctgcagtgctgctttgtcttgccattctgctggctatgcctatattatatactgactctgcgtgctctctcctttgttacctcgtcaagttggtgatctagcttttgacgtgggctcaaatctgcaggatacgaccaagcgaggaaagagttcaaaccaaaagttttgaaagggtgtgtgccacagtccactaatcaggaatccactagagttaggatcagggtttataatatagaaaatccgataaatggcatttacaagcgcctaatttcaaaaagtacgagttacattaaatatgtgtttaatgtataccattatacaagtaactttatctcagaaatatcatcgtcgttaatgttccgttagcaacccctgtcaagtgctataggataaacaatacatttaatggagcgggacataaccttaacgacgatgacatttctattacaaagtcacttaggcaatgacattttataaaactcacacttatcgatagtattttttataattggttgtttgtcaatagtatattttggattttctcttacagtatcgacataaccagtcatttatcacaataaccagtcatacaaggggcattgcatttagaaaccgctcaatagttcaaacaaggttttcttaattgtactaaaattttttggacaaaatggtttgagacttactagttttcaaaataaaatgatcggttattacttctataaaaaaaaccactaggttatgacaatcaacagcaaaatcattttaaaatcattttttcagataatgaaaaacaaaatcatagactagcggttagcggttatagatcggtgcctaaactcatatggaaaaccttggataggttccaacttcgcttctcagacaatgttatccgcgttgatttgagaagcatcagtgccttcttttgtaactttaataattggactaaaattttagcaatggtggagattatggtcaataaaacatagagataatattttcttttgagcaataattgggtcaagaactataggtatgatatagctagctattagtgagatatctagctagctcttcgttcttggtagtttccataaagggagagagaaagggtaaccttaggccctgtttagtttccaaaacaaaaattttcatgctgtcacatcgaatgttacgacacatgtatggagtattaaatgtaagaaaaaaaaaccaattacacatattgcatgtaaattgcgagacgaatcttttaagcctaattgcgtcatgatttgacaatatggtgctacagtaaacatttgctaataacggattaattaggcttagtaaattcatctcacagtttcctggcagaatctgtaatttattttgttattagactacgtttaatactttaaatgtgtgtccgtatatccgatgtgatagccaaacccaaaacttttcctaagtccttaatgtacacatatatatgctgatatgcagcacactgtagtaaatttcctggtgttgtagcgctaatcggcactgtaaaataataaataaatctggcaatcttttatagctaaaaccaaattataaacaaaataaataccgataattatgtaaacttttctttaaaaggcgaatgattaaacatgtgtcaaaaagttaatggtgttacttattaaaaactggtagtatgatattagaagaaaactcaacaccagttacgatgtataactgggtgccaattaatttttagtttcaaatttcttaaattggtaatataaaatgtattgcttctaaattttgaaattattatatcaagaaaaaactaaattaagattccaaaccgagtgcagctacgtattattaattctaaattcaaaaattcattaagacttcatgacaagtacaaccttgtatttattaatgaatgtatttaataattactaaattaagaagataaaaggcagcaaataattaagtattatagtgtattcaatactaatattgtaattaaactaaatcgttttgatcttgatgactctaaagcaagatatacacttatgcacagtatataaaataaatagttcatgcaaacacacaagttatctcaaggatttaccggcctagtctttgaaatagaatttgcgtgcgtgtgtttatagaggtaagtgcacgtgcattatgagtgcgttgtactgtataatataaaatatatatatgtagtagctcttacagttgacatcatacaaagtcatatattgatgttatattcaggtcgcgtactgatgatagtacgtgagggggcttaatcatgatagagacgaaaccaatggttaattataacttgccaaggatggtgtccctccaataaatggtctgttttcatacatatacgctctgcaacattgacgataccttcatgaacagaaactaagccaaattcagactttcgtatggcctatatgtatgtaccccccatggttggcaccaggacgtaccagctttgcacgggactgttcctgataatgtgtttactgtagtactctagcatcgtactaccaccatctcatattacttgtcgctttgagtttttaatatttaattatttatcttattaaaaataattagaattattatttattttgtttgtgacttgttttattattaaaagtattttaattatgacttatcttttcttatatttatactaatttttcaaattaaacgaatgatcaaatgttacaagcaaaaagttaaagcgacatctattatgggacataggtaatactatatactccctccaatcctatcttaagtatagtggattttcgtggtcaacgtttgactgtacgttttatttaaaaaattttaaaaaagtaagtcacacataaactactattcatgttttatcatctaataataataaaaatattagttataaaaaatttttaaattagatactccctatgtcccataatatagcaacctagtaccgaacgagacacttcatagtacaacgaatctggacatgaaatatgtcatgtttcgttgtactatgaagtatctcgttcaagtatctcgtttggtactagggtgctatattataggacggagggagtagatggttaaatattgaacacgtaaacttacaactggactcaattaaaaatgagacgggggagtatatagtacgagagctattaatgttcacttttctaatttcaggatttcagcacttactaaaagtatataggccggccgactagagaagtagactttgcggctctgcacccgtggtgaaccgaaatccacatgaggctaatccaacaaaacttttctgttagtgccatgagttcaactacagtatttgagtgaggccattagaacacgccacataaaaaactagtaagtaaacctaaaaacaaaatgccttgccgtcatgtatatatatcacgctcacgcacatacacgaagggaatcaaattttctagcaaatatgtaaaaacgaagaacaagattttgctgcatttgattaggtaggaaaaaggaacatgtacaggcggcgtagtagtgctgctacgtacctgcagggagctataggaagacgctatctgaacgcaggacagcatcgagagaggccatatgctcgcaagatgcagaagagatgctcgtcgtggtggtcgacgactcgacggccgatcgagctaaacatgcatgccacgagaacagctaggtaaatagaaaaacatgcggctatgaatctgtaaccacggaggcagttccgtatctgtaggcagtggatcttcctctcgcacggtccgtcaaggactttcactgggaaactctttccaattccttgcaggatcggataagaagcatgcctacatacatggttgcgttgtattccgtcgcgattcttttacttattaccgtcaggattaaagaccaggattggcgcccttgatttcattattataactctgtcacggcatgatgccgcgatttcattccccagatatatatcaattccatgctctgcgatcgtctcgttctttactttgcattggcgctagctcgatccgtcgctcccttccgttgattaatacacgcgcatcggcaatctggcatggcgtagatggcgcaaaccgggcggggcgcatcgcctgctgccttttgagcgctccttcgaagaaacggcaagtgcttggcatcgatcgatcgatcggttctcgcggcgaggggtgcggacgtgcggctgcctcttgcgtttggcataacacggacgaccgggtggtggttcactcatgcgtggggtacgtgctagcggagctgcgcgcgggtgtccgaggcgtttgacaccatacggccttcggttgtcccggccaagctgcgaacgcttgctgcagccgactggcgacgaccgcttggtgactggccggtgcgcagaggagcgcgtcgcagcgatgctgggtacgtaacttttgttgcaacttgcaagttggtttgtaagccatcgtgtgtgggcttcccaggatccaacatggtggagaggttcggaaccgtgaggcggcatacggcacgttgcgtacgttgcatagtgattcagcccattcaaccacccgcgtctaaatcccaatacgatatcgttcaggtccaattcacatattttcagcaggaaaaagtacatacgaggtccctcatctgtcaccgaactaccaaatcatctctcaatcgaaaaattagatatatggcatctctcaacttaaaaaaccggtcacttaagatccttagacggtattgacaacagttttatccaacgtaatggttgagttagcgtgggtcccacatgtcaggatgacccacatcaacaccctcttgatctctttctccttttctctctcttctcctctatctctcacttttctcattgtcgtctgagtaagtggaacagggtggtggaacaggcaggagaggaggtccagcggtcggtgacgagcaacgccatatctgagtaagtggaacggggtggttggatgcccgaaccacagtggattagatccagatggcacttatggtggagagggggcaacggtagagacggatcccctggagctacacaggcggctcgacaaagagctctaagagcatccgcaatggtaaagtaaggtgctacctataaaacatgtacatctcagcaatagactagattaatagtaaaccactttaatggtatgtctacttgggtatctataactctctaatccattgcctcgtttttctctatagactatctacaggttagtagatagctttgttctctctcttcatttaatctcttccaagtaagaaaatatgctaacatggatatcttgtagagagcctatagataaccattgtgggtgccctaacacataagagcttccccataaataaattgtggcctctactatgaaatccacgtcaccttccatgtgacctcgtaactttcagcagcacactccggcggcggcaaggcggagatgtgtggtagaaagtgccgacgacgctggaggcttatcaattgttaattaatggttagagtttttattatctcaattgttttagaatagtcttaacgtgtattttctaagagccaacactggacttagtttagctcaatggcacacaaatcagtactatgttgtaattttttcttttcccctttgcgggggagtacgttgggaagaactttatttgaacgaacttcacggttggcacataaacgaattactggacacataatgggtacaaaaattgcaatttagaaatttcttccgttagtaataaattatatggagcacaacacgtatcataattcgctcttatttcaacgtcttcgttgaacttcggcatgataaaattctacaacctttgggcaagattttaaagaacacatgcatgtacatgtacaaattaagaaaaataaagaagctaatattcagggaagagctgttcagttgcctccagccctccactcagcggaacaggcacatgacgaagatcgccgcgagtacgagcaagtgatcgatcccttggtcgatggccattcctgcaagaggtgcaaacaacacgcgccaattcaatcagagtgcaggcaactcacctaatgttagcccggaactggcagccgcgacgccgcgatgcgcaaatcttggtgcgcgtataaagtcacaagcactaaccgtccatggcgagcttcccggcgatggaggcaggcgaggcggcggcggcgccttggcacagcaacgggtgcagcagcgcggcggccaggaagttggcgagcacgagagcttgaggcctcatggcgtcccgctccgttggctcctgtgttgtcctgtggtcgatctcgtcaggctacgcttgcagaaaggctagcgtgactggagattcttggttgcgaacttgcagtgcagcgttccgatcggatttataaacgcagggagcaacgaacaaccggcgtcatttgacattcgtcacgtcttcgttgagtttagcttagcctttcgctgatctgacctgactttggtcgccagccacttctgactaatctgtcttcctctgtgtgtccgtctcgtcaactgccacgtgtagctctcctatccgccggattggcagcgacgtgaagatcgaacggttggaggaaaaaacgatgaatccgtcagttggggtaggccaccggccggatttgaatccatgggaaaaatttcagagaatgaatgctgtgtgccaatctcggccggcaggaaagcgggtgcaactgttcaagcgcacgccacacatgtgtgcgcctgtgatgcgttttggcgtcaggtatgccgtctaaaataattgcactggaacacacagttactgttcgcagtggtctatagctagcaatcctagcgtggatgtgctgctttctagctccatcatctctaaatcttttataagcacaagtgtggaagtacaatccactcgagcactcgacccggccggtttgttcggtcagcactgcctaattggcaattctcgtcggttttcaacaaacattttagctgacgtttgatcataccgaacatatcctaccccacaatggttccagcgggcaatccggcaagacggcaagttagcgatcacccgtagagaggagcgccagaacagaacggaacagaacccatagaccagtagtgctctgcaaaggtggaagcccacggtgtagtatttgccagcccaacccacgcaacccacacacgtgatgtggcccactgggcgctggcaatgttggggggtttcgggctacgtagattagattagatagacgacacgataaaagcaaagacgatagaattaataacgggaacaaagtcccgtcccccgagagagtttaattgcgaccccaacctagcgacgcaacagacatctgttgcaggggacggacatacgaacaatcaaacaaacctagctactcctactacccccagcggcaagtcgaagcaccggacgatggtgaccaccgcgccaggccggcccagtcgtcgacggattggagtctggaaaggaggagagggtcgtgtatttaagcttaagcaggagcaagcaaagcagaccacctcgccatcacagcattcaaagtgcaacgatggggagtggtggtggctactggcttagccccacggtttacgccgcgtactcatgcgacggagctaaataattgcccgggcgccggcccgcgcgccctctctatccggctctcacgtgcggcggctagccccacccacggtgccacaccacgtacgccacggtacgtcgcggtatttactcgccccgcccgcgcgcgtacaagacaattgcgcgtaggtacgcgacgcgcgcggacggtacggtggggaggtgtttactaccacttcctacccacgcgtgcggctctttgttagactttaatttgttgcggccattgcagcacggcttccgtcgatacctcgtgctacgtagtactagcacaccaaggtccagtaaaaacatcaagacgaaccaaactgttcgcgagatttttaatttgtttttttaagatagctttgtcaccttgtcgttgtcggtaagatgagccatactagtattgttactgtggtgctataaccatgcagcactgcagctgcatgcacaagagatcgatcatcgatgtacgtagtacgatgtgtagggcttgtggccgccatcaatccggtaataagcgaaccggttttgcttcgaggccaccccggtcaaggcagggggaagaaaacaacacgaatggccggttcgtatgttgtgaccattttctccatcggagagaggcaaaggacgggggcggtgagagatctaacggcagattgcccgtacccggtacccctcccacgccaccacacccacacccaacggctgcgttcggccacagccgcgtgggccccctcccggaacctgaatccgacggctgcgatcgcgccccggccgtggtcccgggacaggcgcacgtgctgactgtcacggcgcgggccccgccaatccatcccccgacatctcccagtgacttgtccaatcaggcgtccacggccacgctcgtctcactggaggacgggacccacggatcgtggggccgacacgtcagtggggaggggagggagggatggtcttgggccggatcggctgtggcatgagtggtggggcccacatggcacgccacacgggtattgtgctcccggtcgtagctccaatatgacgcgctcggatgagacgcacgggtgtgcccgtaacctcatcatggagccacttctaataaagctccttttgctttgttttttttccccttctcgccttgactgaatctttcgaactttacgtttgttttgtttaggcttactagatcttaatcacctcgagccaggggttttgctgtgctaatcatgaattagcagctgcgtacgttttatggtgttctgtatacggctgtttgtactgcaggaaaaattcgaaggataattctagccatgttatatatgtatgggaggaattttgaatggctatctcgccttttgcagtggaatacagaaaagaaatatggtatattgtattcttcaccaatgtcatactaggcaacattgatgcataagcatatacttgcagtggagtatatgcctatgcagacttgattggaaggggcatttctttttttgaaaaaaaaaaggggtagaagtcagcctctctatattcataagtgaatatacatagctataaaacgagcaccgttataaaggaaagttttacttacatacttagtttttcctttttaataggattgtgacgagatcagtacgcacacttcgctttctatatatcttgatcatgtttcgttgttgagtttaacttactctagctaattaagccgcataatcaattattctctactttcacaattttgatacaataattacttaaaaattaatttatactatgataaatgagaggagaaaaaataaacttaatataatataagacgaagggagtagatgctacagcactgaggagagatatttcagtagcggagatcgtaccatcttaagctttgcctgagagtttctaataaccgtaacttatttcataatatctacctcccttaaactgtttagattctctcataattttcaagaatatgtagtcataatatatagtaaagggattagaagcagaaacttgataaacccatcaaattctcaccaaagctacacaggccccgttagattccataaaaaaagtggataattttttggataaaagtggcacgtttttcaaactactaaacggcatgtttcgtgtgaaaactttttatataaaagttgttctaaaatatcagattaatccaatttcaaatttataataattaaaactcgattaatcacacgttattatcacctcgttttacataaaacacttaatttttatcttcatatcaaacaccgtctcaatggtttcttaattcttgatttctcatgtcccctgaatatgaagtaaattgaggtgcggttgccggtaagcaatacctcgagagaacttttacttaatacatagtatattgttaatatatattgtcggtataataaggacaatttagaattttgtcacaagattaaaagatgtgataacaatttaatctaaacccattgatcacttataccgactatagatattatactaatacagtgtatacgtaaaattctctaccttgaaacccagtgcagcattggactgcccccttatccactggtttaatttagtctagtatatatagagtacataaacaaaatttgcttcttttaccatccttaacacatttattaaccaattgtcgatctgacccccaatgcatggatagtttaggttgattttgtcaggcaattctcatggtcaattcattattttgaatcaaggtttatgatatgtgctccgatatagagttctcattccttttcatagacatatacatctgataagtacctctaacatgcgtacacaattcttactgtctcaggtcataccaaggaagatcttattgtcacacaattgattccattgaacactgtacgacaatatcttgtaaatggtcagtaaaacctgaaagtgcatgtaccattaatctttttctagccaaaatttatctttcttttgcgggtaggaaacctttatctttattttcacggcgcagtgtatccgcggcgtgtgacgatctcatgcctgtcagggcagggaaacgtacgtacgcgatcccctcccccctgatcaggcgatcactgcaccgtcggctccgtgacaagtaggggtggaaaaaaagtttgggctcgcgagctcagctcgggcttggctcgagctcgcttagcttggctcggcttaaataccaaacgagccaagcctaagcgtcctttctagctcgtttctgaaacgagccgagcctgagctgtctcgcgagtcgcttgatttggctcgtgagcctacgctatcattaattatatgggtgattttattttctagtgaagttattatttgtcaatatgtaatttatcatttatattttgatgaattgaatatataaagttattttaattttacatattaattatttgttattactttttttaatgattataaattatatagcttaatggaaggctcgcaagccagctcgagctagctcgagccacaaacgagccgagccaagctcatgttttagctcattgctataaccgagccgagccaagccgagactagcttgttgcgagccattgcaagccgagccgctcggctcgtttccacccctagtgacaagtgacaacgtcgtcgtgggcatattggggaagcggagcaccctgaaaaaaaggtcgcacgccgcagcctccaccgcacgcttcttcggctcccggatcggatctaccaccccacttcggaaattaaagacaaaaaacccttcgcgaagcaacgcaagcccacgcgtccggttccctccacgagtccacgcccgcccagggattccgcacgctcggaacgcgacccgagcccatccgcgcgaggccacaccacaggcgtgaaatccccgcgctgcccacgagcccgccgcagcgccgcgcgagggcagtccggtcaatccggcgcgcaaccctccccctcgcgacggcacgtgaccgcgcctcgagcagaccaccggctgtccccggccgtcggatcggatcgggatttaacctcgccgtaagccgcggataagcgcgggggattagaatacttaacctctcctctgctctcctcctcacccggcttaagcgcgcgggggggctgcgattcgcaggcgagagcacatgccatgtgaccccaccccaccactcctccctcacctacagctgttaaggccagtcacaatgggggtttcactggtgtgtcatgcacatttaataggggtaagactgaataaaaaatgattatttgcatgaaatggggatgagagagaaggaaagagtttcatcctggtgaaactcgtcagcgtcgtttccaagtcctcggtaacagagtgaaacccccgttgaggccgattcgtttcattcaccggatctcttgcgtccgcctccgccgtgcgacctccgcattctcccgcgccgcgccggattttgggtacaaatgatcccagcaacttgtatcaattaaatgctttgcttagtcttggaaacgtcaaagtgaaacccctccactgtggggattgtttcataaaagatttcatttgagagaagatggtataatattttgggtagccgtgcaatgacactagccattgtgactggcctaattgctctccccctctactgtgtttgcgtctttcttcttcgcttctctttctctctctctccatctcctcctcatcacttcccactctcccccttctgtctctctactttctctctctaccgccgctctcgcagcaggccaggttctctctaatggtcgtgaggcagtgagctcgctcgtacatggattccttgtgggcagcgatagcggcactgtttgtggcggcggcggtggtggtgaggggggcggcggcggccgacgacgcccagctgctcgaggagttcaggcaggcggtgccgaaccaggcggcgctcaaggggtggagcggcggcgacggcgcgtgcaggttcccgggggccgggtgccggaacgggaggctcacgtcgctgtcgctcgccggcgtgccgctcaatgccgagttccgcgccgtcgcggccaccctgctgcagctcggcagcgtcgaggtgctgagcctccgcggcgccaacgtcagcggcgcgctctcggcggctggcggcgcgaggtgcgggagcaagctgcaggcgctcgatttgtccgggaatgccgcgctccggggctccgtcgccgacgtggcggccctggccagcgcctgcggcggcctcaagacgctgaatctctccggcgatgcggttggtgcggcgaaggtcggtggcggtggtggcccgggctttgccgggctggactcgcttgatttgtccaacaacaagatcaccgacgatagcgacctccggtggatggtggatgccggagtcggggcagtacggtggttggaccttgccctgaacaggatctccggtgtcccggagttcaccaactgctccgggcttcagtaccttgacctctccggcaacctcatcgtcggtgaggtgcccggcggggcactttccgactgccgcggtctgaaagtgctcaacctctccttcaaccacctcgccggcgtgttccctccggacatcgccggcctcacgtcgctcaacgccctcaacctctccaacaacaacttctccggcgagctccccggcgaggctttcgcaaagctgcagcagcttacggcgctctccctctccttcaaccacttcaacggctccatcccggacaccgtagcctcgctgccggagctccagcagctcgacctcagctccaacaccttctccggcaccatcccgtcgtccctctgccaagatcccaactccaagctccatctgctgtaccttcagaacaactacctcaccggcggcatcccagacgccgtctccaactgcaccagcctcgtctccctcgacctcagcctcaactacatcaatgggtccatcccggcatccctcggcgaccttggcaacctgcaggacctcatcctgtggcagaacgagctggagggcgagataccggcgtccctgtcgcgcattcagggcctcgagcatctcatcctcgactacaacgggctcacgggtagcatcccgccggagctagccaagtgcaccaagctgaactggatttctttggcgagcaaccggctgtccgggccaatcccttcatggcttgggaagctcagctacttggctatcttgaagctcagcaacaattccttctcggggcctataccgccagagctcggtgactgccagagcttggtgtggctggacctgaatagcaatcagctgaatggatcaatacccaaagagctggccaaacagtctgggaagatgaatgttggcctcatagttggacggccttacgtttatcttcgcaacgacgagctgagcagcgagtgccgtggcaaggggagcttgctggagtttaccagcatccgacctgatgacctcagtcggatgccgagcaagaagctgtgcaacttcacaagaatgtatgtggggagcacggagtacaccttcaacaagaatggttcgatgatatttctcgatttgtcatataatcagctggactcggcgattcctggcgagctgggggacatgttctacctcatgatcatgaatcttgggcacaacctactgtcaggtaccatcccatcgcggctagcagaggccaagaagcttgcggtgcttgacctgtcgtataaccagttggaagggccaatacccaactctttctcggcactttccttgtcggagatcaatctgtcaaataatcagctgaatggaacaattccagagcttggttcccttgccacatttccgaagagccagtatgagaataacactggtttatgtggcttcccactgccaccatgtgaccatagttccccaagatcttccaatgaccaccaatcccaccggaggcaggcatcgatggcaagcagtatcgctatgggactgttattctcactgttctgtataattgtgatcatcatagccattgggagcaagcggcggaggctgaagaatgaggaggcgagtacctctcgtgatatatatattgatagcaggtcacattctgcaactatgaattctgattggaggcaaaatctctccggtacaaatcttcttagcatcaacctggctgcattcgagaagccattgcagaatctcaccctggctgatcttgttgaggccacaaatggcttccacatcgcatgccaaattgggtctggtgggtttggtgatgtctacaaggcacagctcaaggatgggaaggttgttgcaatcaagaagctaatacatgtgagcgggcagggtgaccgggagttcactgcagaaatggagaccattggcaagatcaaacaccgtaaccttgttccacttcttggctattgcaaggctggtgaggagcggttgttggtgtatgattacatgaagtttggcagcttggaggatgtgttgcatgaccgcaaaaagatcggtaaaaagctgaattgggaggcaagacggaaaatcgctgttggagcagcaaggggtttggcattcctccaccacaattgcattcctcacatcattcaccgagacatgaagtcgagcaatgtgcttatcgatgaacaactggaagcaagggtatctgatttcggtatggcgaggctgatgagcgtggtggatacacaccttagcgtgtccactcttgctggaacgccagggtatgtaccaccggagtactaccagagcttcagatgcaccaccaagggtgatgtttatagctatggtgttgtgttgctggagctgctcaccgggaaaccgccgacggactcggcagactttggcgaggacaataaccttgtggggtgggtcaagcagcacaccaaattgaagatcacggatgtcttcgaccctgagctactcaaggaggatccatccgtcgagcttgagctgctggagcatttgaaaatcgcctgtgcgtgcttggatgaccggccgtcgaggcggccgacgatgctgaaggtgatggcaatgttcaaggagatccaagctgggtcgacggtcgactcgaagacctcgtcggcggcagcgggctcgatcgatgagggaggctatggggtccttgacatgcccctcagggaagccaaggaggagaaggattagaaacaacaaccaccgacacacaggagaaacagccggcggtgagtggccaccaacgaggccagtcggcggcgaaatgcccgtagaaacaacagtcattcagaatcagatggatgccattttgaactctccacacaagcttagcaatcgcttctgatggtgctacaagataagaattttccagctgtaggttgatcagtcgaagttgttatgtacctataggagtagatcttttcttctttcttttttcgcagctttcttcgtctccctgtttgtttttcccgtcgcgtcgcagtaagagctgtgtatgtacatatataaatgttgaattttctttggcgcaaaatcaaaatccgcctaggttgctcctcgtcattttttccccttctcttgtctcttgacaatggtttaaatgtgcatgagttcatcaaacatgcaatgaatatttattgcagatggatattattgcagggtggtcattgcaagtaaatggcatccgaatctgagaagaagcaccactggagggggtggtggaggagggtggtggtgtgggagagagaaacatgacaggttgaacagcaaatggccagtcaagaggctgacacagctcctgtttccatgtgaggtagagcatggctttgcttgcgtggggtcaggtgcagtgagccagtgacacacccacgcaagaagacgcactcacgcagcacaagcacctttctttaatttcggggggctagcttgctttgtcttcaaatcatttcataagaggggcttagcttagcctttagttggtcaaaggttcccctaagcattttttgtcctctctgattatcctaatcgcctaggtaacatggctcccaatcttataataaccaccctcactattatacttgcatggtgctgtgtccgatgcttgggcgttgtcaaactaatgatgtgtgtgtccgcaaagtgagcggcacactggcatgcatgcagattcccccagatttcaagatggttgttcaaacgtatggttgctttcaagttcaggatttgagcttgcagtgtgctccttgtcttggtttgcccattccttttactgtgagagaatttagtgcagagcagagctagtcacattgggtaaaaattcatgaacttgctgaaaggcattctggttttggtctttatatctccacaagtagcttctccaatctccacagtctagacaggtcgttttctctaggccaaatgagtttttctttttcttcagtttttttttacctttgaggcttcgaggagctcaaaaaaagtccccatggagtctgtcccctgggtgcaactatagtggaacacatacacatccaacacaaacacaaagcctggaaaagctacaggagccatggtgacattgacaaactgtgcctcagaatggagtctctgacatcaccacaagggagtgggccctctgcctgtccgcatagcgttagcgctctggcttaaattttgctcgcccagtgctatcattatccccccttggaatagttgcatctgtaccaccatgtggcttgatgggttacaacttctgagtcgttaaaagtaattggacacgctcttcgtgtagaatcaactgaaatacgattatacgaatctacggaccatttgatacttggaaatgctcccacagaggattaggatgacttctgttggtttactgtagcacaatggattttttgaattacttctttcgatcaaaactatcactatgtcaaagttgttaggaatttcaactttcaagtagctagtacatattccctccgtttcatattataagacgttctagcattgcccgcattcatatagattttaatgaatctagacacatatatatgtttaaatttattaatatatatatatatatatgaatgtggacaatgctagaaagttttataatatgaaacgaaggagatagtagttaagagactttcttttttaaaaataactatatataacacactattttagtctagaataaattactcttacaatgtgggcctacatgctactcttgaattatgttagcaatgcgggcctacattcatacacatttatcattcatacacatttaagacaatcttagaaagaccatccacgccagtaccaatataagcttttggccattgattttaatgtaacacaacataggatagaagagaacatgaggtgcaacttcagcaggcttggtggcaaataaaggaagtgaaggcaagaaaaaatcattcattcgccctataaatggtaaggaaaaaagaaaccgtggtattggtggcagcagtaacagatgcgtttgatattgttcttatgacaatgtcacaaactaaaacgatatcaaaataatgcaattctaaagaaaaaaaatacagtgttggacgtaatacaagagatcaagtgaaatttaaattggcgaagataacagaagtgtggagagtgacaatgacacgccatagcaaggaagttccatgcaatggaggtgatgagatggggaggtaaaacgcaaaactgaaaaagaaaaggcaaaacatatctagcaggaagaattttaacggaaacacgctatataagggacattaataggtgatgacgatggcgaactatatctagggatgggtaaaaattgagacaaaaatcaaaactgaaaacccgagaccaaacctgaaaaaacatagtatcgatcattggtccctaactcggtctaggtctcatgtttacaggaccaattatttgattagtttattgcatcggatacttgaattaccgatctattcaagccttatcctaatcccctcctcattcatcaatatatcccttccacttcctcatccacgatagcacttgacgcctcgtatgttatcttggcgctcctctcccctctcctcacctcagaacttcttgagtggacctctctggctagaatgtctccatggcttttgtccctcattggccaccgctgcctcaacggcaaggtgctagaaataaagtggtacatagagagggaggaaggggagaacaatctcttctcttgttagtgtttggtggtgaggtttggaggaataacaaggtaggggatgacaaggagattgtgatttgttgaacatcgaggtcacatgtttcagatcagatctgagataaaccagacttggagaacaatatgtttaccgggtgtttggtggtaacgagccaccacaaccgcaccaacacctaaggagtaacggtgacagccgttgagcctctccactccacgcaccatagctagcgaggatgtctcctcttttgtgcacttcacgtcctcgagcatcaccaaaaaagacagtgcacgatggtcgatggcaaccatctccttgggggagagccggaagcctatgttaaaggcaagtaccacatttgcgtctaagtcatctgcaagtgtgcggcttgctcacctacaatcctacaaggaagatgaatgtttggttagaccaaaactatcggttaaccaaatggccagtttaaatacttccattgacaagttcggtcttccaatttaaaggaccgaattttgaaagaccaaaaagactagattatagcactatactatgaattggatggtaatgcttgaaattggttagatgtggggaatgcacttctgacgcgaacaaattggtagcatttctacacgtaaacaacaacaaaccaatactgtgtggtcacttatttttgctgaattatttaattcctaggagccccaaaatgcgccatgttcctcggcctatttttgcactgcgtttagaactatgcttaaagatttgtcgtgcatcagcatgcatggcactttaattgtttcgaagtgtaggagtacctagcaatctagcattgttgtcggcgcgatgcgtgtatggttgtgtatcaccatttgtatttctcaatttgtgcttgtgttcaaaaggagggcatcaagtctgggccccaggatggctgtgcttggcctaatgcttccacccttatctgttgggagaggacatgtagggcatccagggacagagttatcatggcacagtgactgggtagctggacgagtgaccggctgagcgatctagcagtagtatcatcggccaggagtatgtgaaaatctagcaaaacaaaagcgcaggttgcattgctgactttctgcactgataacagcgtcccccccgggggtctctctctctctaggtgacattacatgcgactaaggctgtgtgtttagtttcctttcaaacttccaacttttcgatcacaccatatatttggaaaagaaaataaattgtatagtttatatgcaaattgcgagacaaatcttttgagcctaattacataataatttaacaatgtggtgctacagtaaatatttgctaatgatagattaattaggtttaatagattcatttcgcagtttacagacgaaatatgtaacttcaaatgtgtgtccctgtacgttaattttttttttttaccaaaacaactacacacgacctaagtggttcggttgttcgtgcattcatatttgtgaggcattttaccacgcaccatgaatgcgccctgcccatgaatgtggagcagtaaagttgcagctttcttgaatggctactgttgcccatcaccagcaaaaagttgatcccatttcaccggtacaaacgtggtcaattgacaaaatggttgtatagtgttaatatatattccgacgtattttctctatcacaaaataacttaatcatgcattttatccaaatttattata

SEQ ID NO: 42104 - DNA, 1656 bp, Oryza sativa
acaaggataatatgacctgaccttctattaacattgcatttgggactgctgcttgttgaccactttactgtactgggcaatctgatatcaatatggaatttaaatttgataaggcaaaattcattctcttcggagatcaatatggagagtcaagaatcaagatagctacatcatatttttgataattcatactatttcaattggatatgaaatttacttcttgtggatttcttttattcataaaatatgctaattttgtttttgcagtttgagtaacctttattttggtgactacaggtaaaaaaaaatcacttacatgggctcatcaatatgttaaatcttttcacgatcaacattagctttatcatcttagctagccaagccctgaaggtacagagtaatcactatcctctaactctgatgaaaatgccatgttcttcactctccatctttatcccctgcaaatcagcaatggctggcccttctattcatttttgtatctaagtttagaaattactccagggtaaatccatatgttgaatttctttactgggagagctaattagttgatgcgggaaataattttccctcctggactcacttctgaactctctgcaggcaatgtacgtattatttagggatgatggaactctaaagttaccattcttgttccttgtgctacttgacagtcaactgaccatttggaatatgatactgtaatttatatatgtatatacataaatatcgtgtttattttgtttccatacaagacattggaaatttccctataagacattggaaaagattgagagagctaaattgcaaagagttgatttgtgctaatctgtagttatttcagtgcactatgtcttggcttgcttagtacatgccatattttatgaggaacatgatcttttcaggctctaccggagttcaaccgataacaacgcaaaaagaaagaaaacataataatcatatattacttgcttttgctaaggcgttatagaatcgagtgtttatcaacgataaatcataaaatttcttaaaaagttatttttcccgttgcaacgcatgggcacgtgactagtagtggaaaattttgattaaaaatatttaattaaataaattaaaattttaacaaattttggctgaatttttaaaaatcctaaattcaaatcttacaaattgcgagaatcataaacatttgacaggggcaaatgaatgaaaagttcaaaaaaaagggggttaaaaatcaaacctttttatttgaacaaaatttggctgaattaaaacagttctatattaaaaaaaaattgaggtggcctgtctgtgcatctgtggaacatcattgtatatcatgctcatgtatgaaatgtttaatgctgacaacttcacatggtaatgtaacatcaaaaagagcaatgacaatttaacacaagttatagacccaaaaacaacaagttcttccaaagatagaaaacagatactgctgccaactggcacaaatacatactcctacggtaccaaccgtatttttttcctaaaaaacacattctctgtagcccaatgctgtcagagtctcagagatacacagtaacacaaaggacgggcatgttattttcggtaaatgaactactaccagatagtaagacttca

SEQ ID NO: 42105 - DNA, 20783 bp, Oryza sativa
  unsure (1)..(20783): unsure at all n locations
ggcgcagccgcgcaggcgtgcagcacaggcgccaagcagggcaggggcagggcggatggcgcagcagcaccaagcagcaagcaaggcaagcagaagtagtagcagccatcaggccatcacgcccaatctcccatcagcagaaaatggacagaaagagaaaagggaaggcactggcatcacaaagaggttgtacttttttttatttgacaatttcagaacattgcaatttcaaagtgtacaaatttattactgaaattgcaattaaatattttatttttaggatgcttgtacattttgtttcactcattgctttttatcttatcaaactaatcaatctttgctatttgtttttcagattctacatatgtatctatcctcattagtttatatatgtgatgtacggctgaaagcttgaatcagtgaatcttgaggtatttttgagtacctacctttatatttacacttatttgcaaatggatgatgaattgtgaacttgtgattaagtgcttgttactatgacttgctgatataatgttacattgtacaatattgtgcattgaattttttttttcttaattcttgttctgtgttaactctcgcgtgtggtagtttattggccacacctaaattttttttccgtcctccaccgctgttcatagagatgcataatggctttaggaatcccctttgttgactaaacccccattgttcattatcaaacattgttcactgtgcatggatatctgtgatgcaaaactctaattcaaagcctgttttgcatttcaactaaatttcatgtgttaatctcattcgtgtggtaggattttttttttttggggggtttcattgttgtcattggatgagatacttcacatcttgttaacatttatcgtcaatctttcattgtaaaattgtggggaagaaatggcctacctcagataattctattgtgtcaatttttctatgtgattgcttatatctagcaacctgacttaacctttcatttcaaatgatttaatctataggacgaaaattcagattgccgaagaaaaattcaggctgacaggacaccatgtcaactactattgtttgctgcacaatcaacgaaatttttggctgattctactaaatttctatttggtataggtaatttcttccataatgattaccccttgcaaatagtgcaaatgtatacttcgtgggtcaatcttcgcactgttgtagaatctgatgtttaaaattgcctgcatccggtttacaaatcaagaaaaaaaaattgccctgattactgtgccaaccatattttcttttgagggattgaccaatctttttcttggtatcgttctccaaactatctcttatgtgttggaaattattatatactttagtttgcacctattgatctcctacttcttctgtattgtagtaaggcatggcatccatggatgatgtggatttttcaccacatcaagccacacctaaggagtcaatgaactccaaggatgatgcgaaggtgcagccttcgtcagggcaaacaccaaacaaggggaattattacatgggccacgcgaatgccatcatgatgatgtttcaatacatacgtgatggttgccgacgtgttgagagttccatggaagactacacgtgcaagaaggtagaaaaaggatacggtgaaaaaaggaaggtgggagaagggtatgatcctcgctggtcttctcccatcgagataacaatgaagatctgcaatgacgacgtctccgatgaagcaaccgagaaggaaccatgatttagtattatcactactgtgttttggctttagaataaaataacatttcttgtgaattacacaagaaaattcagtaaacaatgtcgttcgggcctattcagtattgcttgtgaaatgcacaaccaaattcgatgaaactttgttgttatgatgcctattcagtattgtttgtgattgagttgatttctgggacctatacaaatgtgctctacctcctgttgaactactatgtatttgtttggcacggttggatgcatagcaatgttcctttatatttgttttccatgtcttcttatataaggagacacatcacacaccagttgtggtttagatctcacataaataaattaagtcggccaattttctgacgttgtgtagcactattgatttctgtaattcttttgctttagatcaaacacatgtaattctttgctttagatcaaacacattttatttgcttcagggctccattaatttaaagagctgaccaatcacatgaatattgatttatgaacatgaaagcgtataaaaaaagcaaatataattaacataagaaaccagtattgctaatttgctattatgttgcctattcagtcatgataaaggagtaaaggactgctagatgtcaaacttatgtgtatggtccaaatcctgtaatggcccattaacaactaaaatacccatgataaatacttatatgcaatactcaacctaagtgcctttgatctgtcacgttatcatacatcttaaggcacagatatatgcattatcatatatctttaatatcatattattatgcattatgacatggggcacaaatatattggtatatcctattctaatattttacttgcaacatatttgatgtatgatataaattgaattaaagctcaaatgcacagttcatataataatatttttttgctaaacatgaaaattttaaaaattattaaagacaaatagagttgcaccgtagcgtttagcacgggcatattactagtagtcagtagttagctgatatatgacagctggagctggagtagacatgaactgaacacagcaagcctgtgctgtacagattcaacttgcttaattgaaatcattcggaggtatcattatatggggcaaaaaattagaggagctctaggaacccttgagattttgggtcaggctccactactgcactacattggctcacacaaactcacaccaactagagagatctactcagtgtagaggacagaaagacagggcaaaaggcaaaacgaaaagaactagtatgctacaatctttgcaatgaatcatctgatgacaccagtcctgatatgaatggagaaagagccgaaagcaatgccttgggacactcctcatgtggcaaatgcccacaatttgatatcgttaccagcctctgcaaaataacaagaactcattggcacaatgtatggagtaaccctaacagggaagtaatatagagtatcatgcaagagtcctcttcagaagcagattcactatactgaggcaaagggactcaagattacttacagaatttacaagccttgaagccattacttgcgttgacttcgaagaaacaagagcatcctcagagcctgctacaaccagaacagggaggtcttccactgatcttagtaaatctgctgctctttttgatgataggacagtcgagaaagaaagacgtcctacttcatggagagcttcatcccagccttcaacaaatagtggagcctaaatgtaaaaacccatttcaagtcagttcgtagttcatgttcacagaataagtgaaaggatgcatgttaaaacatttaatttagcatcaaggaacaggaagacaataaataactaacaacatgcaagaaaagttccactttccttgcattcagacaatatgtggtggaatgataaatagattatttgcaaatgatataacgctccctatgtgcttttagtgaccaaactcttccagagatagattgcgtactaatggtttgacaacacactgaagggaatgaaaattattaaaagtgtgtaccttgtagaggttcagaacatctgttgttaacttggtagcatcaaaccatgcacgtcnnnnnnnnnnnnnnnnnnnnnnnnnnnnnaacagtggccgtaccatgtgctttttccttagaggggtatgcaggagtatacgagcaaatgcaggaatgacttctcttgataagcttacacctataagcacaactcccttcacttcaacctaagaaaaaacaaggaggcatttaaaatgattattaccagaaggatagactttcatcaagcaaacagtctgataagctactaaagttcacaaaagaaaaatgaacagaaggtcacaaggcagttacctttcttgaatctccagatgctcgcaacttttctgcagcttttagggcaagcaggcccccatcatcatgaccaactaaaaccacagagcgtaagcccatgtccgagcaaaatgaaataagaagatcaacctgcagaaggcatacaaagcgttgttcttaaagttctgagttttccaagtacagcgaagaaatatagcgttaatgctgccggaaaatatgttgcaaacataactggatatagtaatattaattaaaagattaatagttgttacagtagaagagcattcccttagatgaatatttgtaagataggatgtacctaaggaaaaaaaagaacttcagaagattgtactcaactatttgtaatggaaaagctgttgtcacacagaattatggtacatagaagacataatcccaaagataagtatagttctaagagaaaacacatgcagtaacatatttacattcagtcagtcatgcttataacaaattccatggaatgagtatgggatattgcaacatatctagtagctagtgcaaagaacattagggcaagtgctgcaagcacttgctgctattgggcagtgcgcaatctagtatatggtaagaagaatcacctgagatccaagctcatatggatttggtagatttttgtcttcccaatcctttctgcgaggtcgagatgttaacccccatccagggcgatcgaaggccagcacagtgcaacccacttgacgagaaagcaaatttgtaacgtgtctccatgagaacaccccacctccaaacccatgcaccaaaacaacagcaaatttcccctgttctccagcctcaagatcaaatcccataggtttcaaacatacatcagcactgccatcatcaacactaagaacaggggtgtcatccgacaaagttggagaggtcactggctctaccaacaatggtgcatatagcgatgtctgatggtattgatggctgaagctcctattcaaaagacgacgggtattagtggaggctgatggtgggctatcatgtctctgtcttctaggagaaatgcttgctgaaataacatcatgatggatttctggaaaagtgtctgtagctgaagatatgcaactcgatggatcggaaagtttgtaatgcacagtgatcccctggcaagcaatgaacatgctatcaccgtctgcaaggaaactgattggaatatccctatcgtcgtgagcaacagattttctcttcgtctcactgtcactcctagaataaaattttccactgtatggtgtgggagatcgaggagtcttgtagcatccaggatatgcattcttgtatgccagaatctgaaagcagcacaacccacgaaaacatcaaacattgcaaaagaaaagcacaacggatgcaagaaaatactagcatacatggccctgtttctacaattgatcacttagtgagatttagaaggcaaacggatgtaagtcatacagattcagggtcaatgccatggataagcagcttccgccgagccctgcagcttgtcctgtaagcgacaacaacatggccaagagcaaagaccaaggaggacaggaaaagcaccggcattcccgatagcttcttgagactgagcttgtgatccgccaatgacggcgagagctcaggcccaatctcctgcgccggactgtaaacgctggccttaatcaacaagatgagcagagaagccagggaacagcaagttgctgttccaaggtacgggccatgggagagcccagaagcatcagacatgaggtatacacctgcacgagcaaacatcggatctgttagtcgcatctcgtagtttttctccccaaatccgagtgcggaaatttgttggcgcgcacttcaaactgccgggaaatagtaggcaacagattcagcaaatctattactaattcagcgaatcaaatgacgggatttaactgaattcaaatacggaaagtgaaaagaatagcaggcaacagatacgaaatcagattaatagctttagaaatagacacggtttttttcacgaaagttttcatcctttcgtctacgaatgaagacaagcacggacgtagcaagaactgtagctttcagatggacaaatccccatacgaaaagggaaaaaaataaagaatcttgagggaaatcccatatcccaaaatataatgaaattagaatatttaaaaaaataacacacataaccaatacaaaaattctcagaagatgaaaagaaatccaactcatacgaacagattccccaatatcctgcgagcgcattagaacagcaatgagggggagctagtcgctgcttacaggtaatgacgacggatcgagcgatggagacaagcggtatgtccacgagcgagctccggaagccgtaacgctcgaggtggccgcgcaggccgtggcagcggaggcacccgagccgcacctcgagccacagcgcgacggccacgtcgccggcggccaccagcgccggcgccgacgccatcagcagcgacgccaccatggccaccatgaaccacgccgtcttcaccccgcgccgcgccctctccacccaccccttccctcccgccgccatcctccacccacccctcgctccggcgagagcggaaccgccgccgccgcgctccccaactccggcgatcgccggcggccaagtctacgacccagcgcgcatgcgacgaggtggtcccggaccccggcgagacgacggatttggttcgcccgctgtgttggggagaaagagatagacgatgaaagaaacggaggtgaagcggaggagaggagaggagaggaagaagagagaaggcgtggtggagtactacttattggggataatggcacagtgcttgacggcttgtgaattgtgaacgaatgaatactttagtggggctttgtgtccgctagtagtagtcctccagtacgcagctaatcacattgttaactctgctaactgaacggtaggaggagaggagaggagccagttgcttgtgttgtctgcatgttctggtttcctccttgtgttgttgcttgggttccttttttttttctgtccatcctgctgtcattcacagcagcaggctcaggcttttgcatttggacagataggggttttcagttacaacagaatgttgctttgtaggtgtgtcatgtgtgtagatttaacaagaaaaatacacgtagtagctctgtaggcagaaaagccctgcttgcaacaagttcagccttcagagttgtacataatattcgtactactatacttgtactttggtaaaatacaaacaatgaaacaaggaaatactatgtctagaaggcataccttggcctggctccccttataatttataaactccattttgtgcaaggaaataccagataaaaaaatgaactctacagataccattattgacaaaaatacacgggaagtaaatgatttcatatcatattaatgcacaacattccctctgttttaattcccaagttccaaatctaatcctagtggcatttccaccgttgtctatcgagattttcccacgtgcccactactatttcctcttcggtgaaactcctcctccctcttctccagcgagattccagagctagcgaagtggtagtaaactggccagaagtttttttttttaccgaacttatcagaagaagatagaggatttcccgcctttgtgcggcaaaaggaggcggtcctatcgcctactgtgcctatggtcatccgatgctgccaccactacacggaccccggccggccggcaaccgcagcgcggcagcaacagcgtagtgccccgccggcccgcacggtcgccgcctcacgcggcagcacgggacggggggccacgcaagccgatgccgatcgcggcaaagcagagcacgctgcacgcgacgcgatcgcggccgtccgctgctcgtgtctcggcgatcgatccactgctcttccttcttgccatggccggccaactcggccagccccgctccacacggctccactggagatacggcgcgggccagggctccagcatcgctcggtacaacatgcgcctaccccggctaccccagaggagcgggccccgcatccagcgtggtgtgattcacgcgttgggcccccatttcccccctgctcccgtggcgtatcacgtactgtatggtttagtgtatcgccgtattctgttcataatgttggagccagtagggcttttttttttcgtctcgttttcgatgcttttcgatgtgtatttttgatgcgtttgaacaggttttgtttaatcctgatccgtggtgtcagtgtgtagactgacaccgctggtctccataatgtttcggattggatgcataaccactgttccaggacagctaagctggaggctgcccctcatgattaacaataattcttccgggtgatagtttatgtctgaggcttcaacagagattggttggcaaagcatgatttggattgagaaaatttcttagtttgaataatggttcttgttatttatccggaggttagtattttaagtgagattgcatgattggtatgaagcaggaatcttaattaaagcaatggactaattgtacgagaatcaggatagcttggcaccttggagttttagatcatcgatggtaatgctcattggaaaatactaaattagtactaccgatcttgataattaagtgtcacaattttctttcatgattacctcatccagtccaattatagctctgaaagtcgattccaaagcaagatacaaaggtttgcgaacttatagcttggcactctcataatcttcagccctgttcactttgataccgttttcaaccttaccaaattttggtaaagttgccaaaaaagagtggctacatttaggttgcgttctttcgaaggacatcggggagagattggggagattgtgactcgttttccgcacgtacgcttcctaaactactaaacggtacgttttttgcaaaaaaatttctatagtaaagttgctttaaaaaatcattttagtccatttttgaaatttaaaatagttaatactcaattaattatgcgctaatgacttacctcattttgcgtatctccccaatcttctctatttacctcattttgcgtatctccccaatcttctctatctcccctctctcaaactcagccttagtttgctgtcaaattttagtaactatataagaaatcctgccaaaattttggcaagttactaaattttggcatcttgccaaattttggtaaggttttttttttcatcaaagtgaacaggttctttttttttcaatcattaataagaaaatatgtgtttaatgggattcaaactcaggcttgtgcgatgcttctagcttgatgcatttttctcctttgaaaatgcttaattagttgtagctctgggtgagttagttgtaggaggaaatttaatgaaggaaatacgtatgaacaaaatcctatgtgaagtgctactgttcatccggtggttttgtagggttggagcacaagaaaagcgtgggaaattttcttttggcatgaattagggaaattcgaaggaaaactagcatccatcttgagctcttttttttctattcggtgtttgggtttgaagcaaagcgcaaatgttctgtatgcttgggcttagggtgcatctattaaataaacaattcttggctctgtggttttttttagagatgcacttgatagtgcatagtgcagtgacaagagatacatggtttcaatttaaggttccatattcgatcctcaacacgcttataattttgcttaaaaaaagtttagagggacgtctatcttttcaaatctcgactcaattattaacatctcgtacatttttttccttgtcggttatccaaacgatcattcttataattatttttttctatgtttactagtcatttattttgcatgtgtattattgtcttatttctatttgttttcatgttctcacattaaagaaacttagcatttacaactttaaatctcgaattacttaaaatatgtacagctatcaacagatgtaccacacacgcggagcttgctcttgctaatttccacctaaaaggaagtacccagcggtgactgttcagcatcaactattgaactgtagcacctttcagtcgcagcagtacctccactaatcacggatccaatgccatgtccagtagtagcagctggttcagtaagaaacattttcagattaaaaatgtccatttttccccctaaatgatcatcaggctcattatactttgccaatggtcactatgtgtctgtatgactctgtgatagtaccagcacgaaaaatgcagagtaattaggagagttgtcgatttcatttgtcctcaccggtacaatagtcatggttcgacttaccgtcggtaacatgatcatcaggctcattatgctttgccaatgctttgccaatagtcactacgtgtctgtatgactctgtggtagtaccagcacgaaaaatgcagagtaattaggagagttgtcgattaggacttaggagaggctcatcagcgcatttgtcctcaccggtacactagtcatggttcgactctgcgcggttaccgggcttaccgcgggggtacggtaatataaataccgcggtaacctccttaaattcaaataaatttaaaaataatttaaatttttaataaattttacacggcttcatacggttttttacggttaccgcggttaccgtgcttaccgccggggctcagtaactccggcccggtggtttaggaaaccctcgcactagtacaagaaaagaataggccaagggtacatccgggagtttggacggcgaaacgaccgtgcgactacagtatgcgccggccggtgggtgggtgggctggtcgagtcgaatcgcggtcggaccggagcccgaaggaaaaagctcgtcttttcatatacgcattgcccactagcccgtagagcggcatcgaactgacaacgtggggccttatagcttccgggcccacaagtcatcgacgaagagcaaaggcttcaaccgcgtgcccctggaaaggtagaggtggggacgcggccgaaaggcgctcctcctcggggcgcgttcgaggtaacggtaacggccaaaagcacggggccagcgctgcaaccccgaggcccacccaggggccagcgctgcagctgacatgtgggcccccggtttgcaggtcccgccgcacaagtcaagtcacccgtggagaaatctaacgatgcccggctgtacaggccgttgcacacgggaaccttgaaggacagggcatgacaggggggtgattcactcgcctctcactctagacgtgcatgacatgtaggtccacctacagtggggcctacctgccattgagtgaagatacgacgagagagaacggcagtcacgagttcggcagcgcgcgtggaaagaaagtgaaaaaaaaacttccgccgaacagagaaagagagaaagacaggtgccctcactgacagtgtcaggtcctctgtcaatttgcacatagggatcctcacccaaaggcgaaaggaggcccacaatatgcacagtactagtttttttttactcgctttgctttaccgatttactcgagcattgcagatttgcagccaccactttgcctcaaaaaacagttacacatcgtactcctatttgccagtgcatttccgtggtagtaatctacattgcagacttgcgtatttctcgtagtaaaagttctattgccgttgcgtcaaagggtaaaactgatacggccatacgggccaaaaagcgagtgcctgcatcggtggcatgtgcccttcgcggtcgagactcaagtgtgggcgcaccgcgcacgcaacgccgcaccctgaaaccacgcaaatttgtactgtgctccatatcttagattccacgtacggctgagcgcgccaccagcaggaccgttgctcgcacatggagatacaaagaccggtcaatcaggcatgagatccagatcgatcgttccgccccggttccaaaaacattcaaaaaaagaaaaaaaaaactggatccaatggtggtcgtcatcgtcattaccaatacttaagcatgcccaataccgtgacaccaagtggtagtagtagtagtagaagcagtacggcttaagccatcagagagcccatgatgcatgcagggtcaatgaggccacggaaacgctgctgatccacgagccgcccggggatgggagggatatggtacgctgtacgcatgctgccagcacggtgagtagctcgatcgtaccggttacagatgcacagtaacggggagcagggccgccgccccgtgccgtacactcgtgcacgtaagcgcgcggcgcgccacagattcgtccgcacgtctcaatctgcgacgcgctgcacgcctctgctcgacatatcgcgggggcaatgtagccatcatcgaccatcgtaacgttggaccaatgggaacaagtgcccgtacgtgagcgtgcagctggacaggccgaccggcatgatgcaaaccaacagcgattgaacggtgagggagctttgctcggtcgtctggctggcctcaattctgttgggggtgcttcgatgctatggggtgttcggcaagccccaaggtaggcaactagtgtcaatgggactaaatgaggtgtcatctagaattaaaaaaaaattgatgtaagaacatagagtaaattaagaggatgacctttggtatcaattgtttgaaggaggacatttggcaccattgttgctatgtgacatgataaatatgaaaagaagtgccccaacaactatttttccatgaaattcataccattaattcttgtattaattcgattgaggggttcttcttaggtcaagctttaattaagtatttggaacctaaacttaggttaggtgcttgccaagcgagcacactctggacaaacagcatataaatcagccctaaagtagttctatccaatcttcaatcctgtgccatgttggatacagggacagctaagaaaagattgtgtctgtatcatcgccctgtcatgcccactaaaactggttggtggaatgaaagcccatgtacccggccataacccatctcatcgagttatactatctctcgtctttacaaggacagtgaaattaattaattaattagagtggatttgtcaaaagtgatttatctttttggttgatcctattggttctttgtttaaaggttttcacagatgaagttggatcatggtctttcagtgcaaattgtgtctaaaaaatgatgatgcatcggtggaaccgtggatccatgactagggcaggattatatcactttatggagccttgagtccactaaacatggcaccgattggttcacttcgtagcaaaagagaaatgtggcataaaaaaacgaccatgttgcaaacatgttattatggtcataaacttggcaataatcagcttgtacagattagtaattgcttgggaccaagatacaattcatcatggggaccaacatgaacattaattggcttgaacctgtttatatttgtgaacccatgatgcatattaggccattaaaacactttcacactaatcgatataatatgtgttatcaagcataaatttttgttggaaacacacatgctcgcaacgcgcgcactttctcttataaacgtccacacataccctacctctatgaacacctctgaaagactagatcaatatattttgagattgacgaagccaccacggatgtctcgctatcgatgaatacgacgcttaccactgcaagaataattagccataaatataagcactcatatcaagtccagaacttaaaatctagatggattggttccaccacaagtaacttaaccagttgagttatgctttctttgccatcaaaattataaagcaaggttagctacatgtattcttgtggtttaccatgatccatgaaatatgaatttaaaaacgaataaattttgatggagtactaatggaaaccacaacttaaattaataatgcattaacttttgaacacacatttgacgattcgttttatttaaaagttttacattattagtttttttgagttattttgtcctgaaagtactttaaggatattctttttatcttatgcatttgcataatttttttaaacaagatgatcaaacatatatctaaaagtcaacagtgttatttattttaaaaacgaagggagtatacaaacagaataaatgcataagttggaaaatcagtgccaataaaatttgcttttcatgtgcgtagtatcgtaggcgtctatgcgggcgtgtcttccatatgattaaacgaatttgttaccttatatatgttctgaagaaagatgagtaaaagcaaagccattgcctattacgtattaggcttcttattggcactactacagaaatatttttttttctgtacgaggcccatatttgattccaggcggaccgtaagtgacgccgcctgaaaaaactggtccaccggagccgggtcatcgctcgcatgggataatctacgcgtgatgatgcatgtaatatattgccccagcccgagcttgctccattcaagcccggcgtttacatttaaacctattaaaaattttcttacactagcacaaaacaagataaagctggaatcaatgaaaacaaaatctcagaaagaacagaaacgtatcattttctaagtaaaatcaacaacgacgggcaacaagatttgtccatacatgtagccgaaaagcctgccacatcgattttccatttgaaaaccggctatctgttgatgtgcaacacctgcaacaatgctaaatgggagaatagctaatatggtccctatagtttcgttcctgggtcattttagtccttaatctttcatattatccaaacaagtcctttaattttgtcatgtgggttatatagtccttggtctcaccaaaatcgccacatggatatgccatgtcacattcctatgcaaaatctatatgatttgtccaatttaccttacatatatcataggaaaataaaaaacaaaaggtaaaatgtaagagcaaaatatatctcaaaagggtgaaaaaaaggataagtattttttcctatggttatgtctaattcacccttatatttatttttctacgatatacgtaagggtaaattggacaattcatcatagattttgcatgaatgatgacatgacatatccatataataattttggtggacccaaggacaattctagaccttatgacaaagtttaagaatttctttggaccatttaaaaggttagggactaaactgatcctacagaaaaactttagggactaaagtagctattctcccatgctaaatcacgcaacattgaaaactcaagcgaatatcgcacagaccgtccatgcatctaatttcctgctgaagttgacacgaagcttcaattaactgacggcagcacggccagacatattgaaaattcttgcttataatttcagccctgggtaccacatcttctttaatcacaggttacatgtgcgtacggcgcggtgtacacataatctacagatgtcacctttacaagagaagctcttaactgccctgaatcgtgatgatcgtctacctagactagtagatattgtaaattagttgcttcaaaattaaatcactggctctcgtctgctacaaataccgttcaatttcttttgtcgtgtccaatgcaaagctccaagagcatgaacttaaccgaactgtgtggttggttggttggagattttaccatggtgtgtggaggctaccttccacatggccctgtatagtgtatactgttgggaggagtacttggctacttgcacaagaacagcacgagctttatgccgaattttggccgcatgcaaccacatgcgccgcggccgcgggtgatttcccaggaaagagcgccggtttgtttagtccaaagccatgacggccagatgctagaaatgtggggaggtgaatatactcattgtgcctactgcctacaaatcaggggttttgtcaagtggatgcatgatttggacctagacaagttggcattggtctaaccggacaaaatgatttcatgtaacgcttctagtcaggaaggcaggaaggtcgtgtggatcgatgtgtgagatgccatttggtaaaggagtcatcaagagcataccaaaatcccaaatgctagaattagcattatagcaaggttaataatacagccgatatgttggctataaggttctttgtagccttctctcaacctaactatataatagtttgctctttataattaatacatggtccacttgtctctctcactgagttttttggttcttgtgtccaaaccgtctgtaagtttacagcccgcttctcctctctctcctctcttctctcctccacctcagcatttagccggcttataacctactattatacttgctcttacaattttattttcttgatcgacataggcaatgatcaggcaaaccttccaacatggcaggttgcgttcaaacatccataacatcccgaacggtcttcccaccaagagcatttaaactggttgctaattttgtcatctgcggatgaagccaatacggcgttcagatctcaacatcagtgaggaattcaggattagatggatccaacactggcggttccaaagaaacatagccccttttgttttctttttcttctttttgcatcactggtacatgaatccactcttgggtcttggcccctaggattgcatacgaacaaagcaaccggagcaattggaatcttctctgctcctgcaaccgcaactcaatcgcaaatgataagagaagagaatatgaatcatgatattctattaagttcccaacggcctatgtatccaagtatgctgtcctttgataactttttgtccgtaaagaagagagatgcaagccaagatttcagcaagtttgtccgtagacaccccccgcttgttcatgtctcatcagtggggcaggcaaaggaatcaggttggggcagattgtcctgctcgaaattcttcaggtaagggcaaaagggcccaatgctgagcaagaacaggttgtcacttgttgcttgccgctagctctgagattttagttccgtgtgtcgggcaattagtccagttgtgatttgagtgtttttttcttaaacagctagacattatgctgttgttttattacgtgtagtacagcgtattacttgggactgggagatgtaagaagtattcctgtctctacaagagaatgagagacgaatctgtggtgtgagtaatatatatcggtctaacgatatctgatcaaggtaaggtaagcgtgcgtggaggcccgtttggaatcgaatagaccgtcctgggcctgagcccaatccagccagaagttttgaggccatttggaatcgaatatgctatatatttgtcgacaaattttccaccaaaaatttgacagatgtaattatagtataatcgtagtgtaattacactgtaactataatgtaacatgtatgtaactttcaaaaatctctccataacatttatttcggtaaaatggaggttgtgagaacaaattctttcacatatgtgtatgatgtgattttttttcttcctcaccagaacaaattttgtaatagatctaacgattcaaaattacgtgaaacttatatacaagttacactgtagttacatgcaagttacagtgtaattacatacaagttacagtgtaattatactacgattgtactataattatatctgtcaaatttttagaagaaaatttatcgacaaatatataggtagtacctttggcaatttaacgacgttctccttgtttttacttcctctcaaacttttcttctccgaacccgtgagcggctgcgccaccaccgctagttaaccgtctcccagtccccgctgaccgcgttgacaggaagggagtcacgccgtgtggacggcggcgtgttatactaaacacacgtaaaaccacaagccgtgagagagtcacgagagtacgagaccacgccgccgccatcgcggacggtatcatgatcattggatttgtggagctcggcgcagcttccggactgcgcgcctggccgagtcagacgacggcacatgggcgcggcatggggctggaccgggcgtgcctgtgcgtggccggtgagtcggcctgaccgtcgggccgtgtcgcgtacgcccgcgatcgtggcggcctgccctgcttgaccccgaccgagcagtgatgggacgccgaacacatccggatgtttgttttcgccggcagagcggagtacacaaacacacgaagagaaaactgaaacaccgtgggcatgcgttcccatgcactgcatgccacccgccgcacccgatgccatcagttgttggaagaaaactgcgagcatatggtgggaccgtgggaggctgggagcatagcactacacaccaaccagacgggcacaagcacagggcagtgaggcacagtggccgtccggcacgagcaagtggaagttgggccgaatgggttgcacggaataaacgtgagaaataagcccactttacgtaaagtttaatttgcatcctttaaaccgtaatacgacaaaacttcacctttcatctcatcttagcaaaatcgtgtgtatggatggttctagttgacgtggcatcatattaaaaaaataaatagaaaactaaaaaaacatgtggggccatatgtaaatgcccacctcaccttcttcctctactcctctcctcccttctcttcgccttgtcaactccatgccggcaagttgcacctagatcccaccttggtgccgccactacccaccccatccaagtcctccctgccctcgctagcgaagtcgtcgcctcctccagcacaccatcgaatgtgcccttggtatcccttcctatactgatgtctacccccgcaatccctttcgcatccccgccatctgccttgggtggtcctgccacaccggtgctaccttcggttatacccttctagccatcggctggcggtagggacgggaggaccacctaccaccgtcggatatgccctccctgacgttcctgaagtcgcccacctctcattcatcagggagcggccaaacttctacccccggtggtggcggggctattccggatcttcatcgtggtggaagatgaaagagctcgagcaaggcgctggctatggaggaggtggtgcagtgatagttcgcccccatgaggtcgagcttgatcgtgcgctcatgggaaggaaggcgggaatggcgacggtcgggaccgctctgcatcacgcacgcatgatgtgacatggcacaacaattgaagtgtgcacgtggccacggacgtcgctggtcaccttgacggagtaatgccacccacatggttttttatgagtactgccagagaacataggccttgtttggatcctctaagctattaaatagccctctagaatcttgttatttaggagtattaaacgtagattaccgacaaaaccgattccataacccctaggctattttgcgagacgaatctaatgatgtatattaatccacgattagcgactgattactgtagcatcactgtagcaaatcatggattaatatacctcgttagattcgtctcgcaaaatagcctaggggttatggaatgggttttgtcagtaatctacgtttaatacttctaaatatcagggccatagtttaacccgattttataagttggaaatgaggatttctagtattatagtttggggatgtcaattaaacttgatagaaagatgagggatgacaagtggacttttctctacgtgaacactaaacaccataatcgggccggggggatattagggccgaacatcctcacaattccacatgcgaatctcagaaatattgtgccatgatcgtttttcatgcaaaaactcttgattctttcaccattttcagtgagctatgaaatgccatattatttttatggactatatagagagctgtttctttgaaaagttttctagtttttacagcagactgcacatagctgtccatcgccaccttctttagtttcaccgcagagcgtaagtttatatggccggacacatcggcatcaacctttcacacagagtaaaagtgatattcgcccgtatcccgtcttccatgggtgagcacaaagccacaaaccacaagtccacaactgcgtttggaaaaagtacgaattaccccccgaactatcgcagtcgaccgaatcccccccccccgaacccgaaaactagacatgattcaccctaaacttttaataccagacgaattacccccctcgacccaatccagagtagttttatcctacgtggcgtacgcgtggcatcccagtcaacattttcttttttaaaagatggtgggacccacctgtcatatactctatctctctctccttcccctctctctccccctctctcggcgagcacggcaggcggcggtgcgggacaccgaggcggcggcggcgacagcgtgggatgcggaggcggcagcggctgcggcgtgggatgtggcggcgcgggacaccgaggcggcgt

SEQ ID NO: 42106 - DNA, 2818 bp, Oryza sativa
tgcctcccatcccacaccacagccgccgcctgccgtgctcgcagagagggagagagagagtgagagagaagggaaggagagagagagtatgacaggtgggccccacaatcttttaaaaaaagaaaatgctgactaggatgccacgcgtacgccacgtaggataaaaccgctctagattgggtcgaggggggtaattcgtccggtattgaaagttcaaggtgaatcatgtctggttttcgggttcggggggggggggggaattcggccgaccgcgatagttcgaggggggggtaattcgtactttttccactgcgttttgattggtaaatgaaatgctaaaaagtgagaaatacctttttgtctttcaaccccaccccactgtagcaagttgttctgtcaaagcgcgaatacatttcccaattgcacgatgacacaaccagccatgcgtcaccacggatcggggtaccttgtatgcctcgatgcaaaaccacttgctagcttaatttcagcgagaaacttgtgcagttcgtatatgcatagactttatgtaacatagaatggaaaatacgtcacgattgtgacgagcacaatacctctcaggtcattcacaatggagtataataccacataagctaagcacatggtttaaatgggctcttctcacactacaaagtggtttaaccgcctaagggtggcatcaatttttcatgccacccaaaacactttctattttagttctcatatctttcaattaggatatctttcaattaggatagaagccttacattaaacacaagctctctcttgcccttcactctcctctcctcggacctcacttgtccactcttcccttcccatgggccaactctccctccccggtgatgaggtccgccgcctcctctctactcttaggccattatgacgagctcgtggcgggtgtggatcaaaagcagcggttactgaacttgtcccatttcaaaatgatgtcatcgtctaaccctcttgaacggcttgggcctatgagctcctccatcgtctagatttgctcgtgcaccaccgccgagcccctccaacaatgcaaatcaacattgtgtagtcatggtgggcgtcaatcttcttttatcgatgttggatccaagccagccatgcccttctagatctggcgtagaagaagctcggcagggtggcatgtggatcaggggtgtgtctggccagcgatctcacccgccagtgatggcgacaataggggtcttcctggtatgttccttctagacctgtctctctggtcttcagatctacctcccattgtctagatgcctcaccaacaaataacgtgaagggggaggggagggctgcacgcgttgcacgagagacatgtctctcacggctggtgaccatggctccaccatcaagtgacctcaggcttgtcggggcacctgtaccctctacaacgtgtgaggagcccagtgagatcacaacctcagttgaggtggagttgcgaatccaatgtggtgagccggagctagtcctacgattaccatgagctcctcctctgatgttggttgcatgaggtagtgtcgtcgccacttgcttcagatccatcgcccacgcgacctcaccctttacttgctcgagctcctttgcatgtggatgtgagcttgcctgggtgttgccttctcaagctagtgcctgaaagctggcggcgatgcctagatcgagcatggacaatggtgtcttggccgtcgctcaagtccaagccactgatactagtgccaacctcgttcttgtcgtcagccgccgctgtagctccctccccacctccctctcctctgccaccactcatggagaagaggatggcagtggcaatggcgccaccaatggagaaaagaacaaaggtggcaaggcaacacggtcaggtgacacgtcagccctacgatgtggcgtcctaaaatgtcatgggagagctcatgtatgactcattggcaaaaaaaatcctaattaagtccttcatagggtggtatttaaaagacgatgagaaaaagttgaatttcctttaaatttaaatttaagaattcttttttctgacggttggtagaaaaggtagctagggctatgaaatttcatacaaacaaaagataggaacctttcgatagaactgtacactacctatgtactgtaagatagctaatcgaaaggggtagcagctttctatgaccatgatttgtatagtatagaagactaagtaagtcaaagatacagtactgatcatgacattacttaccaataatcaactgtatacgtgcacgtggtactattatattatttcgccatttacctacttaacaatactaatcgtctttgtctatactaatcgagcacccaacgtttgtcttaggggctgtttggatagtgacagcggtttacaacaccaaaccttaggcacaccataatttcttagggtagtgtttagttgagttaagccacactttactagcacattggtccacacgtcatactcttattttctagccaaagtttgctatagttataaccaataatttattcactacattttgtgtggcttatcatagttatgataaatagagttatgataaagttagtatccatccaaacaacacgtaaaatcgacaaatcgccgcatatcgcactttgctgggcgaatgccacactacaggactcagccgaatatgtctgcagctatcacaccgaaatatcaccccaagatgcccacgaaaaggaccccgctgcgcgtagcggatgatgagcgacgcgctagcttttgcccctcccctcccct

SEQ ID NO: 42107 - DNA, 14219 bp, Oryza sativa
aaaagaaaaaaaagtaataaacaattatttcggtacgattagataccctgttgtctcactattgtaaggagatagtttccaggtgactgcggcttatgggtaggtgggagaggatgatttcagcgaaagacttcaccaacaaaaggtgggggaagaggccgatgagattggggcaagttgttgaaaaatatctctgatttcgaagaagcccggaccgctctcatcttatctcaatttttcatgtgaatagagctttctttttttgtgtgcgcttggggttttgccatcaaaggcgagctgaatcggttctccctgaccagcgagatttttctcaccttgcaaggttagttcgctcctaaaagcaagtttttttttaccggttccagacaactagccttcctaggtaaggctatgctagcctttgttgataaaccaaacgggccctaaatgatcagagatgaaaagtgatttctataactccattgctatcccaaatgtatcatgcaagaactttgaaggtccaatatccagtccaaggaaatttacttgggctattggaaaatggaattaaatgggccttttgtggagatgcatatgtagttgatgcacatataaagaaatgtaataatgtgatgacaataaatgtatatttcacagaccagcaagatttaggtgttaatatttcagcaggtagacaacatatacttaaaaggaaacttcgagctacaaatatatatacatttggtgaaagtccaattggtagcttctttctttccaaggaaccgtatacgtgagagacttccgtatcatacgattttataccaagtttgtattgccggcccttgttattagaccaatatacattctggtcttttatgcctaaactataatctctgcttctcaggcgcctggctatcacgaagaaacaacaagaaatattctaatacataagatatatataggaataaacatattttatcttcattttccaaaataaaaaaggatatattattttggcacaagttgaaagggttcatatgacatattgaaaacatatgatttcttactgtcaagttggtaaatgacatattgaaaattctggttctcaaaagaaaacatattgaaaaggtttaattgtacaagatgaatatcaaggtcatatgattcttaccgtcaagttggtaaatgacatgatggcatgcatttcaatattttattatttttaggttaattactttgtttgtgatgatgtatattaatttcccttaatataagagtctattacttacataactggaattttgtcaaccttgattcacaagttcttttaccttccatggtcagtgtacaccgtttgtctgttgtttggctacccaagaacaaataatcaatcaactaactactcttactttaagataagtgcaaatggggggatttaacacctataaaacaaaataatccatgcataactagtagaaaacaaactaaatctaggtaagccttaatgccttatatacaataaaaatgaagaaaataaaaaaatattttttctgtaaatctttgcaagaaaaacctgagtattggagaattaatatgttttattttttttactatatatgcacttttaaatgactgatgaaagctaacaaaaaaaatatttggatgaaaaatgataaaaaaaactgctttagcaaaatttaacacgttgcataaaagtagggtggttggcgggaaggtctggagaaggatcttgtgggcaatgtcgagtggaatcagaaacaggtgaatcggacagggagcaacgcagtcgtactaggctagctattttgacttgaaaaaaaaacgagcccgtgtggtcaaatacgtgaagcgaattagaacgttttctgaaaacgacgtacgcctcaaaggtccaaaacaagatctcatgagacgaggaaacggaaaccccatgacttgaaccttaattaatttgttctagtactgcactgctacttcttgagttcttatactgcgtagtagctcatctgttgaatgatgatgcgtgtacaacctctgttcctccgttaaaaaaatattaatttttaaggtataaatttatacaagtatttattcagatttatctttaaaagctggttggagtaaaagagtagtcaactaccgaaggttagatttaactagtcctacaaaactatggttggtctcctcccttaggtgaaaacccagtctagctatgggcaggtgtcggcaggagcttctgtcgttgttcacctctttggaggcttcgtcttgaaggtcttgctactctctcggttacttatgtggttcgtagttttgtcacaggttttctgtgtcttctgtgtaaggttttgtcggttttctcttagcaaaccgtgcagttgtatggttttcgatcccggtttcccttataaatagagtcaactctcttcttctaatatatccagtagaacttctaccgtatactgtttcaacaaaaaaacaaaactatggttactagtgattgtagtttcatatgatctggattcaacaaaaaaaaataatgatctggattcaacaaatgattcatgaattgttgattcgtatggaccaacagaccgtcggaccatgcatgtcgctctcattatgcataatgaaattaaatttcattatattagttttgggctagttgatcgatcagaaagctagatcacctaattaatgaatgatgtgcaatcaaatgctgagcaagtttcagtcctttcataatattattacacttatatgccatttctcatgtactttcttcaatgtgaatgtgaaaaatgttagaataacttacattgtgaaacggatggagtatatgtgtaaatatacaatttagtgatcaaattaatatactactagttataaaaaaaatcctccggaaagcaataattttttccattattttacgatctgaggagtataaaatgaaatgattgtcctatagtctattatagtttaaacacaatatatctccacaaatgatacttcaaaggttcattgtattacccaaaattctttaaacacaaatacacaatatctccacaaatgatacttcaaatgagggtattttgggtagtgaagtttgttgtacctgtccaaaataccctcatgcctctttaggctgtgttcgcataaggtggataggaacatattccctccgcacggaaaacggagcgattcattagcgtatgattaattaaatataagctaattttttttaaaaaaatagattaatttgattttttaaaacaactttcatatataaatttttttaaaaaacacaccgtttagcaatttgaaaagcgtgcgcgcgaaaaacgatggagaggggctgggaaaagagagttgcaaacacagccacagaaggacagaagggtggtcttcatttgatttaaaacctcagttttcgattgagagaaaatatgttaccacttcatgtttttcaagtttcaaccaaaataaataaaaatagaggagatttaacatggaagtttgtaaacaaactcctctaacgcacagaaacaaaaagggaatgagttactcctacaaaacacccggcgagccacggcgccgctgactgcgtagggcgggcggcggctgtctcgttccacgcacccccaccaaccccagtacccaagccaacggccaggatcgtcgtccgcctcgcgaaccgacggccgatcccgccggggcttggtcagtgcgcgatcttttattactcccaaagttccccccgacctactcctcctcctcctcctttccctccctccgcctccccccacctcgcgtctcgcggagcccggagagcagcggcgccgcccatggagtcgctcgcgctcctccacgccaagcccggcggcctccctccccgcgcggggctccgcctcccgctcccgcgcgcgcgatccgcgcgcgtctccctcccctcctccccggcggcccccgtatcgctccagtccccgctcctcctcgcttcgagaagcggccctacctcgcgggacgccgtcgtggggttgggattggggtgcgggctcttgagacggaggagcggcgctagtggtggtggtggtggtggggtctcttgcggcgcgcagcctgccgcggcggcggcggcgggggcggtgccggcggcgcagccggaggggaagaagttcctcggcgtggaggtgaagacgctgaagaagatcgtgccgctcgggttgatgttcttctgcatcttgttcaactacacgatcctgcgggacaccaaggacgtgctggtggtgaccgccaaggggagcagcgcggagatcatcccgttcctcaagacgtgggtcaacctgcccatggccatcggcttcatgctcctctacaccaagctctccaatgtgctctccagggaggcgctcttctacaccgtcatcttccccttcatcgccttcttcggcgcctttgccttcgtgctctaccctctcaggaatgtgatccaccccaccgcgctcgccgacaagctccttgcggcgctcggcccgagctttcttggccccgtcgccattctgaggatttggagcttttgcttgttctatgtcatggccgaactgtggggcagcgtcgtcatctcggtcctcttctggggcttcgctaaccaggtgagtcatgggtttggatttttgtggtcaatctaggcatgtgcaaatgtcaatttattgtctattttcagtcaaaaattgatggccatctcattagctaatgtttaacctgatgtttggctgtggagagcaaaacatgaaggagcagagtttgttgttgggtttctgtcactccgtcagaaattaggatgtgctcttgggataatgggtagttacagaaacgttggtttgattagtatttagtagtattgctcagtgtattgtcaaacctattggctaagtctaggtgcttgttgctttctggcatgaatgccttcaacttcatgattgctactttgctagcttttgttaatctgaattatatttagttggttaagttgcatttttgttgtgatatgcgttcttttacaaccacttgcctggatatggttcacactttttaactgcttttgcaataagtaatgttgattgatgtgggcctgtttgttttgagggccagagttgcagatgaaaccctagccaattttggtactaccaaaccaaacaagctgcagcctttaacataacatgtggccatattatggctacttttcttcccacaaaggaatgcctgaatgcttatattggatagttttatacatacatttcatttgtgtgaaacagtagggaggatccttgctggaagttcaagagggggaagaaatacttagggcaagatttaaaataagagaaaacaaagacagaaacaagcttttcaggagatagggatactctacacaaccatgagtagctagctgataataattcaagacaatctaggtgatagaatggcattatttcacaagtacaaatgtttgaacttctctcttatatctatctgagagaagacggtggaatagattgtgtcaactctctgactgaataattctgcataggggatatagagttttttttttctgggccatttgccagagtggctttgtgggctgttggtcatgcctgaatgagtaatgttggtgcatccgaataacacgtgtgtcctcagctatttgatttcagaattacatctgaatggtaggtgatcaatgtcctcagttatgcagagttcacagtggttgttttttgttgttcacgaagcttgaccagaggtgtataactgtcaattggttgcaagctggatggggttttctagtgttgtctgacgtttggttgtatatacctgtttaatattttctgaacttcccatcaaatggtgacccttcaggctacaactgatttcatccatccttctgcagattactacagttgaggaagcaaaagaattctaccctctatttggtcttggggctaatattgcgctcatcttttctgggcgtactgtgaagtatttctcaaatctgcgcaagacattgggtccaggtattgacggatgggaggtgtctttgaaaggaatgatgagcttagtggtgcttcttggacttgtcatcacttccatctattggggggtgaacaagtttgttttgaatgatccttctcttccgaagtctgaccgtaagaagaaaaaggtcagccgaatagttaaatgtgcttcttttttttttttactactactactacaaataatgcactaacgttttttttcaacaggataaacctaagcttggaatgaaagagagtcttaaagttctcctctcctcaagatatgtaagggaccttgctactttagtggttgcatatggcatcagtatcaaccttgtggaggtcacatggaaatcgaagctcaaggcacaggtaactttctcagctttgtttgtttcatcttcagattaatttgtcaaacagtttttctaattaagtatttctttcttcatcatggcagttccctagtccaaatgagtattcatctttcatgggtgatttctcaaccgctactggcattgctactttcacaatgatgctgttaggccggatcatactccgaaaattcggctggggagtggctgcaatgatcacccccacagttttgttgctgactggcgtcggtttcttctccctgattctatttgggcagcctctcactcctatgcttgccacaatgggcatgacccctcttcttgcagcagtttatgtgggtgcacttcagaacatattcagcaagagtgcaaagtatagtttatttgatccatgcaaagaaatggcctacattcctttggatgaagatatgaaggtttgcttctataccagattgcatatttattcatgtgattcgacgatgaacatttaaaaatatttttgcgcattattctgctttgtatactctcgtgattcatttaagcagtttgttgcttcatatatgcatatcccatgtgcatcatttagaaattatctagcaattcttgatgaactagtatctgttaagtaatttaaagcttctgtcttgatcctgtagttgtaagataacattgcctgtgtttacctgcttccattcattgcatcatatttgctttagttacaccaataagtgcaatccattggcatgagcaattgagcagtttgaactgaatgtcagttctctatccataaagtttgatgttgtgggctttgtacaaagcactagggcgagtttgcaccaccaattatgctgcagaagccaactctgcttcctctgtttgcaggtgaagggaaaggcagccattgatgttgtctgcaacccattggggaagtctggtggagctcttattcaacagttcatgatccttacatttggctctttagctaactccaccccctaccttggtggcatactgttggtgattgttctagcatggctaggcgcggcaagttcactagacaagcaattctctagcttggctaaggaagatctcaaaagggatatgtctgcaaaagagaaggtagatccttccctgctcaaggctcctgaggctgatgtattggtggagcacacaaacggcactatagagagcgaagctactgcaactgagagttcaccatcaaactcatctccaagtaattagattcatctttctttgacaaagtcaatcgataggtaggagaatgattgcagtgggtagaaataatggtgatgaaacaattcacggtttctcaagtttgtaacagtgcgcagaatcaagctgcctgtttattttgtttgtaacgtatgcaaattttgacaagtgcactgaacgccattgtggaaattcaaccgttctggcagggagaatgaatgaataggtttcccacgccttgcaaaattttccttgtgaatggattttgcttgcctattgaagtgggccatgtcaattggtaagctcttgttatcccattgctctaattaactgaaatgatgtcataacaggctatggcaggatcaaacaagcaatggctgagagctcaaagggaataagatcactattccagcaaatatcacttatattgattccagggcttatactaatattttttatggtaattctccaatcttattgctaaccacgcaccaagtgatctagggcggattctgtgtctgccatttcaagtaccggatcacatcaaacttatcatccatccattctcacttcctttcctatttgactatgacatgagaagaattctgaagtccgaagcccagtgatgactaatgactggccagccgagaggccaaaataccagatgcatgtgagtccgtcttttttgtgccggttcagcagatgcatgatactgatgtacatgagcaatccatccatcggttgctcggctgcaagtctgcaacacttgccggacgtattggttgattttgtcgccaaattcctagagatactccgtactagttagatttagattctcatcgttgcctgctgtttagtacgatccatgccttatgtgagcccgcttgctcgttcactccgttggaattttgcaattctgatgctgagccttgtttttaacgagtgtttggtccatccgtttgtgcataaatccgtgcggatgaagcctagccgcctaatgtatcttagaaactttgtgagccattcttctttagggcaaaagctagtaaaaggtaaatgcagtaactcgacgtggacagatcacctaaattcaggtccaaaactctcctattctacctacgctttctcgtttgccagtacagaagcatgtgatcaattttctcccattagtcgttctcagtactctgcaacaacagaagcatcatagacttgaccaaagcaattaagcggacacgtcaacaaaacaggcatcaaactgtccagaaaccaccttcctctgacataagaatgatgtgttgtgagagaacaagtattctacccgatctgcaactgcgtttaagataaggtaatccgtaatcttttacggctgcaaaactgtcacataaaagccacacctggatggagttctgcaactaatcgagaacagagtaccagcctgccctttttacttggtttacgagaagatgaacacaaagctacactcacacggcttatgaacaatgaacagtgatactaaaagagaactatagagaagagtgcttgcacgcacgccagtacacccctccttatctgaagcacactcactcgcactcgacgatttgtcgccatcggagaagccattgtgcaagatcatgtcgcattatgcgacggccccacgggcacgggggaggaggcccaccacttacacgggtgcggggcccattgccacgttgggcctaacaatccaattccccaccgctcgccgtaagccgcacggtgacgcagagacgccggcgagttcggttcactgggaggtggtggtggtgcaggacgaggcggcggccggcggccagaggcgggagaaggtggaggagacggcgattccggccacgttgagccccttggtgccccagtccggcacgggcacccaccaccactcgccgcgggcgcggtcgtacgacagccacacgatgtcccaggcgccacggcagttggagatgaggacgagccggaccacgccctcccgctccgacagcagcccggtcatcacggcgtacggcttccggaacccctccaccagctcgcccggcacggtggaggccagctgccagtcgccgccgacgaccgacccgaacccgtacaggtccacgccggccaccaccttcacccgcggcctgcccggctcgtcgatcaccgtcgaccggaccaccgcggcgctcccgtcgccgtacacgtggagcctgtcgccgccgccgttcgggttgtgcgggaaccgcggccggaagaagaccggccgctccacgcccggcccggagtacaccatcacgcagtccggcccggcgtgcgccgcgcacaggaacgtcccctccgtcccggccgccgtcgacgccccctccgcctggaccgcctccgatgactgccacgtgtccgtctcggactggtactcgaagaggagtggcgtgttgttcaccagctcagcgaacagaaaccttgtaagttaacagtaatcaaccaattaacaattgagtttgactgttcttcagcaatgcacagtagtagtagtggagtggagtaatacgtaacagtaattaattacgtaattactatttggaagatttccagaatcctcgggcgagaaaaagacgggtacctaaactggctcgacccggggggatcggcgacgagcttgaggccgaagcggcgccaggaggaggtgccgcgggggccgagcggggacggcgggaggcggcgggcggcgtgcgccgagaggtcgacgacgacgagctcgcggcggccgttggcggcgaagaggaaggagctgccggacgcggccaggaagtagaggtcctcgccgggtggcaccgcgggcgcgaggatggcggagacggggatgcggaaccagcggccggacggcccatggaacccccggagcgcggcgtcgcgggggcggagcttcttgaagacgaggagccacgcggccgcggggcctggcccggaggcggcggaggagaggtggtacaggcggcggaagtccggggaggagatgacgtgggagagcgggcgcgcgacggagcggacgcggaggagctccgggagggcgaggcggatgaggatgtcgtggaggagctccgacgggaggaggagcaggggacctagagcggtggtggcggcgctcgccggggaggggtggtggtcgccggtgaggtggtggtggtcggacatgggtgggggcggggatgaggtttagtttcttggggatggggttgtttgggggacaagtttcgtgggggttttgtgggtggcttttatacagagcagaggagacggtttttggttgttgacctgctaaacgaaatttgcgtttcatgcggttttaagatttatttcccctctaaatttgtactacatcgtttgtggttgagatgaaaagaatgtgttcgtagggcctgctttcatatagtttgtgttttctgtttagtgggcggtggatgatcaattccgaatatgcatatctacctagaaaaaaaagggtctaaatttgttcagtagaggcctagagggggaaaaatatttataaataaattcaaaataacaaactaaaattgcttgtcttgggcttgtgcacgtcgatttcaaaatatttaaaatgatacatcgactttgtcaaattatttcatcaatttttaggatcatttgcaccatgtattcggaatgagtgcacaagaatttgtcatgaactggaagtgtcctcagtatttataattgtgtgatccaaggacctagagtacgtgctactagaatatgtttttttaaatatacttcactaggataagtttatgcaaacgtataaaaggatattatttgtaactagtgtttctctgtggggatactgacattttgtcgctggtaaacatttttgtattgccaacattttattagtaccgtccatgatagcacaaattcctgaaattagtaatttgataaaaagaataagttgcatgcatctgctcctacaatttggatgctcacggcttctcttccaagaatatttagtcttcttgttcaagtaaagattataaatctagtagagctggcctatctcaacaaaacagggcgggaaaccaacagaattttcatggctccatcccaacaaagagatcatatataagggcgaaaataaatttcctgcatagacgtcagcaagcttatcgttgagtttattattcgttcttgagcaattgggagtttgggactaacataattagctgcattaggaagggtccttttttttccctcttaaagtcagaatcatgcacctgttatgcatatgcatatgatagaaaataaaacagaaggggaaaggcacaaaggcactccaggatgttctatccagagaatagcagaattgccacttggattatcaccaccaatttctcttctgctctttcacaggaaaatgtgtgacctgtgtgagccgtaagcccgtgacacgctaggtcactagcgtacgtagttagtctgtggcccttcaaaattttattttgtacagaggacgccaagatgaagcctgcatatcaccttgatagagaaactagaagtaagattcccttttttctttatttctcaatgatgtgtgttgattaaggcttggagtgtagagtgaagagtctcttctgtgcaaggaaggaagctagcagcagagctattggtttcttatcggaataataattagtttcccgttttttcttctagactcttatccagaggtcgatcaattgaccaacaatcgcttgcttggatactcaattatttggagttatacagctcaataattgaaaagagcattaatttgtgttgcttaggcctcggcttcacggtgatgcagagtcaatcggaagtcctggtgcatcatttctcatccctaataatagtgtgcaagtccctctagcagatgacggcaacacttaactgcctccccaaaccaacataaaccaagaaaccagagaagaacaaagcgaatatagttagattaaaataacttaatgagttgtaggttcgtgtcagactgaatatttgaggtttgcatgcagaggctacatctaaaactcctttcttcttctgctccaccaacaaatgatgagacatcaacagattatgccgacctgggtggatggttttgaggcacaagaataattattcatatacggttaaatcaaaacaagcgaacgaaagattatggccaaagattaggtgaagatgttgaaagatgcttgttttatggggtccaaagaattgctttcgtgagtggcaagaactcacgcatcccttgtgtgcaaccgagatattgttctcatgtggaataggccggtgcaacttcctttaagtacgcctacaaacctgagtttgatttgatttgcttggatttcgttatctcaggatctaattattatatttttagatccaaaatttgattttactttcgaggtactgtactaaggttagtgctaaaaggagatgtactcctattgaatatagttaatagacggctgccctctcctctacgaaaactctaccattggcagagcttaaccatcaaacaacaactaatcatagattcacaggtcgctcttgggctacctagacagcagctaataattaattactactaataaagaactcaccatcacggttgttgtaaacaatcacccgattttcagatgagaaacatttacactgcaagacatgggagacaactaataaccggattaggggcaaaaccaccccgatagtcagaaaccatggcctccgactccaagaaaagggccagattaacccataccagatctttggagacaaatcatttgtttaccgaaagtaagaacaaaaagcggaagaccaatcgaacaagacagagttattgtcctgtggctgttatattagtagtatactctgacgattgagacgggaagttgataaatttcagaaaattttgatgacaaagcaaagcacgcgctgcgcggcgcaacacaaagtttgggattattcaatggagagcatttgcggcctgtggccggcgttgtgcggtgaaaatgccaatttaattggaacatcgtgatgtcaaatgagctgaggaagaccccacctctaaaaacttgtaatattaaatcagagccttctcctaccctctagcaagtagaagacctaacctgcagattaaaccctcttgtagtcttgcagattaaccaagtggaatgcaaagctgatctaagaactgcctgaaaatcattagcgaagtaagggtcacatgcatgcatcatgccgtccgtcaccgaatgaaagccagaaacagcaagttaaaagttagtggcatactgtatagggtgtgggcaagtgctctatctctgctattttaaaattctatagtggtggcggtgactccaacactggcagacacgcggagtatgagccatccgatcgctaaatccaacggctcatatcgtctttcccgtcgtttgcatgcccccgcatccgggctgcagga

SEQ ID NO: 42108 - DNA, 13692 bp, Oryza sativa
tctgccactctgttcatggaaaaactttagaatccagtgtcaaaatccccaatgatatagtgaatcacaccctgctcatccagcatcggcttctttaacccagtaaaatgcattttaacaaccactgacggattattttgtgctgtccatagttccgatagagcaatcagttttgatcttgtaaattgtaagcacctaatttggagttcgacagctggcaacggcatgttttgtcagggtacccgtcgccaggacgccgccgacgccttacacggtgactgcttctcactgccactgatcctttctcggtcccacggcacggctgaggctgtggaatctagcaatcgatccgtattcttttaaactatatgctactgtatgtgtgcaggtggttattgatctccacgccttggcctacagcaatggacaacgctgttgggatccctaaactcatgatttgtatctaataacaggtaatgactaatgacacttcaaattgctcttcagcttttgcatccgatgtaatcacttttctgttgagtcacatccaatacttattagatgctaataaactaaatctgtatgacaacaattacagattgactcatctaattttctgacagtagatgtgctgacgttcctatattgcagttgaatttaacttcagaatattgctgccagcttccggcctcctcaacatcagatcagtgtttcaggtgtgtgtgtctcatttaaattagtcttcttttcctggtttgaaatttccgctttgcaaatggcacgagaattttaagtatacgtcagtgtcgatgaatttctcaaaacaaaaaaaagaactccagttcagtctgcattgcgtggtgatgcataacacacaatagcaagaggtttgctctgagagtcacaacgtcagtacacacatggatggtgaaaaaacactgataatttccctctgttatcctgaaagtaattttgaaccaatataaggatctggccacatgcatcgaagaggagtaaatgtgttattatgtgggatcctggcagtttttttttttgggctatcagattagagaaagcaaatattaaatgggggcaaatactagatgtttgatatcctatggtacaacattctcacaaattacaattaagaagtatcaatctcgatgagaaacagtgtaaatatatgtaataaatattgatatcaacgccattgtgaattattttgtgtgtcatggatatatgcattatataccatattattatgcattatgcattacttggaggctcttctttgcaccctcgtccgcctgtgagtcaatccttcacgccggtggcctcatcttccccacatctgtatgggtgaatatttaggggattgaattttgggtgattgttggataggataggataagtttcatttggtttgtgagtcgatccttcacgccggtggcctcatcttccccacatctatatgggtgaatattttaggggattgaaattttggtggctgttggataggataggataaggtacatttggtttatgtttagtgataggacgtaccggttggtcagatactgttatatacattttgcttatcatgaaggcaatccctttttattgcatttcagaatgaagcttcatcttacactgggtttctctgatttataatttatcatttaatttttcagcatttgattgaatttcttacattgggtttccaacaagtcgtcgtcgattactcgtcgtctggtccccttcgcgcctcctcgcccccacgccgctagccaggtaaacatctctccctccccttcccattccttcgttaattgcaaggttccccctccccccagatcgccatattcttctctcggggtgcagtgtgagatcaattaagaagaatcagcactgtctaggctagctcactgctgtttcattctctgttttctcattctatgtctaatttatcttcttgtaggctacagccatcctggtgtttttagtgctgcacctctctatatatatcctttctaggtaaattttaacccctaatgttcactttccccgagaaaatccaattttgttgctttaatttcaggtagtatataacctggttttacagtttataaactgatgcttcttgtgggatgtcatgtctctgattaatttattttttaacatatgcaccaaatatatgtctgttactgccacacatgttttatattggattcagtaaatatctcctattacttttcactgccatcactctaggaatattacactctccaacgatatatatctgagttgtgaagttactggttttacatgtctgtgtctgagttgtgaagttactgatgaaaacatccagactcaatgaagtgtgattactgcatttaggcggtctgatgtgttttgtttttcagaaatggataagattgttgggggctccacaacatcaactacaaaatcaggttagctatgtgcatgttattaactcgaatgtaaactctttgcatgctaatttcacccatgtgttcctttcttaggccctcttgctgacataaccaatataagtggttccggtttggcaaattgacggggcaaggttggaaacaagtcgttacgtgccgttgaaagatacgacgagaattgtgatgtctttacaaataacactcccaactgcttcaaatggtatcttttacatattgcttgtttcctattttaattcaatctcaatctgtatccaccaacaccaatgtgatgagtataaacttgtgatgctggccatgaagttgtgcatcctgtggtgacgcctaatagtcatccatgtgcggaaaaccgcgatgcgtccttcaatacacccagcaatgtgcatatgtgtacaggtttgcatgaagatgttagtcaccttagtgtggctgaactaaaaagaaagcgtgctagagaccggtacgcagcattgaccccagagcaaaaagatgataggaacaagaaggcacgtgaaagaaggaaaagaaagaaggaggaaactcaagtttcaggtacaactgtaatatttatctgtacaaattaaaatatgtctggccaattatgcgaaacaatattataaattctcgtcgtgtgaacagccccacttggcgatatttcaaatataagcgctgttgatataatgaagtgccaattggaagtgactgattcttccccgctgcatcaaggaagtaatgtctttattgtttgtacagtttggttgaacaatatattattcgactgaatggaaattgatagttctatgtttaaatagaaagtgaagcttcccatcttaatatcacaccaagacgtctcccatttacaatcatcaacaatgtagctcactatggtcccaacgaagtaccaatgagtcgcttcactcaaagtacctaaacatgaatacttctgactttgtagttgataattcaggtatgctaatatctttttattaatgggattacaatgctgttgccatttataaatttctatattacaatatatattactgactatgttacaacaggatgtgaaaatcaatatgaatccagtttttttgaaggcagcgatcaaaatgagtgcgaccacgatgacgacatctctctaggtaacacattttacttcatcacatgttttttttatataaacttgtcaaacataaaacctctttgcttacatatgagaagtgcgctaagttagttattattatctattcatgtttgtacaatttaatatttgaagtgagcaaacaatcccataaatctactcatgatgatgttggcacatcactagataatgaattggtgcgtgcgccaaccaatgagacaaaagaacgattgcagtcaaagctagctcgagctagggagaagtatgcaactcttacaccggagcaaaagcaagctaaggtggaccaacggagaacacaacgtcaatcactaacaaaagaacagagactagagttgaatgcccgtcgtagggttgcaaggcaatctatgccagatgtggaaatccatgatatgaatgcttgccgtagatcaagacgacaaaatgttactcctggggaaagatctgctcatctggcacgacgtaacgcactctatgcagctaggcgtgacaaaccatgcgctgaatccattgcactagagtgccctgagggatctatcccattgttgctaaatccaacgccttgcttggaaacaaccggtgatgtgccatctacatcgagcctgcaaactgagcatgctgtagatcatcaggcgcgatcatgcacattcaatgatggtatcatctatatatgttttcattcgtactcgcaatttgggggaatttaactatattccacttttagatttggcaactatccaaatgcccttcttaagtttgctcttaattttttgcccctcttagatggtggcttcttaactatttgtcactgttggccatgtggcaatccatggcaaaagtgccaattagttaagaaacgtaacaagggaatttggataactgccaaacctaaaagtggcaattagttaaattcccctataatttgtacccttccgcatactaacttctcatatctcattgtactaaagatgatatggattccttcatggatgatgactccgacgatgaatactacatgtttgctgggctaggtatcgtcgtcgtgatatcttaatgtctctttcacatgtataatttttgcggactataaatcctttgcgctaaaccataccaggcgacgatgaggatgacgagatggtacaatctgatgacgatgacacgcaatcaccgacctcttctgttcctgatccgtatgactatatgtacagcaacattccacaaagcacaaatgttctgaagcctgaacctgactgtaaacactgtggtgccaagaggttccagtacgaaccgccgagcttctgttgtcggggtggcaagatcaagcttgtacaaaatgaaacacctcctgaactgatgaggctttggacaagctcggatccagacgccaagcatttccgtgataacaatagatacttcaacggccacttctcattcactacccttggtgtaagccttgacaaggcctttgcaaacatgagttcgggcgtgtacacttttcgggctcatggtcagatatatcataatatacattctttcagtcctagagattctggtccagagcatctcgagttgtatttctacgatgacgatccaacattgagtcatagattccaacgttcccctagccttgaccaggatgtgattaggactgttgcagacgtccttcggaacaacccgtactcggagacatttagaagtctagggcaggctgaagacctcgcgaattatcgcgtgacactaaatctggatcataggttgcaccaaaggcgttacaatgtgccggtgacaactgaggtcgctgctatctgggttgagggaaatgagagaaggaagttcgagcctagcgtgacaatatacaggaacaaccgtacgcggaaatctatccagcctttctacgaatgttatgatcccctctcgtaccctcttttcttccctagagagaatggttggcatcaaagccttccaaaggacaaaataaccatggaggatgcaaacgcacggaatggcgatgatcctggtaagtttatcttcgtactatgttgccttagagaattgatcattgtgcgttacatgactgtactaacctagatgtttctcacgtgtagattgtaacagcaggatacgagtctctgtaagggactactactgctataaattccagatgcgtcgtgggattttcaatcctatacttcacggcggactcctgttccagcagtttgccgttgacatgtacatcaaggttgagagctcccgtctagactatgtgaggaacaaccagaaggagataagggcggacctgtatcaagggttgatggatagcatccaggctggggagagtcgagcaagcgcggttggcaaaagaactgtgttgccagctttgtttgtctgtggtggccgaaatatgaagcgtcgatacatggatgccatggctttagtatagaagtacgggaagccagatgtattccttacaatgactagcaaccccaagtaggatgagattactcgtgaacttgagcctggccagacaccacaagatcgtcttgatctcgtggtccgtgtctttcgagccaagttagaggacctaaagaagcagctgttcgagaagcacatccttggcaaagtcattgcacacgtatatgttgttgagttccagaagaggggtctgccacacgcacactttttgctgatcatgagtggtcgatacaagctaacgtctgcagagcaatatgaccgcatcgtctcagctgagctaccggacaagaaaaaatatccagagctatacaatatggttgtcaagcatatgatgcatggcccttgtggtcgactcaacggtaggtgccaatgcatgcgagatggaaagtgcaggaacaactacctacgagagttcaacaccacaacctcgcaaggcaaggattcatacccgttgtataggagacgtaatgacagtaagagtaaggtggttagaggacatcctctcgataacaggtgggttgtcccgtacaatccttatcttctacggatgtacaactgtcacatgaatgtcgagatttgctcgagcatcaaggcagtaaagtacctctttaaatacctttacaagggacatgacaaggcctcgatatccataaacgaggcagataaaaacggtgaaatcgatgagattcagcgctacagggatgcgaggtgggtgacccctccagaagccttgtggcgtatatatggttttgacatatgccacatctcgccgtctgtgaggcagttgcaattgcatctgccaaacatgcacatgttggctttcgatgcagacaaggatctccgtgatgttctggataaggaagacgcaggcagatcgatgcttacggcgtatttcgaggctaacaggcagcatgtctaggctcgagatatcctttatagagatttcccaatgtggtttacttggcagacgccaggtaagtactggaagaaaagagatagaggtggccaggtcgggagaattgtgtgtgcccacccggcagagggggagcgctactatcttcgggtgcttctaaaccatgtgacaggatccacctcatttgaagacctacgtactgttgatggtgtgctcatgccgtcgttccgtgctgcagctgaaagaaggggtcttatagaggcagacaacaccctcgacgagtgccttacggaggccggtgtctaccaaatgccggcgtcgctacgcaggttattcgctaccatattggtgtactgcgaacctaccgatgtccgtgcactttgggacaagcatctagattccatgtcagatgtaacaacgcatgcccttatgctgtccaacagatggtgctgatagatatccggggcatgctacaatcaatgggtaaggaaatctcatcgttcccgctccctgaaatagatgaatcacatgatagtactcgaggagatcccagagagattattgaggagtcttccattgttgtggagagagatgatatgaacctcccagaccagctcaatgatgagcaaaggtctgcattcaataaaatcatgaacgcggttggtagtgctcaggggagcgtgttcttcgtagatggcccaggaggcacggggaagactttcctatatagggcgctactagctacagtgcgtggcaatggtgatatagaggtggcaaccgcgacgtcgggtgttgcagcttctataatgccagcaggccggaccgcacattcgcggttcaagatcccactcaacattgaggaagggtcgtattgcagcttcaccaaacaaagtgggacggcaaagcttctccagatggcatcgcttataatatgggatgaggcctccatgacaaagaggcaagcggttgaggccctcgatatgagcatgagagatataatgggttgtccacgttctccgtttggagggaagacgattgtgtttggaggggatttcaggcaggtgctcccggtcattaggaagggcactaggtctcagataacagaagccactctacgcaggtcctatctttgggattgtatggttcaattaaagcttgttcgcaatatgagggcgcagagcgacgcgtggtttgcggactacctccttcgagttgggaatggaaccgaggaggtgaacaaggaaggaaacataggccttccttcggatatttgcttagagtgcaaagggaatgaaacggacctcgaaaggctcatcgataccgtgttccctaacctaaacgataacctgacggacccaaactacatcatatgtagggccatattgtccactcggaatgagttcgtcgatcgaataaacatgaagatgattgagcggtttagaggagatgtgatgacatatcatagttttgactgagcagaggatgaccctcataactattacccgccaaaattcttgaactctctaactccaaatgggctacctccgcatctgcttaagctgaagataaactgccccatcatgcttttgaggaacattgacccagccaacagccaacggactttgcaatgggacaaggctggtggttcgtcagttcggaaaaaatgctattgacgcggagattgttgtagggcagcatgctggaaagagagttttccttcctcggatacctctatgtccttctgatgatgagatgttcccatttcgcttcaagaggaagcaatttccggttagattgagctttgcattgaccatcaataaggcgcagggtcaaacaattccaaatgcaggcgtctacttaccagagcctgtcttctcccatggtcaactatacgttgcactgtcaagagcaacctctagaacaaacataaaaatactatcgatgccggtagaagacaagaaacaaaagaaaaagtctaagcgtactggcgtgaaggacaatgagaagaaaggaaaggaattgtctaaacaagctgcaacatacacaaaaaatattgtgtatagagaggtcctcacagattagaaaaggtatattatgtgactaattaaccgtccacaatatgcttgcttaaattccattcttactgtaatttttatattccatgtctaacatttcttgagtttttttccttggacagcagtaaacatttactttcttggtctgccccttctcctgtatatgcctacatccactccttccccgagcagtccctccggccgcctcctcgttatggctgactcagagaccaaaaccgttgtagtcggctgctcgccgaggagttgcaggtgatcaggtaaagatatttttctatcagtccttggtgaaccaccctggcagctcttcccttgctcattatttcttattctttgctaataggagagaagcagccaggtccaggatgaagcaattcactgttatgaacaaattcaagatgaagtccttacttgtaagctgacagttatttcttcttcttttttaaaacaatcgtagttggtttgtacatgtcttgcagcttagtactgatgttagcagatttatgaggttctgctttagttcagatttccaattgcagtttagcatttcttgtaatcatgttgtggcagtccagtttccagtggggtactgaataacacttgagtggagatcatctgaactgaaagccaacatttgagctcatgctattagcctattactatatcaaataaaactttgatctttatcaaagaaaaaaattatacaatttttgtttctatcattattttggtatgagttttccctgctcatgctaagctcacttctgccaaactatttgatgtttctagcaagagagtcaaatcagtgatgtctttatttttagaatcaagaaacatgaatattcatataatatgcaggtcttcagtgagtgttaagttttgtgtgaggacgtaagcaggagccaggaactgtgagtactgatttgtaacggagcacatttgatcagtaatttgctccatgtgaaaggagcttcggattcagattaggtcagggattaatatgttttgctcaactggctattttatttaattgcaaatttcagtttgtcaaaccacttgtaaagttttttgcatgttgtacatgcatttggtaataaccatgaagtcatcttaggtaaagagtttgagcattactgttgcctgctccttaaattttagtcagcgagttgttctgaacactaattaaattatgttgaatgtagtttccttacgatgctatatttgtcttttcaacgccagattttatcctccgtgatcaacaaaattccccgtagcaacgcacgggcaccctactagttagtagcaaatcgtttgaaagtgaaggagtcgtctgggcaatatcgagttgtcgactgctcaagtggaatcttgttgccgtactgtttatgctttaaccccccctgctgccaacagatatggtgccaaaagaggcctaatttcatccaccaaagttagtgttagtgatcgcctttgtattttatttttctttggtcggcctgtcctttttggtagccacataggatgagttgacaccttttgttttcttgccaggggttaggttttggttaggggcccatgcgttttatccgtgcgaggagaggaaagcatgcctttgccaagtcagcttatatactagtactagtcgatatgggttcagataatctatttttcaattggaaaactaatctataccgagttcttcgcttcaatattccacgctttgtctctccgctccagaacctcaaatatgttaaatacgttttgtcgtctcgtctcgtcttttaccgcaacgccgtcgcggagcggctcggcagcagccagcaggtgatcctgctttgctagccggaagacgcagaattagggggagaattagcgtacgtgctcggcttctctgccctgctctccgctcatatgattgggggtgtggaactcatcccacagccggagaagccggtgcacatgtacacacggtgccgtcgcacgcgccgcgctcacccagacaggcttggaagttggatgaggaggttgggggcaagtcagcagtgctaggcagtcggtggtgttggcgccagcggcggccgtgcagtcgcagaggaggcacggcgtttgcgggtggggtggccttgcctaggccgcgacgctgtaccgattttcttggcacgacccaagttggcctacgagaattgtgggtcggcctcatgtgattcttgccggtgtcgtcgctgggtcgacgtcggcgcgacggtgcgaggctgcgggcggcacgggctaacgcctcggcccagatctttcttagaggattcgacccagttctgcgagtgaaacagccagttttatccagcaatcggccgaggaagaaggaagttcatatggcaacgtggatatttttcttttgaaaaattccattttacccccgaactattttcgtggagcactaacccctaaacaatttctctgttcatttatcgacagaactattgaaaacgattcacgttactccttaacggtatttctcttttttctctatatataagttgtgttttgcaataaaatttggaacttttgatagattcattacaacctactctctccatgttaaaataaattaagctcatatttagattcgtagtactaggatatatattgtattaggctaacttattttttgatagaggaagtgcctcctaatatttttagaattttattaacattgtttacataggttagaagcactagggctgatttaaacatcagggttttaaatttcaagcaaataatcatgagaaaattaaaatattataaaactttaataatggtgtcatctatggctacaaaattttagcttaaaatatgtctcatataaagaaaaaaaaagaagagaaatacaattaagtagtaaagtggaacatttttaatattttaggggtaaaatgagttaggggtttacgtaatcgggtgaaagagtttggggaagtaaaatggttttttcactccttttttttccttggatctgcaaggcagatattaatagagttaataacagggtaggatgggttaggttggagaaagacagctccacccctcacccttgacctctcattcctcccccgacgaccctagggtcggtgggtcctaaccctcgaccgggccctgtcagggaagataaggtgacgtccgggaggctaccacgttagtggagcactagtagccagtagccaccacatcgatatggagggagaaaataccaaggctagctgctatcggggcattactttaccaagaagaaggtagagaccggttgtcgtattgggggagcgtcgaccgccacgacattgggatggaagaagagaagataaaggcggatataatgttgaaggagcacacaccagctgctgatattgctacatcagaatggggagaggatatcatgggatagaggcctcaagaacataccgactgcaacttgtcagggtacgaggaagccaagtagttagtaatgtacgatgacgagtatgggatttaggcataatgatactgataataatagcatgttggaattcgcttaatgggttgatggccttttttaattgtaaacattatctcctgtcttgaataattttagggcccatgagtcacgtgtgggtggaacacaccattcaaccccatgtacctgcaagtgggaaactcaccccaccccatatggggacacgatgggtatctaatttcaaaggaaaattgtcacctctaaatattatcatcaatgtatcactattatacagaagacgtgtacgcgtgtgcacaccattatgcccacacatgtgtgaatacatcctctaaaacaaaaacaaacagaaagccaactataaataaaaaattttgtattaaaaatgcatccatgtgagtgtattatggccaccaggatttcaacgctgatggatggggtgcatgcatccacaatttcatctccacaatctgtttaattcccgggacttttttgaattatttgtaaacaatgttgtgtatgtggtgtacttctttttatgtaatcgaaaatgtgcaagtattggtatatcattgtttttccccctgaagttggatatatggaatgcatttttcttgttaaaaggcatatgaattgaaaaccatttaatctattgtcccaaccgtagcctgaccacgtcgcgactccatactgtgctattacagaacaaaatggggtgcgcatggggcgactcctgggcgatgccacgtaggataggaacaatgttagggttggaaattttacgaaaaagtcctccgatttatccgtaatttgatctcggtccctcatgaacagtatctctgagctgatattttacgtggaagcccttagtaaaaccggatattccatacgaaggagagaaaaatcgtgaatttcaaaagaaattaacagaccactgattccatgatcggtctcgtgacactccgcgtgaacctctgttcagatgcacctcgtactgaactgtgcgcgggacagcagctgcagcaaccaaccgaaagagactcccagcagtccccccccccccc

SEQ ID NO: 42109 - DNA, 13881 bp, Oryza sativa
ccggcctgggtgccaccacgcgcgcgcgcggcgcgcggtacacctgtgtactcaggtctggactctggaggagtatgcaccaatggtttcctctatgaggactgaggtgatagaccacatgtacgccctcctgtagtcctgttgcatctgccttcggccacatcagcccacatgctgctctcactttcctggcattctttcaggcagatgaacgaaatgaaaccatgaatgtgaaacccagccgctgattccgatcagccctgctggacctgataccgcgggcaggggcttcttttctttctttctttttttctggggagatccatgcacgcacagcacaggttgttgtcatggacagtgctagtttgcagagacatgtaccagatgctcttgtggaatggttcgattcagtgaacgtaggaataggaaaaactcaagaatagtgtaggaaatcatatgcaaaacagaggattgaaaaacatatgaaaattataggaatgatcgtttgattggtacaaaggaaaaacataggaatgttgagtattaagttaatagcaatcaaaatttgaatggttttactagggtaaaccttatcttccaatagtgttttgcctcgatcctacacataggagaagaaaaatgagctcaaggtggatgttaattttcctatggaattcccttgaaatcatggttataggaaattttcccatgcttttcctatcttcaattcctacaaatcaaatggatgaacagtaccaaatcccataggattcttgttcctatgtttttcctccattttttcctatgaatcaaaggaggcctaaaaggtgcaatcagcgcgatcggttgttactttcttcattatttttccgaagactactttctcctactacggtatgttgttagataggtgcattttggaattatcaccgttaaaattcaacatcttaactctaatgaaatataatctgatatataaaaaaatagtattagtagatttatcataaaaatccgttacatcttaacattcttatcaatatacagttaaaaaataacgactaaatatttgcgttggagatttgaccttagcatagttgaaaaaacaacaatgcactacccgtgtccaagtctgatggagtatattaactttagtaataaaacgatgatccaaaatacaatttacctttttttctggacacacccaaccttgccctgaaatcatagcggatgtgtatgggcatttattttgcccatggctaatctaaacctgattcgatattaatttgtactaattttggcccatttactcacagctcatgtgaaaatggaattctagctggatttgccctcaattatcccccccccccctccctctctcccctcacctatctctctccttccttgacggagtttggcagagcagacgaccactttccgttttgaaacaaacacttcgccaaattattttgagtccatctagagtaatacctattcggttctttttttttttgtgccaggaaccatatttgaacgagtgataaaaggattttcagttctatactctactaattaattgagctatctgatcatctatcgtgcatcatcctagtacagtactatctatatcaattaaaggtgcaggtagtcttgtgcttcttatatgttcttacattcttagtctctatccgcgtgtatatgagctagttttgtgtttctagcttgttattaatcgtgttcctttctgtttaattatctataaaaaatataactcaagttataaagaagctcactaattacccatcggctgcctgactgtcgggcatgggcactgattttgcccctcaagaatatcaaacgtggattaaagatgttgggtctttgatcagccgtgttccttttatgctcgtgtccgatccgatccattgacatcctaaatggattagcgtgtgctcttccctttttttttttcgtggatggaaaaaatggatcggatcgatctgaaccgcttcatcattcctcggtcaaataatgtatggagtacgtactggtaagtcggggagcatgagcatctgcaaggctgcacgagcgcgagcattctggtccctgccatggctgaaagatactgattagctgttagcgatctggagctagctaggttactgtgataaatacagtttttagtaccggatggcagaaacctacctgcagacaagatcacagggcaaattgaacttgaccagggaacttaaagcaaattttaaactttgagatggatagcacgcatccatgtggtttattgggttcaccaaatctggactccaagtgtccaactgataaataaaagaatggggaaaaagggcttcgtatgattcctgaaacgtagcgctttgtacgtgcgggccgacagtttccacatactgcagcgcattgcacggtacgaccagctacgaaacaaacgcatcacgccacggaatatggattgcatgatcagtattaattatatgtgcatcagacaccaaagaccatattttgcacaggtcttcagggtggtcaacaacccatgcatcattaacaaataatcttggccagagaatctgcatcgacatctctacctgaaagctgaaaagtgtcagggaacaatggcaagtacacgttcggtcagacaagcagagatacgtacgtacaatcgatgcctactcttcagctaatctaatccttgcgagctgtctcactccgtcaataccgatctcttgaacggctggtctcgggctgctgcttcaacttcataattaaagcccacgattttctgtttaattagtgatagtggggataaattacattgtcgatatacttggacaacgacctatgcttctgattgagctaagtagatttctcgcgataagactaagcttagcctacaaaaagttgttataaaagattaggtggcaactcacagctcgggctgtacacttggatgctacttgacacctaatacatctacccatatatgataggattttcgctgtcaacaaatcaagctgcttcggctagttcccttttgcacgtccttgtttattcactaattgcgtggtgcttgctgcatgctgtgttgctgtagcctgtactgtgtgccagcagattttagagcaagtttaatagtactagaaaattagcgcgcctctgctcattatagcctgtgtatattttccaattggttttcaaaattcaggtttataaaaggttggcaaatgaaatattcgatggtgttattaactgatgcaacaagtttagctaaattagctcctatggcactcctgctaaaaatagtaactattgccctgtaagaacaaaccatcgaaaaccggatataaccataactaaatatatttacattaattcaccaagataaaaaaaaagcctgaaacagccacagttgtttccagtctagcttctagctatggaacaaagaagaagcacaacaatgtagttacagtgaaagcaaaaataaatttaagaaccagtctttcacacatttaaatgccggaggtgatgatttcgagcacgcggcagcaattttcatcttcgatatcttgcatccctagaaatgtcaggagacgaacagaaattagctgcacctagagtgactgatagaaggagatcaagagcaagagacataagcattgcaaagccagatcgtcctggtgggctagtggcaaagcagcaaaagctataagagactatgactatttttatttttagaatgaaacaacaatccccagttctgaaggaaaactgttgtttgccaattgttagtttttattataggtgcattcaaatgataatgaaataacttgttgataggcccatcaaagtgataacatccacccaacaaaacagagaaacaaatgtcttcagaaaacattacatctctatatatttgtcagataactgcaaaaaaagcatgttcagagaacactatattttttatacatttagagaagtggaaagaaatataacaaactcatgatgtattaacttaagaatgtggtcaccatgtacagttgcaatcgatcgcaacttcagaatttcttaagttaatactcaggatgttcccttgagtagaacacttgcaattagggcactaaccaattatgatgcaaatgtctaaattgtgccacttttatagatttattttcgtttgtcaggaggaaaactctgtaaagaaactattgtgcaggattgagaccaaagaaaaaaaaagtatgtaccagtgctgcagtgcaggatcattttcatgattataagtgctattagaaagggtattcagaaataaaaaaaaaacaaacttgagttttgtcaagaaccattcctgattatgtttttttagcttattactatttctattccagattatgctaattgtatatacactaatatctctaactcatgtataattcgattgctgctatgatggaatcagtaatgcataagttaacagattaataatccatatagagtttcacatgacaacttaattagcatcaaaatttgcaatttcaagtcgtgtttctcctggatttctgcagaagtggtagtagcaatagagcaattaatatactatccaacaaaatattcctaactgagtgctaatcaactgcaactctaagaaataaggaaatatactcttttttggtcatttcatcgaacaccatgaatgcacagtttgcgttgcaaatcagcaaccacacatccttcatgtccagggaaataaatggaacaaatatcagactatagactgtagcttgcttaccactgccggccagtcccgcgcgtacgcctccgtctcctctcatgccatccgcgtcgccggcacctgctcccctgcttctctgccaccccacccacaccgtgcaaaacttgtgtcaggccatggcaatccgaaccaaatccgctagctcgccgaggaggaggaggaggtagcgcacttacatgtggagggggcgaactggagcggaggtgggacgtacaactcgagcgctgcgccagcaagctcgaccgcggcccatcgggtccagcgcatcggcaaggagggaggtcgatgggcagcaaaggggcaaggatcggaggaggtggcgacgctcggctaccgagatgcgaacgagcaggagagctgaagtgacgatggcggcactgtgggctagggtttttagggatggggatcggcgaggggccggggaggcacagagggatcgacgagggacgggagcggcggtggccgacgccggacggccggagacggttcgcgaatcgcgctaaactcccttgcatcatctctgccgttgattcctaatccaacggacgcgcacgcgaactagaccctcgaatcgcacacagccacatggcggggctaatcggccgagaatgcgcgtggaattcgttacaagagatagtcactgctaactctaattcatatatagccaatctaatagttaattcacacaatagttgcttactattctattaatatatgatcccacctgtcatacacacactgcgtcttggagtccgcgttgcagttggctacagatctgtagcccgctgatcttctctctcattctttatctcattaaaatatgtttacagctagctaatagttgtacctgctcttagttaaaacttgcacaacacacgccccaatgcgcgttgtccagtttaggacgttaggccaattaacacccgcgcgtgttgcatctgctatatttgaatgagaaaaaattggatagttagttcttgcaaagaactccctttatttttataatttagatataagtaattatagaatcaataagaggtgaaattaaataagagataattatgattgatttcggtgagtaggtagagatagagaaattgaataaatgatgattgtgatttgttaagatcggagtagttcgaaaaatgtgttatatctatgataaattacgaatgcagaagttgctttattttgaaacggattcgaattggaaaattttcgtacattccaaggaggccgaaatgtatatgtttcaaaccagtgattactactcatgtgatatatttggattaaaaattagtctatgcaagtctaacaatattaaactgcttttcaagaaaacggcgttttcgattcctaaaataatgcaaaaattgcatttgcttttgccaataagctcaacggccactcagggtcactagggaaatgggaaattgaccgtaccgaccaagaccaatggctatgcggttgaaccggaaccaactctggtttgctttcgacggttctagcgagcacatggattacgctagaaagactactaggctcaagttacacgtgcgtcaattttaccaaataaatgaaaaagaaagtgtgcgagggaattgaatcatggttgcttagctaccagctcaccgtctaagcgagctaaatggcttttgcaccatggctaacaatttaacaaagaatattcacaccaaataaatgcatcggttcttcgatcgaaccgcacgaccggtgactaccgcgcaataaccgtggtaaccgtaaaaaaccgtgcaaaatttatcaataatttaaattattttttaaatttatttaaatttaaggaggttaccgcggtatttatattaccgtacccccacggtaaacccggtaactgcaaggttactgacggtaagtcgaaccctgccgtacttaccgccggggtgtggtaaccccgacctcggcggtttaggaaaccctaccggtgagctggtgaactatgagcttcaccaatttcatggacggtctagctttttcactatggtagctatatcctactcctattagattgttttttatgtttcagtggatccgttttctttgcattttttctttgcatttgactagatcttggtcggaatgattttctgcacgtggatttatgcattttttagaaataattgcacacatgtgtaatttctagaaaaccatgatatccaagtatccaactctagttttgccattataaaaaatatagttttgttgcaccaatcacatatatctctttctatcggttggttcatatatttccagttccaaccatgccaaaagtactgtaattttccgtgggtgacacgctcagtagttagagatagttagaaatataagcgatgcgggcaggcgggttttttagcccgtttatcctacttctagtttattttttcttttaaattttatactaccatatgaaaaataaactagcaaataagtttttatatggttaacgcaactatccacttgcattcctatcagtagtacagttctgatcgttacttctccttttttttttctcctttctttctaactcttgtttggagcacaattcaccgtcacaagaagtgatggctggttgttttagtcaaattacaacttgcaaatactaagtaagtaattgagatcatcggtatagcaaaggattttctccgcaaattttaaaaccaagagttttacaaagtcagttggcttgcaatgattgaaaatgagaagtatctgggtgaattcaaccggtttaaagaaagcaagctgcaactgaccgagcctgctaggaccatttatctgaccgtgtagcacgcaattccgggaccatgttttgtactattgatccagacaggagcatcttccgactcgctatccgagtcccaactctgtactaactccgtcccaaaataagtacagccgtaaatattcgtgtctaatatttgaccgtccgtcttatttaaaaaatttaaaaatatttagtcacacataaagtattattcatgttttatcatctaatagcaataaaaatattaatctaaaaaaaattcaaataagacgaacggtcaaatgttgaacgtgaatagtgtaaaattacacttattttaggacggaaggagtgtatttttagaagatataaatcgcacgggagaagatgggaagaaagaaataccaaatactgttcggcacatcaccctacgcctgatactccaaccaaaaaaagagtttttttttaaaaaaaaaaagagaaaagaaaaggcgccgcgttcatagtccatttcattgcttagtcaatgtctaaaagaattccagcaagtggcaaacgtactcctacactgcattactgtaaagctctgctacctgctgcagcccgaaattcgcctacgatgctcgttcgcgaggagaaacggcaacggttggtgagtacgctggtcgatgtcatgtgcctctgggtgcgatatggcagatgacaaatctgcaagcgcttaattaggtgtggtggcgctttcgccgccgctgattcgcttgcgcatgggctaatccgatcgaatcggtcatactaggatgcaaagggtaagtacgggcgcgcgtctcccacccagcaaattcttgttacgaacgtcgtggtggtaccgtgcaaccgcatgacgcatcaggaccatccgccaggtcgacgggtccagccccgatttccgttttaatttgcgtgcccctgcctctgtagactgtagggccatggccgcaagcatgcaaccgaggttgacgactcgctcgcacgtcacttcggtacacagttgcgcacatgctctgctgcgcatgttccagtacacggcacaaagagcctcaaaattgccatggttaagagcaaactcggctgtgaattgtgaaatcaagttcagcagctagctgagactaaggtttccacaagaacttgtgtcaaattttgcagaaagcccgtcgtcgtttcagcaacaagtcttgcttgaaagttgatgcgtgcatggatccgaggaaacttttcttgtgacgagcgccgggcggctgccggctggctacagagcggcgtgcgagcgacggtggtgtgccgccgatgtacgatcgcctgttttggggggcacaactgaaaacgacttttcgccaaagagcagcggaatctacaaaacgtcaggccttatccccagttctcctactcttgtacacgccggcccaccaagcaatgctctgggggtaaatctgggtgcatttctcgtgggcgcgacgcatttacccactgattttgctacagaagttatccgtgggggacctccccctatgtcaccgatgggtgataacacatggcacggcttcgaccgttacagcaacaaggaaatttctccggggtagcaaccgtggggcacccagcaatttttgtctgtgcttaatgaggtaaaaccatactctttgcttacatatctcactatcaacacaggtgtgggggctccagcaactgccttgtgtagtcttcaaacttccatttgaggttcgtaatgttgcagtcttactttcgttttctgaaatgatgtatttatgtacacagaaagatatgtgcactcatccagccaaaagtaggagcattttatgacaactttgatcgccgttttatatatattatgggacatctgtaaaagaaaaatatggcacaattaaaatgcgatgaagttatttcgaagaaattggcatattattatgtcatacgggaaagtgcaaatgtctaactagaaaaaaaaatgatggtaatgggccacaattgacaaggaaaggtaaattattgtgtactatgtatatacatattttttcacaaaagttttcgccgggccgatattttttcacaaatgtagagtgtgtgatttctttttttagttagttgtttgatagaactacgatcaagttgtttgagatgtcgattatgtagcatgaaaaggacaacacatacaattgaattgatcaatcagttgcgtttcctatggaaaggtacatattgtgtacaatttaatcagtggactgacaactccaagccaaagtctcatcacaagaacaaaaatgtatagtcctaacaatcagatatactaggtgtgtactaataacatcctgtgacaaaaatatctaagctttataaataaataatttgaggctgaacacttctccttacacttgttagctatccaaatatccagtttatgattcgcatgaggcatattccagccccatggtgtaatttcctcatacaagtatttagcaccatttctccacaaatattttttatgagaattacacagtacaacgcagacactcacaacgcacgcgcactcacccctatggacgcacgcacgcaaaccctacccaaaagtttaaggtatactccctccgtactcgtaaaggaagtcgttttggacagcgacacggtctccaaaacacaactttaacatctttttcctataaaaatatttatttaaaagtgatatatgtattcttttttgaaagtatttttcaagacaaatctatttatataatttttacattttcaaactcaacaatttgagagttattcatgatttatattcctaaggtttgacttaaacattgtactaaacaactttctttacgagtacggagggagtatttcttttataatcaaaattaagaagaaattaactcattcatcaatgtgacaaaaccaacgaactatatacatacatgtaaccgatgagtattaagccaactcattagatttcgactaacaatttaattcagcacacagagtaaatatgtccaatttatttaaaaactaaaaaatgaaatatgtattaaacttttagatagaggcagtactagtttttttttgtctcagacaattaccttcaggctaccgtatcgtttggtagcttgactaacatattctgttggattgctaccgcgccatgaataagctccatggcacgtaaaaaaaaaaatagcacttcatttgaaacactctaacgctaccaagaaattactgctagcgattgaacatttcacgtcagacatggacataggatcctgtttgtatgtaaaattcgagtggtttcactacaaaatctcaacaaagttcgtgcttgaatggcctattcctgcctcgctctctctccgtcacgaagttttctgtagttttgtacaggattccaaactccgagatcccccccacggacaaaatcagaaaacaggaattgacagaaggcggggggcagcatccccaccccacggcggttcctcgggcctcccgcccgcctcgcacccggaatccttccttcccgaggcctacgtgtcccctcccgcatctccacgtgtgcaccccccgccaacgtcactcgccctcaacctcttccccctcctctccctcctccgaccgactcctactccctcctagctgacgctccgctctatactcttgtatccaccgctacaattccccccgctgcacacgcaccgctcgccgagtgcgaagcggtgagactagactactctttgagttagtatggccatggataccttcccgttccagtggcccatggatccagccgcgtcatccggcctcgacgctgggtttctgccgcctccagcggctgtggcgcccgacgacggcgtggggtactacgacccgcctgcgggggcggatgtggacgccgctgctctgccggagttcgccgcggccttcccgccgtgcgcgcctgatgctgccgctgctgtgttggccatgcggcgggaggaggaggaggtcgcgggcatccgcttggttcatcttctgatgagctgcgcgggcgccatcgaggctggtgaccacgcgctcgcgtccgcgcagctcgccgactcgcacgccgcgcttgcggccgtctcggccgcctccggcatcggccgcgttgccgtccacttcaccaccgcgctctcccggagattgttcccttcgcccgtcgctccgcctaccaccgacgccgagcacgccttcctctaccatcacttctacgaggcgtgtccctacctcaagttcgcgcacttcacggcgaaccaggccatcctcgaggccttccatgggtgcgaccacgtccatgtcatcgacttcagcctcatgcagggcctgcagtggccggccttgatccaagccctcgccctccgaccaggcggcccgccgttcctccggatcaccggcattggcccgccctcacctaccggccgcgacgagctgcgcgatgtcggcctccgactcgccgacctcgcgcgctccgtccgcgtccgcttctccttccgcggggtcgctgcgaacagcctcgacgaggtccgcccgtggatgctccagatcgcgcccggggaggccgtcgcgttcaactccgtgctgcagctccaccgcctcctcggcgacccggccgatcaggcgcccatcgacgccgttctcgactgtgtcgcctccgtccggcccaagatcttcacggtcatcgagcaagaggccgaccacaacaagacgggcttcctcgacaggttcacggaggcgctgttctactactccgcggtgttcgactcgctggacgcggcgagcgccagcggcggcgcgggcaacgcgatggcggaggcgtacctccagagggagatctgcgacatcgtgtgcggggagggcgccgcccggagggaacggcacgagccgctgtctcggtggcgggacaggctcacgcgcgccggcctgagcgccgtgccgctcggttcgaacgcgctgcggcaggcgaggatgctggtcgggctgttctccggcgaggggcacagcgtcgaggaggccgacgggtgcctcaccctcggctggcacgggcggccgctgttctcggcgtccgcctgggaagccgccggggacggcggcggcgacaataacaacaacagtaacagcaacgttagcggtagcagcggcagtgacagtaacaacagcggcagcagcaatggtaaaagcagtggggctcgggatggtagcagcgtgtgtttgtaaatcgcgggagggttagtttgattaaggggatcgatcgtaaatcgcaaatatgaaaatctgaatggcatggaacttttgaacttaccatctgatgaagagtttcctgtccatctatctctctcgccgatatgggagtatacttggcatatatttttcagatgcaatttggatattccaactgattaattaatatacttggcatatctttgttaatagtaggagtacaattatacaaagagacataagagaaggcgccgtcaaaacccttgttaatactgccaccatcctcgatctaatgacgcccttcccaagttgctagtagacctgagcaatttcagcgggcgaaaagactgacttgttttgggcctaaattcacacataagtctgggctggcaaaggtatcgggcttgctattctgatgctgggccaggactgggcgtaggcctcgttagtaagaggaaaaagtacaccgcaggtccctcaacttgtcatcgggataaaaaacatcctcgaaccgcaaaaccagatatgcgatgtcccttaactatacaaaaccggtcacctgaggtcctttggtggatttgaccccagttttggtctacgtggcggttgagttatcgtgccccccccacatgtcaggtttatccacgttagcctcctctccctctttcgcctcttctctcccttcctcatctctctctctcacacttctctgcaagctggcggggccgaggcgggagagaagaagggcggcgccacgagggcggccgacggaggcagtgtgcgagtgcaggagccgacgaagcggagtggagtggaggcgcggagtggcggtggcggcaggcgggcgagcgcgcggcgggcgacggatagggagcggcagccagtaggcggcgatggcggaggcggaggttgtggaggtggcagccccctagcgacgggcatggtggtcgtcggcgtcggtgttccccgcttctcccggtggtagtcggcgtgcctcgcgcccattcct

SEQ ID NO: 42110 - DNA, 10096 bp, Oryza sativa
ccaccgccgcatggacagaatgcccccgcttctccctcttggccacctccgcggcgttgtccatgcggggtccatgagcagccggaccccactagcgagctcctgcatcagcccctccccccaacctattcgccatcaccggcagcttgccgctctcggcgagcttggtgtacgcgtcgacgccgccgaggtagcggcccatgacaaagaggtgtggcggcgctaggcggggaggtccacagcgagcacggcgaggagatccgcggcgaggacgtcgtcgtgctggaccatgagcaggtggaggctgctgcgggattggttctcgatgctccctccctgagcttgtgtgccgccagggggaagctcgagccgccctaggagccgccgtcgccggccgcaccatcctctgcccgcgcgcgccactgtgggcgccctagcgtcggcatccccatgccctgcgagtgtgagagcagagagcgagaggaaggaaggagagaaacagaaaaaaagaaagagaaaggggaaagagagagagagggggtggtgtggtcacctgacatgtggggcccacgtgggtcccacgctgactcagctgccacgtagatcaaaaccggggtcaaaaccaccgaaggatctcgggtaaccggttttatatagttaagggaccctatatatctgattttatggtttaaggacgttttttatcccgatgataagttgagtatcttctgcgtacttttcccttagtaagaagaacaattgaatacaaggtttaattggagctgctgctgcagttcggcaaaagatacattttgctagctttcgcggatacacagtacgggggctgtggcgacgtggcgtggggttacgtgaaaaggaatcgtatattcctcggtgtatgggtctccactccaaactactgtaccattggatgcacactagtcacaaccgtgtggagagagagagagagagagagagagagagagagagagagagagagtcgtataaaacctgtcagctcaactaggcaaaccgacgtgcacgtctgcattaccacgactcgacaacatcgcgacttgctcgtagcagcctaccgactactatgctgcagtcctgcagcgaggaggcaagctagttggcgtcggcaggagtcagcggacggaccaccagtccaccgcggcgtacgagttcacgtgcccgagcgagggggcgatcagcgagctgcgctccccgaccggcaggcgcatggcggacggacgggtggcttggctcggcgcagcgcgtgcgcatgtcagccgaggccggtgtccctcccccgcgcgcgctctcacgtcacgtgctccgcccgcgcggagtgcggaccaccgggcggcacgtgctgtgtcgcgcggccggccgcccgtgtgatcgcgggtacgttgttgaagcgtgggcgcgtggcgcgcgtccgcagtcgctggttcgcagcgcggatgggattgctgcgggaaccttcgggtaggaaaaacgattgcttttcgatagtaggtgttgcggtgaaataggaaactcgctcgacatggtgagaagagatcgggaaagtacgaagtgggtgatccaccattgtaagtttgtaggtatcgaaacaaatcggggtgaccgccgatctcctgcgttcaggctagtaatccagtatcactagtggaatgagcccaggcggcaggcgtggcggaggagaaattttaggcaatcatgaggcatgctagaaattaattactccttccgttttaaaatgctcgacgccgttgactttttagcacatgtttaaccgttcattttatttaaaaacttttgtgaaatatgtaaaattatatgcctacataaaaatatatttaacaatgaatcaaatgatagaaaaagaattaataattacttatttttttaataagatgaacgctaaaaagtcaataatgtcaacatttcgagggagtacatatttatttctactgtgttaaagacgttttgatcagatggcctattagctcagctggttagagcgtcgtgctaataacgcgaaggtcgcaggttcgagacctgcatgggccatactttttcctttttccgataaccacatttaaattccatctattttcttactttttcctttttccgataaccacatttaaattccatctattttcttatttttcgtatgactgcatttaaaatcatactttttcctttttccgataaccacaaaattccatctattttcttatttttcgtatgactgcatttaaaatcataccttttcctttttccgataaccacatataaattccatctattttcttatttttcgtatgactgcatttaaaatccatctgaatcgtatgtttttcctttttccgataaccacatttaaattccatctattttcttatttttcgtatgactgcatttaaaatccatctgaatcgtatggctgcattcaaactccattttttccgataaccacatttaaattccatccattttcttatttttcgtatgactgcatttaaaatccatctgaatcgtatggctgcattcaaactccatctaaaaagaatgtcaaaactagtttgtgagctatttcccagtactattgtccaatgttcttaacattgctaaaattcgcctcatgcagcgctttccactaaacagataaaagtagaattatcaccattcaaactacatcaaagaaattaagacattttggttttgtcatataagttcaccattgaatatattttgatattatatttgttttattatatggaataatggaatgctgctatatttttctatagaattgatcaaaaagtttaacttaggacaaacctaaaatgttttatactggtactgacgagctattatccaatattatgaacatttcctgtaattttgccttcagcagcacttctcactctaacaggtaaaagtagaattatggccagtgtgcaagattagagaaaatggatgcagaaggtaaatcctgactttgctgttgtttctctacaggtacagtacacttcagtaaatacagttaattaaatgggccatattttctactaagtatattattttgtttcttcgtatgactccatctagaaaatgcgagttcacattaaactgcttcgttcagtcattcttcaaatatctccttcatttcaaaatgtatgatgccattgatatgtaaaagtataagttataattgagtcacaataagacaaatgatatttatacaattttttttaataagacgaatggacaaacgttatgcgaaaagtcaacggcatcacacattttgaaaaggaggtagtaattaataagttctctatgtttgaacttcttcgttcaatcattcttcaaatactgaaaaagttctctatgtaaaaactgggttagtggctagtgctgatttactatcgtccaatattctgaacatttgctgaaatttgccttcaacagttttaaaagcagaactatcaccagtgtgcaagagtagagaaaatgtgattatatggatgcagaaattaaatactggctttgttgttgtttctctcccgatatacgttagtaactacagctacttaaatgcacatttgtgcctctctttttcacctgtggctggctggccaaggattcagcacggagatcagcagtcacgcaggcacgcagcatacccacatgtaggcattattgtcttacccggctacagccgtggccctgcaagtaatctaccagttagccattcagttagaaatggtagctaggaaaagacaatagatgagttcgcaaacatatgaagtataaagactgatgagtaccagttagcacaatttcataagccttcagtgggcaactaaaatgttggtatgacctttgacgccagaacagatagtatcacacagggtttgtaaagcacagttcagtaatgcaaccaaacattctgtaggccatgctatagactatgctcaacagcagaagttaacctgagaacttttagatcctgctttagacatttgatattgagacagaaatcatgtcctgtagatagtgaagtttggtcatgccatgcctgacatcttgtaaaactgaaactgaatagtttacttctttatttattttttttgaagaaaactgaaactgaatagttacatacttacatttgctcctgcaaactttctatattttactcaatggtagatcatgtattcaagtgaagtttacatagtctgaactctgaaggtttatacctggacagaactgtgtccaggtgtcttctctatacctctgcttcccattagtcctctaacatgttcgacatcatcccattgactttcttcagcatgtaagtttgaaacgagcacatgcactcccacatcattaggagctacgttaacgatatgctgtccaattacctttcctagatccattctgtgatgaactctacaagcagcaagaagtgatccccaaattacaggattgggttctattggcatcttcttgataaagtgaaatgcctcgtctaacataccagctctccccaggaggtctactatgcaaccatagtgctcagtatcagggacaacaccaaggcttgacatcaaatagaagtaacggagaccttcatcaaccattcctacatgtgcacaggcaccaagaactgccttaagagtaatgccgtccggttttggatcctgtaactccagcatttgatcaaagagctccactgcttcttttccataaccattgcttgcaagacctccaatcatggcattccatgagagggtctgcttatgctgcatttttctaaatatttcagaagcagtgtcaatgcagccacattttgcatacatatccaccagggcactttctaggcacaaatctttggctacattcatctcttctatataagagtgtatctctcttcctttatcaagtgctcccagctgtgaacaagcagaaagtagactaaccagtgccatttcatgtgccacgacttctgcaatcttcatttcttcaaataggttgaaggccattgtaaattgatgtcccttcacataaccacaaaccataactgtccaggaaacaacatccttttttgtcatagtttgaaaaaccctttcagctgcagccatatcaccacatttggcatacatgttgatcaaagaatttgtaaggatattgtcacaacagatcccattatctttgatataactgtgaacatgcatgcctttccgcaactcaccaagttgagcacatgctgataagacacttacaagcgttataccatctggagttacgccatgcaacagcatctcttcaaatattcttagcgcttctttgtgctcatgattttgcacaaagccatcgatcaacgtattccatgatttagtatatcttgcaggcatggcttgaaatgcttctaaagcatcagacaagcatccacatttcgtgtacatgcttatgagagcattcctgatatccacatctgcctcgataccaaatttaccaacctgattgtacacccaccggccttcatcaacagcctgtgtttggccacaagcagaaagcaggcttataatcgtgaccttgttaggaataattccttctgcttgcatctcagaaagcatctttagcactttgtcccagtgaccacactgtgcacaagctgatatcattgacgtccaagacaccacgtccctctcatacatttcctcgaaaaccttgcttgcttcctcaacacttctaaaggcaccataataattaacaagacctgacatgacgaacacatccgatgtaaacccaatcctccgaaccagcgcatgaattgcgtccccatttgaccgccacttcaagccagcaaaggcagcactcgccgacacgaccgctgccatagtgtaattatcaggagagactcccctccgacgcatttccctgaacaccgccaatgcatcccggggggcttcgcagctgctgtaccctctaatcatgcagttccacacgaacgcgttcggttgggccattccgtcgaacaccttgcgcgcgtaccgcatgtcatgcctcgccgcgggggacgcgaggagggcgatgagccggccggcgacgaagctgtcggaggtgaggtgggcccggacgagccggccgtggagctccgccaggtgggcccgcgaggcgcaggcgtcgaggtaggcgaggaggtggtggcggataggccgagcctggcttgcgttgccgtggaagtagaggtaacgcatggcatgaggagcagactaaacagcggttggttgacgcttgacggagctagcagcccgcgactattggaagcgatcaagggaactaccaacggcttgtgagttaggatagtgggaaggcccgaaagaagatagcctgaacgctgcattgcagttacagcgcggaaaggagagctcggctgatcgttttggcctttttaggggctttttgcatcgattctgaaaaatcttgtatttcttgttctacatatatgaccccttctatttccatgttattaattaaagaaatataatttgctaaccgaattactccagtttctgaactattggagtagtctgatttaccccgttagctccaataacatccagtgacggatcttctcgtggccattgccaaggcactgtccatagctatgccccacaaccaaggtgagtttgcgacctggcgttggacatttgggcgttgatttcagatgctagtaatttgattaataggttagttggacactaatttaatgcctttatcggcctaattttctaatgttctaaaccaaaggcacagccggactaaagaaaataatagaaatacgagcaaacacacctgtataacactctcacgaaaattactttattggtaaaaatattacatgcaaaattttccattatagttgttcattgtagtacaattgtagtatagtttgtgtataaaaaaatatttcaccaatggaaagcacgattgtagtatagtttgcgcataaaaaaatatttcactaactgaaagtataatacgcctcatcctagtatattaatccgtcatagctaaaatttagtgttgggtttgccattgataacagccttccacatttccagaatcctcaaaccggataaacatatattattgaatggactattgctatagattacctatttcattacaaggagaaagaaactcaacagattacttacaacaagtagtgttaacaatatagcaagtttttagatgccaagttattccgcaatagatatattttcgtaacaaaatggtacttcctccgtttcacaatataagtcattctaccattttccacatttatattaatactaatgaatctaaatagatatatatgtctagatttattagcatcaatatgaatgtggaaaatactagaatgacttacattgtgaaacggaagggagtactggataccgcggaatcgtttgagataagcaggtttgtgaaagatattttcaccgtgtctacatcatttctttacaaaagcatttgtgatttgtatggtagtacaaaaggtttccaagtgaccacgcaaacaatgttgtccgctgaagtgtccacctttatcatgggccgaagagggaaatatcctcataccccgtcgtcacccagaaggccagaatgtcacttgacatccttgtcgcggccattattctcgttggaagctatccatcttgcgaagacgtacgtgcagaatgcatcatccatgatattgtttgtcccgtccctacatcacgccaaaagtcacaacaaaaacacagtaaagatagtttggaaagaaaaaagaagttattctcgatataaaactggcaatatttggctataagcgagtgtaatttccgtcaactaaagcccaattgaatcaaggttcatagtttcagaatatattctaaaataatggataatatttgaccatcattatgtttttggtcaagtaaaagccaaagccatatggttcgcacttcgcagtttcaagaatatttaaacacggtaaattacccaatctgaactgagatctttgggtggtatctcgtgcagtagctggcctccataatctttaagcatataccatccctgacagtgacatcgactatttaaggttaggtaggaattaacgcccaattacggatagtgtggatcaaacttgagttcactggactctgccactacggaaatctggatcgcatcttaattaagcctcgagagagacattagtatttttattcgctcattccaccggtcagaaacgtgtgcaagctaacaacatcgctaggcaaaaggaagtcgttgctttcgagtttcccacccatggcatcctccgccggcgacccgctcctctccggcgaggccggcgacggccgccgcaggttcgtcccgtccaccatacggctcaagacgtcggtgtggtcggagctgggcggcgcggtgggcgatctgggcacctacatccccatcgtgctggcgctgtcgctcgcgtcccacctcgacctcggcaccacgctcatcttcaccgcgctctacaacttcgccaccgggctcctcttcggcatccccatgcccgtccagcccatgaagtccatcgccgccgtcgcgctctcctccgcgcacctcaccatcccgcagatcatgtccgctggcctcgccgtcgccgccatcctcctcttcctcggcgtcaccggcctcatgaccaccctctaccgcctcctcccgctccccgtcgtgcgcggcgtccagctctcgcagggcctctccttcgccttcaccgccgtcaagtacatccgctacgtgcaggacttctcccgttcctcctctgcttccacctccgtgccgcgccccctcctcggcctcgacggccttgtcctcgcgctcgccgcgctactgttcataatcctcgccaccggctccggcgacgacgaggacgtcaacagggacggcacgagccgtcgccgtcgctcctgcagccgcgtcccggcggcgctaatcgtgttcgcgctcggcttggtgctctgcttcgttcgtgatccgtccatcctgcaggatctccgctttgggccggcgccgttggggctggtcaagataacctgggacgatttcaagatcgggttctgggagggcgccgtgccgcagctcccgctgtccgtgctgaactcggtgatcgccgtgtgcaagctgtcgtcggacctgttcccggaacgggccgagctctcgccggcgcgggtgtcggtgagcgtggggctcatgaatttcgtggggtgctggttcggcgccatgccgtgctgccacggcgcgggcgggctggcggggcagtaccggttcggcggccggaccggcgcgtccgtggtgttcctggccatcggcaagctggcgctcgggctggtgttcggcaactcgttcgtgacgatcctggggcagttcccgatcgggatactgggcgtcatgctgctcttctccgggatcgagctcgccatggcgtcgcgcgacatggggagcaagcaggagtcgttcgtcatgctggtctgcgccggcgtgtcgctcacaggctcgagcgccgcgctgggcttcatctccggaatcgtgctgtacctgttgctacgcctgagggatttggagtgggatatcagaggactgctcggtcgctgggccgcgggacggcggcaatcgaccaacgaggccaatgaagatggggctggagatgcttgatcgaaatcttgagaacatctgttgatttgagattttgagtgtggtgtgaattgttcgagcgaatatatatagtatcaacatgcatagcggatagccacgagtgattgaatttctgaatggagtaactccacataatcgcccaaactttcaaaccaactactccctctgtccttaaacatcttaaatgtttgacgccgttggcttttttaaatatgtttgatcgttcgtcttattcaaaaactcttgtaaaatatgtaaaactatatgtatatataaaattatatttaacaatgaatcaaataataggaaaggctgcaggaat

SEQ ID NO: 42111 - DNA, 5139 bp, Oryza sativa
ggcgtcaaacatttagggacggagggagtactattataccaaaaaacaaaaggtatttatacaagttgtaaatggttcactttgcaccttaatatttttttctctttattttactatttatacaagttgtattttaagctaaaactttatttttaacatcattatcattaccaaagtttaaaaatatttttaatttttatgacagcttgcaagaactttaaatcttaatgtaaacagtccattttttctttttaaaaaaagttgaaatctcaaatttttaaaaatgatgttgagatgtcaattgtaaacagaggaacacaatttattattctatgacaggtgggccaaaaggtaagttgaaatgggatacgggaggcactgtagactcaactgagggaaaaagcgccagtgagcttgggaagttgggccggtccatcgacctaggccttggagcgaaggagagagggagaggcctcggatttgtgggttgatatttcctgggaataagctcacgaaggtcccttaacttaacaacagatttttttaaatcctttaaccacaaaaacagaaatatgtacccctaaacttacacaaaccgtgcacttaaggtcccatgacaacatacgtgggtggtttcgccgacgtggcatcctagttagaaaaaaaaattaaaaaaaatatatgaggcccatatgtcagcttcatagatgttttcttctcctcctcttcgcttttcttcttctcctcttcacttttctcttcaccggcggagcggcggtgggcgagcgcggcggcgggctgcggacgacagagcggcgggcgtgcgcggagccacgacccacgggtcacgagaggttcgactgccggtggcggcgacgcaaagaaggggagggcgtcgtcggcggcgggagcggtgggggggagggggagtcggcaggccgcgggcggcggaggtggccggaggtggagggaccatcaccgtcgccgtgcacagcgaactcggccaccgtgtactctgctgcggccctcttattgttgcagccgccgcacatgcatgtggtgaagtctgcatttcaccatctctttttttttgtttatgcttgaagtctgcattgttgtcgagggcgtgtggtgaagaaggtaggctttgcaggcggtgatgagggagatgtgggagcggccacgcggctctgtgtagcacagttcctcgcgaccgttgtacttgaccttcatcgagaatgtccaccacaacgacctgagctggtccttagccttgatccgaagctccttggccatggacctctgctcctcatcatttccctgcccgcggccgcgcctggcattctgctcctccatgaaggcaatgtaccccgcgatggcatcttcatctgcttcttgttggtattggtcgtcatccgattcctcaagaagaggggcccaagactcagattgagattgagattaggattgggtagcagcatggtggtggtggaggtggatggtctggatgaggcggcggagggagtagtaggacttgcttctggcgggggagacgtagtggagcctgggcgcgaggccagggaggttgggcttggaggtgatggtccatccgagcgcgaggaggtggttcttgatcttggtccgaagctcgtcgtcccagcggcggaggagggagaacaagggcgcgcggtggtcggagagtagcccgccgcccacatccgcgcttgcccgccggctctccgctctctgccggcctgaataagagaagagcgaagagagaatacagaagaggagaagaaaacaagaagaaaagatatgtacaactgacatgtggaccccacatacttttttttaatatttttgctgactaggatgccacgtcagcgaaaccacctatatatactgccataggaccttgagtgcacggtttatatgagtttaggggtaaacatttctggttttgtggttaagggaccttaaaaaatctcgttgttaagttgagggacctcttgtgaacttattcctatttcctgtccattagggaaggatgaaagggctgaagcatgccaggccacgggggctgcctacggcttgcctggcccgccaacgctgtgcctcggtggctcggggttggcttgccggtccaagttggcagccacatgttgaccatgttagctttggactgtgacttccaaactgtaacgtcattctctcaaattagagaaaatatcctagacatattattttagatcattacatcaatcttttttttaaaaaatatccaaaacctccctccatccctgcccctatgcagcatccgccgtccgttccttttctcttttcttttcaactccataacaattaaaattaacactatcctaatggggaaaaaaaggaagaccaaaaaagacctccgtattacctgtatgacattaaatatctgatgattttctaccaacttaattaatttctctcaacatgtatatgcggccatttacctatacaaattgaccattatatttttataaataaatgatctttttaatagataaataaatgatcttaagatgataatagcatctaaattacacacatgataaatgatcttaagatgatgtcactaagaaattagagaaaaatatttaaatgatatattttttccataacgtgtattccttatagtgttaattttttatagacaactggttcaaaataaaagtatggttagttgaacatcataccgatcgtaccaagtatgagttgcaccaggaatcttagcagtaaaacaaccatgaggtggcctcatcaatctatcaagtcacttccacatggaatttaattaaagaccatatccattttttttcattttgctagaacatgctacagttaattgtaaattcctgacatttaccataaaacaatttaaaaacatgtatttgttatgagcaactacaatttagtggtaatttgctaatgaaaaatactatggtaattattttaatatttcttacttgattggagagagaaatttagacggatgcttttgccccatgccaggttgtatgttcaacctacttatatttttgtgccaaattacaaagatcatatcatttcaaggatgatttatagagtggaagtctccaattttttttacaaaaatggacgtggcctaaattgaagattgaacaaatgttgttggatttaaaaaccctttctaaatagaaacaataaaaaattttagaaggactttcggaacaaaaatatctaaaatttcaaatagaatcaaacaaagaatttgacatttttggcaaatttttggggtaagatatccttctaggactcgaaatacccaaaattttctaagagggaaccccatccattgttttgaatattttctcctaactgctaaattcaaaactcaaaatatccaaaaatatctcattaatcttatttaatgtgctttgaacgctggtcataattttctttcattatggataattagaagaaaattatgatcagcgttcaaagcacactaaatgaaattttagtttaaaatatagtacaaaatttttaataaaaattctgccacacataaacattcataataaattttaatcacattaaagaagaggtccgcgcatatacgtgggttacctagttttgagatataaataaacaaattcaacgtattaatagtagctagtagcgcattgctcatacctgaatttatcttttctttttctctttttgtgtaggttgaattttaacttgatttttggaaaactgatagatatgtatatactctacattaccaatttatttaagaattttcacaattatttgcatcggattttgagaaaaaaaaggttaaacgtggggacaacacattgagaaattagaatccattctcattaaaaatactatctctgtgccgaaatgagtactccctccgtcccaaaaaaagataaaccctggtttctgtgcccaacgtttgaccgtccgtcttatttaaaaaaaattaaaagacaagtcacgcataaaatattaatcatgttttatcatctaacaacaatgaaaatacgaattataaaaaaaattcatataagacggacagttaaagttggacacggaaacccaggatttgctttttttttttggacggagggagtacatcttaaattcgttcgttacaatgtgattatgccaaagctgatcaactataaaaacaaaaatgtactttgcatggatgaggcgtaccaacctcgccattgctcaacttgactccggcgctcagctttggctcacgtacgccgcccggcgtttttatttgccatcgatttcgcatgcatgggaagttggggacagattcggtttcggctcgcaccacttaaactaatggaattccgttagtaatcagttacagcttgttcaggacggatccgattcgatcgcgcggctaaaacgttcacacatccatttccaactcgcaaactacaacagtcaccccgcatatatagacagattctcaagctgcgggcatatatgtacgattgatcgccaggggcgatcgggtctcctccctcttttcctccaccctccacgtggttttttttagcaccacattacttttctattttagtaaatttatgcacctaaagtttgtacacttcaagtttacacatctaaagtttacaggcccttaaatcaaaagtttatatatctgatttaaatttaaatttaaatccaaatattttttatatatagtatttctatacatctaaagtttatacacctaaagtttatagacccaagtttataagtcaaaagtttatatacccgattcaaatttgaattgtatcggattcaaatttgaatttgaatttgaatttaaatattttttatatatagtatttctatacatctaaagtttatagacccaaagtttataagtcaaaagtttaaatacccgattcaaatttgaatttgaattatatcctgtcggtgatatgggaccgggggtatcgtgaccagaggcttgaggcagacacaatcgcccacgtggcctggcaccttcggggacgtcgggcccgagggtgaggtgtccgccctcctcctgatttcccccccgagggggggtcg

SEQ ID NO: 42112 - DNA, 19631 bp, Oryza sativa
tggtcgcgtcatccacagacagccataatcccacgtcgcacctgtttccggcggaagtgggggtaggtatgggccgtctcgtcagaagggcactcggacagcaatcgtaccgatctccgtccatttatgaagagaagaacagtccggtttggaaagggaaaggtgcatgtggtatccccttgagatataaaaggaggaccttgcccacctagggaggggactgagggctggatgacactttgtaacttgtccatacacagatccacaaaaacacaggagtagggtattacgcttcccagcggcccgaacctgtatacattgcccgtgtctcgcgtttcttcctggctcgcgatctttctacatacagcgagagcttgggatttcaccctaagcccccggacgaactggcaaaggggggcctgcgcagtctcccggtgaggagccacgagctccgtcatctggcgcgccaggtagggggctcagcgtgtgttttctgagctctcatactcttccgtgtgcgccaagtttcccttgttcagcctaatggccgagcaagcaaaggcgcacgacctctctccgagtgtgagcggcgacgacggggagccaaacccacgccgtcgagctcgtactcccccacctcctccacaccaaagtcctaagcagggggaggcgctcgagagggttgataaatccatagcatcaccggtcgcgggtgatgcaggagaacggcgagatggggagcgtcgcctcctcgtctacggcgacggcagcacgcctcagggcgcgcttcaggctgctggcgcgctcctacgtcacccgcccgtcgttcctgacccggagtctccagcccagcgatggctggacgacgtggccaacttggtcatgacggcacagcagcgcctgggtgctggtggacggtccgccaccaccaagacctccggcgccgccaccaccggctccgtgtcatcaaggcggagggcgcggcgagcggcggcggttgcacgtcattcggctgccactccctcgtcgacacccccgactcgggaggatcagcatggagagccggatgcccgcctcgacatcgagcgccggcgtaataaccggcgtactccccgcgcaacggagggcgcctcttcgtccagagtgtcgcctcgacatggacgtgaggaccagccctccgtgcccccggctggtggtgtcggctgtagagcctttgtggcgagtcttcggaatgtccgttggcccccaaggttccggcccaccatcaccgagaagtatgatgggagcgtcaaccccaccgagtttctccaggtctacacgaccgggattgaggccgctgggggtgacgacagggttatggcgaatttctttcccatggtcctgaagggacaggcgcggggttggctaatgaacctgccacccgcgtcggtccactcctgggaagatttgtgccaacagttcaccatgaactttcaaggcacatatccgcgcccaggcgaagaagcggacttgcacgcagtacagcgaggggatgatgagtcacttcgctcgtacattcagcggttctgccaagtccgcaataccataccatgcatccctgcacacgcggtgatctacgcgttcagggggggtgtgcggcacaaccgcatgctcgaaaagatcgcttccaaagagccccagactaccgcagagctttttcagctcgcggaccgagtggctcgtaaggaggaggcttggacctggaacccctccggttccggtgtggcagcttcggccgcccccggatccgccgctcaaacagggcggcgtgacaggaggaggaagaagaggtcggtccattccggcgacgagggtcatgtcctcgccgtcgagggcgctccacgggccacccgaaaggggaggcctgcgagcgacaaaaagaaagaggctggtactcccagcagggagcgctcagccggcaagtggtgctccgtccacaacacctccctccatgatctcgcggactgccatgcagtcaaaaatttggcagagcgaacgaggaagtgggaggaggacaggaggcaggagcgccgggaaggtaagtccccggcggttccttccggcaaacggcgaagtgaggccaaacagaaggcccccgctgttgacatcgatgacggtgatgatgacctaggtttccaagaacctggggccaccattgccactgtcgatgggggagcgtgtgctcacatctctcgccggagcttcaaggctatgaagcgagagcttctcgccgcggcccctactcatgaggcgacgcgtcgggcgcggtggtcggaggttgccctcacctttgaccagaccgaccacccaccgtgcgttgcccggggagggcagattgcgatggtggtttcccccaccgtttgcaatgtgaagttggggcgagtcctcattgatgggggagccgccctcaacatcctttcccccgcggcctatgatgccatcaaggctccggggatggtgctccggccgtctcaaccgattatcggtgtgacgccggggcacacatggccgttaggtcacatcgacctgccggtcaccttcggtggatccgccaatttccgcacggagcgggtgaacttcgatgtggcggacctcagtctgccctacaatgcggtcctggggaggcccgcgttggtgaagttcatggcggcggtccactacgcctacctccagatgaagatgtcgggccccggcggccccatctctgtccatggcgacctgaaagtcgcgctcgcttgcatggagcagcgcgcggaccacctcgctgctgcgtccaagcccgagggtggtgacgagaggcttggcacctccgcccccaccgccccgaggcggcggattgtcacatgcgacgaggtcccggtcaaggaggttgccctgggcgacggtccatccaagaccacacggatcggtggtcttctggatggcaaataggaagacgcgctcgtctccttcctgcgggcaaacgctgacgtcttcgcatggagaccggcggatatgcccggggtccccagggaggtgattgagcaccgtctcgccgtgcggccgggcgcgaggccggtccggcagaaagtgcggcggcaggccccggaacgtcaagccttcatccgcgaggaggtggcgagacttctggaggccggattcatccgtgaagtcatccatccggagtggctggcgaacccggtggtcgttcccaaggcgaacggcaagcttcggatgtgtatcgactacaccgaccttaacaaggcatgtcctaaggacccttaccccctgcctcgcatagatcagattgtcgactccactgcggggtgcgaccttttgtgttttctagatgcatactctggttaccatcagattcgcatggctagggaggatgaggaaaaaactgcgttcattacccccgtaggaacctattgttatacatcaatgcccttcgggttaaagaatgcaggtcctacttttcagcgtactactcgaatttctttgggtagccaaataggacgtaatgttgaggcttatgttgatgacttggttgtaaagacgcgcaaccaagagactttactctcagatctagcggaaacttttgaaaacctccgctccgcccgcataaaactgaaccccgataagtgcgtgtttggtgtacctgcgggcaagcttctcgggttcttggtctctgcccgaggcatcgaggccaaccccgagaagatacgagctatagagcggatgcgcccccccagcaaacttagggatgtgcagtgcgtcaccggttgcatggccgccctaagtcgtttcatatcgaggctgggagagaaggcgctacccttatttaagctcctcaagcgctcggggccgtttacttggacggaggaagctgaaaatgccctcgctcagttgaaggcgtatctcagctctcctccggttctcgttgccccggagccaaatgagcccctgctactttacttagcggcgaccccccaagtagttagtgcagcgttggttgtggagcgcgatgaggacaatcctcattccgcgcacccccaccctgtgccgacttggcccgggagcaagcagggaggagaggcccccgagtcgaacggcggcctaaggcccctgacgaccggagtcggccctctacccgcttgtcagacggtgctgggtgcccccgaccctcaggaaggccccgaggccactgcgggaaggccgcacctatcgccctttggccccgaggctaaccctgtgctgactcgacccgggagagagcagggaggagaggcccccgagccgaacggaggcctgaggcccctgacgaccggagttgtccctttgcccgcttgtccgacgacgccaggagcccccgaccctcaggacggccccgaggccactgtgggaaggccgctcctgtcatcctccgaccccgaggtcatcggcacagaagacgagtgcgccccgagaggccatttggacgaagaacgccccggggatacggcccctagcgaagaggatcggccccaccgaagggtgcagcggcctgtctactttgttagtgaggccctccgggacgccaagacccgataccctcaggcccagaagatgctttacgctattctgatggcctcgaggaaactgcgccattatttccaggcgcatcgggtcactgtggttacgtcttaccccctcggtcaaatcttgcgtaatcgagagggtacaggacgggtggtaaaatgggcaatcgagctttctgagttcgatctgcactttgaaccacgccacgctatcaagagccaggccctcgccgattttgtggcagagtggaccccgactccagagaccgtctcaattcccgaggccagcacggacccctcacggctgcctcacaccgcccactgggtgatgcagttcgacggttctctgtctctccagggcgccggtgcgggggtcacgttgacctctccgaacggagacatcctcagatacttggtccgtctcgattttcgagcgactaataatatggcagagtacgagggactccttgccggactcagagtggcagctggactggggatccgccgcctcttggtgttaggcgactcccagctggtcgttaaccaggtctgtaaggagtaccggtgctctgacccacagatggacgcttacgtacgccaagtgcggcgtatggagcgccattttgacgggatagagcttcggcatgtacccagacgggataacatgattgccgacgaactctcacggctcgcgtcctcgcgagcccagaccccaccgggcgcctttgaagaaaggcttacccagccgtcggcgcgacccgaccccttaggggagacggatgcgcctgaccggcccccgaggcccgtcggagtccaggcctcgggacccgaagggagcgctccaagctcccttagattgattgcatggatctctgagatccaagcatacctcacagataagactctacccgaggaccgcgaagggagtgaacacatccaacgcatttccaaacgctacgtgctggtagaagggaccctctatcggcgcgcggctaatggaatcctcctgaagtgcattcctcgggaacaaggcgttgagcttcttgccgatatccatgaaggcgagtgcggagcccattctgcctcgcgcacactggttggcaaggcctttcgtcaaggattctattggccgacagctctcaatgatgcagtcgatctggtccgccgatgcagagcgtgtcagtttcacgccaagcaaatccatcagccggcccaggccctgcagatcataccactttcgtggccatttgctgtctgggggctcgatatcctgggaccgtttaagcgggccccgggcgggtttgagtatctgtatgtcgcgatcgacaagttcactaagtggcccgaggcttatccggtcgtcaagatcgataagcactctgcacttaaattcattaagggcatcacggcccgttttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcagaaatcctcaaaggccttaaaaccaagaccttcaatattctcaagaagcacggcgattcgtggatcgaggagttgccagcggtgctctgggcaaaccgaaccacaccaagccgagcaaccggggaaacgcctttcttcctcgtctatggcgcagaagcggttctcccatccgagctcaccctgaggtctcctcgggccaccatgtactgcgaagctgatcaagatcagcttcgcagagatgacctcgactacttggaagagcgaaggaggcgcgcggccctccgagccgcgcgctaccagcagagcctgcggcgctaccatcagcgccacgtccgggcccgatcactctgcgtcgacgacctcgtcttacgccgcgtccaaacgcgtgctggattgagcaagctctcaccaatgtgggagggtccgtatcgagtgatcggtgtcccccggccgggctccgtacggctggccacgggcgacggcacggagctgcctaacccgtggaacatcgaacaccttcgtcgcttctacccctgaggggggggtcgagtgtcaggtcttggctcgggccaaccccgcacccccctcgggtgtgcaggattggccgggggctaccacgcatgcacattcttatttctcttatttcagcatttcaataaaagcagtttcaatttcctaaaggttgtgtctgtgccgttttttccttttgaagaatcttgacttgaaataaggtcactcgtgctcaaccttgccctcgggggctcggttcggtcagctaaaatcgccaaacggggcccagaaccgagccgtgccccggggcgtggtgaactccgggggggaatcggcaaaaacccacaatcgggtcacccataaccctcggtcaccacgttcccgggctggccagcctcgacatgtggatctccccaggcactagccccgacccgagccattagaggactgggacttgggcacgagcccttaaatcaagctaagacacaaaagaggaccacggcacagatcatcctcatctcatacgcatagcaaaataaaattgacacgaagaattttttcatcattttttccagattaagttgatctatacaaaaaagaggcatgaaggccttagaagaaagaaaaagaaaaaattggagattggcgggggcctgggggctcattccaatgcgcccgggtcgccggcctcgtcgccatcgtcgtctgcaccgctggcgtcgccctcctcgtcggagttgggggcgaacgcgagccgaggggccgagccctcgaagctgttgacgatgtggtcggcggcgtcccggacccgcgcgcgcgcgtcgtcctcggtcccgggagggaactcatccaacgccatccatggagagaagttggggtccctggcctggtaactcgctaatacgagttcgaccgctccttgggcgaggtccctcgaggatgacttgatggtcttctcgagctcctcggggagttgttggagagcccaggccatcttcgtgaggcgcggagcgaggccttccagattggtggagtgcagcattgtttggcctttccagaggcccgcttgtcgaccggcgcgatccaggcgggagaccgcatcccaaagagtgccgggccctatctcgcccgccaagcggagggcctcggcctccccggcggatgagtcgagggcgcgctgcatgtcggcgacggtgtgttcggcagctgcgaggcgggcggctaagtcgctttcgcccgcagccgccctaccgatgggcgcccttgcggccagctctttttcccgcgcctcgaggtcagcagcccgctgctccagtgcggctctctcggcgcggacgcattccagattgcggcgcgcctgctcctcttgcgctgcctcgcggagggacaggctgtccgccagccgttgcgccgcggcctcggcctcctcgagagctcgctcccgctcagcgagtgcgtcctcgcggaggcggagcgcggactcctcttcggcgcaggcggcctcatgcaccgctagcgttgcctcccggatggcgacggcggcctcgcggtccgccaagcccctctccacggcgccggcgtgttcttccagtgccatggcacgggcctcaaggacctcctcgcgccgccgggatgccgcttcagtctccgttgcccgccgctctcgggcagcggcggtgtcaaggaccccttgggcagcgtcgagctttttctttagctccgcctcccagtttgcgtgttgaaggcggagggtgtcctgcgcctcgaccatcgcggtggtggcgatgagggcggcctcccgctcctcctccacctctcgggcgatctccgccagcaccgctttgcgggcttcaagctccgagacatgacggcggtgagccttacggcccacctccaccatgacgtccaccgagcgccgtccctcctcgacacgcgcccatgcggcctcgagctccgctcgttccgctcgcagggcctccacttgggcgctgaacccatctagcaccgcagtgtttgcggcggccaaggcctgcagaaggggctcggcgctcagcggggcgacagaagacgaggagaagagccgccttggagagaacgcgacgcggctcggcccgccggaggatgcgctgggctcggggatgtcccccggacccgtttggtcctgggcgtcgcccggagaagtgggcccaggcgatgcgcccgcggcctcgtcacgagccgccccggaggccgtcgcttgagcgtcgcccgagggagtgggcccaagcgacacgccagcagctttgtcgtgagctgcctcggaagacgccatcgcctcagcctggcgagcccgggcggcctcctcccgagcggtttcctccgcttgacgaacccgagcggcctcccgggcggcctcttcagcttcccgaaggcgatctgcggcctctcgccggtcattttctcgcctccgttcctctgcggccgccggatcttcggcctcggactggccggacttggggtggcgggaggaacgcgacgggacatcgctgaagcagaagaaaaaaccagaagacgaacaagatgggtaagagaaaatttgcttttgggataggagaaagacggtcgcaaggagagtgggacgaacctgcgagggggtcggttaaatgaccaccttggaggggaaatcaggtttccccgggatggttccgtctcccccatcttgcggagccgcttcttcttgcgctccccctcgggttgcgatgacggcgcggccccctccgggcgcagattgctggcacgcgccgccccgccccctcggggaggagatgggggaggtgttcctcccagcttcctcttcccctgggcgtcggcagggcggctgctccccgagcccccgacgcgaggcccagaagcacgaccccctcctggggtagattgatccccccggcggctctcgcccgcgccgtcgtggcccttaggagtttcctcctctgaggccccgacccctatcataatggtcagaatagaggcgcggtcgggatcgctgcagagggggaggattcctcgaggaataagagacgcctccacggagctgagattcagcaccctttggaccacgatcttgaagtcctcgggagcccaatcccatctggctccctggtgggtccgcatgtagtcttcggacccagtgtactcccaagcgctccgggcgcgccgctggagcggcgcaatccggcgacggaggtagtcgccgtacaccatggcccctgtgagcccctgggagcgcaggcccgccaggcggtcgaggacggcgtcatagtcatcccccagatctaccggcgcccgccagctggagacctgcgccgggggctggcttggaagtcggaggcgcgcttcgttggcgaggggggtgtagaaccagtcgctcttccagtcgtcccacttcttgcggagggcgcaggggatgtagcggttcagcaccggcccccgcggctggaagtagcaaccaccaaccaccgacggtggcgacaccgactgcacggtgaagaaccaccggaacagccgaagagatgggcgcaccccaatgaacatctcgcacaggtgcgcgaagatggccaatgtcatcaccgcattgggggtgaggtgcgccatctggagatcgtagaactccagaacgtccataaagaagcaagaaaatggcggaaccagccccgccattgcgaaggggaggaagaagacggaccgccccgggtagtctggtgccgggcgtcccccgcccagcatcactatctcccgaccggtggcggattccggcatgaagcggcgcggcagcccggcgtgcctctcgctcacgatgcgggaaggcggtagaacgctaccatcgagcagagcggagccccgtgccatggcgccggaggaagaggtgattgaaagcgagcgcgtgtggcgaaggtagggcgcagcagagaaagagggagggctcaagcggcgaaggcaagagggataatggcgaaaggaagggagcaaaacttttcctcggtgtttttatacccttgccatcgctgggcccggctcctcgtttctcgcgcccactatctcgctccctcgtttctcactatctcgctccctcgtttctcgtgccctcgcttccactaatcccattcgcccgcttgcggcgcatgaggtggatatgcggttgtggcagtcgagatagatcgtatcgtgcgcgcgttaattacgctcgccggccgaagcgacgttaccatatctccaggcgaagcaaatcagctcacccagattcgtgcgctgcttaagtgatgtggcagtcttgaagagaccgcccattatggacagccaagttaccatatgtgcatggtttgagaccgttgggtttctgcgcaaccatggaaaccggtcccacctgtcaccaggctttaggagtggcattacgcccgaccgcttcccttgagaagggcgatcgccctggcataacgccgggggctactgtcggtgatatgggaccgggggtatcgtgaccagaggcttgaggcagacacaatcgcccacgtggcctggcaccttcggggacgtcgggcccgagggtgaggtgtccgccctcctcctgatttcccccccgagggggggtcgggttgctcctgccccggccccgagggccgaggcaccccgaccccttgagggagtttgcgccacatatatgggataggtgaacacggcagtgctcacctaaccgcatttattgtggtctggtcaagcgtgtcacactgcatgcagcgcagtgcagcgcgttcttttatccggtctgtgactggtcacagaccggtcagatcacgggttaggtggcgactggcggtctgacgcacgccttgccccatcccgtcaagacgaaagcctctaggcacttgtctcaagccggagctagcgggttatctcttagagatggcacgttagccctggttagatttataccaggcttcatcccaaccattacatgcaagatgttacatgaagaagggcaaacatgcacgttgctaagctgacgcgtggtagacaaggatgactgatctgtgaccggtctgacactggtcgcgtcatccacagacagccataatcccacgtcgcacctgtttccggcggaagtgggggtaggtatgggccgtctcgtcagaagggcactcggacagcaatcgtaccgatctccgtccatttatgaagagaagaacagtccggtttggaaagggaaaggtgcatgtggtatccccttgagatataaaaggaggaccttgcccacctagggaggggactgagggctggatgacactttgtaacttgtccatacacagatccacaaaaacacaggagtagggtattacgcttcccagcggcccgaacctgtatacattgcccgtgtctcgcgtttcttcctggctcgcgatctttctacatacagcgagagcttgggatttcaccctaagcccccggacgaactggcaaaggggggcctgtgcggtctcccggtgaggagccacgagctccgtcatatccgattcaaatttgaatttgaattcaaatattttttatatttagtatttctatacatctaaagtttatacacctaaagtttatagacccaaagtttataagtcaaaagtttacatacccgattcaaattcaaatattagtgtatagacctaaaatctataattcaaaagtttacatacccgtttcaaatttgaatttgaattcaaatattttttatatatagtatttctatatataatttttttcaactttgttttttttatcttttttaaatttatagtgtagtaggaaatagaataaggggaggaggaagggatgagagggtggggggggggggcgctggttagcgaccagtcgcgccccccgcgccgcgcgcggccacttttcctttcttagtctctcttctctacggcacatgcatatacatatatacgtatacgtatagttatatatatatatatatatatatatatatatatatatatatactacttttagaaaaaagaggtgcttccatcgttcgttaaaaaaccgtgggagaaaaaaccgggcgaaaaaaccggacgaaaaaaaaactatgtccgataaaaaaaggacgaaacaaatgaaaaaaatccgctggcgaaaaaaaaccgtgtgaaaaaaaaactccgataaaaaaggcaaaagaagggaaaaaaaccgggaaaaaagaaaaaaaaataataagtccgatccaaaaaagttgaggcaaaaaaaagaaaaaaaaagaaacgaatctgactcggtctacagggtaaaaaaggcaaaaaaaataaaggaaaaaaatcaaaacgaatccgactctatcgacgcggtaaagaaaagggccaaaaagaaaaaaggtatctgtccgattccaaagaaaaccgaatcctattatatgtgacacggtgtggtaaaaaaacaaatcgaatccgactccatcgacgcggtaaaaaacaagcgtaaaattttttttctgtccgattccaaaaaaaaaagttgcgaaaaaagttttccgtttctctttctctatctctatctctatatgtacaacttaaaaataaaaaagtgtttccgtcgtctatccgtgaaaaaaacgtgaaaaagaaaccgggcaaaaaaaatcgatatatgtgacacggtaaaacaaattaaagatgtttctgacatccgtagtaacgaaaaaagggcgaaaaaatgaaaaaaaaggaaagtccgattcaatatctatatatacctaattaaaaaaattatatggcttatgggttatagttttcgtccataaaaaaaattccatcgcacgtgtgatcgatcccgctttaatccctctccgatggcaaaaaagaaaaaaaaaagaaaaaaatgagagaccacatcaaatttggacctaaattctaaacagaacactacaacaagaatacaagatcagattcaagaacactaagaaacaccgacgctggaagaggagggtgtcgccgtcgctgctgaaccgccaccgccgtcgtagggatgtcggtatgtcgggccaccgccacattgttttgagagagggggggagggaggggaaatgattttagggttagggtttgggctgttgaacttttatataggtcgagatgatcgtctatcagatcggacggctctggcttctcccgcgttaggccgaacgccattcccaggccgcccacacggaatacgttcactttaggtcgcttaagttgttcctccccgattctaatcccaggatgcccacattattgggccacctcatggaccacgtgtacgctccgtatgtaacaagttcacgttaggtcacttcagctgaacttttttatttcattataaatatattttcttaaagtgctcatatcatgtaaaactaaaccttaatcatataatatttttatatttgttataattttaattacccgtcgcaatgcacgggcattttttctatgtcaaaaaaaagaccacgacatacgagtgagagatatataccccacacacacccgcaggctcatgtttaactgaactggcaacagattttcatttacaggtctaattgttttatttaggtgattaaatttgttttcatttatataattagtttgctctatttaagctttttgaaaattgctaaaatttgagaataactttttctacttcgtattatattatttttagccaatggaattaatggaaaattaattatatatttttatctttttgaccaaaggtcactgcaattttatttcattagtattattattatgattatgattcctttatatttttttcaaccagtatacatgattaaaattacctttacccgttgcaacgcacgggcatcattgctagtgtgtgtctatatatatatatatatatatatatataacctattctatacccccctccctcccaagggtcacacccacttccccctccttaccaaggcccaaaacccacctcccaccttggtcaaaggcccctcccaccggtcaaacccgcctactaactccccccaccacccacctcttctcagctctcgtcccaagacagtgcagtaatacgacgaccactgtgtagtaatattgtgtcttacgtgtagtaacagcgttaaagtatagttgaaatatagtcatgacggatctacttttgataagctcttttattctagcatcatagtgcaaacggttttaaaaaaccttacatcacttgggagatattgttcttcaaagcttgacttttttgcaatttgtctctccataagcgggaatactatactattatgttactacttgtctgttgtatgtatactattatgttactacttgtctgttgtatgtactacaatcatatcacgatgttaatacaatgcgttttactgtatttttgggtagtgttactgcataaacacgtggtaacgtgtaccttccgtgcagtaacacttttacttttgtacattaataagtatatggttagcatcaaagacttttaacctatatatttttgtttcaatcctgatttactgtaattcaccataatattattgtcaaaagtgcagtaacgtcatatacatgcagtaacactatattggagggaggagatcggttttcttgaaaagagggaggaagaacggtttcttgaggaggggagtacgtagatgcattttgaagtttaaacctccacatgcagtaacactatagcatcattgtgaaaacggttttaaaaaataatacataacttgtgagatattgcttttcaaatattggcattttgaactttaacactccatatgcagtaacatagtatgtaatttgtagtaacatgtgtatatacatgcagtaacatagttttaccaaatgtataaaattgttcaaaacactcttacatcaatcatacctcgctcaaagccacctacagactttacctatagcccacctattcgatcttcatcttgtaaaaatgacatagtaaaactacaattatcgtgcagtaacacagctacttgaaagtggtaacatgtacctattatgtactaacacttctacttttgtgcagtaacaaatatatggttagcatgtgaggctttaacccatatatttttgtttcgattcctggtctactacaatttcactatgatattactgccataagtgcaataatgtcctatgtgttatacagtaacatcacgtgttactgtacttttacaacaatgttattattggagcatagtaacatgctatgagtttcaatagtgaaatatataggaattgataatcatattactttctcacaaaatttttgaaataaatagcatcattagatgaattggttagacgaatgtgctttgaactatgaggtcatgggttcaagtcttaaatttggcagtttattttttatttttctagaaaagagggaaaaaatgtttcagcgagccaaaaaaaacagaaaaaaaataaaaaaaagagagagagatcagaggagggagggggagcgagagaagagggagggggagcgagagggagggacggggaggagtggactgggggtatagaataagtcttaccctattttaatgtaaaaaaatatatacacatgtatataaagtttgtgtgtatgtataaacatctaaaaaaatacgtgtatacaaactttgtatacgcgtataaaaaataattggtatatgtacgtataaaaatccaaaaaatgcacgtatataaacaactttatacaaactttgtatacgtgaataaaaaattagtattacatatatataaaatccaaaaaatacacgtatacaaagtttgcatatgcgtatataaacttacgcgtatacctcagagtggcagttctccgtctggcatgcagggaccccgcttggccggggttccatccccggcagcttctgcttgaagaagatgactcgtgacacagtaacaggagccacgtcaagcgagctggttgggctggcacaggacgtgcacgaacatatggcaagtggcgaatccttggcagagctagaggtgcagatcgacatgcgactcgtcgccgacttgtttatgaatgacgacgttcttccttacaaaaccacctacagatggctctggtgtccattccgcatgccagatccatagggtgacaaaggctggtctcttggttctaaattctcttgagtcaccgagaccgagcgatctgtatacaacatctagcatttctatttttttcacatgatgtaccactgcacgggttgctgtaattagtactcactctgtcttcaaataatttcgtattatatcctaaacttttcaccgctcatttatttaagaaaatatataaacacgcaagaagagtataaaagtatggtgttgctaaaaatcagtcgacagattttatggctgattcaatcaaatttttatgccgtccgattggcatggtgctaggcaacgtgtatatccacaactcatgccgtattggatatttgtgcatgggccttccgttcagctaacaaaaaccttcattggtgtcggctcacatgtgctggttttaaaccttctcccacttctgcctcaatgaaaaaatacagaaccgacacttttaaacaatataggtgtcggtttttaaaaaaaccggtactaatactatagacgtcggttttttaaaataatcggcacctatgcttgcttacattataggtgtcggttctagataaaaaaccgataccaatactgtagatgccggtttgtaaaaagaattgacacctataatatagatatagtgccgattcttttaaaaaatcgtcacctattaaaaaaaccaaccagaaccgagactgccttttatccatggggtgcggaagtgcgcaggtgttccacgccctcgcggcttctatgccattagtgccggggacgtcgacgatgacccgctcacctcgctctagctctcgctttccctcttggggcaacaggaccaggggttccaccacaacaacgcacagaactacttctaggagctctctcctcgccatgacgctgagatggggaaggaagaagaggaatctgataagtgggcccccgtgcaaatgaggaaatggatggagaacgttgcatgaccgaacagcaggaactaagccaaccagagacgggtgaatggttggtgtacccaaaaaccaaaacttttagcggaaataaaagttacccttgaatcgatgaattgcggtctaaccggagtagattaaccagtctgaccgaaccatagccgccggtctgaccggtattgatctcccggtctaaccgccaaaacttgtcgccgatgcctgttgtcgccgctggtctgaccgctgcaatgccgccggcctgaccgccggtatcccgccggttggaccgccgaacccgtgcaaacacaaattgaagatatctcaaagtagatgacaactttattacttctctctatgtttacaaagtgcaacagcagcacacctcacaaaaatctcgaccaaactcgaaaccctaattaatctctcaactcaatgctctctaaagtgataccgggaatccacaccctccctctctatttatacatgaggtaggctgcctaaagccacgaaccaaactcatacaagaagtcctaatccacctaggaaaccttccagtacaagaaaccaactttacaaactccaattataccaaatttggactccttccaaattcgactccacatcccatacgcacacaatatctccatcatatgccatatggaatattcaccaatcacgtgcattgatctttagcctaagaatcccgcatgatatctgaccatccggacgtcaccttatctccaagttgactcccgattcatcaccggcaatactctcccgaggcatttagacacctacacatgaatcaaacaaagaaaccatattccgattccaaactatctccaacgtgactcattattagaaaactacagtattacatacgcatagtatccatctagaagccataaacatgaactatccacagatatacaataaaacaacccgaaaccgaaacacaaattttacatggaaaacccttgcgggaaaaaccatgggcgttgaccggcaatgatcactattgaggagttggatacatacgcatgggatacattgggctatcgcaccctccccgtgtggcttacaaggaatatatatagtataaatctaacagtcctagtggggaaagacttatgagtcaaactaggaaactaatcataatagtcaagttctattagaaaacttatccaaatatattgtgggcccaaaattcggatcatatatttaacaatgcaccccttacaagtttctcacgaaaccctatctaatttcacaaacttggcttattgttagatttgaatttgcttcagttttagggttcagatttgctgaaactctgagacaactgactttcgagggtgttttctcttaaaccgtttattatttttcaaatccctccagtggagtttttccttagtttgtctagtttattctatcaagtttgcaactcgatccaacggttggtttaagagaaatcgtgtttttacagaaacgctgtcgtgctgtttttagggctgacggtcagaccgccgagtgacctgcggtcagaccagccaggctcggtcagactgactctagtaggtcggatagactggattacatgtgtttcattggcttttgaggttggggtgtgttttgatctgtcaagattcgattatttgacttccgctgacgtaatctacggtatctaccattcaccccctctggtagacttggttacttgtgtttgatcgtacaaacgtgacgacagtggcacggttctaattttgtaaaatttcaatggcacaactacaaatagacaaattgtaatagcatttatctgaaa

SEQ ID NO: 42113 - DNA, 4790 bp, Oryza sativa
catttatctgaaataacatgtttgcaatatcatggattaaattaactctattttaaagtcatttatagccaaaattaaaaagtttaatctcagcttagagtactattaaggttccaactttgagcacttataacttattagtaatatatgttataatctatgttctttttataattatttggacaacatgtaaaaggctagaatgtgatcctacatgtcattatttttaaatcaaaacatagtagttgatatggtttttaagaaaaatttgacacttcatttgatcacattgtccacattaattacaatctgccttaaaaaatctaatagattcggtggcgagaatcacgtgaaaacaatatttgttcgaccaataatccttcaaaaacatatgggttaatatgggtgttgatattttttcctctgtattatagatctaatttacctgttgatggttcatgcatgggttaatatattatggaataatctattatttttaattcatttggacactaatattgtaacactattaggatgagaatgaaatgaaaaaaggatagactttagttctatgtgacatgtttttaatcaaaatatatttaatgtgaggattaggggtgaaggattaatcgtgttttttttcccaatcatacgtacgtagtttttcttcggtgattcttttttcgtatgtacataacacaagagatttttctctctgttgaataattacatattttttctgttgtatgtacagacgagagattaggtggtttatttttaatagatgtaatccaatggtttaaaaaatgggtccactgtattaaattaaaattaaaggcaagatgttttgctttttttttctcagaattgcttggattttctctaattttttagagcgcatcctaagagtatttgtaggaagcttaaatgacttttagtatataatagatttatgtaattataatttatttttgtatgatttattttattattaaagatactttgagcatggtttatattgttttctatattttaagaagacgaatggttaatgtatgtcaaaagttaacggtatcgattcctacatcctttggtcaatgtaagtcaaaagtctacaggaaccctagaggcataagcctcaatccctctcacatcaggtcccacctgtcagcccgaaatgaatattcctttggaatatttattttccaaatccaaaaatcatttctgttgttcctcaaaataaattaatctctagaaattcatatacgtagctccgattgacttcattccacttccagtaatcctctaaaatcgtgattaggggtgaaaatggtggcggaaattccttatcgaccgagcgccgtttccgtatatgagtaccgtttccgaccgtaaccttttttggctatttttaaatttttttttttcacaattcttttttcatcgtattaatatcgataatgagtagtttaaatgataaatatgatcaattaccggccgatcgagcatcatttctgaagagatgctactgattccgatcgtttccgaccattttcacccctaatcgtgatctatctattggcactattattagtcctaaataaggtcttcttattggtctttgtgtatgattttgaatattttcactactttatcggaattatgttcgagtgcagatttcgagaagtgtcgtgaacaccttgagcaagaaaagtcacccttgaggccttgaccatattgctcttataatttaaatcttgattgttttgcttgcaaagttgcattaagtacacataaattgctttggtcttagtttgcgtgccaaaccgacggacctacctagtagtttcactacttgtaggtcaacataccgggtatgaattactccatggctattaaaataactatagatgatttggagcctgtagttggctatactattcaaattgctctaacctagagaccaagaaacaattcttatcatctcatagtttggatcatcctaataaatgtaatgcatgcattaaatagaattagagatctcgagggtagatgattttaaaaaaatgagtaataatttaatggagaagaggtcttagttaattgtatgcatgcatgcatgcatgccttatactcattcctttcaaaaaaagttacacctattacttttgtcaccaagatcaatgagaaattaactcatcttgcatgtaataaagatcaaagaatgaatacaaacatggaaccaatgaatatttacatggcttgttgggttttaatcaaacatataatttacctctcaatttaaggctgagttcttctctctactttcccaactcaccttcatcgttttccgtgcgcacgttttttaatctgttaaacattacatttttttcgaaaaaaactatatgaaagttactttagaaaatcatatcaatcgatttttcaaatttattttagctaatacttaatcaatcatgcactaaatgctgcttcgttttgcgtgctaggcaacttgggttcctaaccctcactcccgaacacaccctaagtcttggatgtataaagactataaatagaaacaacttatttggaaaaactcaaatgtgaaatatatctaattcttgtggatggagggagtattatggaatataaaaaaaatagttgtgtcttatattatgaaatggagggagtaagatttatatattattttagagttctcaaagatatgtgtaaacatgagatgagaccacatgttagaattcctccgagatatgaaggaatattttctatcattcaaaattccttcaaaccaatttctgcacttaacgggcttttatatgagttttttcatttgtaatgaatcccactagttctacacaaatttcctcccatgtaagggcgtgttcgattaatccctgtgagggtttacatgttcgattaatccctgtgagggacggattgaaggagatttattttagatgtggaattatttcccctcaatactctccaattcttttcagtcccctctaaaccgaacaagaaaagtttttcgaaggaataattcataaaataaatttatgcaaagggccgaaatgggcaaaattgaggcttgcggagttgcggttgcgggggccttgcctaactctgcctgctccgctacgcctgcgcatcttgatttcaaaatagtacagacatcaaaccctggcctctccactttcttccaccaaaaccccacacgcctccaatgggatcctcgccggcagcgccgtgggccatgctcgccgctacaaaaccgacgccgagctcggcagtgcagagctctccctcacaccctccacgccgccatgggtcgccatcttcgtcgtggccccacaatgcgccaaccccgaccacaatacacaacttcccctccgtcctcgccgccgacatccccctgtctcctcttcttcacctcgcagcaccgccacacaggcccgctcatcatcgacaagttggggcgcgggctcgttctgtggaatccctacttaagggctacttcacatggttcccacgctccacctttccatttctgcgagcgctctccgcctcctggccccccgagatgaccatcgcccacacagataacctcagcttggccatcgcccccggcggcggcagatacctggtccccgagttcaaccccatcatcggcagcgacgcggcacgctactctgtttctcgtcgaagaggggggtgtgctgagcaggatatcgactacccctcccaggtcgcccatgggacagccacagcgtggtctcatgacagtggagtcctggtgggtcgatcacctcctcactcgcgacccgttcgatgttatgccagtgtcgtgctttgtccccgagagctacaaagaggatcgatcacctcctccccctatgtgtggttgattgcaatctgcccctttaacattcctcaggtattactactatagatgctctgaccttccagtagatacatacacggtttgcacctcatttggtcttgcaatcgcatggagtagttgtcagttactcacttgtcactataactagtgatacatacacggtgtgttgtgttggagactatcagatcatatatagtatcattttacataaaaattttatggtcttgaagcataccaatgtttcaggtgttgggttagagtggatttttgttctaaacatactatatgcaggttttagcaaaagtattgagcggcaccaatattctcaatgcgcaactcgacttgacaacgtccgggtggacaaccaagaattaattctcactaaacaaatcttaatttgaaccagggtaattaacaaagtacaagaataatgagaggactaccgacaactccgggattcctccaacttcttttactttactctctccctattttaagtatactatagaacatataaagaacctaaagtatacttagagcctcttgtaattcagctctacatcttggtgtgtgttgtgaatgagggagagatgggtatttataggtggagagatgccttgggattgtggagatgctaagcatctaaatggcatcttcactctcatcttgctatgtgtccagctgatgacggttgttcaggtaaagtcggtagaaaccgtcatagcaagtcggtaattgccgacctgtgaagtatggggtcgaatggcacaactacgggttcgccaaacccttgctggcctattttgctccgaattttctcgtgggctctggtggagaacccctcagcccaaatgtacttgcaattggc

SEQ ID NO: 42114 - DNA, 3132 bp, Oryza sativa
cacccgtgaaaaagatcaatagtttggttttgtgaaacataccctaatatctgaggttatgtgccacatagcaaaaatatatgtgattgtgtgcaacctgaatagataatggatagatatcaagtctatatatccattatctatccgaagtagcgctgtcttataaccgccaaaatccattatgtaggtagggttttatgaaatttactttttttaagattatcaagtctatatatctacatagtcaccattgcaaatgatgcattgtcttttatggagtacggataaaaaaacttaaaaaagtagaacatttcatctggggtaggggtgaaaacgggcctggtacgagcagatcatagcattcccatatcttcctttaatttcggaaccgggtacaggtaatgttgaataatatatcactcatcctgtattatatcccatattaattttttcttcaaatctgattcgggaacggatatttatttgtatatctaattcaatagatatttactataagaatgcaattaaagtgttaaaaaaagatacatcaaggaacaaagtatataatattacacgtaagatcataaaaatagtgattaactaatcttttatcatgtttataggtgaatttataatagattttcacatatgttttataatatagaacatacaggcggatcaaacttttctcgtatcctaacccatattttttacggattcaggtttaaacctgaaaatatcgggtatcccattttctctcccatatattcttcccataattttctggtcgagcgggtgatcgggaaatactcgccccgttttcgccgctaatctggggaaaaccttgcgagagtatactagtccatcaaactttaaggtcttagtgcaaattcgcattgtttgaatgcaaaaggtaattaatttgcaccatcctacttacatatttttaaaaaataaagctaaatacgattgtggttagccctcacgttttcttagttagaatcatcgccaatgttccattaattggtacaggttttttttctttatgtattgttccagagttgtggcaccaaaatacatgttgccacataccagtgcgtgagcggccacgaccgcacgacaacttcttttttttgttttttctactaactaatattttgcgtacaaaattgcatgatcaagacaatgctcatgatttgtgttagtcgccattcagcggtcagttctttcggctggttaatgcggttgagcttgaagaattctttttactctttagctaaaatatttaacaaataattttctcttttataaatttacatatgtattccccttgcgcccttcggaagggtgtttttttaaaaaaaaattgacccttctagagtgcgagaagtagggatggtaattttctcgttagggctgaggacgcgatgggaccactcttatggggtgggggcaggggggtggggccccgaaaaataaaagaacggagaaaagaaaaaggcagggatgctaagttaccaacggaagacctgacagggctcaaggctgtgaattactcttctaaaagtagccaattctgagaatttaagcccacaacccacctataacatattggcacaacaggcccaatagagaaagagtttggatatattggaaaaaaaaaaccctgagttttgttccctattccacagccgccgcacatcgtcacacatctctgctccgtgtcaccgtgcgaattgcagtcttctccgatctcgtgactctgtcccgactccattgtcttcatccatgccaaccttgccttgtccccttagtctcgccagttgctgcatccccaactagatggcgacgcgctaaagttcacctgcttctatccgtcatcgcctcctagagctttcatcgtcggctcgccgccctcagctgtcatcggtgcctctaacgttcgactcctcgctgtagcccccaagccgtcaacgtcgccaaatgcgagggctgctctcccgctgggtcctcacaggggctcgggtgcattgggttacccggtttgcaatgcggggtggggaggaatgtgaggaggggggagcgtttctgtccaacccggccctgctgccacccctagtgagaagggttctacatgttttttttttttttgcatttagatcttcttgtcggttttaattgctaaaaaaactaataatgcttatttgatactctaaacaattttaaggctgtgtttggaactgaaggttcccagcccctctccatcgtattccgcgcgcacgcttttcaaactattaaaatgtatactttttgcaaaaagtttctatacgaaagttgcttaaaaaattatattaatccattttttaaacaaaatagctaattcttaattaatcatgcgctaatagaccgctaagttttcggtacttactgtgcacgctgggaacgtccgattccgaacacagcctaaataaaagctggtaaacaacaaagttgtagatctcgtcaagatctacaacatttgtataagtttgtctatattggaagtcgtttgtaacgtagattagagattttgtaaggaatatttggattattaaacgatctgaaatgaaaaaatatattaattataaagttgtagatctcctggattgtgggcttgcggcccaacgccgaacctcggtgagcaagatgggttggatcagaaccatatttgtctaaatgggtttttatcagatcagcacaaatatgtgatgcttttcacccgctgaccatatatgcacaaaagtatattcggcgttaacaacagtatgctaactagcatgttgtctttccgtgtattgcgacagggttttaattcaagaaaattattagtaacccacttaatcattatttttcctttttcacactgtatttttttttcttttcaaagaaaataggaagttggtggctaccattacgcccatttaaaggagtattgatataaattctaaattcttgtcataataacagtttgcccaaaagatgctcaataggcaagtaatcgacataaggcagagcaagattatcagtctttgttgaaaagggagatagaacatggtgttatatgcacacaatacaatattcctaatcaaaaca

SEQ ID NO: 42115 - DNA, 11647 bp, Oryza sativa
atggcacgttgctcctgtagcctgtggcgaggattattgtgtcgaattgctcctccttgccatccgtgaacctgaccccttgcctcgtcatctccttcactgctcccactacctagtgatgcatgattcccatcagcgcctcatcaatcaaagcacaggagaaaacccacagggataaaataaatgaatctccatatgagaaccattttccacaagagaaatgtacatgctgcatgtgcgaatagctgatgtgccacattaggaagtagacgcccagcagctcacatgtacagctcgacagtttgactggtctcagtttctactactggttcttgaaaggagctaggctagctgaatggttggcactaaccttaattttgccggatttgatgtggtctagcgtcccaacgtccagtacgggtgtcctgccggtgaggttcttgagctcgatgggccctgttttgggccgccttaggccgaactgccccgtgttaccgaggatgaggtgagccgccgtgagaaggaaccggtcgacgagctgaaccggtagccatcgcagcagcgccatggcgatgccgaacgtggatagaccgaacatttcccttggtaggacatgcacctggacgaaacatcaccacggcgcttagatttgtgtaacccgtcatcataataatgtaatgaaaatgacacgcgtaattatcggagggcagggggaggcaaaatggaagaaagaaacggctgttgataggacaagacacccgacatataaagttgtgtggaatggaagatgttaacaggtctaatttctccttcctgaatatgatccaatacagccatgcacaatgaaaacggatttaagatgacaataatatgtccaatgacaataagatgtgacacacagaaagataaatcaaatacagacaaaaaaaacaggggaaaaacagagcatgatagataggttctaaagcataagctcagtttaactagtttcttaccgtgttgcgcaccaccatggagggcttcgcgccatgccggcacaaatccaagctcacttccatgccagaattcccgcatcccacgaccaacaccttcttaccggcaaactgctcgccggacttgtactcggaagtatgcatggcacacccggcgaacttctgcatgccgggaaagtccggcacccgcggctcggcgttctcccccgtcgcgacgacgagccaccgcgccatgagcacctccccgccgtcgagacgcaccctccatgcgccgacggccgcgtcgaacgcggcctcctcgacggtggcgccgaagcgcggcgcgacgcccgccgccgcggcgtacgcctccatgtacgccacgaactggtccttggacgggtacgtcgggtactcctccgggaacgggaggagcggcagctcgcagaagcgcttgggcaggtggagagcgaggcggtcgtacatgcggtggcgccacgtggacgccagcgagtcggaccgctcaagcaccgtcgccggaacgccccgcgccgcgaggcacgccgccgcggcgagccccgacgggcccgcgccgacgatgacggcgcccgggacccacgtctcgcggcgttcttgcgccggcttgttgtccatggccccttgtgcagagcggttgtgtgtgtaggtagcggcgctttttttactgccaactaggtggaggttttactgtgcgaagcggtggttttataggggtttttggagagaaggctcgagcggcgcgcttcgccggtggcagactagagtagaggtgcagcgcgagcaatactgctgctgtaggatttcgcttgttttttttggagccctgcaatgcgaattcatggagtagtttcgtacgaagaatgaaacttggtgagggcccgtgccccgtggtaaggggttttggtccacactagtatacgcttttgtaggtgggagctaggtccttgtctttgggatgcaaatttggaagaccacttgtgccctcttaatcacgcaagccgagcggattgaaaatccaacataatccagagagggccactagcccagcaccaagaatgccttgccacatatagtatgcgcattgggatgcctgtgtcacttacatatggattgggagtgatcgattacatctccgtctcattttaaaatacagctgtgggttttcgtgtttagcatttgactattcatcttatctaaaaaatttataaaaaaataaagaaaaatagtacacataaagtattgttcatgttttattagctaataacaataaaaatactaattataaaaaattttcaaataaaacggacagtcaaacgttatatatatataaacaaaactgcgatcttcctgtcacagaggtagtatataactgatttctcccccttgatatgcttgcacaaaccaaacaacacatgatttgtattctcatctgtcatagttaaattttgaattttagtttattttttaagcataggtagttgctaaaaacatttatataatagttttaccataaattattttagtcgctaataagtggctaggcttataataaaccttttatattaaacctttcatattgttccaacattatactttgatcattaatctctttcgtaatatattaccatctactacaaaatcaacatcataaaaaatgttttcaaatacaaatacaaaaatgctacttgcatggcactaaacacatatttttatttaattgttagtccattttttcaaatgtagactttatggaaaacaataatgcgttgtatattagaacacagagattgtgtagcaaagttttagccaatgttctgatttctaaaagcctttaccagatctccttaattagctttaattttttcttttcgttgaaaccattggagaactagtgagaacggctggaattaaaataaagtatattaaaaaattcaaatttagtattagtttttttaaaaaaattgactgattgaacgagcgatttgtaactcacgttttaatttacgaatggttttgtgaacaatggttctagctagctagctatacttattctcagtttgctcatgcaatgcacactaaaaaaattctaaataaatatactacatgtaatgcatgccataaaatgtttacatggaaagtatctaaaaataaaaaatgtactagaaaaaaattgtctttgttttatttaactttaataaaaactcagtatctgcttctttacatgtataccatgtttcttataatttcccaaagagcacaagttcaaatttcaaagtgggtgtaggcacactagggtgtggaatatgtattggaataattattgcatccataccatattaccacatttctcttctctattggaagatacatatacaatcaaattttgagtgcttacgtgtcgatttccttttacataattcttttttttcattgttcatttcgttgcaatttgaagaaaaatgcaacaaaacgaaaaattgattgttgattgctggaacagattgggtatagtatggaatacctccattgctcttcagagcatgatattggaagccaaagccatttataatcgaagatgttttatggagcaatttcttacagatgcatggaacatttggaagcaaaaaaaattgatttattttttccataaacctctttcattatcttcgtggaggcaactcctcaagggagacctcattcttctcttgtttaggctaaatgaaataaatagagatgttgctaaagattggactctttcgttgtaactttttttgacctttaattttttttaataaaatctctttaacagggaggcctcccctgttgtgttactgtaaaaaaaaagaaaaatgcaagagttttgccttcttccttcaaatttcgttgggattcgggtttgctatttgaatggcaaatgattttatatagggacataaatataaatatatgaaactaggttgttttttgcacaccaaaatttatatttagtagtccaaatcgtacaatttcagctcctcctaaaccgtatctgttttgaaaagatgagtagtcgtgctgtgcagcaggggaaatgtgacgtgtacacagagacgcgaagaggttagaggagcctagggggatcgaattaaatgggcacagagacaggcagcagcgagcggcgagcggcgagccgtgcactggtgctctactcttgcaccttattgccgtgacgcgctctaggcgcaggatgtagcacagatccactcttcaatggtgtggattagaggtccaattgcgacagagcaattaatggtgtaactgcgaagacgtcgatggacgggtacgactcaactccaagtgatcgacctgtactgtacgtctgaggatcatcaccttgaaagccacagtcaaggttctcgctggaaatattatttatggtgatcagcctggtgagtgtgcaggtgacagcgagtccatcttgctacgtacttgtactttactatggctagctaggacgaggattcactgcactgcacgtacgagctactcgctccgttttatattttatattacagtgtcttcgtctcattttaaatactgatataagtttccatatccaatatttgattgtccatcttatttaaaaaatatatttttttacaaaaatagttacacataaaatattatttatgttttattacctaataacaataaaaatgctaaccataaaaaattttcaaataaaacgaatggtcaaacgttagacataaacggtgtaaaactatagttttttttgacagaggtagtacgtcatttgactttttctagtcaaactttattaagtttgatcaagtttgtaaaaaaaaattagcaacatctaaaatatattaaatttgtttcattaaatttaacattaaatatatttgtttctgttaaaaacactattatatttttttaataaacttggttaaacttaaagaaattttattagaaaaaaagtcaaacgacttatattataatatgaaacggagggagtagttaccgcgcatggccgcatggatgtgtgtggcagctcgcaagccgttggatcaagcactgtaagtgtaactactgttggtatttcttacgatcacagataagatccataagtgcacggatataccgatgtagcacttcccctacggagtattccaagggtatcgaatccaaggaacgtgtgtgattatctcctcgtcaggttcatctaaggacacaaagctaaggtgggcagagggcagagaggatttcctaatgagaagcagtgtccagggaaagcttaagtttaatcctaacgcaatacttcaggcactgccaacccgctgttcccagatgtcgctctactacgtatccggacagtgaggacttaagtactcttgagggctgtcaccacctctacacccacctcaaacgtactgtgggatacgcagcaaccactggaaattaattacccagacaccgcgtctacgcaattaataactactctagtgccgatcaaacactaaagcaatcactataaataaatagactatagtgaacaatgatccagtatgctaattaggaactaaccaagaagtaattctcactaagtaaaccttaattactcagaatgatatttctattaaagcagaataataaacaaagtacaagagataagagagggttaccgataactccggaattcctccgacttccattactttactctctccctgttctaatatacaataaaatacactagagcctcttgtaattcagctcatgctttggtgtgtgtgaatgagggagaggagaggggtatttatagtgtggaggtgagttgagagagtggagatcctccaagcatccaatgagcatcttcatcctcctagtgccatgtgtccagctaatgacggttattcaggtaaagtcggtagaaaccgtcatagcaagtcggtaattgccggcctgtgaagtttggggccgaacggcgcagctacgggttcgaccgaaccaagtggttcggccaaacccttgttggcccgttttgctccgaattttctcgtgggctttggtggagaacccctcagcccaaatgtacttgcaattggcccatttgaatgtgtttcattaggtttgtgggtccaaaactccataggcttgaatatggaagtttaattcaccacctcctctttgtatcttttgtctcaactttggtggttcgtcacctgcgtacaaatatacaccaacactcgtggaaattgttagaaataaatcctaccactatgttggatgttttatatatgtggttttatgcaggtattgacggtgttaacttggtacttaacagccgtcaacaactactccatccatcttaaaaaaaacaaatctagaactggacgcgacatatcttaatagaacgaatctggataaagacatattcagattcattgtactaggatgtgatatatctagtagtaggatgttattttataggatggatagggtagatgcgtaatgcagttctttcttcaagcagtcaagcacaaagtgctcaatacaatatggatggcttgcttgccacctgaaagaaacatgtatattaggtaagatcggctaaaaccccgatactacccctattagtgatcaagaagcttgctatggatcatggttctaaacacgacttactaggtcgaaaatgcattgatgcagcactaagtatgaaaagaaacacaatatctagacaatcaagccgttgactgattttcaagatggtagatgtctaaattaatctaatctagcaagtcgatttagccgataccagcagaaaatctaaagcgagaagcagccgatagaactaaatcgatatttaagactagattaacatagacatatgataacaatggtcatgatacgagcccctttcaatcatggattgacaccttataaatctttgtacagttccttttaaattaatgaaaagtaccgtggggcttcccccactatttcccggtcaaaaaaaatggtcatgatacgaggactaaaatttctaaaacgacataatagccccaatatcacaggccatcgagacgtgttacctcttgcaaagcgaactcgttggaaagtaaagacaaaaagggtggcgatgcgccaaagttgaattgactcaactatccaattaatagatacaattgccttaatcaagctccatctctagttggcaaatatggttattccaatctaggcccagaccgagcccaaatcataccatatcggctgtatcagccatctgcctcatcaacctttatcaactcgcactctgtttctagctgatacggtatccagccgatgtgtagtccgactccaaatccaactcgatttcacaccaaattcgcttcaatcttctaccttcttctccgaatctgatgcaaaattccgttgttaacaacaacactatagcagacgagacatgtttagggtcttttattctttaatctatccggtccataggcgatttggtctaactacatcggcttagaccactaacgatacgctatcagctgactaactctgcttttatctttcttgctgattgcaggatcaaatcagctggcacgctcttgacacacacaaggctagccttggacctgcactggagttaagcagatctcccatgccgccgtgtttcgcatcaacggtatggaaaggtaacaagatcacatttccaatggatctagtctcatgtaaagttccttacaagtcaatgggaatcacaaaacaagaagacgtccagaatctattcgggtattgcatcatcgtctttgggcccattgagtcatgtatcgtgttgtagtccaatagggatgcgctcaggggtccaaggtcgactctaaaacctatatatatatattcaatagtcgtcgttgagttaaggtcaggttttgtttagattatttctgtcatagcagtttcgccgctagatcgatttgtggaaccccaactttgtgttcttaattaatcattcatctgtaataaagttgttatctttctagttctaatttgtgttcttcgagatttgcataggaattagccttctcggcgagatccatcaggtttcgacacggttgataactagaggagacatgatgctgcgattgcagggtttagatcattttgatcggaagccaaattatgtttgtcaagtttccgctaaatcaatagtttcttcacctaacggaagatcgggtgtcccaatgcagtaaacacggaatataagtgatgcacttgcaagtatatagatgtgtatgtcttgccgttactgaattgaagttataactctaatagttctatgcttgttgatttaccagttgcagaaaaaaaaccccccttaagtttagagtttattttgagccgttttcatcatggtttattttctaacatatatttcagaaaacatcggttaatatcatataaaaattgcatccgtaaattatttttagttgctacattcattttatttttcacggctagcttatcagccacagtttaaaagcgataaactttttattgaggtatagtttatacgatataccttatgatcctccttcgttgaattttcctttgcttttcctatgtttttatttgcggcagcaattactcctagcatgtgtttggtttggggataaggtgggatggattggactcatccctattattagtttggcataagggatgggatgatcccacttttgaagtaatggctcatgtgtcagtgagaaaaaaagtgggttggattggttcgccaatttttgagtaaatttcacaaaactacatgtattttgcacaatttgttacaaaactacagatttaagagtttgttttacaaaactacagatttagtatgtctgtttatcacaaaactacatgtattttatacaatctatcacaaaactacagattgaagaacttgtttcacaacactatagatttagtgtattcgtttatcacagaactacgcatttaatgtattaatttaattatcacaaaactacatatttagtgtctccattatcacaggtttaacaatgctaaaacatgtagttttgtgataatgaagacactaaacctgtagttttatgataaatgaagatattaaatttgtagttttgtgaaacaaattcttaaatcagtagttttatgatatattatgcaaagtgcatgtagttttgtgataaacaaagacattgaatctgaagttttgtgaaataagttcttaaatctgtagttttatgataaatcgtgcaaagtatatatagttttatgaaatttactcatttttaagggaccatactaacccgaattttaggagaatatttcctgtcagagaccatcctatctcacctattctcaaacaagcacactaaaaaaataggtttaatctaacctgactcatcccaaccctttaaccaaaagtatgcctacaggatgcatgcatacataacgtaggaaccatagcttccataagcagacaagtgtaggaatgtggccggagcgcaagagacaaagccgtgaccgtgagcatgcacactccctcccaactcgaagcacgcatgcctgcccgatcgatcgatcgatcatggatagatgggtacgtgaccaccacagtctggtgagtctggtcacgtacgtacgtacatacgcacgcatgctacgctcgctagttgagctccatgcgccgtgccttggcaacaagttccctgggtctagggcagcatgcatgtgtaccaacaccagtacgcgcgtgggccccgtctctcgatttgctctcaatcattgatgattctctgcccactgcgccgtgggcccccccggcgtgtacgtcctaatcgcgcggagtggcgtacgtggaccacccggccacggccactgccatcgatcgatcgatcacgctcggctcggcgcttcttctcggcgtacgtctgccaccaacaccgcgccgttatatgtctcgtgcgctccgttacgttgttcgatcgccaagttctatttccaaaccgtcggataagagttgcaacaaatggctgatcgatcgatggtacgtgttcaacgtacggtggtatatatatggccgtgtgggttgtggcacaatgggagacagggccaccatacaataggggtgctgactggtaagggccaaatgagaggcgaacggtatgtctcaataccatggcagtttgtacgatttgagcactaacgggtggggctaggatcgagtcgttgaccgttatacaaaatgaaatgaggattgccgcgacgattggaacagccacaagagagatggctaacttggagttccgtgaaagtttggtcaatctaattgtgtcctagaaagtgatggtttttcaattcgaaacagttatgggtttctctccattttcattcaaaaaaactcaatccgtccattttgtttttatatgttttagctgtcccaccttcatttcacataacagtttgcatatattcctacttccaattagtgaattgtccaggaggtggtagaataatcctactgcaaagagtaccaaaattaagtgggtgaattggagaccccaaatcgaaaaaaaaaggtgaaaaataagtcagacaagtcaaaaagagggtaactgcgtgcatgtgaacttttacatcgattgggatagtactcattttagaacctaaaaattctctttcgaggtaggggcaattaaaattccaagcaagtgatgcagtgcccgataagtaaaaacgtagtagcagataaaggctagctggcctggcacgtagggtggtgtagtattgtgggagtagttactctggtccagaccatcgaagaggtgttacgccagcttaccgcaaatggaagaaaaatccaatggaacggtaccacctcagaagcattttatatatatatatatatatatatccaatggtctctcgatcgccacaaagcatgcaaataccagctagctctagctctctctctctctctctctctctctctctctctctctctctctcgccttattctttcactccctaaatatgaaatttttttgaggctcgattaatattgatccctatatcgagtatattgtttgtaggctttaggcttggaccatggggtagttggaagatggatcagcctagctattgaactagtagcttggaccgtagtgtgcgactgtgtgcgccacagtgaagcatttgttgagcaacgagcgatgcaagaagagaccggactaaacaatgcaatgcagttgatgctcctgcgatagatcatgcatgcatgctcacagtacaggatcccgaatcttctggcaattgagattgagtgattgcgatcgagcaatcgtggggtgagccagtctctaccacatgcatgcatgcaacaaaggaggtactctacgtaggtccagggtgagtccatctttggcactgtagttatggaagcgcctctcgcgctgggagaaaatggcacgtaggggtactctctctaagctgggcatgcaagtttgtgttttgtttggttcttcttcacccaacataagactgctcacgacgcatttgttgccacagttaaaatccgattccgtgttgtacacaca

SEQ ID NO: 42116 - DNA, 15037 bp, Oryza sativa
gccctgctctcccctgttgcgagctactccacggagtatagagaaatggagaagaaaaagatatcatcatcgtctcaatcattcaccgttcgttgggacgtgacggggcggacagatgtaggagtacgacgtacacgcagagacgaggtgcgtggagtgcagagacgaggaaggcgtggcgtcagccgcaggtcatctccgccggcggggcgcgcgcgatggtccacgctacatacgggcatacggctagcagctactccggccgcatgcgagcacgcaaattgcgaggcacacaaagccgtagtactagctgcatgcgctcggtggggccggtgttctgcgcttcgtcgcgtggggcgccgcggtgaggtcacgtgacaggcgggcgggcgggggcgtttttgcaccgtgcattgctgcacgtcggtcgcagcctcgcaggcgggatggcatggcatgcacgcgcgtgacgacggcagttggcaggcaggcaggcagcatactctctcgagcgccgaggccgcggcgcgagcgagcgcagaacggagaacggatggatggatcgacggctccacacaattaccgggatattccatcgcattcgcatcctctctctctccccgctcgcgtgacgagacgagcgtttcccgccgaggaacgcgtgacgggaaaggcgagccatccattcgtatgcatctaccgacctgtagtatcccctctgctcgctctctctgcgtacgcacagcctggcaaaacggatggaacgcgcagcaaggtgcagggcgcctgtgtacctttttttttttttgtttactcacagtcacagcacttacagtttacatttgggttgtctgagggagcttgggaccgttaacgttcgccactaaaggaccgattagtgtagggtccgatctagccgcattagtatcgatcggttgcgatttgcaaacatgcattgacaaatcaaagtgatcaaggcatcatatagagagccaccgcccaacgttgagatcaacgggaaatacgctccggatatctttctgctcagagtaaggctaataatacagccgacctgttggctataagattctttttatcattctctcagcctacccatataatagttagctctttacaattaatataggacccacttatctctctcacagaggttcttatgtccaagccagctgtaagtctacagtccgcttctcctctctctccttttttctctcatccgtttagacagcttatagcctgcttgctcttatatgcctccatgagccagaggcgggtacgtcgcaatctgatatcgccactctgctagctgcttcaacctccgtagggtcaagatcagcaacgtgtcgatttgacgttgcgtggacgcgggctaatgatggcaccatgataggcgtggctctcccgtcgtcaaaaccggagtgaaaaagagaaaagatgccacatccacgctactacagctagctgcatgccgtgccacgccgttcatatatgcattgcatgcatgcaaatatcactcgctagacgctagcggtcgcgtcgcgtgtgcttctcgagttgtccgtcgtgcgatcgacgggcgtacgttcttcgatccccggagatccggccgatccggccatggagctgatcgacatgaggtgcttgcattgcattgactgacatcgcgcgttatgccgaggagcactggagtgtactccgtacgcgatcgtgccagtaccggagcgagactcaattttttatagttgccagtgacctcacgtacgtcgtgcacagttgccagtgacatcatgtgcaagatgcatgacgacgctgcgccgtggcagttctattcaattcatgcgtgctttggcagtactaagcagctacgaggacggcaggaagatacacaggagctatgccgatgctgcagggtacataaacgctgtagttttacatcgacttctccctgcctttaaatcgaaatgtaccgcgtcctccggagtcccgatcgagctccgattggaggagtgtgactgtaggcttaattgtctcctagtactgtctcctgtcgcaagtaggagtagcattttataacgacacagtcactaactaagatactaatttgatcattaatacgtgtatgacacacatcaattatatagtaaaattataatattcaaaaactaatttgaagataaatctagctatcattcttaaaaagttgatacgaaatattcatgcctatactaattgaatattttatagcttccacgttaaccataaatattgatataatatcgtataaatattgatacagtttatcataaaactacgatcgtgtataaaattatgggcttcttaaggtaacctgagggcctctctaaaagcccatcagtatatatatgttatgagttatgacacaagttaaaacgtataggtgcatggtagattggacagaaggtagatgtcaaaacgaatattgttggatgagcttttagagaagctctctgtttacctctaagaagcccgtgattttatacgcaatgtacaagttttacgctcaattaaataaatgaacatatctctctcttatatattaactcctgtagtctcttttgacattgtgaatgatctcagttctgtacttttgatcttcaactcttctaacaatataatagagatttgttaggttttagacgtttcagtcacctaaacttgcattgcgaagcctgaaattgcaatgctacacaatttgcatttttttttgtttactttaactgcagtttgctactatatactccctccttccctaaatgtttgacaccgttgacttttttaaacatgtttgaccgtcgttttattcaaaaacttttgtgatatgtgtaaaactatatgtatacataaaaatatatttaacaataaatcaaatgatagaaaaagaattaacaattacttaaattttttgaataagacgaacggtcaaatatttttaaaaagtcaacggcgtcaaacattttgggatggaggtagtatatggttttactttatttatatctaagtttgagcttttttttcatgtaattttgtagtatatctttatgagctataggcttaattcatataattttgtacttttctatttgctataatttattattcaaccattagggactgataagtataagtaataagggaatggtgagaaccactagattgtcatcaagggatgagaaaagttattgaaattattaaaaatttcaggcacctgaaatcttagacactcccaacataataaatccgcaaaaagctaccgaatcataatgtttttaatcttccttatttttcatatgaatctatcatattgttactttcacatagcaataattttatggagtatttgtgaatatgtagtgtccaaacatttctaagtttagtcgtatatatattcgaaaacgacgtacaaaagaggaaataattaataaaagaaggaaagaaaaagaacgactaggatttgatccgataacctaatgacctatcagatcttgagcaaagtaaacatgcaactaccatagagatacttctaggacttcggttaatcattaggaggaagcaattagagaagattgagagggattaacttcaacctaaataagtatggaattactcctgttaaatctccttcaatcttctttgattaaccgaacaaggcctccttcaatcttcttattaaccgaaaacaaggccaagcattactaaatcttagtggacgcacataataaatagtaaagttctctaaactgttatccagatccctatactctgaaaatgctgttttagatctctaaacttgctgatctgatctaatctgcatactctgataaaaagagaaaaaggaaaaaaaatgtgggccacttatgggagagtgggaaagaagagagaggaggggaggtggcagccacattggctccacgtaagataacaaagaggacatggcaactttggatcgggatgacacatttaaaataagaacttagatctatatattttcaaagttaaaagaactagatgacacatcatgacaagtttaaggactgatggtgaacttcactcttttcccattttcttaaaggaaaaactgcattcagcaagaatacatacaaagcttattgacctttcaatagattggaatagcaattcttggaaatctatttactcaccgcgcataatattacaatgcattcacttggcaacggactataaattgagtgctttgcagagaagcacctgcagcttatttggaagataagagtgcaatacaacagacctaccaagtaggcaagtcctactgataatcaacttgctaaaatatgggtaacaagaaaaatgctgtgataactccactgaactaaaaaacaacactaggtaatgactagaaactggagggtgttggtgtttcattccttgaaatcgtctttgtcatttgctggaagccctctgttcctccaaaaaactgcaagagcactccctccaagctgttacaatagaacgccttaaattagacattcacgaactccagcactcattatataaatatgagatggtatttgctattgatgtgcatgcttgtagcattaggagaaaatagaaatgaaacgtaccgccatgcatacaacactgacagcagatggaacagctacgagtggattcgtgaagtgcttttgggcaagtaaaaatccaagtgcagaactctggaaacaggaagagacattgttaagcacaaatgtcattaaaaattacagcgctctattaaaaattactttgcatactactaaactactagtacttataacatcatcaagattcaagcttgtcaacagcctcgtttcattgctcgaagctcaatagtgtaaaactagacatattcatcctgttatcttggggccttctaatattcaccataattaaacagaggaaacatgttagcctaattaggtggcaacagaatgctgcagagtgctgaaattactgcataagtaaatgagaaactacatctaaacaacaccagcacaatagactgcatgaaacaggcatgttgacttgattatgcctttctggcatgaggcatccatagcaacgataagaaccattaaataaccaaagactgtacaaaccgcaggttctggacaataacagattatatctaagacatttcagcatttatttacctgcatcccgcattcaatagagatagtcctagaagttgattccccaaaagaggaaacttttgataaccaatacccaagtgcaaaggcagcaacatgcagcagagcaacgggaattataagttgaccaccttgagctttcaacacctctgagacttgtccgatctggaaagaaacagtaaattcaagtaaacattgtaactaagttatgtttcatctagcctcatctagccatttacaatattcaaaatgaaaatgaagagagcagcaatttactcaaaataaagaacagacgataatacatcataatcagataaatttgcaaaatttgtggagagcctaaacaatcagcaatgtatggaagtgaaacagaacacggagttgttttcagacttacaggactagcacaaagcaaagtggtgaggagaaccccaatcaatggtgttatggatataatgcgctcagtaaacttaggaaaatactcatgcgccaagactgcaaaataatggaaataaagtcagtaaatctgtcaaagataagatcccaaagtacagcacaacaggtatccattgggcttctttagtacctccgacaatagttggcagtaaaacaacctgaaaagtactgatggccaatccctggacagatgtaattttcttatactgatggacacttgataaataaaaatggattattagttggttttaaatatgaatcatggtgcccttactgcagcatcgacaggaaccagttgaccagctaggagtttagtaaggagtggtgtcatcactatagcaccaatagtcgaacaactgaaatgtaaagataatcacaattagtcagagtagaattgggagcatgacactcaggaagaaaacagagtatctagggtgtgttctatactgcactttcccaacttctactccctctttttccgcgctcacgcttcctgaattgctaaacggtgcgtatttcgcaaaaaaattctatagaaaagttgctttaaaaaatcatattaatccatttttcaagttttttttaagctaatacttaattagggtgtgttctatactcacctttcccaacttctactctctcgttctccgtgcgcatgcttcctaacctgctaaacgatgtgtttttcagaaaaaaattctttaggaaaatagttttcaaaaatcatattaatcaaatttaaagtttttttagctaatacttaattaattatgtgctaatgagtcatcccttttttcatgccggagagaggttctgaaccatcggtgtcgaacgcagccttaatcatgagctacctcattttccgtgcggggagaatgagttacgaaccagcacaattgaacacatcctaagtggtttctgtattaaaatcaaatggcacaacaaaatagcagaataatagcacataggcaaaatagcaccgtatgccctcaattccagcccttaaactatactttgtccaatcaagccatgcatattaggttgttttgcttacacgactaaacaaaattgtgtcaacattcattcagataataattacatcaaactataatagttttggaacatggtcctatcatccaaaaaaagagtttatgtatgaagcctgccatgaaaacctactagaaaaggtacaaggtagtaacattctttaaacgcttcatggctggaagcatgtcaaattgaattggcatgctaaaagcaatctgtgaactaaatctttggaatcgtaaatagtgtgtccaaatttgatgtctcaatagaaagcttgttgagtgtgtaaccatgatatgcagatattttctacgcatgcgagtacagacaatacaaaagtgttggcatcaaataaatatgccggttaaaacttgcgaaactggtaacacatacaaacaatctaaaccaatgtattcaatatttttgagactggctagcatgaaaatgtgtcttccaagaaaaaaacgggtaatttaccatgataacagaatgataagagcacaacagaaatcaattataaaggctgtcactctaattagggataaagaacctcaagaaagatgaaggtacatgtataacaagtagatcagaacaagcaccaaagaaatttcttctcaagcaaatctgaagcttacgttgtcataagaactgaaagtgcgacatttcctttggatatataagtagcaacatttgatgcttgtccaccagggcaacatgacactaaaataagaccagttgcaagaggagcagataacttcaaggtctgtaaaataaacatccatattaggttgcacctaaatatagacgtcaaatttgtgcagatatcttagtgaaaaaaaatgcactagaaggaattttaggttcaaactttttttgcaataaccaaagagaaacactataccactgaaattgtattctatggattcaaatagacagcaatggaaaacaaagaatgcagataacgggtagagtttacatttgatatgataaaattgtatcggctaccctacatagattaactttcttcacataaaaattgcaatgagatgagatatcaccttacaagggaaaaaggtaaaattaaatggaaaaacaaaagaaacttgagatacgtgacatgctcaaagtatccaagacacaggaaatgaaaggaaaaggtcctaaaaatgaaaccagagaacaatcttgaacctttaaaaaaatctttgatgttgatcttgaaccttcaaatctttaaggttgctttgtcagatcagtttattgattattgatttaatcaagacatcaacctttttaatttaattacaattaacatttgcatgaaaaatctcatgaaaagaaaccgtagcataatggcatgtgcatcttttcagggaagggcttgtcaaatcaattatttctttgagcaaggcaccaacctttcaatttaatatttcccagagtttacatgagaatctttaacaagcctgtttcgcatgaaaggaaagcctagcatagctgccatagcagcatatccaaacaaaggaataacagattgtgtttatttcatttttttgttctttcattagaaataataggaaggcatggcctagcattaccatggcaatagcaaatcccagcataggtttgatcaaatactgcgcaagaaatcccacacccacctgcaacaggcaattgcattagtaaacctatatcaagttggaggcctcaagtacagaaaaataatcactatttctttaagagaagacgttcaggagcagaaacatacagtccatggattcctcatgcatctcctgaaatcttcgaaggtcaatgttagtcccattgatagcattaggaatcctaggcccacagtgaaaagatcagtctccaaccaggtaacctgaaagttttccaagaaaactataaagtcagtttctgtggcatttgctgttgagtacagacagtaatgggtattgtcaagttagaaattttaccatcgatggcttgtagatgccaataatggtacctaatatgacctgcaaaaggtgagctctgccttagtacattttttaatatttgctttacaaaccaccaaatgtaacagaactagaagctaaaaaagggcagataaaatcctcaaatgctcccaaatcaacttacccagacagggaaaagagtggtaagcagctcaactattttctcgtactggtttgcttcactaggaatgctctctggcagattactggatatgttagcttcagccttgcacaatagttgacagcttctgaggaaacaacagatcatttcatcattaccataagtaattaaaatcagagcaacaagtgtttaataatgagattattcaagaaaggccagcaatatagttttgctgatctgtaggatcattaatcatgtggatgaaattgcactatttaaaaatataactatgtggcctgtaaggaaagcaagtatgctagctatcacgccttgaaatttttggtctaattagtagaaaatttaattgcaaaaggtactgggctttttttctcaaatataaactactgaactacagattagaaatgccataacactaaaacataaggtgcaacagaaaaatggtgaaaacaatcagattaggggattgaagaatgggtcatgattgcactaaacagaacagcaaatacttcgactgactacagagacagaacataatactatgagaagttccaatcaattcactttctatcttgttctgaggcatgcaaatatagtccagaagatactcaaaatatagaaggtaatgatgaattttcccttaaacatcgaaatgcaaagcttagaaggataggcacacatgccaccttgcttaaaagcatacaatgaagttcaacagattgcatgactaaagtaaacacaactcacacaactaatccactgagttaatctagttgggacagctgaaaatggtagagcaagaacttttggccaccgtgattacttacaaagtcactcttttaaaagttttttttttttgcatctatagcaatgtttagaggaaatttgagaattgatcagttgctagcgtataccatgtacttcaaattcaccacatgcagcatacccattctatatggttattgaatagttcatcaatttcatcccttctagtttacattttacttccttcaaaagcattactcatactaaatgactaaagccagtattttagagttgttactgtgttttcatgataacattaagatacctatacttccaaagggaagtgttcataatgaaaaaaaaactttaagttctgtgaccacatgggaccttggttggagcacatcaccagaaggatattcaggattctccttttacaataagctgcagttgttgaacccccaatcagcagcctttgcagcttcagatgggacttttggttaaagtagcagagaaaggttgcagcacctacttccaattagcacaacgtgactagtgaacactcaacaaacgcagtttgtgttgaccaagtcaaaccctgatctcttctgtaattgggtaatccacgacctaaggaaagcaattccccggacccaataaacatcgacgaggtgctcatacggcacgtacctcagagccggagcagcagtggtcgccggtgcggacgcaatggtcaatccccattcttccttctccttcctaccatagcttggcatcgaacaaacgatccccaatccgccccctgcgtacaagccaacatccagctcagagggatggaatgggaaaaaaaaaagaagcaaaagtctcctccaaacaggctccaacgagcgccgtaccgagacgagcagccgtgcggacggcggcggaggcgatagcggcgtgcggccgcgggcggagggctcgggagacggacgccatggagcgagcagggcaggtggtggacgccgccatgtggaggacgcggggcgagagagagagacgtgcgtgactgctgctggtggagttccggaggtcgcggaagtggggggcagaagggtttaaggctcggagtcggagcgagcggcggagaagcggcggtgctactggtcgttgtcgcgtcgaggaccgaggtgggggcgaggaaatcggggtgcgccgggagagccacacatcgggggcggcttggccgcggcgctcctgtggatcaggtggctccctccctccttgctccgctcctccgccgccgtgctgctgacacccctggcccgcaggaggagtgcgggcgtcgtctcggtctcagttccgacggaatcactggaatgctggatccaaaggaaattcccaaagttcccggtcctgcgggggcaggccggcagctaggatgggccggaccgtgacaggaagtgcataaaaggatcatcaaggcaatgccggtttacaacagtgtctaataacgggttctcttcgttgtcatgcaagtaaatttgatgacgtggaaaaaaaaaggaaagtatggagaaacacattgctacgcatgacaacagctcagagttgactcttgacatttattaatagaaagtttgttgcatgagggtgtagaaaaagaaagaagtataataaaaaaaatatttatgcattaatggtttagaaattttattgtctctaatattgtaggaggatagtttttagtgacattaattaatatagaaagctgcttgtagtcgtgtttatacttttcactcttttttttaaaacacacaggttgagcactaataagattattttttttactgtttttaccctatgagcacatcgactggttggcttggcatatcttgagaaactggaaatatttcgtatcgtttttatctctaccctcttgtaaacaaacaaaaaggaaaaaatatcttggaactcctgtatatggagtaggccaatccataagcatttgaaaaaaaaaatctagcgtgagcctcaatttcttggaatttcttttagccgttcactcttcaagtaaatgtgcaattttcatacgaaacatccaaaaatgcaatcgagtaatcctatgttttatggattggttttgttgactaatcctgtattgttttttttactcctatattatcggactaaacaagttacaaacttttttgtggggaaagggatatattactcaggacttaaatcgtccaaaacaagacgagaaatacaagagcattcatgatctaaccaaaagacagacaggccctcacaacggcctttatttgctaataaatgactgactgaattttggctgcgatgaattttccggagctgaatctccctatcaccggataacagttctgtagcttctttcaccaaaaaagctacctcagacatttccctctcctttgattcgagcatctgcaccaccatcaagcagtccgtctccactacaaactgtctaagcgaccattggagtcccacgagaatgccctccttgcaagctaaaatctctgattccagagcactaccacatcgaggcaggtgtttgcagcaggcgaaaattaccttcccgctccagtcccgcataaccacgccaatgcctccactcccagtctgcgcatcaaaggagccatcaacattaactttcatccacccctcacacggtttcctccatttttgatttttatcctcaggaggtcgcctggctggattggttttcccattaacaaaggaaataacatgcttccccttctctacattcgcttgaggatgttgccggatctccaacagtgactttacatagctctccaggaaacgcttggaagcttctatagggggtggttgcttcccatggacgatctcattccggacaaaccaaatcctccaaagaatcagcaggaacacagttcgctcataatccaacaggatttccagttgatcaaaaatccaacccgggtcattgcacagattacccccatttagagatatattacccgcctcacacatggccccccataggttcctggcgtcaggacatctgcacaacacatgcttggtgtcttccttttctaaaccacacactaaacatatatcagattgctccagcttccgctttgctttattctccattgtggctagacaattggtggctgctctccatgcaaaaattctgaccttttggggggcattggtctgccatataagattccacattcttttgcatcttgcggaagaagaactagaactggtctccatattaacaaggttacatgcgagcccatatgcgcttctcactgaaaatttgccatgtttatccgggtgccatgctacaaagtcatcttcttgccgtgaggagacccggatactgcatattgcttcagcatcaacaggtaagaacacctggtttactctggtttcatcccaggcaccattttctgacagcagttccgagacccattttagtctgcagttacctttacgcgtgattggccgtctggaaaaatcccttggcaaccaggggtctctccaaatgcgcactgacttcccattcccgattctccatataattccttccttaagaagtgacagcccatactcaattgctttccacaccggggaagcatttcctccaaaacttgtatccacaagggaaccatttggaaaatattttgccttgagtacccttgcacatagactgtcaggattaacaatgagccgccaggcctgccgtgctagaagtgcttggttgaagagacgaaaatctctaaaacctaggcccccattgctcttcggacgagttaaacactcccaggatttccaatgtgttttccttttccccttttctacaccccaccaaaaattccgtgttaacttggttaactcctcacatactgactccggtaggttaaagatgcccatcacatataccggaatagtctggataacggattttataagcacctccttcccgccactcgacagcaggttttcgccccagataataagccttttccagattctttcctgtaaactttggaatttccctttgcacattcttccttcaggggttgggaagcccaagtatctgtcctcaaaaccagagttagctatttgcaaggtcactctaataacatcccgagtctgcggcggagaggattccccaaacatgattgagcactttgccgggtttatgagttggcctgttgccaaagcataatcagtaatgacctctttgacagcctgggcttgaacgttatcagctttgaaaaacaaaagcgtgtcatcagcaaaaagcaggtgtgaaatccccggggcctgcctacaaatcttcactggcgagagagctccctgagccactttgtcttccaacagcaatggtagtccatcggctatgaacagaaacagaaagggggataacgggactccctgacaaagaccgcgtgatggagcaaaagtagagagcagagttccattgaatttaacagagtatctcaccgtggttatacaaactattatccatctaacccagcgatgagcgaaacccagcttatacctccaaaaaaccccagtccacccgatcataagcctttgaaatatcaagcttataagcacaagcagcgttctcaggctttctattcttttgtatggagtgaaaacattcaaaagccaaaatcgcattatctgtgatcatccgacccggaacaaacgcactttggcaaggcgaaactaactcatccaggataggtctcagtctattgacgagacatttcgatacaactttgtaaatgacgttacaaagactaatgggacgaaaatcccgaagttccataggttgctcaattttcgggataagcacgaaagtactgcgcatattcagtgatagtagctttcaaacattctcagaagtcaatactatgtttacttaataatgttacaactcgtaagtacgaatagtaaatgtttctttatcaatgtatgcattgcacttcttaatattaactctattgttttgtttaggcaaaggtttgagagatatgtgcagcttcctgatttttcatgtcggagagcattgattgaggataaagttagaagatttgtggtatgtgtcttgagtaatcatgttctagtgtataatatataattgactcattattttaattcacatcgtatattttggttgtcttcttcaaaggtaccaaccaatgttaacctggatgaaattgcttaaaaaacatacggttgtagtagaggtgcccgactgagtttggagagaaggggattgggaagatacgtaaaacaaggtgagccattagcgtataattaattgagtattaactattataaatttcaaaaatagattaata

SEQ ID NO: 42117 - DNA, 11281 bp, Oryza sativa
  unsure (1)..(11281): unsure at all n locations
aaacacatagcaaggtttgcgacaaagctatgaacaatgcttgaaaacagagctttgctcaaaagtggagagaactggaagtttcaggttgctatatgcgactttttggaagctgtaggtgaggaagatgcgtatgtttctcctgcggatattgagctctattcaaagtggttgtctgcatgccgatcagtgtaacaattaacttgttggaattaatggatgggctaaagcccactcaaagattaatttttgaaaaatcacaaaagcccacctcatgagatggcatacatgtggagtttagtaccaccttgcttattctaggagagggggacctccttaaaagggaggaatgcctcctagccacttgaagcatgtgtggtggagagaagagggggaacacacgctcgctcgcttgcttggcttggccgtgtgtgcacgacgtacacgtcgaatggtccgcaaaattggctcctcacccttgcgcagatgcagccttcttttgcagttttgttttgctgtaggaaattcggatttgttttgttttggaaacatttcgaaaaatccggtgcgtgaaaacggcgtggagtccgaataagttacgcgcgacttatccggttcggtgtggagtccgaataagttacgcgcgacttatccggttcggttacgcggagtggagatcatgcgggcgccctgatcaagcgacctatctctatataaaccgagtcgccaccttcacgcaacagacacgaaatcaatctagagtttgcctcctactctgtactgcgccgtcgctcgtagactactccatcccgctcgccggcgtgaaccggcaatcgggagagcaggtctccggaacctctgccttcgacgtcctgcaccgggagaaggcggcaataatatttttcggaagcgcttcgcgtgactgctccctgttcgtccacgacggctcgccttcctctccgctcgcgtgccgtgcgccttcgtcgacgcccgcaaccacgagtagttcctgccgagaaactggtctttccgccacctcggtacgtgttcgacatgttgcgcatatttgatctgtttatattttactgcttagtttacatgtgtagatctaatgatgcgttcatggtagtttacatctgcaatgtcatgatttatttatagaataaattaaattattatgtgctggcgattcatctcacactttgtatactgtgattagatctgatccgtagcagacttcggtattttgtttccccgggtatgcttatggttcttcctttattttaaggatgtcaccattaattaatttgcgaagccctggcctggaaaaaaaaagatacgtggatatgtaaatacagtatttgtggtaattgaattgttgtctgctcattgcgcactgttggtatttcttaacgatattactagaaacataattctcagcaatggcgcagaaatacttctggtatattatggttacagagttcatccgcaagcgcacggatataccattgtagcatttcacctgagagtattccaagggtatcgtatttattttatcccgtgggaagatcacgtagagagaactcaactaataatttatatattacttgtgataatcatattctaagcaggggttaagataatccaagggtagagtgacacttaagcatttctactcatcctcataataaataatctaagctgggtggaaagaaaagagaaaggaaatctattcctatacttctaatatacaaattatacatacattctagttaactgatatactagctaataccctctatccgatgccctcctggtacttcgaaaagccacccctgactgccgagttccttacgatagcccgtcatgaccatccaaccggggctaaatacggaggagtaccctccccaagaaattaacttaggagtatatataggcgcggaggaatacccctattgagctgtcaccatcagcggcccacctctcatccacaatatataaccccaaataatgatatcctgtaatctagacaccacgtttaaactactagatactactctaatatcatcgtcatgacatagagtaattgcatatgcaaacactatacccgcaccaaagcatctcctagataagttagcagtatagtcagtataacatgaatataatgtaaagtaggtactcatatactcagaaagtattccaataccataaatgtatgtagaatagtattctaataaaagtacaaagcttacaaaagaggaaaggaaagctactagagccatacccgaactcttccgaagacttccggactcctgattcctattctaattctattccaccagctagatactactaaactaaacttgagaggaatgatagagctcttgcttgaggtgtgtgagtgaagtgagaaggtgaagtccttttatagcttcaaccgtcattggggcttcatctcgaccgtccagccaaaacctagatccaaccgtcattggggcttcatctcgaccgtcattggggcttcatctcgaccgtccagccaaaacctagatccaacgaaggcgagggtggttcggccgaaccatcaggtttggccgaacctggggctggcccaatccagcccaatttcggctggcggcctcctctgctgcttcacttcgtagacttgtgaattttggcctgattcatcgtgtcaattctgagttcttggcccattcatacacaagtctggttctcgacatcgtccgattaatttatcgtctgagttgatgtcgattctccttcactttattgtcattctctgcaaaaggttagtaaacctaattctagtggaatattattgttctaacatatttatgcattgcaagcatcactagttctcctctattttggtaatattgacggtcgaaactgatcgataacgaccgtcaacacgcaccggcctcacacgacctgatttctaagatagtttggggtgcctatgtcttttgttagttctcggacaagtgttccattggcgaactacggctatcgtatagtccgtgatagctgtccttcgctaatatacgtattatccatttacacatgtgatcccctcagcttacaactgcctatcacctatcaacctctgttcgactactcattacaatggcaagtgcatctttccatcttaggcaatgtgggagaagtgccgatcgtgggagaatcttgtgaaccccttcaggatctacacactttgggatcgtgcattacatatgcgtgcattacatcccatgtgaatgcaacaacatttctctgtcagttaaggtttgaccaagtattcgtttcctttttaatcaccaattttgttttggctagagcacatgtgtgatttttcttttcttcccatttgctaccctaacactcgcccgtgagatgcagggtagttctcccttcgcaacagaaccattcttttattaaaaatatttttttcaaacattcacaactttatacctctcccgtcctctacgagtccattctttacgaaagaaaaatattctctagaagggtgtttttttataacgtggcaagcatccgctaacatgagctaaggctctatttctttcagtttagaattattataatctaaattattgagtcagattactataagctagattgttataatctgtagtataatatacggttagttgtttctttcctagatttttagagcctagattattgggtttgcaagtctaaagagggagtggggtagcatggtgggtaatttttcacccaataatctagaaaaagctcacataaatgagcttaccatattataataagctgggctccagattataataagctattttaataagttgtatgtttctttcagcttaatcttaataatctagattataataatcccaggctgaaagaaacagggcctaagtgctgccatctagaggttggcatggccattttacaagctgctcccttgcaagttgcagcctttctaaaggaatacaatggaaaactgtccattttgcaggcctcctagagcgcttaaagggggcaccttggaaaactgtcgattgccaagatggggtgccattttgcaggcgggtttgcctacaaagtgcttagcccccgatgatcgtctaatagcacacaccaacgatcgtctaccacatcgtaaaaaaaagctttttttttcaaaataaaaccctatggggtttttgaaaaagtcctcgcagagaacatgaggggtggtatagatttgttaaagtttgaaaaaaaaacattttgtaaatattttaatataaaaattcttttgcaacacatatagagctcctaatggttgtggttcaattttttctagaagatgatggcatgaacgaagctgggtggcaggagcagcatcaaaaagagtaggaaggcggtgactagcgagacataagaactataaatatttgaacctaacaatgataaggtttgaattttgaaggtatctaccacaataaagagaagggatcataaccaaataagtgaaggggaggcaattggtgagacttctaaaatctatcaaaaggaaccccattttcatagtcgtgatgacgatgaagaggatgattgtaatgacgcgcagacgagcggaaaggggtggactggtggataacatggtagggttaacgaatagcaagtgtcataggggctcaccaaatttgacgaagatcaagataagaataaggaatcctataaaagatagtttttttaaaaaaaataatataaattcgttgctgtgctagccacataattgtgcgggttaccctgctaattttatattatactcatcataattaatatgattttgtatctatatttatggtttgccatgccataatttacgctatatccttccatgcgaattgtccttgttaatcttaagtacatgcaaccgttccaacctgcgaatggtgaagattaagtagatacacgtaaaacaagaatgtcatgagcacataattaattaagttttaattattttaaacttaaaaatagatttatcttatatttaaaagcatcttttcacatgtaatacatcatttactagattgagaaatgtgttaatagaaatcaatgtaaaatctatatcttgggtgggtggaggggcgaactggattgccacgacgaatggaacagaatccagagatcgcatatcagcatccatttctggtccaagcggcacatcagccccgtcgcgtcgtggtgcatgccttcattcgcacgaaccgtcgccatctaccgcacagtgcataacaaaccctgatggcaaccggcgagcacaaatccatcctaccggcatcgccaaacgggaaaagcacccacctaaaagtccacccggttcgtttggccgtcgcggcagcgggaagaaaagaaacgcatctcgcgcacgcacccacatacttaagtgtttttctcgaatttactatagtcgacaaattttcctccaaaaatttgtcagatgtaattacagtacaatcgtagtgtaattacactgtaacttgtatataattacactgtaactataatgtaacttgtatgtaactttcaagaatctctcggtaacatgttatttcagtaaaatagaggtcgtgggaacaaatcctttcacatgtgtgtgctgtgatttttttcttccttaccagaacaaatcttgtaatagatctaacgattcaaaattatgtgaaacttacgtacaagttatactatagttacatgcaagttacagtgtaattacactacgattgtactataattacatctgtcaaattttttagtagaaaatttgtcgacaaatgtatagatggtcccgtttttctcgtttcctctcctctagctaactctctcccccggccacgcctgccggtctccaatctccaggaatgattccgacgtgccgcacaatacgacgctcctgcctgcggtaggcgaggcgatattccgaattcccggtcgagttagttaaagctgtatgcaggaagcaacacatgattgcatctatcaggtgttgctgtgtgtgtggtgtgactggtgaggtgtggtgtggttttcctaaggaaaagacgccgctgggatacagatcgatcgatcgatccgatcgacgcggggtttgttagctgagcaacctgagctcgcggacagggactgacccgtaaaagcaaagcaagctaagtttcgctagctcggatcgatcctctttgcgctgtggtgatcgagtctggtgactagcccttccaggtcagtgacagaggccaggcgcacctcacctcagtccggtgcaggggctcctcgtgtagggtggtcccaccatggttcattagttgttaagcaagtagtaataactaatctgatagtcacttatctgtctgtcttgtgccactagtgaccaccgacgtagctgcaattggtccatggaccttccctgcgtggatataatcatatatatgaacgtgtttaatggctttctgtttttttttcttttgtgaacggctttctgaataatggctttttgtaagcaaagaatatgggcgcatatctaccagctcagtgtaaccgctaattactccatataactgtacaaggaagagggccttttgtaccgttgtaccgagtacttcgcttgtaggagtacgattagttgccacgatagagcgttcctgagtcaactgaggtgtggacttgtcatctttgtcgacgtgacgacacgagacacaaaagtactacctccgccctaaaataattacaattctatattgtttagcatatattaaggtttgagaaaaaagactatggtgctcctcattaaaagatgtttatgtgagagtggaaagatggttgagggtataatagagagaaatttgaatgagagatgattgatggggcaattagtactctaaaattacaattattttgggacaaagtttaaatcatggaaatacaattattttgagacgaaaatagtagccaggtaggcatgttggtccgcatcaagggaatcgatgaagtatagttgaaggaattaatgttagagcgtacttcccgtacgtgatcttggcaggattaacgtttccagaatcagatgggaattggtaccaaatatcctgatctgaaaatgttccgcgcgtcgaattccacaacaggacaatactagacgagcgccgcatacacacagacacactactctgcctttctacacatacaccggacatctttctgaaatctaaactgtagtttctgcaaattaagcatgcattgcatgtgctttagcaaaaaccaaacggctctccgccatgccagataagcaaagcttgaggttgaggttgaacatacagtttacatagttataaaaattcaaaaaatataaaagcacaaatcgcttgttgtatatccctctatcaacatgaaaaattaagcttaattcacacatgaaaaaaatttgaaaagaaggaaaaaacaataaatttagtgataaatgtttttgtttctttgtgcatatcgaatttgacattactataaatttactccctccatccaaaaaaaaagtttaatcctaggatgtatttgaacatgcacattgtctagatacatccccatgattgattttttttattctcttgataggagaatatgtatgaatacatgacacaatcatctatacatttcatatttgcatatccttttttgaaaaaaatattttaacagtctaaaccctagacaaaaatgtttacaatgttagatttgatgggcagttgaggtagccacggtctcacggaattccctactatacgctgcagcagcgctaacgaacccggccgtgttggggacttcgggtacgggcgcggctaattccctgttacacctgccgccccgctctcgcagacgcgcgggccccacggtctccccttctacagtttacgctcccccgctatataactcagcccgcgcgatccccgcaccaacctcctccgtcgtcctctcccccgaatcagctggtctctagcttcgatcggcactgccccgagaggtaattgcatcgaattactcctccacttgatcaggtccaacattacaagctcgatcgatacaacagctaggaatttcacgtgtgcacttgttcgtaccaagttgtgtgaaaatttttcacgtttgtgacattttccgtccgtttgttcgcggcggaagtcaattggtgtccgtcggcaatgcaggaagcgcttgtctccccggtgcgctcggcattggagctcaagccgttcaacttcggagaccagcggctcgcgtcctcgccgcgctacctccccagcggcgacgacgccctgtaccgctgctcctcccccttcagccccagcttcgggttctcctcgccgtcgccgctagccacctccgtctcgctctcgccgtcctcctccgcctccctcgtcgatgacggcgacgacggaggagcggccgccgacgccacggggcagcggctccagctcgcgcgcctcgcgctgcagtaccaggaggtggccgaccgctacgagctttgcctctcccacctcgccgaggccgccgaagaggcggcggcgctccgtcttgagaacgccgagctccgcgtcaccaacagcgacctcgccctccgtctcgcgctgctcagcgggaagcataccgccgccgtcgccgtcgccgacgagatccgtcggctccgcctcggcgagcagaaggtcgcggccgccaccaaggagcgcacgcccgagaagctcgccgtgctgccgaagagcatctccgtgcggtccacaagctacctcaagctgaaccagcaatcccaggccgccaccgccacttcggcggcccccaaccgcaagccccgcacgtcgtcgaacccaaccaaccccccgaactcggtgagtcccccgctctcgcctcgcgaacaccacggctcagcccgtttgatcggcatttgacattgttgcgcaccactatcaaatcatgcagcagcgcgcgtacgacggcggcaagaaaggcgacgagcagaaggcgcaacccgcggacagcggcgcggagctggaggtgtacaaccagggcatgttcaagacggagctgtgcaacaagtgggaggagacgggagactgcccctacggcgaccagtgccagttcgcgcacggcgtcaccgagctccgccccgtcatccgccaccctcgctacaagaccgcggtgtgccgcatggtgctcgccggcgacgtctgcccctacggccaccgttgccacttccgccactcgctcacccccgccgaacgcctcctcctccgatcctagctaaattaaggcagtgcgcggccagtcttttgcaccacctggatggtttattgctttcgcatgtatactatatacgattatacacacgaaaatgtacaaaaatacgaacatcgtaaataacacataagaggtacgtacagggtacaggaagccatatggtagagctagtagcaccgatattgtaatgtgaatatccacaaacaggattagtgttttcgtcagctcgatcgggttcagggacttcagattcgtcagtttgttcatattctgttcagaagacgtggtactataaggcccgtaaggacgtggattcgcaagtactacttcaaaagtgcaggtgtgaaatccccagaaagaaatgtggctgacgactgtcattttgttggtgtcatgaggctttttattaatggtatatagaggctctttgatagtttgatttcttcatactcgacccattgctgttactgcaattttccgttgaaatgaacagtgatttttgcggtatatacgtcggcatgttgctcacttgctcacagcaccgttcccttgtaaaaaaactgtgtaagaattagcgattctatactttgtgcatattgcctcatgacttaattttctgtttaaagtaacatattttaatatcttaattccaaatttgattgaggtggtgtgtgcgtgaccggccgcgagtggtagtggttgtggtggttagttggccaaggcactacgggatatcgccgtcaacaagtacaatcactcgaggtgattcttggcttagttctttctccaacttttccaattcacatccctcatgtttagcgtacgttttttaaactgctaaacgttatatttttttgcaaaaagttttcatatgaaagttgctttaaaaatcatattgattctttttttaaaaaatagctaatgcttaattaataatgcgctaatgagccgttccattttccgtgtgctaagaagcaacgttctctgttgttgggagctaatacatcaaacacgtaaaacggaacgacttattagcatataattaattaagtattagctaatttattttttaaaatagattaatatgattttctaaagcaacttgtatagaaattttttacaagaaacatgtcgtttaacaattttaaaaacgtacgcgcgaaaaatgagggatgtggttatgtgggtttttttattatttttatttttatttttattttttttagacaggtcaccgggggtcatgtgggctgtgaaaggaagaaaacgaactcagcctaaatgttgacgtgggcttccaattagcaacttggattattatttttggtgggggggggggggataatagcaacttggatttattggccactatgatgattgaagagcaaaccaaaatttcagagcaaattcacctctagaaagaaagatcaattcaactcacgttatgtaggtggcacggcagcgccaaccatgcttaaaattggatatacagacaagaagggatcctggacatatatagatgaagcagaagcaacttaaaaagcaacagaagggaacacggattttcttttctagggatgaaagggaatccaagggttatgagcgtctaataagtgtcttctagccggtctggccatgcatattgtgcaacaaacatatgtacatctccttatatacagccgttagttcacgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 42118 - DNA, 2162 bp, Oryza sativa
atcacagagttgatattacaacgacatccttacccttctcttcctctcatgcaccaatagatggtgcatcaatgtgaggacgctatgtgagggaaacgtgttttagactcttgagaagatatcccctcttttgttcaagcactatctaaatgattgttaaaaaatctcaagaaaatgacaacattcacaacacatatataaacttctcaaaagaaaaaaagaagtcaaaactcaactttgacggaatgatagatgttacaaaactctacattatcaatatttttttagagttcttcaaaaactacttacattgaaattgagagaaaaacttagacgagggggacatcccctcctcaagggattagaattctctcacacattaaaattgagagaaaaagttagacgaggggaacatcccctgccccctcgagggattagaatcctctcccgctatgtgagcttagagctcaatgacaactccaaatgaagaacgtactcacaaaagatcgagggaaatttcaatacaatccacttcaaaacatcaacccaaattataaaaatgtcactgcaaaaagcatagcgatcgaccttaccgttggtttgtctatattaagcatttccatgcatccaagtccattcgatctcgttaatggaaagctggagttgtacttcaattatccaaaaatactaagcatttcctagatacacattttgatgcaagccctcacacaatctctgttacagttttgttgatttttgattccatctgctagaatcagaaaaggggatgcagttcttctgatgtacaattgactgatacgattgcaccatctcttaatttacaattaaatctgccactcatataattgcattcaactgatgcaaatatgaacgattgcataaaagtgtgttaacatgcatgcaaaaacagtatggtgtgccaatataattaatgtgcaaacagtggcatgaaaaccatagtgcatgatatatatatatatatatatatatatatagctatttctaaagtgtgcacactaccaacagaatcttatactgatatcaagctggcctaaaagaaccattataaaaccacgaggcaaagtttagacagtatcaacattaattagaaaaccaaagtttagatatgcatatggggtgcgtgtgtatcatccaaatatgtctttcaagtaaaaatacaacacgagaaactgatagcctagagtggtagcatttctatcagtatcagattcaaattaactagacagaagggaattgcaccagattgaaagcatagctatagctagcagcatgcgtagttgcgtacagtacgtgatccggccagctcctgggtctccagggtgcatatatcatgcaaacaaataagtagtcaagtgcgtagatatcagtttaatttattgcaacggagatcaacaaccacagtacatgcgccctgctaggctgctacctgctagcgacttgactaactgcttctgtattatgtgcatatatatagcttgcagcgcagtttgcctatcggcacgatgacctctagcttcccggtacaaaaaccacacactttgtactgcctcatagcttagactacggtactcggggaggtacatatatatattagtagaagctaattaccataaactgatacttaattaagtgagtacctacttgcgtgcgaccaaataagtagcatatatatgcagtggcaactctattaagacagtactacagcatgtcaacatgacttcgtagctgctaattaatcttcaggggccatgcacactagctactacattagctagctcttctttcacccgacgacgacgactcaggcggcaggcgcgcagtcatagtcgtcgtcatcgtcgtcgccgtctgtctcggccatcctaccccgcgcactgcagcacggtgcgccggcgtaaaccgcaaaggaggcaataatgccgccgtcttggtggacgagggggctggcctccgacaccggcgccatggaaattaagcaggaggggtatgctagctttagctcgctcaacactactgtggctgatggggctagcactctggaggctctaccgctctagctagtgcgctgtactctataccagctagctagctgtgtggtggtactggtgtgaaatttaacc

SEQ ID NO: 42119 - DNA, 4305 bp, Oryza sativa
  unsure (1)..(4305): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagnagagtgcagttgaaaaagtaggagtaattgagctatcagtactgatatcagttttagttatataaatggtcattctgaaattcgagtcacttttgcaggagttagtagagcagcaaaatggtgcagaccaggcaagacttctgttgctttgagacttaattccaagtgaactcgtgcatcaattggtcctaaatatgataacttggaattctgcaggtgatacaagtggctacgtcaggagaggttgttggagaaattggggttctttgctacagacctcagctattcacagttcgaacaagatccttgtgccagttgttgcgtttgaatcgtacagcttttctcagcattgttcaatccaatgttggggatggaactatcataatgaacaaccttattcaggtctaccatttatttgttggtctcttctctgtaacatttatcgcatatgtttgcatttgtagaaagatttttcatattcagagtggtaacctgaccactgaaactagctctgtagtaactcctaaatcgaaccaccctggaacctgcatcatcttgtttaacaatatgtgaagttaaactagtattccctcatatagccactagattatcttgaacacagaaattgtttattcatgtcgactgttctgccattatctaaaaaatatgtcgactgttctgcgactatcagacttgatgttcactgttgtctgttgtgatctggataagggctgtttattttgtttttgcttcattgacatttatcatgctttatgtcgtgcagtattttgagcagtactgagatccactctttttttttctgatgcagttccttaaagagcagaaggagaacagtgtaatggctggtgtcgtaaaggagatagagagtatgctagctcggggaaatctggatttgccaattacactctgttttgcagtaactagaggagatgattttttgttgcatcaacttcttaagcgtggtatggatccaaatgagtcagataatgacgggcataccgcactggtcagtttagtcaactatacgtatctgtgttgtttatttttctatggacttatgctgaccaagaaagttaccactttcaaatgttcatgattaacagcatatagctgcttccaaaggaaacgagcaatgcgtcaggcttctattagaatatggagctgatccaaatgccagaggtatgccgaaaactggaaaattttgacagcatatagtgtacaatttaactgtaagagttaaatggtatgaacagctggatgttatatccaaaccctgcaatatgtcatggcctcacgtcacctgtaaatcttacgaggctaaacttgcttgcaaaattcctgttgaattttctaccaatctaacatctagaacttactgatttacttaatagaatttgctccatgagtttttgcgaagacgcaaaagttttgtgcgtcgatgtaattaactccatgagtgatgagtcttatatacagatgttcaatacaccatctgacatgccacgattttcttttccattttccagactcagaaggaaaagttccactgtgggaagcgctgtgtgagaagcacgccgccgtcgtgcaactattagtcgaaggcggcgcggatctgtcgtcgggtgacacgggcttatacgcttgcatcgccgtggaggagagcgacaccgagctgctcaacgacatcattcactacggaggcgacgtgaacagggctcgccgggacgggaccaccgccctgcaccgcgccgtctgcgacggcaacgtccagatggccgagctcttgctggaacacggagccgacatcgacaagcaggacggcaacggctggaccccgagagccctcgccgagcagcagggccacgacgacatccagctcctgttccggtcgcgcaaggcggcgacggcgagtggccaccatcacgtcccaagctccaccaccaccagggtggcgccggcggcggcggcggcatcactgatcgggaggttcaacagcgagcccatgatgaagaacatgatccacgaagacgccgacctgcccagccgggttctccccgagaagctccggaggaagcgggtcaccttccagaactccctcttcggggtcatctcgtcgtcgcaggcgcagcgggagaccgaccacccgctctcgaggggtggcctcgcggcgacgggctccccgaacccgagcagcggcagccgcaacgccgtcatcagggtgacgatcagctgccccgagaaagggaacaccgccgggaagctcgtgctcctgcctcagacgctggacatgctcctcgagctcggcgccaagaagttcgacttcgcgccaaccaaggttctcaccgtggagggcgccgaggttgacgaggtggagctcatcagagacggcgatcatcttgtgctcgtcagtaatgaatgggatgcagagaagatgaaaggcaagagctagtaaaggagttgtgtgtttttttttctttttcttttttggttgtttactgttgatttccaagaaaggggagatagaatttaccccggagtccaacggttagctaaggaataactggaaatcattggtatagttattccaccatgaagagatggtgaaattgatgggttacgtccggtgttcgtaagtagagaagcgtaagaatttgattttgttatagcgtgttgtgatgttagcctgtttttgttttagttggcaagttgatctgctggcatgtacagttttacgcttttctaatttttgaaggaaaagtccaaagaatgtaccagtgcttcattattattctcaccttcacttattgatttgggtgattttaactcatggaatcaaccttcggttggaacagaacagttacgtactgacggaatgttttactcccctatcctgaaatataactcgaattttggggcggaggtagttttagcatctttgcctctagagaaatgaatttttggaaatgatgattttaccaccataccaagctgcataaccgattatattaagtaggaaacaattttggggaacgatatctctactacttaaaaaattcgtagtggtggtcttgattcctgacatagcagacgcatctgacagacacgcgtaatctcaaccatccgattgccatatccaatggtgtcaatctcctccccatcacgcgctcgctcctctcttgaatcgatctcctccccacgcccactcctcctcctcccacgccgcgtccttcgccctcctccctgggcgacgctcgccccgccgccgcatcgcctcctcgccagccacgcccgccggcctcctccgcgatcgccgccgccctctccaacgcgcctccacctcgcatcggatcgatcatccaccttcgccctcctccctgcgtcatctcctcgcctcctcaccttctcacctcgccgccgcatcgcctcctcagcagccccgtgccacgcgcgcgcgtcccgcgcgcgcgtcccgcgccgccctcgaccgccgacgctgcgacccgcgccgtctcctcgctgccgtcgccgtgccccgagtcccacgtcccgcgccgccctcgaccgccgacgcgggagcaggaggtcacgccgcgtcaacaccgccgaggagccgcttcctcgccgccgtcgcgacgacccgcgccgccctcgactgccgccacctctgccggtcatgatcgccttcatctgaaggtatgtatcccctcctaccccaccacttctgtcaaccgccgccgccgcaatagccgcacgccataccatccccgacctgcaaaccggccatcgccgcccgcacgccacaccacgctgctgcgaatccccggttgctaggtctaggttaccatctccgtcgccgctgcccaatccccaaccagccatcgcagcctgcacaactcacaacatcgccaccgaatccccgctgctaggtcaccgtcgccgctgccagatccccaactggccattgctgcctcatccctagcctaggtcaccgggactactgctcccccgtcagcagttcaaagcccccaactagg

SEQ ID NO: 42120 - DNA, 6230 bp, Oryza sativa
  unsure (1)..(6230): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgttcctgggcaacaataggtttgaaggggtacttcctgtttcaatctcaaacctttcagtttatcttgaatacctctatcttgattttaatgcaatatctggaagcttgcctgaagagattggtaacctcgttaggttagaagctcttctactccataacaactctttcacgggaattcttccgtcatcgttgggcaggcttaaaaatctgcaagttttatatatagacaataataaaataagtggatcaatcccattagccatagggaatcttacagaactaaattatttccgccttgatgtgaatgccttcactggtaggataccaagtgcacttggaaacctgacaaacctagtggaactaggtctttcaagcaataatttcacaggttctattcctgttgaaatatttaagattcacacgttgtcgttaactttggatatatccaataacaacttggaaggatcaataccacaagaaatcgggggcttgaaaaatcttgttcaattctatgcagattccaacaagttatcaggtgaaatccctagcacccttggtgaatgccaacttctccagaatatatctctccaaaataatttcttgagcggtagcgttccatcactcctgagtcaattgaaaggtctacaaattcttgatctttccaataacaacttgtcaggtcaaatacccacattcctgtcaaaccttaccatgctcagttatctcaacctttcattcaatgactttagtggtgaagtaccaacttttggtgtcttttcgaatccttccgcaatttccatccatggaaatggcaaactttgtggtggcataccagatctacatttgcctagatgctcttcacagtcaccacacagaaggcaaaaacttctggtaattcctattgttgtttctcttgctgtaacattactactcctcttattgctctacaagcttctctattggcgtaagaatataaaaacaaacatcccatctaccacatccatggaaggccatcccttgatctctcactcccagctggtaagagcaacagataatttctcagcaaccaatttgttgggatcaggatcatttgggtctgtgtacaaaggagaaataaataatcaagctggtgaaagtaaagatatagctgtgaaagtgctaaaactccaaacccctggcgcactcaaaagtttcatagccgaatgcgaagcactgcgaaacctatggcatcggaaccttgtcaaaataattacagcttgctcaagcattgataacagtggcaatgacttcaaagcaattgtgttcgagttcatgcctaatggcagtttagatggttggctacatcctgacaataatgatcatacagagcaaaggtacttgaatatcctggaaagagtgagcatactccttgatgtggcttatgcattggattatcttcattgccatggccctgcccctgtgatacattgtgatattaagtcaagtaatgttctcttggattctgacatggtggctcgtgttggagactttggacttgcaaggattcttgatgagcaaaactcagttttccaaccctcgacgaactcaatactatttagagggacgattggctatgctgccccaggttagtctgtttcttgttcttcaaatgaagcccacatttatacaataatattagagcaatgctccggtgctttctacttggagtattatactacaagtaaaattaatctcgaccgttcattttaaagggtagattagtaatctcctaatatatattaggggcaattttggcaggatctattttctctgtctcggtcggtcttggcttgatcgcatcaggtccgacgaaaagcaccgcatctcgcccgacgcacgttgcttatcgctactcctcccggcacgccgtggctcggtgcggtgaaaccctcaggcgtcccctcctcccacctctcacctgtctatccgttcctcctcctctcctgtattccacgtcggcatcctggttcgccatcgtggccttctgtccgctgcgagtggccttccgcgcgcgtccgatttcgccggagcccctgcgcaagacctaagattcttggcagcgcccactttggaggattcaatccattccgccggcgggtagtgatctccattccgtgttgctctgattgtgtgggctgcggccacttgggaggcagctgcgatacattccagcgccgtatccccggtccccctccgtgcgtgcccgagtcttgtggcttgcatcggcgagcacctcctcgaccgcgagcacggcatgagatgcagaatatgcaacagtgtcgctcgctgcgtgttgccgtggaaggcgtcgccggcgaacctgatagaccgcaatgctcagaggtttcagcacatccgtgctcgcggcggcgtcaggacactggatcggacgatgaacgatgcatgcggcatgcccgatctgctagctcaggatggtggccggcgactgtccgcacgctctccaacgggcatgacttccacgaggattgcaacatcgcgaagtggctccgtgacaacaagaaggcctgcccagttcattctgcttgtaatattcagttgtatggtgtgtcgaatacttcattgactaattgacgagctttgagatactgatgtttattggatcttgtgactgtcccaatatattcattgttcagtaatggtttaagtaaaaaagaaaaggtgaatagtgatggactactagtaatgtcaatgtgttgaccatgttagtgtgttgtgcattttttttgtgtgcaactgtgatggggtgagatgaatccaagcaatttgaactgaaatatgtcatcctgctcctggatcagtaaacaagttgttttgctcctgaaagagtgagactgaaaaaatctgataaactgcttaaatgagatttttcactatcagagttttgcccatatgtaaattgcatttcagtcagagctgtaattcaggatttgttttatatttcataccatcgaaacatctaactgcattctgtcatattctggcgctctgaatcatcgctacatgattcctttcttgtgctcatatgggggtagctaagccctcaattgccactaaattgattttttttcagtcataggacaatgtctactaatgggggcttagaacatcttgattcactctttgctgcaaactccctggtctactgtcgtgtttatgcaaaagcatttgcattagctccgcggcagcttgtgaagtcatgcacagtccctattcatgtagcatccaaacacctcattcccaagtcccttagctgctcgtacggtcgccggcggcgaccaaatgccaccgcctcactcgagctccgccactgcacgtcgccggctgccatagctcatttcttggccaatccgagccgtccaccacatccccatactacactcgttcattcccagttgcccattcctcctacctcgccgccgttcgccggaacccgttgaatttcgtccgccgtccaattgcccggcgatctcctgtcttggtcaaagctacatggcaggactagtcgtccgccgtgggcaaggaccttcagcggcttggcgaagaggagaagggccacccttggtcgctggagggggaggagatgtcgatcgcgctggagatgatggaggcggagagggagatggacaagcgacgaagtcaacgatggatggggtcagccgcttgagaatggcgaaggtttagagttactgaataataatttacgataatacccttacatgaattattatctatggacaaatatacccctccacgtttctactaccactatgagtggtggtagtagaattagatctcaaccctacgattatatacgatcaacggctcggattattttctactataagtagaaagcaccggagtgaggctcataatattatgggccatttgcagatgaaattagttttaggggaagcattgaatttttatttttacctaattgtatatcagtacaacttatggtaaatttatagctatacaagttataagaattctaatatttctggggaatgttcgatgcaacagaatatggtgctgggaatactgtgtcgacgcaaggtgatatttacagctacggcattcttgtgttggaaactgtaactgggaagaggcccagtgacagcgaatttacacaaggattgagcctctgcgagtctgtaagtctgggtttacatggtaaagtgatggacattgttgacaacaagctgtgtctgggcattgatcagcatgatcctgagacaaccgatgatttttcaagcaagcaaaagatcgattgcctgatttcattacttagactaggactttcttgctcccaggaaatgccatcgagtagattatcaactggagatatcattaaggaactgcatgcaatcaaggaatctctcttgctggaaatagaggatacagaaaaatgaagacactgcatttcttttttctgctgggttacttttatgttctaataaatctgtcatgcatattcttgagctccctcttaagtatctgcagctgagtcctgtagtggtcattccaactatttgtatcctatgataactggatcactgatgttcactgcagaaatatctgttatgtttcttttgatgcaattactttggatcaaatccaaattgtttacagtgtggccggttgcagtcatgcttctacagtctgcatgatacctttgataatttatacaagagtactatgcaaaatgaatattcccttgttcatttctggttacagtctgcatgatactccctccgttaaggttataagacgttttgactttaatcaaagtcaaactgttttaagtttcaccaggtttgtagagaaaagtagtaatattttcaacccaagataaatttattattaaaatatattcaattattgatttgatgaaactaatttagtattatatatattactatatttatctataaacttagtcaaacttgaaatagtttaactttgaccaaagtcaaaacgtcttataacctgaaacggagggagtaccaaagtacataacaaagtaatacattgattcgcatgataatttcgacgattttagactgggtaagttattgcttacgttttttttttttggagaatacgcaaggagcgcatctttgtattatgaggaacaaaagttatttactgggaaaattgaaaaaaaaaataagggacgggatacaagcgataaccaaaaacactaagctagacctattctcgcacgagtattgtgcgacctagagaagactaggggctggacattcaacgccggaattgccgcgttggccaaacgccagagttccgcttcagcaatcattgccttcgcaacctctagccacgttctatgctctcttcgtgttgatcacaaatgacgcaacggtctaggtgtgggaggccacggttgtggaggaggtccacgatccagcacctgttgagagcaaccaaccataagaagtagcggcatcgcggggcgccatcaatttccagattggtttggactgaaaccagactcttcctaggaacaatgctcgataggctgaactggaggtgtattcccccgagcagtcccacctccaagagagggagtccggttgatccggcaatagctccatcgagtttagagtggtctaaaggtggaggtactcgagaatcgcttggatccctagagctccatagatgtctctgacccatcttctaccttgaagtgcctcaacgatcgttttgcgacgtttgaaatgctcgacctcagggacacagttgtagacggctggtgcaaaggagcgaacagagtatccttctagctagttgtcttcccaaaagagcgcagattcaccattgcccaagatacacaccgtggacgccgccacgaagctgcgttccttgggtgagattgggatgttcagaccttgccaaggcttatccaagcttgttctctgcagccaagcccagcgagatcttaaagcgatgcccattcgctctaagtcgggaacacccaatccaccgtactctttaggggcgcataccttggcccaa

SEQ ID NO: 42121 - DNA, 11208 bp, Oryza sativa
atatatgtgtacctagatttattaacatatatatgaatgtaggcaatgctagaaagtcttataacctaaaacggaggagtagtatttatacccaccaaccaatctatattgaccagttagtttcttgtgacttgtagtagtactttttattatggaggttataacttgtacggattttgactttttcttgtattatttgaccacttgtcttattcaaaaaattttgtgcaaatataaaaaacgaaaagttgtgcttaaaatactttggataataaagtaagtcaaaaaaataaataatgatcccaaaaatttttgaataagacgagtggacaacagtacaagtaaaaagtcaaaatcatttatattttgggacagaaggagtactaattaactcttgttgcccaacaccatttcatgacagattggaggcatcgttggttaattataagagaaaaatattacccactgacatgtgggaccaatgtgtcagtggtcttttcgctgtttttgtcgcactgaaatggcatggagggtgaatacttgacccctagcctactctgtttcgtttgcctcaatttgtagagtctattggatggtctacctctgttccaaattacatatagtcctcaatcaaaaatgtctatttttttatcgttaattttaaatatccgtgtaatttaacttgtgaattatatattatgaaagtatttgttttgatgaatctaaaaataaaatcttatgatattaaactaaatcaatggttaaagattgaaaatgcttaactttaaataaacctaaaacaactaatttgaagcggatggagtattataaagttgaaaaacagatttaaaacagttttcaataattatatatatatatatatacacacacatatatatatatatacacacacacatatatatatatatacatatatatatatacatacatacatatatatatatatatatatatacatatatacacacacacatatatatatatatatacatatatatatatatacatacatacatatatatatatatacatatatatacatacatatatatatacatacatatatatatacatacatacatatatatatacatacatatatatatacacatatatatatatacatatatatatatatatacatctatatatatacatgcttttgctaaaatagtgtcatttaaaacaaggtttatatgtatcatactttttctttacttcacccctagataaatctggtatcagaaatactttatagtatctttattactatatcttaatttagagatgaaaagttaatggtcaaagtcacctcaaatactctagtcaaaacatcaatcgaaaaggtaaaacatcaaattatcactatgttcaatcttgcatctacaagacgctaaatccataccaaacaaaactgaactctatagcagacaagctgacctgccgacatcaaattcaacaaatagcagacaaactgatctgccgacataagaaattcaacaacttggtctgggaccatactcaaactgttgctgttgctcagaagaatctctgaaggatgactgaaacttcgaaaatctggtgaggttcatgtcattaaaatctgatagcaattccttcattcactgatatcagcaccaacaagctgatcatgtgtttggtcatgaggattgtacctacctagaaccccccataaggccataacagaattctcatgaaaacaacattgcacattttagatgatgaagtacaattcccagcatctgcattatcgagaaacatcatcgggaattatgttacaacaatacaacagctactatacaacttatcaaggactggatctgctcttggtaactatcacaaggtgccacctgggttgtcgttcgattccccgtgtatttcgcaaactatcaatttttttataaattaagactgctttgtgtagtgcattcaaaattcaatggttaactcagcaaactgaatgggcctctcatcatcctgtggtgctaggggttaagcagcagagccaactgtttgtcttccttttccttgttcgtttagactctttgtccttgtggaaaccgttctgatgtaagccattggtgtcaaggctctcttctccgtgcacccgtgtcgtgctcctccttgtcatggacatagtttttgttacggtagaagctgttgtgtatcgttgcgagtcactgtcaagagcatctttctccctatgattaacattctcattggacaatgaataagtgtgctgggtctctctgcattaagaaacataccatgtaataactgtgcatcaactttagtgcaaatgtaccacagaagaaattaatatcatttagtgctgaccttgaatctcgaggtggcaatgtagcaggatgttcatttggaatattgtgtgaatttctagagtcagtggtactgccatctaaagttacatcgtaaccgataaacttttggaccacactggcacttccagcattgttgcctcggataattgcaatagctttgtccaatatgttcaaagcctgctctacctcaggactaatgtaaggcttattttcaacatgttgctcttgctcagccggagggtttgaagggcctattgcatgatgatccagcttgaataatgccttctgttcactctcctcttcgactatctcactgttcgaggtgatattagtaaccgcgagaacattctgcaaagtgggattgtcagggagggcttctgttgccctttcctccactggagtgacatttgcgatgtcagtagaaccccggtgctcacggattctaacatagagtggttctctcaaagctttcttgtaatcctcatcacaatttgccacagtactgactgcctgcaaagataagtcaatagcaagtgtttaaacaggggatctcttgtgtcagaatttgctcaccccacatagcagtaccacgaaatctatgtaaagaccatactgcaatgggaaaagcgctatgcatattgatatcaaatcatcacaaaagtatcgaggtagtatgccactgaccttctgatagagtttatggccgctgccaattagttgccttgatatgaagttgataagccatggtggaacgaagtctagcttaatatccatattagctattgccctgagtggaggatttggttaaaaaatggagtatcagcatatttattaaactgaaacttgttgagcaaaaagaatcacaaatgaataaattttaaaaactacatacaattatatctttcttaaagttcaaacgtgatttaataacaatctgttcaaaaaaatggagtcaagacatcatgtaaactagcattcaagacgcaagaatgatgaaaattatatattgctaaacaattaaaattaagcaggtaaaacaaattctacagctcaactcacaagtacaggaataacatggcttaataatgaaaaattaactagtaaaataaaaattatagcatgtatccagaacatgcatatcaagtcagaagtacgtcatagaaaaatgaaaaaacttaatggaactctacctttttctaggacaaagtcatccagtccttttacagtcactaaaaaatcactttggttgacagaatcactaatttgattccaagtttccaacaaaagtgggtacaatttcaatagcaaatggagcgatctataatgcatcttcgtgctttatattaaataattcaatgcacaataggattggatgttttacctgaaaagcttttctcctttgtaatcctttgcaaaacaaagcctccgactacatctatccgaacggtgtcaccagcttcaggaattccatccctactaaatccatgtgtctctatatttatattgtccgtatccgatatctgcaacaacgcaataagcagaaataaatgaactggaggcatggacaatgaagtctgtggatcaaggttcataaaaaataaatagcccagaaaattcagcatacgcacagttttcatgattacaatgacaagatcttctttaagatactctaattcgaagtagtgaagaagagcttctctctccgaaactggccatggaaccttcaccctttcttccaaatagtggatgcagatgttagtcacaacatccatcaaagagaaaatccaactaaaatttgtagaaaaatcatggactgtaaagaagatttatctttagccaacctgaccaaagaaatttcttcaccaacccgaaccttcttcaaacagcctgactgagcaactttaaaagttggaaggttgtattgtggaaacctggaacacaaaaaccacatcagcatatgagaaagaaagtacccatttgtctatcctttttgtttcttgggttcagtggggctgccaaaactttagtataccgctggcaaacatgttatgtttcataaaaagtagtcgaaagtaagccatagaattatccccaatttttttttgcaaacattgttggcaacaattagtccaatctttatgcatatggctgaaatgaacattatgttgtctttgtcagcttactgcagaaagggactttacatgagcaatggtgcaacatcaggtagttgctaaagtaggtacatgtgggccatatcgcagagtgactgctataagcaaaataggcaatatttgagtacacttctcaattaagaacagtcatgtgttaactcaacaagaaattgagtcatgtgagtgcacttcgtgaagaacaaaaaacagcagtaaagaaattgagtaaaaaaacacaagaaactgataatctgaatatctgaaattgttgtgtatagattatccattctctaagtagttttcttagtatggttctatcaacttgatgtaatcgtctgagattaataaaagcttcctttatcaaaaaaaaaaagtagtaaaaagctgtactgccatgttctagataaaagtttttgtgttgattccacatgctaaagtaaaagctgagtcaagcaggtcctgatgctgcctccatgaacttttttttagtaacaaatatagtgtccgacgatgcaaaattctaggcgaacaacatctgaagttgtccttaatgaatgtgctcaccattttttgtacagagacgattcccatgaaacacatgtacctatgcaaaaaacagtgtgcttaagtgactgtgtgtattgtgagaccatagcattttactcactactagttagatttcatacaaacatcaattggtccatcagcaaagccttcagcaaggagggtgtgaaatggggtcccctctggtccctcgcgatacataactcgtaattggtccgtgtcttgcttcacctacagaacagagagtaactgcatatcattgcaccaatatagtacaatttgcatgggaatgtaacagacaatttaatcactcccaaaaagaagggagaagaagacatgataacagcaaattctgacgcaaataatataaatgaggcagaaattgcaagcataaatgcatccttacgctctggagattgatcataacatggcatatgaataagtaagcaagaaaacaatgaatacatcacattttttggtgcaaagtaaagatccatttctttgtgctctaatcacatacacgcagaacatattctttaaatgttttactttggttcaatgcataccttccattctttatgtgatgcctcatgaatcttcgaagatcgttcattccccgaagtatttagcatttcaagaaaattcgagatctctttagaccttgcttcagcaatcaggtcaatattgcctaaaaatgatacaaaaccaaatcataagaaaaaccaacaacagagagatcacacaagcagcctgattatgatcaactcaaatagatctttcaaaacaatcaactgaaatagtagcaatcattcaggaaccagtaggatattcacacatagacgatgaaacaatagaatctaaacgacatcacatgagagaatattttctcaactgcaaccataacagctcacgtgcagcacagataaggtaaaactaaagtacacaaaaatcacaacattaattacatcaacaagctaacctactcgatccagagaagaagaaaagaaaccaaatcaagcccccaaaccttcatcgttgccggcggacagcgacgacgcaagaatctgcctcttcacgagagatctcagcaactcctcgtcggcgaggtcgggcagcgccagcgtccggtccatccggtcgcgaagctcccggatttccctccgcttctccatggccgccaccatcaagctctagctcccctcctcaccaacctataccttcattcacccaaagccatataaaaggtataagatgagacctttttctctccaagagcaaagaaaaaaccccaagataggaaaccacgcaatcaatcccccaacgattattcctttttctccccacaaaaaaggctcccatcacccttgaatgaatgccaataggagggaaaaaaaaaacaaagaaggcaagaaagctggagactttatgctctcatggctgcaaaggagggaaagcacacgctctccaccacctccataaaagttgccgaatttatctccaaggaatcgatctcactgagatgccaagattgcctacttgtacttgatactactactacttcttcttcttcttcccaaagccttttccacataataagcgaatatatgggaattgggaggagaatccaacccaagcagaagctagagatactctacttaccgctcttgtcaatggagattgctccggcgatgcgcggcggcggcggcgaggatcggcgaggaaggaggaggaggagaagtagtagagagagaagacgcaaatgaggagctttggttggtaaatggatgctggatgtggggcccacctgccggagttttattattagtggcatttcatttctccgaccgagtattttgactagtatatatattttcgtttttcaacctgactgatcgcaactgataactgactaatatattttcgtttttcaacctgactgagggactattaaaaaaaaaccttatataggttttcttatatagttatcaaaatattggcagaattttttatataggtactaaaatttagcagaaaactaaatgtagccatttttttagtaactttaccaaaatttggtaaggttaaaaatagcattgaacagctcataaattcatcaatcaaagctactctatctggtagctgtacccagaatttgtggtgctccacttgacctttatgtacttaccttgacaattcgtagaaacttcggtaggatgtattcactccgtttttaatacatatcacttttaaaaatatatatccgtattacttacgcacttcatgctagaagtaactttaataataaattaaaacacaataaaatagataatactacctccctccgtactaaatataataaaatataatttatatactttaaaacaaaattagtattttctttttaagctgaatgtttaaacgtttgtttaagagttaacggtattatctatttaaagtaaaaccggagataataatcatcgacaatgcgttacgggcaatggtaaagtgcacaaatagacaatgtattaaaaattcgagaggcaatttcgttggcctaaccgcctaagttggccggtcatacaacatcgcgcactaatttgattgtaattgtcgttaattatcacatatcaggaaatttgtatgacactctctaattccaaacatattattttagaccagtgtaatggaacttagggaaactgctaaagtgaccatgtaactacatggtaagaggatacctcttttattaatactattccctccattttataataataataagtgtagttttagctcttttcatttttcttaaaataagtttatgtttagtaataagtggatcataatttatgaaagtagaaaatatttatattacgagtagataaagtgaaaaataattatattggaatttgataaattagaggtattttattattttttttctattgatatgtgtgggatgggtgaaaaataaatataggttgtgtttagttccacgctaaaattggaattttgaagaaattggaacgatatgatggaaaagttgaaagtttgtgtatgtagaaaaattcgatttgacggaaaagttggaagtttgaagaaaaggtctgaatctaaacagaccatagatggaaagagtatacgatagcggcaaccagaagcaatttacatttagagataaatggagaattatatgacatcctatgtttggaatcaaatgaactgtaggctaaaaatctcactggtagacgtaggcctggtttagttcccaattttttcttcaaacttctaattttttccatcacatcaaaacttttctacacacaaactttcaactttttcatcatatcgttttaattttaatcaaacttttaattttagcgtgaactaaacacacctgtatccaacaaatctagagccctaaccaaatactattaccccatcacaatcacaatgaaggcacacattgagctataaattaaaggattcctaaattaaatgcaccggctagagctagcaagaaaacggccgcagcttcaggagggggaccaaccaccatctaccagctgatcgaccatcatcttctgcttggctggttcgagccacaccacaccgccgcagcagacgaagtcgctttcactctcgcctccgccggtggtgccggccggccggcggtgcgccacgccgcggcatttatttcgttctgtccgggccgggctgttgagaagaaatggggatttgggcggcaagctagccggcaatgccatggaacaatagatgtggttttggctgtgtttagttccacgtaaaaattgaaagcttaaaagagattaaaacgttgcgacagaaaagttggaagtttaaagaaaatgttagaatgtaaacagggccttttttttattttttttataagaaatatgtagatgcccacgatgcgggcccatttatctctatgaacacacacgtacatcttatcactacgagcaacctcgaaagactggaccgacatatttttgtttttatttttttatttttacttttcggtggttgctaaactgttgtaagtaagatgattggataaagagggggtcagcgaattatgttagccgtcatccctccgtttcgcaataaaataaaaggcgttataactttttctctatgttaaactatcatgtttataaaaaaaccaatatctatatcatcaaattagttaaataaaaattaaatatatattttggcattatatattttttaaagtattataatttttctataaacttagttaaaattaatgaagtttaatatagaaaaatatcaaaacgttttactccataatataaaactagatgaggaggagtctgtccgctccatgtcacattagtgcgttagtgggtaaccacagcctcttcgagaaaaccagaaacgaaacaaacaacccgccgaaccaatattaaccaagaacaaaaataaattgagatgtttagttgacaccaaaattaaaagtttggttgaaattgaaacgatgtgacggaaaagttaaaaatttatttatgtaggaaagttttaatgtgatgaaaaagttaaaagtttgaagaattattttggaactaaacacgggcgtgaatcacatccaccaacaaaaaaatcagaagaaaaattgtaaataagcatactttactaggaaaaaaaaactaaagcataataaagcatagagtggaataagattatgttgtaacacaccgacagctagcaatcttctctgcaacggggataaacaacctttttctttccttgatgtgtacacctaaatttacaaagttcacccccttgctaagagttataaatcttatcgataacttactcataactaaatgtccctatgataacatctcccacaaaaatctacaagactaaaatacaaacacagaaagaattaagaaaaaaggagcagcctagcaatgtcagtgggcatatggacaagcacagcagccatcaatgaaaacaggcagcggaactttcatcacagttgagcgtaacatccctgaatgtctcactctttctagcacttcatacaggctaactgttttgctgaattaacagatttagctggcagatcttgaccgatttgttatctccataaaggccaatttggcggcagaatagtcgccactcgcccaccgtcaaattcttgacttatttggaacagtgtgaagaaaagaaaagaatcattcaaggttggtttggtttgtggcctaaataggccttaccaatcattcaaggttggtttggtttgtggcctaaataggccttaccaatcattcaaggttggtttggtttgtggcctaaataggccttaccaaattttgtcagtgccaaattttggcaagttttggtatgactaattttggtaaggtaaagttgtgtttggattgaagccaaaatagcctaagttcactattgaaatggccaattttcttaggcatgccaaaatttggcttcaaaccaaatagacactatacactattaaaattgccaaatattggtaagcctaatttaggcctcaaaccaaaccagccctcaatccatctgtagaaactataccttttgagataaaatccattgtacttccaaaatctgatttcaagccaaacagattctatagtaccacatgcactgtatgtatttagatagcgagaaccttgacgaaatttattggaccgactgcggcagtaataattaaacaattccaaaattgcactgtcaagcgttaaacattccatgttgctttccaacgatttccaggctttgatggatacaatgaaatcttggtttaatagtgattttcacggctcaaccaacaactaaccaactgctgccgaatctaattcaagctggtcaattggctacttctccggtggtgaggtcagctgccttaagttgaactttgcgagctctttgtacctctcgaccaccccaatcatgcatatagtctgtccaaaaatcaaacaagtccatcagaaactgaaccgactggcttagcacagttcagcaggtgaccagatgcacaattcacacaacttaatgtgagctat

SEQ ID NO: 42122 - DNA, 762 bp, Oryza sativa
caccgtgcggagcgagcacgcggcgcacgcgcgcgggcgggggagggatgcggtgcacgcgcgtggttcgcggtggaacggatgcggcgggcccacgcgcatcctcacggcttgcggtggaacgcgcgcacgggaggggctgaccggggtcggcccgatccgatctcggccgagctggcgccgacgtggcgcctacgtggctgccacgcgagctggcgggaggaagacgaaggcgccggccgcgaatggacggcgggcggcggcagtttctccggggcgccttgcgacgatgaggggcgacggggcgtacaccgggatgacgaggaagaaggagagggagcgagccaacggctcggattcgccggagggagtccgtcggcgtcaaccggcggagggcaaagggggaaacggcgacgaggtcacgaggggccaattcccggcggtgagagcatctacgcggccacgggaatccgttgctagcgtcggattgagtggagcttcgccgagcgaggccggcgacgagcgggtgctacggagctcgggcggcgacggcggcgagcacacggcgagcgacggcaacggtcggggtggcgccggctagctacggggaagctactcgtgctaccaccgaaaactaacggggggagatggagcgaggaggaagaacggagggaggcactaccgagatgaggagggcgctgtgacgagaggccgacggtgcgggagtaatctctccggcctcgggccggggaggaggaagga

SEQ ID NO: 42123 - DNA, 778 bp, Oryza sativa
cagaataagtcgcaagcaatcaagataaatattatgaaaattgtttaaaaaatatgatataacatctgtaacccccgactcactagtcaacggcgaaccagttgatgtagtgaggcaaaggaaaaggcaaaatatcatataaagaatgaaataaatgatgacttagctttatcgtattccctcgatgacagcaaaagtagccgatgtgggaacgaaacagtccatcaatggtgacaaaaacaccagttggcgccagtggaaccaagccagtggtgtagatgatgaagcccattaacggtggcgaagtccgccaaccgtataagcgaaaacaccagtcagtggcggcagaggcaagccggcggtgaagtcgtagacgcccaacaacggcggcataataggccagccgtgtaggcggagacaccagtcggcggcgacggaggcaggccggcggtgaagtcgtagacgcccaacaacggcggcataataggccagccgtgtaggcggagataccagtcggcggcgacggaggcaggcgggcggtgaagtcgtagacgcccaacaacggcggcataataggccagccgtgtaggcgaagacaccagtcggcggcgacggagacaggccggcggtgaagtcgtagacgcccaacaacggcggcataataggccagccgtgtaggcggagacaccagttggcggcgacggaggcaggccagcggtgaagtcgtagacgcccaacaacggcggcataataggccagccgtgtaggacacgagtcg

SEQ ID NO: 42124 - DNA, 5908 bp, Oryza sativa
  unsure (1)..(5908): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttacggatgaaaagaaaatccagcgatcagctcacagtattctagtttcttacttcgcatgtttaattaattccctacaagctaggaaagaacttttgcactttacttcacatttcctttatttttctcagcttgactttccattatcaatattgataattgatttcatttcaggtcataataaggaaaatttgtattttagcatgtcacagttcatgaattagataatatgagtgtgtgagaaaagggaagacaatgtgcatattaaatttccttttttttggtgattgtaatatactcatataatcgataatatgagtgatgttgcaatgcacagatggccaattggaaaaactaaaggtttatcattgcaaatcatattgatagaggatatagaaattgagatttttctagcaacacagaaaggaagaaattaaaaatatatatatatagcaaaattaaaactgataccatccgacaacaaggttttgcatcttggtctttacctgaattgacatctatctatctatcttctatctatctatctatctatcttctatctatctatctatcttctattatatactaaaagtccattaaacttcctacaaacgctcctagatcgccatgtggcgttcctataaacgctcctagattgccacgtggcgttttaataaatcctagaaattctaagaaaaaagcaaaacatctggccatcgatttttcatttaatctggtggacccaatattttaaaccattagatctttgttaaaaaaaacccaattcaatctataaaaaaaaattcccacgttacccaacggtgtccccatggacctgtatacgtacgcgtatcccgtgtaagtctttttcttttttcttcttcttatattcttaggttagatgaaaaactaaaaagtccatgttaaattaaagttgtaaaaatatatgctatttcaagttttattctaaatagcgcatctcatcaaaacatccattaaaaatattaataaattaaaattgtagattatattattgtatatctcttaagaacatagttaaattggacttatattttcaaaaaataaaaagaatttaaattatgagcagcgttctaaaaatttactcactccctactgtataatatacccaaatgacattattaaattatcatgaatatattttcatatattatatgttcctttattcatatatttttggaaaattaacgatcatatattttttgacaccatgtggatgtattttttatctcttaggcttcattcggtctacctcattagatgagcttatctaagacatgcgaaaaaaaagaatgtcgtcagcttaagattaattaagtattaaatattacatacttgaatatggatttatttgatctttttaaaaaactttgcatagaaagtatttgaaaacatgcatcgttccaggaaacatctcaccataaagggactagccaatccaataagattttagaactcaaccttaaatttactataaaatatatagtatataatatattttatcaattaggaatagaaccaaatatatcaatcatatatccctactaattcctatgtgtataagtttcatatacaaatcactatccaccaattatcaagtcatattaattacttatgaggcatccgtgcttaatgcacctaataattagatgacatctaatatgcagtgtgttatcaagtactgataatggacaatactaagtgagaaaccatcaacaaatgatatgtaagtattgataccaccaagccacaacaaataatagttgactacaaatatattggtattgggtaatagtgttcccacacacctacatacattcctaggatgccacgtgacgctctaataaattagggtaaatctaacaaaagttataagaaaaagtaaaacatctagccattgatttacacttaaactggtggataaattatttttaaccattagattagatatgttcaagtaatccattacgactatgactaaaagcattcctgcacttccaagatgccgcatgacgctctaataaattagtgatcatataagaaaaaatatattaagaaaagcaaaatataactgtttatttacacataaaccagtggatatattattttcaatcattatattatatctattcaagtaatccctcactatgtacgtacacaacagatgttataaaggaaaaaaagaaagtgtgtatacgatcagccccatcaagtagttttctctttctttctttgcagctctgagattttccacaaattgtgtatatgagtagcgaccactcctggcaaggctgttgaagaagccacgctgcacagcaccgctacacgccatctcgccaattttcttgaaagcattttttttactattaatgttaaaggcaatctcgagcgcatatataaacatgcggacacccatcataaaaataggcatacgcacacctacactgagagaaaaaatatttgtcaaaaaaagaggaaaaaaatatgtacttaatatttgccaggaaaaacatagatatatagcatcgaaaatgtcgcatgtaaccacattatatctttttaattatatcattcccatctatataatgatatgctaattattaacattatagattattccatcgtatattacccatgaacatgcataggtgaaaaaacaaaacaaaaaatatattaactcatatgttagcgaatgatggtgatagacgagtttagatataaccggaacaattcgcatccgcactttcattatagtttaagggtgtaattcagactattaccttttaaaatagtcacttccacataataaggattcataatacaaatttaaccaatactaatttagtaaagtgcccgcgcatgtgcgcgggccaccttcctagtttatgaattaaataaacataaaaaaattctaattataaatttaaggtcctgaagatttgcatgctctgaaaccttttcaaattataccatcatataattttgaggaacttttaagccatgcacctaaatatctcttttgtagatcaggcttacaatgaatcctaatccttcgtattagtacatatatttacattgtttctcatccagatgcatacttcttaatagtaaagtttgcgttagtaaatttgatgggaataatcaacaaatccagaaatttatagctggtgagtaagtcattgaatcaagtccttttttttttttggtttactgattgaaggctagcataactgaaacgcacacaaaacatcgatgtttgacggaaatatcaatctttgtggaactccgcttcagaagaattgatcaggcaataaaaacaatattgagcatacagtgaacagagaattggaaactattcatagacttaattatcctctacttcggacttttgtaagagtttgtggttggcctctgagtggtgtcctgcactctgccgttaaatcaaaagaatcctagagagtttttgtagtgtttattgttcatacctagggcaggttagctaatgggtaacttccatttggttctgcaaaccaactaatgccgttgctgcagccaaaatacaactgtctgttacataatgacagcaaagaagtaacgttgtatatatatacagtagtttatttttcatattccagtttagcatctttttcttgacaaccgaaactttattatattgccattggcagggaatgagcaatacagtttgactcggtacagtctagcccagtagacacattgctacacaagagagacagaaggagtatgttgtcaatatagtaaactggaggtgcagtagaaaaaaaacatatgaaatgagaagctccaatgtgttcttaatttttgtaggtnttcaattcgttaagntntnntggttnttaggtttcccccggttatcccggggggaaaaaaggggccccttaaattnttgaaaanantattnttcttaaaaatgggggggtttttttccccccccctttaggccaagagcttatcaaatggatctatcgacgtttgatgtcgcgattccggtatttgcatggtatggggatcgttggtactagggtatacgcgagactgaggtaaaagagacagagacaaggatttttatacaggttcgggcccctgaattgtcagataataaccctacatcctattggccgaagccggtattgctcttattcaccataatcacaccagtataatacttggggtagcctatctaactgttgtcgtcatggcggtctgaaggtctgactcgtagtcgacgacagggtagtcttcctccttgaatccatgcccggcgagatcagagataacgctttcgtctctcctgacagtatccggagacaccgtaggggactagccgtgcttatccctgaagtcgatatccggcgtcttgtcttggcgtatgttggcttgtattggctttgtggcgtctatgttgattgtggtgggtgtcgattgtccgtatcccctctcctcctagggggccttgtatttatacccataggtgtccccttgtccaagtagaactagggaaaccaatatggatacaatccgagtagtccttgtcgtttccatgtagaactctggttatccttccttatgcggaacttctcctatatccgtaggttgtttccgtataggacatggtatgtggtgggtcctgccgagatttaatcaactactattaggtatgtggtatccataaccctgacaggatccttgagctagctacaggcattgtcaattgagaaattgttacaaacaagagaagattgtctgttagtagtcccatcatgtttatactcataacagattgttttagccttccaaccagttttgcatatatcatattgttaaagtagatttaaagtttattactatttttttataatcctccaaactttgcaaattgaaacaatttatatcacgagaaaaaaaatatcagtcatacaagagcctcagtagcacctgaggtcctaggttcgactccccatgggagcgaattttccaggatttttcggcgttgtgctttcagtggtaggcgacgtatccgtcgacagcgaggcgcctatggtgacttcgtcaatctctccaggatttgctggctcagtcttcgaagatgtttataggggtagggtttgcgtgcgtgtgttcataggggtgagtgcgcgtgcgttctgagtgtatgtgttgtacagtgtaatttaaaaaagaaaaaagtgtcagtcatacggatagctactggtcgcgcgaatgcggaattttttttatttttaattttttttattaaaagttttacaaaagtaatttttcattttaaattgacagaagtggtcgcctaccgccctctgggagggctatttttaaaaatcgccatcccagagggcggcgaaagtcacgtggcagaggcccgttcgctctcgggcgacgcccgtcaacgaaatttgcaggcggcccccttgccgccttccgctagggcgattttgtagtgtgggggggccgcctgcaaatgggcggcggggggcctggaattttgcaggcggcccccttgccgccctgggggagggcgatttttgcctcccccctataaagcccagccctctctctctgaaatttcattatattcagtaaaaatccaaaaaaaacgaaagagagag

SEQ ID NO: 42125 - DNA, 21556 bp, Oryza sativa
tgttttcatcaggcacaatgtcaaataaggtcacattttagatagttcacggtgaaggaaatattagatttggtccagatggtgttgatctgtcagattttgtaatgacatctaagggcatcgataggcctgcggagagaacatttcagtcaatttatagttggttgttgagaggatttagaatagaccaagaagtctacacaatgtcagtatcagttgtagtgagtcgtgcaacagaaggttatttttgggaactaatgcgatggacagcactgctgcttggagacggtatgtggaaatggcttttgaacggtcatggcccctcgttatatttgtgtcggtacaagagaaagatataaatgtttcaatgcaaaccgaagatgtagagggtcctatcaatgcaggggatgttgttggaccatcgatgcaaaatgaggaaaatcaaccaagggaggagcaggccatgggcatggcggatgagggggagagagtcggtataattgttgatgaaatggagagggaagattcgataatgaggaagcggacgacgacgcatcatccgatgaggaaggtgatgtaatggccactgattgggcaaatgaggacttctctggacttgttatattagagggtgatcatgtaccctgggagtataaggagaacgaggtaattgagggtgcaaggtatgctcataaggatgagatgaaggaggcggtgaagcattgggcagtttccttgcagagagagtttagggtggtcaagtcaacaaattatgtgtatgaagtgaggtgcatgaaggaagattgtccgtggcgtgtccatgcatataagggtaaatggaatgattattggaaagttagcattgtgaccgagcacaagtgctacttacaaggggtggagaagtatcaccgaaacatcacttcagcttttgtggcaagtgagatgtacagcagtgttgttggtaacattggctttgaaccaaaatcaattattaggcacatcgagagcaaattcaagtacaccataagctatgcaaaggcctggagagccaaacaaaagattattgagatgaggtatggcacatttgaagcttcttatgataatttgcctcgtttgttagccaccattgcccagaggaataataatacttactatgacctacatacatttacatcggttgatgatcgaacaaagagtgtgctgcaaagagcctttttctcattgggtgcttgcatcaatgcttttgtgcattgtcgacctgttctatgcatagatggaacttttatgacaggtaaataccgaggtcagatattgacagcaattgggtgtgatgggaacaaccaggttctacctatggcttttgcatttgtagagagtgagaacactgaaagctggtactggttcctagagagagtgcacattacagtggtgcgtatgaggcccaacgtttgccttatacatgatcgtcatgcgggtatgttgcgggctattgactacttgcagaacggttgggatgagaagggacttccagctaagtggcctgatgttcggagtcggtggtgcatgcgtcacatgggtgcaaatttctacaagcaattcaagaacaagcatcttatggagctctttaagaggctctgtgcacagaaccaagagaagaaatttaatgagttgtgggacaagttggatgagttgacaacgaagcaaacagatgagcaatctcgcagaccacaagttgaaggtgacgagcctcccatacctcttggtgcattacatgatgacccaccaacaatgagaaggaggtcagggtcgtccatcagaaatttcactcagtggattgagaatgagcctaaggagaagtggtctctattgttcgataccgatggatctcggtatggcataatgacaaccaatttggcagaggtgtacaactgggtaatgcgaggagttcgggtacttccattggttgctattgttgaattcatcattcacggcacgcaagcctactttagggatcgatacaagaaaattggtccgtccatggccgataacaacatagtgtttggcaacgtagtgacaaagtacatgaagataaaatcaaaaaggcacggagacatagagttgttgctcaaggcacacaagtgcatcggtatgaaataatgtgtgttgataggagcaggcgtggtatctatcacaagcaagtcgtgcaggaatgtgtcttgaaggcggatggtggatgtacctgcagttgtatgaagccgaagcttcatcaccttccttgctcacacgttcttgctgctgccggtgattgtggcatatctcccaatgtgtacgtctcaaattatttcaggaaagaagcaatctttcatacatggagtgaggagatatatgggttcgggatctcaggatcttacacaacgctgagtgcccaagttttttatattccagatccatctaagttaagggtgaaaaagggtcgacgccaaactagacgcatcagaaatgatatggatgagtcagaagcaggtgggaggactttacgctgcagcaagtgtggtctgcgcggccatacttacaagaaatgcccgaagaatgcagaagttccaagcggcgcagatgctagtccatctggacaggcaagtgatggtaggcgaccacctggtgaaggaacaacaagcaggcgcgcaaggccaaggcgttgtcgcgcagcaggcgattccatggtgtaacaatgctatcgatttaggaaataaaatgctgttgtgatgtgatgagtgttcggactaaatacttctatcgtgtaatttcaattgaatgttgttgtaatgagtacctccgactattgttgtactagtagtattgcgaactattcggtgttgtatcataatgtatcgtgatgagtgttcggactaagtactcatatcgtgtaactgcagttattgttgtaatcagaaatattccgtatggtgacacttttgtttgtttgtactcttgtttaatatgtgttaataattcgcttatgaacatttattacttatgttgaactaattatttatatgtttctgatcaatctatttgatgcaggtatggcgtacgacacaccggcgctgttcaaccgtgggattgacaggaaccaccgctcgttcctgtcagcagtcgagggtgcacagctcggcaccttccgtccacgcacgtcgcgcgagtggttgcgtgtcgacccccgtcacgttccttggtacgcgtatgttcacatttcaactcaactttgctttgtgttgtacttatgtttgaagtttgctctatacaggttacgtgcggcaggccttctaccactttgtaggcttgttgaggcggcggcggacgaccgtgacccagcgaagtggtggaatgcagaccggtcactccttgccgctctggtagaccgctggagacctgagacgcacacgttccaccttccctgtggggagatggctccgacactacaggacgtgtcgtacctgctcgggctaccgctggcgggagcaccagttggtcccgtggacggtgtttttgggtggaaggtggatatcactgcgcgcttcgagcaggtgatgcgccttccacacctaggaccggccaacacccttcctccgtactctacagtcgggcctagcaaggcttggttgctccagttcactgtaagtaaataagttgttattatcatacatgcttatttgcgatcaacagagtgttttgtactaacatttcattcttaattgtaggcggaccttctgcaccctgacgctgatgattactcggtccgacgctcccttgaggcgtacctgttgtggttgttcgggtgggtgatgttcactagcacccacgggcacgctgtggacttcgggctggtccactacgcacggtccatcgcggatgctcagccacaggacgtgccgcagtggagctggggttctgccgtgctagcagccacgtaccgtgccctctgtgaggcgtgcacgaagactgacgcgggagcgatcatcgctggctgccctatgttgcttcagctttgggcagccgagaggtttgccataggtcgaccagtggtggacagcgcaccctacggggttggtcgcagcgcgcagtggccagaggacggtcccacgatggggacttactggtgtcgacgtggggttagtgcaacttcgctgcgttacaagtttatcagtcgtcttctttttttcttcacataacatgtctaattccgatcatgtttattgcagcgtcgttacgctcacgtccaggtgagacgaggttacccggacttcgtgttcgagtttgaccgtctccagccgagcgacgtcatctgggagccgtacacagaagaggccgtcgctgcgagagcaccgctaggactttcgtccttgtgcacacgcgaccaggcttactggctcaccatcctgccgatggtgttcgacattttcgttgagcctcactgcccgcagcgtgtgatgagacagttcggacttaggcaggtgtttccgggcaacgtgcagccgaccgtcctccctgccgaccactcgtgagttcggattgttcatttctaaatttttatgataattacttcatcgagccatataatttacctctcttcacaggttgactcgacggggacagctagcaggcgcactttgggctccacgtgtacagcagtacgttgacgactgggtgttagctacagaggaggtgatcaacgagctcttcccacacacggaggagaactaccgtgactaccttcgctggtaccttcctcgcactcgtgcgcgtgtgaccttcactccagacgccccagagccgcacgttgccgctgtcacggacgcgtatcccacgcaccgtgaccgagactacttcgtgggggtacgtcgaatttgtatagttcttacaattatttcatttatcttgcataatataggacaattactgaattttttatttccatcttgcataggctgatgccgcacgggatatcagtgccgatatcaccgcagtccaagtgaggttgaacagaggtttgcacttgactgacgttgagcagagggtgaccttcgaccggatgcaggagaagatgcatgcggtcatgcgcgtcttctcctgtcacagcgccgtggacgtcgtacctccagctggtccggtacaaccacggcctcgcgcgcctaccgtcggagcaggacctcgacctacggcacctgttttgcacggtactgctcagcccaaaggtttcttaagttttgtttctgtttttgtacgaaaacatcaccccgtcgtaacttgatgttccatcctcgcaggacctcgtttgccttcgagcgcccctagcttcggagcagtgcgacctacagcaccggtttcgcacggtacagttcagcccagagattagttcatttttgtttcagcttttgcacgaatatgtcaccatgttttaactgcacgtttcctcatcgcaggacctcgtctgccttcgagcgcgttcgcaggcacgaccggcgcttccgcgagctccgcagtggcgttcgccacctcttcgggcgcgttcgccagctcttcctctcacggagcgtcgatccctcgcccacacggtactttactttttattaatactattaaatacctgtatgaaactgatggtccttgtccagcaggatttgcagccgggatcttcggtactggggcctcttcgtctcacgccggtaggactggtcctactagccagttctacgacgacgacttgcacggtgcacaccaccacgacgtactaggctcctctcagcttggaggagctccagaggcgcacactcaggagcagccagaggtcacacctgtacaggcaggacgggttggccgtgccgtacccccggaccgactcacgtactcccaggggcacattagggcgcagggtaggagggacaggggtaagaggcctcgtcagtagtgttctacctctcagtccttatgtgaccgtttcttttggcttacaaacttgtaaagcagtactacttttgctattactactgcagtactacttgtgtttgtctcgtctacatagttcttttcattcatatggtgctagaacaacttatgctcacgacaacacactttcggcgcttcacggtagtgtcagatccagtagcgcgcacagtccacaacagcacacatgaaaagcggcagctcgagttgtcactatcaactttcggcgctgcctgttgacataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactagcacacaacacacgaaaatggaagcgccattccttgagcgtctcaactggcgaagcgatccttttgctggttggtttccaccatggtgtgaccgtcctttgtgcgattgtggggatggatgcatactcaagtcttccctcatgatacaaactcggggaaggagattcttccaatgcgcgaactttgatcaggtatgcttcatctattcgaagttcaaatggataaaaaaactaacttcttcgtacacaattgtaacatcttacgcagacatatcgtccaatgtgcaacttcatcgagtgggtagacatggagaacccacaaaacgacggaacacgtgcttacccacgtagtgaaacaagatcggactaactaaggcggaaggatgagcatgaacgtcgaattgctgctgaggctttagaatggcacgtaaatcccctaggactccccacgtggcgtgagcgtccggagtgtcgttgtggtgaccgttgtcaggtcataaggtccgtaaggcaccgaactcgaggacaaaggtgtttcgtgtgtccaaacattgtcgacgatgatttcgtggtaattacaactattcttttcatcactccttagtactatcattaacttaactatcccaaaatggatgtacataggaggatgtaaggaaatgtcaattcgtacaatggattgacacagtcagagttacttcaagtggcgggccgataacgcaacctgaaccgaccatacagttcattcatgcttggatggagtacgaacgtcgggtggaaattgcaagcttagactggaggaacaatccattagggttacctaaatggtccgagcgtccaaagtgtgggtgcagagatcgctggcaggtggctacatcctttgctgaacaaacatttggaaggagatattttgtctgccccaatgtagacaacgatttcgttgtatgtctaaccatttacaaaatccgctatgatttgcacaaaattactacccaaacttaataacattactatttttacagggcaatccaaggatgtgtggatttactcgatggatcgacaatgtcactccatcatatcatggacagaagataacagagtcagaaacacaagtagagtatcaacgattgaaggaccacgagaatgcaatgcattctgaccgacctagaaggggccgataggttaccgcatgcttgattcgtcgggatcgacaaatttgtaccgtgtatcgatggcacttcttatctatcttatcattacaatgtttaattatggtggtgattttttgtatgcgtaagactaagggcctatttggattgctaccaaaaacatgccctaccaatattttggtaatttgaatagtacttgtgtttgatttcgattgaagcctattcattggtaatacgtaatctagatttgagattatgtagaacattcttcactacaattttacattttggcagcaaaccaaatatgatcaaatgcaattttaccttaccaaatatttggtagtgccaaaacttgcttatattttggcactaacaaaaatttgtacggtaacattccaaataggccctaaaaaataataaaattatattttaccagtcttggagattttaatcttgtatagttttcaatataaaaagatttgataactattgatatttataaaaaaatataaagcacagtataaaatcgccctcccccagggcggcaagggggccgcctgcaaaattccaggccccccgccgcccatttgcaggcggccccccgcacagtacaaaatcgccctagcggagggcggcaagggggtcgcctgcaaatttcgttgacggccgtcgcctgagagcgaacggccatctgccacgtcactttcgccgccctctgggatggcgatttttaaaaatcaccctcccagagggcggtaggcgaccacttctgtcaattttcaaaaatgaaaaattatttttgtaaaacttttaataaaaaaaattaaaaataaaaaaaattccgcgaatgcgcgacttccgtggctggttctaattggtggagatccagattctggtaggccatactaatgggccgcacgatccaggcagtgacgttctgccctcactacaatgggccaacggaagctgtccctgtacggcccgtcgctactgttgtttgcagcgtatacatggccacgcccacgcgcgtcccggcggccacggcacggcacggcacacacgcacccgtcgactacagtaaaaacaacaacgatacgtatacgatacactcgcacactcagatacagacccccccggttcttactagtccaccaatccaccatgcgtcccactaccaccgccgctctcctgatcctcagcgtcctcgccgtcgccgccttggccacgaccaaccatgaagtggaggcggcggtggccgcgctgccacgcggcgccacacgccgtccggcgcccgcccacggcaacgtggcgacggcggccggctgctcgccgcgggagcgggacgcgctgctgacgttcaaggcaggcatcaccgaagatataatgggtctcctcgactcatggaagtacgacggcgctgggcctgggcaggcggaggaggaggccgattgctgccggtggcgaggcgtccggtgcggcgccggcggccatgtcgtcgggcttcacctccgcaacgtgtatgccgaccagagcaacgactacgacttcatcacctccgggtacgacctggccggcgagataagtccctctctgctcaacttgacgtatctggagcacatcgatctcagcaagaaccagctccagggacagaccggccgtgttccggagttcttgggctctctgcaaaacttgagatatcttaacctctccggcataccattttccggtgaggtgcctccccagctgggtaacctcacaaatctacactatcttggcctgtcagatacaggcatcaacttcacggatatccaatggttagcgcgcctgcattctctaacgcacctcgacatgagccatacgagcctcagcatggtacatgattgggccgatgtgatgaacaacattccttctctcaaggtccttcatcttgcttactgcaaccttgtttatgcggatcaatctttttcacactttaacctgaccaatcttgaggagcttgatctctctgtcaactatttcaaccatccaattgcatcctgttggttctggaatgcacaaggactcaagtaccttaaccttgggtcgaccaaactctatggccagtttccaaacgttccaggacaatttggatccctacgatttcttgacttgtcatccacatgtaacatagacatcgtgacaacaaacctaacaaatctatgcaacttgagaatcatacatctcgaacggagtcaaattcatggggacattgcaaagttgctacagagattaccgcggtgctcgtacaacagattgaatgaactatatttgtcagacaataatatatcaggaattctaccaaatcgtctggatcacttaactagcttggtcattcttgacatctctcataacaaactctctggacccttgcctcctcagataggcatgttcagtaatttaacttacttggaccttagcagtaacaacctcaacggagtgatcatagatgaacactttactagtatgagaagtttgaagacattggacttatccggtaattccttgaagattttggtggattcagaatggttacctctatttagtcttgaggttgcattgttttcaccttgccatatgggccctcgctttcccggttggctgaaacaacaggttaatattacttatcttaatatgtcatttgcgggtattactgataggcttccaaactggttttctacaacatttttgaatgctcaacttttagatgtttccaacaacgaaatcaatggtagcttgccagcgaacatggaggttatgactacattatctagactatatatgggatcaaacaagcttaccggtcaaatacctttgttgccaaaagcacttgaaataatggacatctcaaggaactctttatcaggacctctgccatcgaactttggagatgaccttgtcttatcttatctgcatctcttctccaatcgtatcactggccatattccaaactctatgtgtgatttgcatcaccttgtttacttagatttagcggacaatcttttggagggggaatttcctcgatgtttccagccagtgtttttgagtaagctatttgtcagcaacaatattttgtccggaaagttcccgccatttttgcgtagtagacataatctagagatgctggatttggcatcaaatgacttctatggaggattgcccatctggattggagagctgtcgaatctagcaatagtacgactaagcaataacaatttctctggaaatattccaacaagcattaccaaccttacaaggcttgttcaactagatctatcaaataattctatttcgggtgttttacctttgcatttgtccaatttaatatgtatgaagaaaagtggtcattgtgatatcgtaatggtcttcgatcgttactcaatttctggtcgttatggtcgcaatgttggcattgcaaatatgtctgtggacaccaagggccaaaaactttactacaaactacccatagtattagatatcgtgaccattgatttgtctttgaactacttaactggtgaaattccggaggagctaactcttctcgatggcattaaaaatttgaatttatcatggaatcagcttagtggaagaattccaggcaacattagtgtcatgcaatcattggaatcactagatctctcaaaaaacaatctttctggagaaatcccatcaaacctatcaaacataacatctctaagcaggctagacttgtcatacaaccatctcacaggaagaataccatcagggggtcaactcgacaccctctatgcggaaaacccgtctatgtacaatggaaacactggtctttgtgggtatcctcttcggagaaattgctcagacaacagcagtgcatcaaagcatggtgttgaacagagaagggaaagagattctgagccaatgttcttgtactctggacttggttcaggatttgtggctggtctttgggtggttttctgtaccatcttgttcaagaaaacatggaggattgcttacttccgcctcttcgacaaggtgtatgacaaagtgtatgtgtttgttgttgttacatgggcaaccttgtctcagaagtcaggcacacgttaggctattgcgtagtagcagcgttcttttggtggaatatattgtaccacgtcgctgctgctactactactagtactactgtcgctttgaataaatcgatacagcttagttcttgataaagatgagcatgcttaatgtatgaaaaaaaaagagagaagttaatgttgttctatttatgtgaaataaattaaagatggctgtttctcaatgttgtgcagagattaatgttgcttaatttatgtaaaacagagatatgtctgacgaatgttattgatcagtttgtagcactgccgcactggtgaatccagagtttttttttttaatgactcgcaccagacagtgcgaagtttttttgattgagcaggaaaaaaaatccaagattataaccctgggaagtcgtaaccaggaaaaaaaatgaaaaataacccccacccacgcaccgatagctccaactcaacatacctaggagaaagctagcaccgaaccgaccgccgctatgcgtgaccggtcaccgctaagccaacaaagaaactacatccgagaacgttcaaaacttaaccctaataaccgacaccaggccccactctagccacctctttgggattatgagagagaaggatggaaccgttctcccccctaggccctccgacgtggctaccttgcataagctagagcgccgacgaaggggacatgcatctagagcaagcttgcaccagttgtctggaaggattcggcaaggggctacctagacggtgtctccaaggagaggagcgacggatacacagccaccgtcgtccgtcaaggtctcaaataaagtcgaggctgagttttcacccggcagccccactggaggtgaaggggtggcacgacattgccctcaagaggggtagagacattcgaaaacaccgtcgttgccggcacggccaaggccgggctaggttttcgcccgctgcctacgagtctatagatgacaccccgatgctccaccaccatcaagcctccgccgacgcatgggcactgctgcatcagcgccccctgttggtcagcctccgcatgccacactagcctccgccgccctccgaccgcgcctcatcgcgccgcgccggcctccgttcctattggtcgtgcctcaacgagctgtgccggcctctgaccacgctccgtcgccgccacccacacctcataccgaccggctagccacgtctccaaccgcagtccaacaacgactgctcacgccgtcgttgttgcccacaacccaccaccaccgatgccacgcccgcacgcggccgccgctatcctccttccccgttgccagtctcgttccccgcctcctctctagttgtcaccatcgtcgacgcgccggtccaccgcgtcccatctcctcccgtgcaccggccacatcccatctcctcccgtacgtcggtgcagctccagccgacctcgctcccaccgctgccagcagccgctgtcgccatcaccacccactcaaaccccatcgccatcgccagccgccaaccccgctagatccagccaaagcggcagcccgatctgggtgtgtgctccgccgccaccaacgggcgccgtcgccaccgcaaccgaccgccagttgccacctccatcactcagccccgccgccagccgccaccccgtcagatccggccggaacgacgcagatctagatggttgccaccgccgctgcccaggcagctcccccggccgtccgggtgcatgctgggcaaagccccgccaccgccgtccttgcggccgcgcggctttgccggcgcctgctcaggcggcggcgagccagggaaaggagggggaggagggagtcggcagcggtgttgcctctcgtgttcgtgttgtgaatccagaatattgaatgcttctccaaacatgcatgtttgcgcttgaaatataatgtaaagtgacatagtataagatatgaacaggaccaatccatgacagtttgaatcgaagaaacgtgcagacttttaattttgtccaataacagggcaggctctcgaaaagcttgtaaattctgatattgttgatcaagataattttgttttcgaagaaccttcgcaaaggacatggagttcatgccaatttataagataaacaataataagatgtagtgttaaagtcatattttacaagttactagaaaaaatgccctatgctattttaattttatttatactgtttagctagaaaaaaaatgtttgcgtgttgcaacatgtaaatattttaattttattattgttatacggtttagctaaggtaaaagttactgtgggaattcgcttggatatttttttttagtaaatcatgagcttttcatctcatgttaacatgcgaatttttttcttcaaaagatttcttatacagctccttttatacttttaaaaggaaagaagcttaaaatccaactcaaacacggagctgtatttgcaaaagcgaacgaacttaaaaaccgactcaaatacggatgacgtaccaaaatatcggcaaaaacatctttaatttttataacagtagagataagttgttatacttaggataaaatttaaattttagaagtggaacagaggggtagctccgaattttttttatctgaacacatgcaaaccactaattacaaatctgagcacgcaaaagttagaattctacttctaatcaacctgcccatgtcaccaccgtaaatccggttggcccggtagtctattacacctccctcatttcttattcggttagctttggctcagtgccatgacggtagccttaacacgatgatggtgtgcgtatatataaaccatctaggataacctttggcaataacagtgttagcgtggatatagtgtaactaaaattcatcaattctgagcacatgggattgagcaaactagcatgcagcaaacaattgatcgactaatatgaatcgctagtattgagaatttagtagtacaataccgcattgtttgtattttctttgtgatttgaacaatgaataaaactcgccgtatgcaaccctaaaccctatgattttgatatactaccggatgaatgatttgaacaatggagaaaactccccataatgatgcaactaaccaattttagaggtgggttgttgggctaacgtgatcaattcagcagcccaatacggcccaatagtttgttgggctactcgttcgatggaaacatatcgctgcatatgagcatcttgtctaaataattaaatgtgattattgcgtgctcacatttgtaattggtggtttgcatgtgtttagataaaaaaaattcggggagtagctagtaagtgaaaaactcctaagagggcaccttcagtaaagggcattgctggattcaacacgaagctagtactagcgctgacgatcagtacaactgataaagaggttctaatttccaaactgataaagaggtttcaatttccaaaggtttcactctcagtgtcaccgcaacgcgtggaaatatttgcaagcctgaacgcactgaagataagaataactaatgtgaggttccaatttacaaaggattcactctcagtgtcactgccacctccaatacaaggaaatgatgatctctctcccaagtctcgagagtcttgaagtagatctgaacgcggagctagaggaaagcaggcgtgcataatagagaaaccaactgaagcagctactagtggccatcggtgatcaaccagtagctagcaggagttgccggcgacgtgccgctcggtgcaagtcttcggcatcacattcggcacaactgcccaagagctcgacgttggcaatatcagttcttttctggcagtcgcagcccaccacgaaagtcagcccggtcgtgtacgtactatccgcaatcaaaatcagtatcggcccaaatctacatgggcctcacgtgctcggctatcctgatccggctgaattaaaccgaggagattgttttgtaggaaaaagtatactttgactaactcatgtgattctgttgatgcgaaaaacacgaggcctgggagatctgcttaactttagtgaaggtccaaaaatcttgtctttgaggtttgtgagcgtgccggttgatttgatcctgcaatcaacaagaaacaaatacaggaaaatatcacttaaatccataaacgatagccgatcggtcagtcgccaatgacatatcatttatccttgagccgatgtcatctttgcatcgatcggcagtcatgaataaataagaaagaactaaatctattcaatcggctgtagatattaatggtacataatccctatgttgatatatatttaagtcaagtgattgggatagatcgatcgttatgccgagacagtataaatcacttagatcgaaatatatattaacaatgagattataagcgctcatagcatagccgattagatagatctagcatgtatcggctaatactccgataccactctatgttaagatattaaagcaagcaaaatatatcaaacgagaagcttaatatacctgaaagcaagaagatctcaatataaagggcggatctagcatatcaattaagcacataaaatataaggctaaatcaggtaagatcggttgaaaccccgatactaccctaatcggcaaccaaagacaggctagagattgatattctaatcacgacttatagggtcaaactcaactgatgcagctataagtatgaaaagaaagacaatatttagacaatcaagtcgttggatgtttcatagggtggtggataccctatataatctaagtcaacgttggtatttaacctgatcggctgccttctagtgatagatgttagccaactgaaggttaaataacaatattgtcagagattatataggatatatgataactcgacaacttacatacacaaggttagagtgtcataaagatggaagcactaatcccgagaacgcaagccaccataacaagttttacctctagttgaagatcgaaaccgatgcagctcaaactgaaagcaagaacccgtcgaaataaaacgaaagcaaaaagggtggcgatgtgtcgagattgtattgaacgtgtgttaatttgattacatagggctcggggtctatttatacccgagaattacacaacatgtccatgtcggacacgactcttatctctaacaaactctaagataccataagtctttgcggcagacttttgcccaagcttatctctaaggaaattacatcaaatatcctaattaatagatacaattgtcttctcagaactcaatccgtgcatggcaatccatatgaagtacttcaacccaaccctgatgacgtataccaagtcgtattgtcgaaatcggctcaatcggctaaccttgtccgactcgaactctgtcgattctggtcgcagccgattcgaacttctgccgattcttgctctgtttccggaacgatctatctcttggattctgcttcagttttatcttcatctccgataccgaaattaccaaatttggtcgttaacacatgccccccaagtctggaatatttggtaatgtttcggatttgccatattttcatctccaagaatatcgctcattgctgtttttccgaccgttaccgcagcgctttaaatactaaccgtcacccccgagaaatttcacaccgttacttccgttctcaccgcttaaacaaactccgtcttctctttctccggcgatctccttggcgcaaaaaggcgacctcaaggcgatcccaactccggccaagcttccgcctgcagcaatgtcgacttccgccagcccatccgccgcgccatcggcaaagtatgcagaggtgagcacccatcggctagatctctattttgtgcagtagatcggttttcctctatctcatcttattttcttcttctttattctcttttgcatctgtagcatctctctaatctgattgcaattcccagtttgtctcacgagcatcagtactttcttggcccaatcggcaattctaaccccactgagttcattagcgccgaaactaataggataccctttagattggccagcccaaatctaggtcattggaagaatactttcaagtcttggccttcccttgagaaaagttctcctgagagaagttggctcgtatggtgcaagcgtgtatcggctagcaagcaggttcactgggatgaactaggaatcggccaagcccttgctcttactttagcaaattcggctaaggacgaacccctaatggcttctgcaacgtatttctggtccaacaccctcaatgccttcctgttcaatcaagggccgatgactcctaccctgctagacatcaccatgatcactggcctagatatcaccgcatcggccaaccccatgaatttgaattccaagaaccagtttgagttcaaaactaaaaccataggtggctggtctggctacattgctgcatatatgggcaaaggatctgtcacccctcgagaacatactgcctttctgctcatgtggcttgagaaattcctcttctgcggatcaagttgtggccctactatcaattggcagttcctagccgaagcccttgaaaccaaaaagcaaatcgctttgggcaaaatccttctcgactacctatatcagacgttgatcaatgcatcggccaggatagccacaggctcaacagtagctgcaggtggaccctggtggttcctacaaacatggctcaacttagtcgccatgaaagctgtgaatcggccggctctatcagaatctcagtttccaagactagagccgattacagatgaagatggggaagaaaagacccatcggagatgcatgtcgtatggagaagctgcttcaacaccagccgattctggagctaagttataggctgagctactgaaggactggttcttcagtttttatgatggcttccggaaagatgctcgagtctggtttgtatacggagattcaatggactttgagctaccatcggactttagatttgaagagatcaactctgaaaaatatgacaagtctagagaggtcttctcggctgctatcagtccatgcattcttcctgttggcatccatcaaggaagaaacatacaagtgtcttacgagttctatcacccaatgagctcggccaggcaatttgggatgggacagctgccaatcggcttgtattttgccgataaaattcagtgtagaggagagatctcatcgaccttgatgatggatcggctgctcaacatcccaagacctcccttgggcagtattgagaacatagagctggcaaggttcaggagcagggcctttgataggtggtggggtgaatggaagctacacttgttccatcgatcggcttccatgtatatgacagatctattcctggatgtcatccctcaggtaaattttactttgtcaattctgctaaaacaactgttagctgacttgtatcttgactaatctcttcttctattttgcagacaacagaatcctctcctcctcgcaaagacataaaatatgctccaggccttttaccaaacggaggtggtctagctcccccagtcatcggctatcatgcccccaggacctcaagtctgctccaagggcaaataggagaactagccgatgctggcaggaagaggaagactaaggcatcggctgttgatccatcggttctggctctgaagaagaaggccgaaaagaagaaatccaagccaaccgacgacttgcctgccttagatccatccatcgaacaagccttcgatgaagaggaaattgaggaagatgacgaccaagcggcagccgaacttagtgacttaggagaaaaaacaccatcggcttcgcccaaacagactcctccaactcctgctgccccagctcatttttcaagggtaaacaactcatcttgatcatttctcgaaacaacttgcatagccgattacttattagccttgtatttgcagaaaaagaaaactatcgtgaagaagaaatcggcaccgacaccatctaagccagctccaccggtaaagttccctctgcaaaatcctttaaatctgatcgtaaccggtgttaattaacacttatcttttttagcctcctcctcatccttcacctcctgtgcagccgacaccaagtgattgtactccatcggccgcaggcagccataacatcgaagaagaagaacaaccagcagctcctgtcattccagtaagcatttcattgtcataaatcttagattggctatataatttgtttcgatatttaactgtcttcaattttctctcttgcaagtcttagccgatctgttctctttcgatataaaggattactttgacgaagaggcagaagaagaaacaaccaataaagctttagcccctctgaccgatgatgtgaaaagaactcttgaagacatttctcatcggctagagacatcattagacaacttggtggttgactgcggttcaatccggacaagatttgcagagattcaagccctaatcccggatgatctagcgaaaaccatttctccagctgtataccttgagcaacatcaattcaagctggaaaaggccaagcaaaggatagccgatcggcgagagcgaagagatattgaagccactattaaaaccaaccggcaaaccgttcatgaagagaaggctaagttagatcaactctcgattgggccgattcagtccaacatagatcggcttgaagctcggaagattgatctcatagctcaattggaggaatgcaacgccgaattggctcttgagcagaaaaagttagccgatctcccaaaggctgtcgaagaacagaagtccagactgagatcggccatcaggaatgtggctgatatgaccaagtctctcaaggtcatctctggaatcgacgcccaagatatccaagctatcgaagaagtagaccaaatcagacaatgggctgtatcggctatccagcgttacttgtctggatgattatctttgtaataggacttagaaaaaaaacatttttttgtaatcggctaagaaacctttgtacttcttctgattggctaatccttcgtgccgattaatataacatctcaatttgcttgaaacttctcaattttcgtatatatgtatgtgcctccctaattttacaacgatgaaggcattgataaaattataatttggactaacggcgatatattaaatatcggccatcatacatcggcagaacaaaaccgattatgagaaaacaacaaaaaccactaagggcaatataaccatatcggccgtcatacatcggcaaaacacaaccgattatgataataaaactgctaagggcgatataactatatcggccatctaaaggcgatgtaaatacatcggcttaacatgtatcggcaaactcagctgatcatgaattgacccaaacacttggataatatttcttcaagtattttccattaagtgctcgtctataaacttctccatcaagtccttgcaacatataagctcctttggacacaaccttatagatttgaaacggtccttcccaattcggctaccacttgccgaatttgttatctcgagttcctatcggcaagattaacttccaaacaagctctccctcagaaaaagacatagacaccaccttcttgttataatgccatgcaaccctttccttatctttgaaaactttagcaagagctcgcaatcttgattgaaccaaatcttccttttcgtcggccatgagattataatattcatcggctgtcaattcattatgtaaatttgtcctcctggagccgattctaacttcccatggtaaaactacttcctgcccataaacaagcttataaggaggaacttgaatcgatccatgacaagccatccgataagaccacaatg

SEQ ID NO: 42126 - DNA, 3199 bp, Oryza sativa
atattgatacacatcatacctccaatcatcggctgatattgtagcaacttctatcttgatatctctcatcatcggcttgtaccctgatgccccctgagccaaatcattagcttcgacattttgctcccgagatacatgcttcaaagttaccagccaaaatccatccatcaactctctgcacttctcattgtaaaccatcaatgtatcattcttacattcatattctcttgccaattgactgatcaccaacaaggagtcacccataatttcaatagcatcggcttcaacttccttaagcaattgcaatcccttgagaaccgcttgatattcagcctgattgttagttgcatagggcttaatagtataggcaaactcgaaacttgccccccgaggagaaattataaccaagccgatactacaaccatgagtgcacattgatccatcaaaaaataaagtccaaggcacaatgtcaactgagccgattgaatcatcacgatgatccacaataaaatcggctatagcttaccccttaattgccttcggtgactcataccgaagatcaaactccgttaaagcaaatatccacttcctgactcttcctttcaaaattggagccgacagcatgtacttaaccacatcggctttacatatcacagtgcattcattggacaatagataatgccttaacttcgtgcaagagaaatataaacacaaacacaacttctccacaggagaataccttgtttctgcatccaagagcctgcgacttaaatagaatacagccctctctttcccttcaagctcctgaatcaaaaccgagccgattgacttctcaccagccgatagatataatctgaacggtatccccttctgtggaggaatcaaaactggtggggaactaagatattctttgatattatccaaagccctctgttgctctgccccccaggtgaattcttgatcggctttcaatctcaacaaaggtgtaaaaggttctaatcttccagataaattagagataaacctcctaacaaaatttatcttgccgatcaactcctcaacttcttcttgtcctctggaggatggatcttcttaattgcattaatactcctttgagtcacctcaatccccctctcatgaacaagaaatcccaaaaactggccaaccgatacgccaaaagcacattttgttgggttcatcttcaaaccatatttcctagttctctcaaaaaccttcctgagatcgactatgtggttttctacttcctttgacttaacaaccacatcatcaatataaacttcaaccaaccagccgatcagatcgtggaatatgtaattcatggccctttgatatgtagctccagtgctcttcaagccgaaagtcatcacaacccattcaaacaaaccgattgcaccaggacatctgaaagctgtcttatgaatatcctcttctgccataaagatttgattgtaacccgcattgccattcataaaacttaatatcttataccctgaagcagcatcaaccaactgatcggccaccggcattgggtactcatccttcggagtagccttgttcagatcttgaaaatcaatgcacaccctgactttgccatttttcttgataactggaactatattagaaacccactcagcatatcggtatggacgaatgaaaccagcatcatataaacatgcaacctcagccttgacaacattaagcatatcggctttacatctccttggtggctgctagtatggcctaacccctagtttaataggaagccgatgttcaacaatcgatcggctgagtcctagcatctcataatactcctaagcaaagcaatctctgtattcttttagaagctctatcaacttggttctgaattctggggataagttcttactgatgaatgttggccttggtctatctcctagacctatgtcaatttcctccaaatcatcagccgacatgaaaccctttccttgcttgtcatcgagatcatctactgtatccttggtgtagacgtttgaaccctccacgacgccctcaaaataataatttggactctccatcttcaattggctgtatatcacaattggacacttttagaaaatctccatcccaaacttttccaataggcaatcaataccatccatctcccaaagagctaaatcggcactagcaacattaactgacctatcggctagcacaatctcaatcttgtcaccttgccatttaatcaagcattgatgcatggttgaaggaatacaacaattggcatgaatccaatctcttccgagcacacggtatcgaccctttccatccattaccaaaaatggtgggggcacaatttttttggccaatgtcaaatccacgtgaaaaactcccttaatctcccatgggttggcacccaaatccctgagaaccattttccttttgagcaatcattttcccttctgtccagctttatgaaagtagcgtttgggatgcaattcacagcagctcctccatcaaccatcatcttggacatcggcttcccattaacaaatctattgatatacaacggcttgagatgccgattttttgtcccctctggcttctcaaaaatcgctgctccggtgacaaaaccaatcaagcagaggcttcatcaacatcatcaacatcggctagcctagcttcaaactctgctgctagcataaaaaccatattcaccgatgcagacgcagtagccttgcccttgagcaacccttttggctttatcagcttcaacttcatcggctgttgtgaccgagctcttaacacgccacacctgcttggtctttgttttcctcagccgatgattgatttcttgttctacttcttgaaagcgctccatgttccttattctttgaaccattctcttttgattcttggtgaaaatgcctgtaggacaccattgtgttttcctatcttcatcttcatcatggtgataatcttgatttacatgtcccaatctctgatgaacaggtatcctcttttgaatcagccgattacctctattacaggatcggcttgaactccctgcagtgtcactgcatccaggacaattctcgatcgatggcagcctcataccttcattccagcagaatctgaaaaactcacagtcccaatgaggatcaaaaccaccatcatcttcttcataatacctttcctgcta

SEQ ID NO: 42127 - DNA, 20892 bp, Oryza sativa
ctccctgaacctctgaatgtaatgctgcacagactcatcatgcctttgcctaattgccgtcaagtccgatagcttcatttcatgaatttcactgtaaaaatagctgtgaaactgtttctccaaatcggcccaactattgacagagttatatggtagagaagaaaaccatgtaaacgccgatccggacaaagataaaggaaacaacctaactctcaaggcgtcaatagccgatgcctcgccacattgaaccaagaatcggctgacatgttcataagttgaaacattgttttgccctgaaaattttgagaagtctggtaccttgtatcagccaggcaatggaaccctttcaaaccactcagggtatggatgctgatacaggtttccatagtcctttggcttgagcccaaactgcttcctcatcacatctgcaatcatgtcggcccaaggtctctgctggggtactccttgcatctgctgtggaatcggctcgaactgattaaattgaggagcaaattggggctgaggtgatcctctttgctgatactgaacatgaggcaatggaggctggtactgatagctcaaattacctccataataattctggaaattcggctgaatattatgcactaaatgctcaggaataacttggggcaacaccgattgatcctgttgaacattatggaccaagtgttcagggataacttgattcacaacatgttgcctctaccgattgtcaggtgttcctagcccagccgatgtatgctgcaaattctgctgttgaatcggcagaaccgtctgctgtcttggtggtgtttgctgaatcggcattgactgtgctgggttggccaccagtgggtttggtagaaacatcgcagcaacctgctcctgggtcaaccgattgatattttgtccaacatgctgtggctgttctctggtcaacaatcgaggattggttgtttgccttggtgctgacgacggtgcggctggtgcaggagccgaaactggtgccgtcggttgaactggtgttatgttggtagcaggctgttggttaccagttatcaaatatctgtaatttgggaagacacctcctggaagataaactggtcctgtagcttgatgcttagctattgttccatcgaccaaaaacttcaccatgtttgttaaggtattaaccagcactcccgattggttgatcaaagcatgttgcacggtgtagtctatccaatcttggaagttgttgaactgcaattgttctctgttgctatcttcaccaagatcctcaaccaagccatcctggagcccatcacctttgtcgcccaatccatctgtagtacctttgctgcctgaatcatctgtgctgacttgagttttttgcacctcaccatctttagaaggacctgttccagggacatcagcaactagcttcaacttgtatttttgaacaactctcccttgccgagtctctgtgaatgaattcatgaattgttgttgtgcgttctgcatcattagttcaaattccttttttgctctggtgatagcttgccaacagtgactggaataatattcccagtattaacctcagcctcattggttcccgtaggctttggaatcttggtctgaggagggaccacagtctttgttgctgatgatggtgactgtggtggtttttcagccatgagagaaaattgtcgtaacttggtcccactgggcttgccaaaagcgtgttgatgcgaaaaacatgaggcctgggagatctgcttaactccagtgcaggtccaaaaatcttgcctttgaggttcatgagcgtgccaattgatttgatcctgcaatcaacaataaacaaagacaggaaaatagcagttaaattcataaacgatagccgatcggccagtcgccgatgacatatcatttatccttgagccgatgtcatctttgcatcgattggcagtcatgaataaacaagaaagaactaaatctattcaatcggctgtagatattaacggtacataatccctaagtcgatatatatttaagtcaagtgattgggatagattgatcgccatgtcgagacagtataaatcacttagatcgaaatatatattaacaatgaaattataagcgctcatagcatagccgattagatagatttagcatgtatcggctaatactccgataccactctatgtaaagatattaaagcaagtaatatatatcaaacgagaagcttaatatacctgaaagcaagaagatctcaatataaaaggcggatctagcatatcaattaagcacataaaatataaggctaaatcaggtaagatcggctgaaatcttgatactaccctatgaaaaatacacgttcgttgtaatgggtgaatattattttattattattattattattattattattattattattattattattattaattatacaatttagctaaagtgaaaatcattgtgagaatttgtttggatactatttttagaaaatcatgagttgtaattaggagtccgactcttatctcatattagcatgcgagttttttaaaatgatttcttatacgataactgttgtgtttctaaaagcgccccaagttagaatgtgagttcctttaaaataatttcttatacgactccttttatattttaaagagcgaacgagcttaaaaacggactcaaacacatatatgtattttgataagcaaaacgaaattttttagcgtgtcacgttagatatacggacacacgagtattaaacatagactaataataaaacaaattacagattcagcttggaaactgcgagacgaatttattaagcctaattaattcgtcattggtaaatgtttactgtaacaccacattatcaaatcatggagcaatcagatttaaaagattcatatcgtaatttacaagtaattagtttttttctatatttaatactgtatatatctgtctaaatattcgataagactgggtggaaattttttgtttgggaactaatccgggcctgacgcaatgctggtgctcgcagaagagctcggtgcgacgtggcaacgattaggtggagacccgaccagagcgcatgcattgagtagaggaacagatgtggatgtgtgtgttcttgctataaggtagtaaaagtaaatatgtatttaattattagggatgttatcatagaaaaatatggttaaatatatatattttggagatcacgtcgttatcttaaatgttaaggattatataaccagagggagtgtggttgtgtgttgaaactcataaagataaaaataaaattgacgcacataaaaaaatcattagtatatgattaattaaattttaattattataaacttcataaatagatatattttatattttaaaacaatttttttagaaaaaaattttatacaaaatgcaccgtttagtagtttgaaaagtgtgctaacaaaaacaattataaaatcttaatcttaaccttagtcttcctgagccagtactgtacatggttggtactgttcatcgggttactgtgctcgcgcatggaggtctggaacgcagatctggacagtggtttggtggctgtgtttgttaggctgactcaaggtggcatttgcatgtggaaattgagtgggctgcatggaacttgatcaattgggccatgctacatgtcgaaggccaatgcaagtagcaaggcagcagttgtgtatcaatattactttctccgtttcacaacgtaagacgttctagcattgtccatattcatatagatgttaatgaatccaggtatatatatatgtatctagattcattaacttctaaatgaatatgagcaatgttagaaagtcttacaatctaaaacggagggagtactatattaggactcgacggaggcagtgcgcgggttgagaaaaaaatgttatagtggtaaattttttggtttattcaaggtgataataaaattctcaaagtattaaggattcagtctagatacagacagcgtggatgatggattcattagctcgatccataagaaaccaagcaagaaaggattctcttcatgtttgttgagtttgatttgtctatttgatgatgatattagttatctagctatgaattagattaagtcaaatttaaaacgggagatagatgcaaacatggtctttagggagtttgggatataccaactataggaggaatccaattttgcttggcaacacgactgtgacgagagaaaaaaaggtggagcactgttgtaggtggagttcgaaggaagacattacaagatagcggagtctcttgattacggtgagcgtagtgcaggcttgttgggactgctcagcgtgagtagtgaaaggatcaactcaagtccagctacacgaaaatttgtgcaagggacaaattcagattgacgaggcattttcgtcaaagttgagttatgatatgctgtaattatgctggatcagggaagagtgttcgtaatcaatgctctaggaaagtaggcttcggttaaaccttattaataaatatggtgtcttggtgtcattatcgtgtttgtatcttctatagtgtttcttatgtgctcggttaccaatgatgattttggaccggttttataagaaggaaccgcatgagcacgaagctgtgtgacaaaaagcgatggacctggccgtacctcatccatagtatatattttttagtttaccttttcctccctcggtcaaataattatggccaacacgggctctcaaggaagcaatatgtagtacatacttatgatttctgtaaattaattttagatttcacttaatttacttcctaaagaaaagtagtacttttagtactgactcaaaagttacttctattgccctgtacgtttcaaattacttcgtcaggctttgcacattatactttttaaaatcctattagagagctttgtgttttaactccataccataaagctacttcttctaatactagaacaaagagttacttttgttatcgtatttagttacttctacaatttatttgaattacttttagatttcacgctgaacttacttcatgtagcttcatgttttacctctgcactatgtagctaaccacctgtattgtttacataaaaacattataatattatgactcactctaaacatctaaatatgatccgtatatatgaaacataattattttcttcgggtattgatatagggtgcatgcatgtgtaatcacgaacttcaagaaaatgtttatgtaactatcccatctaatctacttttaatccgctagattgttacatttacgttttgaagaactacaatcaaatgaagttgaaaaaaagtactatgaaaaagacaacaattacagaattactactcaaatggaattgacaaaaaaaagggtgatcacagtgtacatgcgacacgcaaggagcggaacaagaggccaattaatggtggaaaatggaaatggcatctactaatctcatggtttttggtgtgatcttcaagctagtgcacactcttctcatatggcaccgatgattggattagctagatgcaattgacaagcatatagactttcgttcaataaaggccatcaacaaacccaacttctaagaaatataatcgtataaactattttatcttggaaatgtctttgccatcacttttattctgttagacgtcgttaattttgtcaaaatgaccaaattaccctcctgaagacctcccatgacaaattctcttcccttccaccgccagccattcctcttcaatttctcccctccacttgaactgccggccactccctcttccacctcttctcgattaatgctaacatctagttgtaacaaaaaaaaaaagtagcccggccgtcatcatcgacaatgcctatatatatcaggccgagctttggtagctgcagagatctcaaagctatagcggctatttcatttcctcttagagtatagttgccgtccatactccaaatacgtactgcctgatgggatcgtcaggggcaccagagttgacacatgaaatgagcagcaatccttgtgccggcgggagagcaacaatcctgggaatcggcacggccgtgccggttcatgtttatgagcagaagtcattccctgattattactttgagattaccgatagcaatcacttggtcgacctaaaagccaagtttgcaaacatctgtaagtgcatgcgaaattactaccattttgtatcttttcccgatcgatgaacttaattaacaaccataaatatataggtagaagctagcagcctcatcttttggcttatacttattcttataagccaaaatttgaatttccaatcttatatttggagttaattttgagatttttcatcataatttattcttcagcctttgccgttagatcgctaagaacatgcatataaaagttttatttacaaattattttccgtttacaaatataccgtttcgcttattccatcaataaacgaaacgatggagacgattttcatggtgcccaagcaattatatagcaatggttattgcattattgcaaatctaggcgagaagacatcgacggagaagcggcacatgtacatctctgatgagtggctgagggccaacccgtcggtgacggcgtacatgtccacctcgctcaacgtacggcagcaggtcgccgaggagggcatccctcggctcggtgcggaggcggcgcgcaaggccattgacgactgggggaagccggcgtcgagcatcacccacatcgtcttcgccaccaccagcaccggctgcctgcccagcgccgacgtcgtgctcatcaagctcctcggcctcccgctgtcgaccaagcgtgtcatgctctaccaggctggctgcttcggaggcaccacggcgctgcgtgtggccaaggacatcgccgagagcaaccacggtgccagggtgctcgtggtgacatccgaggtgatgtcgctggtcatccgtggcccctccgaatcccacatcggcaacctcgtcggccaagccgtgttcggcgacgccgcgggcgccgtcgtggtggggtgctgccccaccgccgacgagcgtcgtcccgtgttcgagttggtccgggcatcgcaggacgtgataccggggacggacgacgccgtggtggtgaaggtgcggcaggaaggggtggtgatcaccatgcaccgcgacgtgccgctccacgtatccaacgccatcggcggcgtggtcaagagcacgttccacgagatagacatgaagatcaccagctacaacgaggcattctggctgctgcacgccggtgggagggggatcgtggatggcgtggaggagaggctgggcctcggcggggagaagctggctgcgacgagggaggtgatgaggcagtatggcaacacgcgtagctccaccatcttcttggcgatggaggagatgaagaggaggtcggaggagcgagggatggcgacggcgggggaaggcctcgagtgggggatgctcatcgcctttggccccggactcaccttggagaccatgctgctccgtgcagtgccacgtaacagctagctatacatacgccaacatgtgatatcgatcgaccggtaacacgaataaattaagcagggcaatctacaagttatattttccagtgcgtacatgttatattttccagtgtgtgacaccagtaaaaataagtctacatgttatatttttccagtataagtgcgaatattatgttaattgcttcttgattgttactccacggttaatttagttggtttcggaaccagctgagtatggaataatgttatacgtgatcaattataagctcttactcgatcatctggtcggacgacaaacatttctagcatgatccatattatgattggttcgtccctagttggaaaatgtggttctgttaataatgttctgaagctttgttttttattatccatattcggtacatcactagaaaaagaataataactgaaaatgaagtaagattactccactggtggagaaaccatctttcgtcggtcggccgatttccacaatagtcccggatgcaataaaaaccggggctaaaaatgatctttagtcccggttcaaaagggtagcgggcatatttgatctttagtcccggtttgtgttaccaaccgggactaaagatcatctttagtcccggttcgaatgctgtcagggcctgtcaggcccccccgggatctttagtcccggtttgtaacaccaaccgggactaaagatcgtaactttagtcccggttggtattaggactaaagatcccggtgatctttagccccggttggtgctaccaactgggactaaagtcccacccctatatatgtgtcttcttcctcctccagctgcccgagcaagcttcaaaatttctttaaaaaagaggggaggtcatgccaaaatttctattgaatttattttggtgattacatacaaatcggaggtgcttaaaaggtttgcaacttcatcctccaatgttttttttttgtcatactacatttgcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaagacacattaaaattagtttaaaactttacaaatagtttttaagaattatttggtgtaatattttatgatttttgtatgaataaagatatcttataattattatatgactgtcattattgtaagaataattatttgtgtacggttttttttactcatgtagatggatcagcaatggatgtacgctgaccggcggtccaaagagtttattgacggcgtgcactattttttgagagtggccgaagctaacaggcaaaggggttttatttgttgtccatgcaataagtgtaagaatcagaaggagtattctgtatccaggactattcatttccacttgtttaagtcggggttcatgccaagctataattgttggacatcccacggagagcaaggtgttgaaatggaagaagatgaagtggaagacgacaatattccggactttgctcagtatgttggatttgaaggaaatcaaacgggcgaggaggaaatagctgctgatggtaacgacgttgcggatgatcttggtcagatgttgcaggacgtcagggaggactgcgaaagtaaaaaggaggcccataaattggacaagatgttggaggaccacagaacttcgttgtacccaggttgcgagcaggggcacaaaaagttggataccactctggagttgttgcaatagaaggcaaaaaaatggggttagtgacaaggcatttggcgatttattgaaactcgtcaagaacattcttctggggggaaacaaattgcccgagacaacgtacgaggctaagaagatagtggcaatttcatatgttaattagagtttttaacatttaatttactatcattcatatgctaattataattgactggagaatttttaaaagtattaaatttaatatatttttaaaactatcattcatatattagagtttttcacaatttaatttactatctttcatatgctacttatatatgactattcgaatttttaaaaggtttaaatcatgcatgtggcatttacatatgttaattagagtttttagcatttaatttaatataattcctatgctaagtacatatgatgattacaatttttattaattttaaatcatgcagtatgtacatacatatcttaattagagtttttaccaatataataatatcattcatatatatgctaagtatatatgattattggaatttttattaattatatttgcttattacgatttatccacttaatttattacagacaaaaataatttttcgaagtaattgtcattaatctttgtactttaaataatgttaatgcattaacttctattttataaacacatatgtaagcgaaaatcatatgcagtgctataatctttagtcccggttcttaaccctaaccgggtttaaaaagaatttcgaaatagcgggaaaagatatctttactcccggttgttctcaacaaccgggagtaaagatccgggcgtatatatattcccggtgcgccctcgtcttcttcaccaacacttagacgttttcggccgatcgatctctctcggcctctctccttcgccacgccgccgctgctttcgccgccgcgcgcgcaatgccgccgccgccacgccacgccgccgccgccgtcgccacgccgccgccgccaccgccgccgcgccaaccgccgccccgatgccgccacaccgccgttaacgaacgagaacaagaacgatcgaacgaacgagagtgagaacgaacatgtcaacgtacgttgccgcgagaacgtgaactagaacgagaacgatcgaacgaacgagagcgagaacgaacacgtcaacgtacgttgccgcgagaacgtgaacgagaacgagaacgatcgaacgaacgagagcgagaacgagaacgatcgaacgaagacaagcgagaacgtgaatgagaacgagcgaacgaacgaggacgaacgttaacgtgaaatgcaatatatatatatatatatatatatatatatatatatatatatatatacatatatatatatatttgttacttcgcatttatccaaatacatctttttgtatcttgcaaaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctatcaattgactattgtagtcttaattagacttagcatatacgcacgaaacacttagcatacatgactattttagtcttaacatgtaatattatttgagttttaatataagattactttatttgtaattagacttagtatgtaattattgactacggaattggtgcgacaagtagcaattgactattgtagtcttaattagacttagcatatacgcacgaaacacttagcatatacatgactattttagtcttagcatgcatgtaatattatttgagttttaatataagattattttatttgtaattagacttagtatataattatttactagctagggttgtataatatacgtcacctagacttagcttatatcatgatttgtaattagacttagcacgtaaggttgtgtagggttctaatgtacgacatttacacttagcatacatgacttagattgttaaaacataaatgtctcgtaacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaacagggcacgcgggcaacgaggtgcagcgaagaagcttgagggtcagcacatcataacggaagtggaagaagatggacgtcctagtgccccggccgaagccgccaagaactatgtacgtcacagcggttgggttgtgcgggataacgtgcctgtcagtacggtgtactggtgaagaacaagggcacgcggagatcatgagagctttgtcccagattcggagaaagagatgctgtggaccacaatgctcgagacattcacccttcctgcgggtacagaggacaaagtgaaaaggtggactctgaagaaaatggcagaacagtttcagagcttcaaggagatctgtaccggaagtatatactgaaggggcagacaccgaacttcgacacattcccaaagctaagggatcactgggacgagttcgttgcatataagacaggtgaacaagggcaggcgatgatggaaagaaacaaagaaaatgccgccagaagaagtaccatcaccacttggggtcaggaggctatagcgtcgcgatgcagcccgtgggagcagatggaggctagcttgattgagaggggtatcgaaccggcaacagccaattggccggaacgatcgaagttctggtactatgctcacggtggaacgctcaacccagctgatggctcactggtcttcggcgatcagatacgagaggctgcgcgacgactaacagatgcagtggaagcctcctctcagggcacgttccgaccagacagagatagggacgagctgacactcgccctgcagactccagagcatccaggacgaacacgagggaaaggggtgattccttggaagattggtttcaaggaggacatccacacgtacaggagtcggatgaggagcaagagagataccgaggcgaagattgcagacctagagttccgggtatcgagctacgaactcaacatgcaagaggaggtggcaaggaaggttgatgaacgcatggccgcacatcggtcccatgatccccagccgaccattcctcctgcaatggtgagcccgtcaggaaaccgtagcagctgcgcctcaacggggcaggtaggatcacagagcatggacgccatgcaaacacaggacgaatcgacctgtcccgttgatgacatcactcagcggacaccatgtgagctgcatattcctttcaagaacttatcaataaaggtaagatttagccattccgctagttgctgcttatatatgttgattactaataaataatctctcacaacatgaaggtggcgtcgggcatggccatcccaacggacccttcaggtacttaccactgcaggccgattccagcaggatactcgaaggtcgaagttgagttggtcgaaggcgcgtacgaggacctcgagctggattaccctggaggagacggtgagacgcatctacgagacacatgccatgccattattctatggcgcaggcggtacatcatcctccctgggcgacaagcggcgtctcgtgccccatctcctccggctccgccatctcctcctcaggatcctgcaccgtctcctcctcatgctccgccagcaccgtctccacctcaggctccagcatcgactcctcctcaggatcctgcaccgactcctcctcgtgctcctacacctactcccctgcaagctcctcttccggcaccttcaaagtcaagggcccccccagctccaccgcctgcccacacaagggcaacgaagaaggcgaaagttgacgccgccaagaacaaggacccggggtacgattgcacgcaagaggagcttgacgcttacgttgcatcagaagtcaagagacaattcaagcctcgaagtctagaaaagaagattcctatagaccccagtgtcaggaacttcttcaggggtatgtttgcatctgtcaaggaggccatcaagctatcggactatgagcgaacgctgaagaaagcatcttctggaaagtccaaaccagtccctcagcttggagagcaaccaaaccaggagatcgagccgttggtgaccggtgaagaaatgacgatagaacaatttattactgacaccggtctaactacggatcaattgctaggagtcgcaccaatcgaaaaggcggaagtgaaatacatgtacgaactcggtaaaccgcttgtcaagcctgagctgctgcagtccctacccacacaaatgtacaagttccatcagctgtacatggagatgagcaccaccagtagagagatgatcggagcgaggatcagggacacggacttcttgcaaggagatgacattctctggatcaatttcaggggaatctacgaactataccagctggacgccctcgacgtctctagtatgagttgctggattttgtaagtatatcgttcagttagatttcttactatacgtctcctttaattaattaggtccttgtatataagtagactatagaaaataatatactcccttttatcgttgtagaatggagattcaaagggcccgatggcggagggttttcgatactggattcatcgaccctcggaaagtaaacgtcgcaatgctcgaccaatatccacaagaaacagaggacaatctcgtccatctcctgaaggcgcagcattacaagacgttcatactgttgccatacaacacagagttagtttaattttactgtcttcctacataccaaatttcattcccgtacgaacttgctaagtgtttcatatgtaatgcatcccttggacattgcagattccactgggtgcttttactcttcgacctggatgcctgcaccgtcaacgtatatgactcaatggataaaaaagagtctacgtttgacaaggttttcgaacttatagataggtaccgtcataagttcctttgttaattaagaaaatcttgttatgttaattgctactacgaatcatagctttaaactccatgtagggcttggtatcggttccgtcatttggtccgcggcaaatggagagaaagacttaggcggaagttcaaatttcctgtgagtacacatgctctacatttatatttctccgattcaaatacatacaagtgtatattaattagatctctcgttgtttgtcatttatttgtagtgcgcaaagcaaaagcagggaactaacttgtgcggctattacgtgtgcgagtattgccactgccttgcaaaccaaatcatcaccgcaagtgagctcgatgtacgtacaaataaattcaaaatttcattacgtagcgatttcttgtttaattactaatcaatttcatacattcatatagtttattcgcatgagggataacctgaccacacacaaggaatttatcgcggcggttcaagaacaactcatgggattcatcaacgaagaaatccttgatcccaagggtgaattctactacgacggaaacacaattcaccggtccttagcttctgagctagcagcgagtactactacgtcgaaatcgtagctagctaggacatataatggattgtaattaatacatgactacatatgtttctatatgcatgcgtacacattttctataatgtaaatatattttggtcatatatatatctatatacatatgcatttgcataacatatatatgtataaatacatatatattatgcatgtatatacatataatataatataatatatatatatatacatatatatatgtatgcatatatatgtattgaaacatatatatgcatggtttatatatatatatatatatatatatataaaccatgcagcaacagggccatgcaaaaaaaaaaaaggactaaagatcgatctttagtcccggttatttcacccgggactaaagatagcgatctttagtcccggattggtactcccggtttggaaaccgggactaaaggggggttacgaaccgggactacaaagggtttctccaccagtgctcttacatatcactttttgtgatctttgatgtacaactttaatcactattatatattaaaacagagttagagtatttacggctaatttttttccagtagtagatgatgtacccatcgatagtgaggtgttcatggtaacttaatcaatctcaagatatgtcgggcccagtttttcggaggtgctcataaggatagaatgtgcgtatgtattcatatagttgagtgcacacgcattgggggcacctgtgtttgtaatgtgtttattttaaaaaaaaagagtacctagtaaaaatttgtattgttatagtgtccttttctaaactaatctacacatatgaaagtgtagtagatatggaacaccccacttatgtgtatatagtcagcaggaataccacataaattgtagcagtgcaagctacgcatcgcgtgcctttagccaatcggttcaatgaaataaaaaaaaatcatttgtaggtcttacaacagagaatatgttggatatttcaagaggaacaatacgatccagttgattaaagaacgtaattaggagtaggtacatacgaccttctcatccactttaggatagttgtctatttaaaattaatgatctttagaaatcataactaataaatcacatattcaatttcaaagtcgtttcaacagctgtattcatggtaattaaatggacaattcaacaactacactccctccgtctcattttaagcgcaaacatgaattttcgtgtccaattttgatcgttcgttttatttgatatttttttataattagtatttttgttgttattagatgataaaacatgaatagtactttatgcatgacttttttttaattgttcttctaaaaaatcaaataagatggacgattaaagttgaacagaagagtcatggttgcgcttaaaatttgcgcttaaacgctgttaggtgtggttggtacaactaaaagagatggatacccgcgagcggcggcgacacaagtgtagttgagtagtagtttaattctctaaaccagatgtggcaacggatagaaatcattcggcgatgacacaagtgtagttgagtagtagtttaattctctaaactagatgtggcaacggatagaaatcattcgagcatgcgggtatccatctcttttagttgcacaataaccagatgtggcaatggatagaaatcattcggcgatgacacaagtgtagtaaaccagatgtggcaatggatagaaatcattcggcgatggcatatgctcgcgggtatccatttcttttagttgaaccaaccacacaccacatctggtttggcgatgacacaagtgtagtaaaccagatgtgacaatggatagaaatcattcggcgatgacacaagtgtagtaaaccagatgtgacaatggatagaaatcattcggcgatgacacaagtgtagtaaaccagatgtggcaatggatagaaatcattcggcgatggcatatgctcgcgggtatccatttcttttagttgaaccaaccacacaccacatctggtttggcgatgacacaagtgtagtaaaccagatgtggcaaggcatatgctgcaacggatagaaatcattggcatatgctcgcgggtatccacatctcttttagttgaaccaaccacccacatctggtttagagaattaaactactactcaactacacttatgtcgccgccgctcgcgggtatccatctcttctcttttagttgaaccaaccacatctaacagcgtttttcgtcctcgctttcacgcaaaagattcgaatccggtgtgttacagtgaccgggcaaatttcctatttaagctgctgctgctcaagttaggaaagcgaggtggtactaatctagctacagtgccgcgccttgctacagtagcgcgagctactgttgggctgcatgcatgcgtgggccaaggcccatggcctgctgctagcttttttttcttttagggtgttacacggatccggcggcggcggccacgggcgatagcggtggcggcgcgtgccccctcccctccctccccatgcagatccggcggagggagggcttgggggcagcagatccggcggccgccgccctctcccctccttccccttgcagatccgggggagggggtggctgatccggcggcgcgcggcgggaggagagcacggggcggcggcggcggccgcgggcgacagcggcggcggcgcgtgccccctcccctccctccccgtgcagatccggcggaggggaggcttggaggcttgaggagatggtgaccggcggagcggcggcatgcgtcggcgaccagatctatctctccccctcctctttttttcacttgtgttttttgtgtgtgatttgatcatgtgagatgttcatgtgatgtgttcttgtgatgtgagatgtgtgttcttgtgatgcttcttgtgatgttcatgagatgttcatgtgatgtgttcttgtgatgttcatgtgatgcttcttgtgatgcgtgttcttgtgatgtgagattcggcggtgggcgacggcgacggcgacggcggcgggcctcggccaggcggcggcggattaggttagggttagggtttcttttttctttttttttgtttctttttttttctccgcgcaggcggcttaagcgcccgcacgcgaaaattggttttcgcgtgcaggcgcgccacccgcatgcgaaaatcacgattttcccagacgactgggtgcatgcgggccgcccacccgcacgcagaaattggctatcccgcatggaaaaattggcgctgtagtagtgcttgatgcgtgaacctagccgtacatgatcaataaatcagtaagattttaaattttgatttatagcataatttgtcactcctctctatttatagctccctcttccaccttctatgtttagtgatggacacaattagtgaatagccaggccgggcttacgtaggccagcggtttccaaacactcccccttgggctctgactgtataatttggagaaaagaaaaacccagtggaaaaaatttggagaaagagtacatagcatatgcttgcaatgtcgcatgaattgcctcattaaaaatcttataataaactactgggaaaacttatctaacggaaaaaagagtataatgcactcaattcttcgttcaatttttctagatggaattttgggtattttattttctatatcaaaattctggaatgagtcagcgaaattctccccctgaattttgcatctctctaaatctcattattccaattcctcagacacacttattcaagagaagatgttaataatgggttagtggacaaatctgtaagacttccatatagcttagttcgttgcttctattcaattcatgtacatagaagagcttggggttcatgtgcttagtgagtttgcttctcatgtaatccatttgcatatgtgcgacatatgctggggttgtgttaacagtgaaatttggtaagcccagagtagtcatcggcttagagtcagcattggcttcgaagtcttgagattagccgatgagagttgtcaagtcgtcagttgtcggattcttgctatattcggttaaggaaattgatctactaaaggaagcttatccagaagagaccgagtttaaagagaatgcggcatggcaagttatctattaattaggaatagtttattagtttccttttatgtttaggaaagtgtgtttagtgtcctataaggactttatcttttccttttatctttaggaaagtttctttcttgtccggcaagaacttgtatcaacccatgggtataaatatgtacacccagggtattaatacaattcggcgcatcgccaccttttaccttttctactttattttatcgtccgacgggacttggcacctgacgtggggctatgtttgatctccggctaaggggtaagtccaatgttccgtcggcctaggcaatagtatcgtttacgtcggcgtcgttcaagtctgcatcagtacattcgatctcttggattgctctggtttggatgatatatttgcctacctatttatcatatgtctctgttaatatcgtcttagcatatcaatttagctctatcggctgcttctcgttttagggattctgccagtatcggctaaatcgcgttgctagattagatttgcttagacatctaccaccctaaaaactcagtcaacggcttgattgtctagatattatatttcttttcatacttagtgctgcatccattgagtttgatctactaagtcgtgcttagaaccataatctctagcctgcttcttgattgccaataagggtttcatcggggtttcaaccggtgagttatctggacgttgcatcggctcataaggattgcatatacatataagttggatttagccgatggcaacaaaggtttcactatttaatttaatcttgtggatttcatgatatcggacctccagccaatgtgtgctttaaccttcggattaatgcttgtttatcatatcattatttgctgattggtttatactggattatattgttatgtcgttacatcatcttcagccgattgcctttatatcattatttacattggacatatagccgatagctctaaaccctatcgctatcggctggcatcggctattggctggtatcagcatcggctggaatctctacattggattatgagccgatcggctattttatctcctatttacataacttgtcagttgcaggatcaaacttactggcacgcctgcatctcatcaagatttggacctgcacaggagctaagcagatctcccacgccggtgtgttcgattttttcgtcaacacaaattggcacgcccggtgggaccatgaattttatatccacatgtctgaagaagaagccaatgccaagatcatggtcacggtggagaatttaatggaggaacaacaatattggctcggggggcaagcgtatcagtttcagcatggtggagtacatcagtatcggcttgtcggtgacatggggccgcgggtatcatgactagaggcttgggtagccgcgatcacccacgtggcctgaccccctcgggggggtcgggcccgaggatgatgtagccacccctccctctatctccccgaggggtcg

SEQ ID NO: 42128 - DNA, 7526 bp, Oryza sativa
cgccccgaccccctgtgattttggcgccacgtatatgggttaggtaagcacagcggagctttttcagctcgcggaccgagtggctcgcaaggaggaggcctggacttggaacccctccggttccggtgtggcagcttcggccgcccccgggtccgctgctcggtcagggcggcgagacaggaggaggaagaagaggtcagtccattccgacgacgagggtcatgtcctcgccgtcgagggcgtttcgctggccacccgaaaggggaggcctgcgagcgacaaaaagaaggaggccggcgctccctgacctcgactacttggaagagcgaaggcggcacgcggccctccgagccgcgtgctaccggcagaacctgcggcgctaccatcagcgccacgtccgagcccgatcactctgcgtcgacgacctcgtcctacgccgcgtccaaacgcgtgctggactgagcaagctctcaccaatgtgggagggtccgtatcgagtgatcggcgtcccccggccgggctccgttcggctggccacgggcgacggcacagagctgcctaacccgtggaacatcgaacaccttcgtcgcttctacccctagtgggggtcgggtgtcaggtcttgggcttgggccaaccccgcacccccccccgggcgtgcagggttggccgggggcttatcttttttctcttccgtatttcaataaaagcattttcgatttcctaaggactgcgtctgtgccgttgtttccttttaaagaatcttgacttgaaataggtcgctcgtgctcaatcctgccctcggtggcccaggccggctaaaatcgccaaaaggggcccagaaccgagccgtgccccggggcgtggtgaactccgggggggaatcggcaaaggcccacaatcgggtcatccataaccctcggtcaccatgttcccggcctggccagtctcgacacgtggatctccccaggcactagccccgacccgcgccatttgaggctgggacctgggcacgagcccttgttcaagctaagacacagaaggaccgcgggacagaccatcctcgactcatacacacaacaaatagaattgacacagaaattttctctttatttgattgcagattaaatcagtctatacaagaagggggcccggaggcttcggaagaagaaggaaaagttattaagattggcgggggcctggggctcactccgacgcgcccgggtagccggcctcgccgtcgctgtcgtccgcaccgtcgtcaccgcactcgccgtcggaggtgaaggcaaacgcgagcctaggggccgctcattattgtcggttggttttcccttgccgatgcgcgtgatttgcgaccgctgggattctgcccgaagagagagcagggaggagaggcccccgagccgaacggcggcccaaggcccccgacggccggagctggccctccgcctgcttgtccgacggtgacaggcgcccccgacccccaggatggccccgaggccactgcgggaaggccgcacctgtcgccctctgaccccgaggtcgtcggcacagaagccgagggcgccccgcgtggcctctcggacgaagagcgccctggagatgcggcccctggcgaagaagatcggctccgccgaaaggtgcagcggccggtctacttcgttagcgaggccctccgggacgccaagacccgataccttcagggccagaagatgctttacgctattctgatggcttcgaggaagttgcgccattatttccaagcgcattgggtcacggtggttacgtcttaccccctcggccaaatcttgcataaccgagagggtactggacgggtggtgaaatgggcaatcgaactctctgagttcgatttgcactttgaaccacgccacgcgatcaagagccaggccctcgccgactttgtggcggagtggaccccagctcccgagcccgtctccgcccccgaggccagctcgggcccatcgcagctgcctcacaccgcccactgggtgatgtagttcaacggcgcctgtagggaccggccccacctgtcaccgggcctaaggagtggcgtcacgcccgagcgcttccctcgaagggggcaatcgccctggcgtaacgccgggggctactgtcggtgacatggggccgcgggtatcatgactagaggcttgggtagccacgatcacccacgtggcctgaccccctcggggggggtcgggcccgaggatgatgtagccacccctccctctgtctccccgaggggtcgggccgcccctgtttcggccccgagggatggggcgccccgaccccctgtgattttggcgccacgtatatgggttaggtaagcacagcggcgctcacctaaccgcatttattgcgggttggacgagcgcgccacgccgcatttaatgcagcgcagcacgctcgcttatccggtccgtaaccggtagcagtgtgtgaccggtcaccgatcggtcagattgctggttaggtggtaacaggcggcctgtcacacgccttgccccgtcccgtcggaatgatgagagcctccaggcgctcgtcactagccggagccggcgtgctaactcccggagttggcacgtcagtcccggctagatacatgccaggcttcatcgcaaccattacaagcaagacattgtatgaagaagggcgaacatgcagattgctaatctgacgcgtggtggacaagaatgactggtttgcgaccggtctgacactggttatgtcgtcggcagacgaccgtgtccccacgttgcacctgcttccggcggagtggaggtaggtatgggccgtcccatcagaaggatcactcggacagcagccattgcaagtctccgcccaattaaaaagagatgacagggtgatccccgaggtcagacgaatgaggacgcgtggccgcactcaaaaacaagcagtgttttagcttccaagagaaggcgagccaagttttagtaaagataggatgggtccccaccctatagaaaaggaggtagaagtggtgcatgtgggatccccttgagatataaaaggaggaccttgcccacttaagggtggggggggataaccggagctggtagaggagagaaggaggaagagggtctctagagtttgaactctcttgctctccagctctttgtagctccttcatacacagatccatcagaacacaggagtagggtattatgcttctaagcggcccgaacctgtatacatcgcccgtgtcttgcgcgtttccactttcgcgaacatttcacagattgagagcttagaacttcacttagcgtccccggccgaaccggcaaaggggggcctgcgcggtctcccggtgaggagccccacgctccgtcatggctcatgaaagccgactgcaggaagcaaaggaagatcggttttggagttatcaagacaagaaattttgaagcatgaattctcatactccaaaactggggggcatgtgttaatagtgaaatttgttaagcacagagtagtcatcggcttagagtcagtatcagcttcgaagtcttgagattagtcgatgagagttgtcaagtcatcagtgttcggattcttgctatattcggttaaggaaattgatctactaaaggaagcttatccagaagagaacgagttcaaagagaatgcggcatggcaagatatctattaattaggaatagtttgttagtttctttttatgtttacgaaagtgtgtttagtgtcctataagtactttatcttttccttttatcattaggaaagtttctttcttgtccggcaaggacttgtatcaacccatgggtataaatatgtacacccagggtctatgtaatctatcttcacgatcaatacaattcggcgcatcgccaccttttaccttttctactttattttattgtccggcgggacttggcacctaacgcggggctgcatcggtgttcgatctccggctaaggggtaagtcaaatgtttcgtcggtccaggcaatagtatcgtttacgtcggcgtcgttcaaggctctatcagtacattcgacctcttggattgctctggtttggatgatatatttgcctacctatttatcatatgtctctgttaatatagtcttagcatatcaatttagctctatcggctgcttctcgttttagggattctgccggtatcggctacatcgcgttgctagattagattagcttagacatctaccaccctaaaaactcagtcaacggcttgattgtctagatattatatttcttttcatacttagtgctgcatccgttgagtttgatctactaagtcgtgcttagaaccataatctatagcctgcttcttgattgccaataagggtttcatcagggtttcagccggtgagttatatggacgttgcatcggctcataaggattgcatatacatataagttggatttagccgatggcaacaaagatttctttaccaaactctggtaaatacatgagaaatcccgtcaaaacttggcaatattgttaaattgtcaaaattttaacattgctaaaatttgataaagtttattttagctataatctgaacatgcccttaatacgttcccttttcactggatttgaacacatcgaaatctggggaggcatagaacaacatatggcatatgggcaaactggagctcaagcgcatccaccgaaccagagaggcagagacaacgctggaagcatggaaccagagactacgcgcgcgactgacgcgtccgatattttaaaacccatatctagtgtgtaacgatcacacattggaactggcacatattggaactgtccccaatgtgttgttttgcagtagtgtttgcttcttttcttcttaaaaaattttgtctgccatgcatcttcagttagcttggcgaaaggaaaataaaaatacaacgtaaaatcgacattgatttagttttgtttagcaaatccaaaaaaaaaaatctaacttggtcatagtggatcaaggacatgccagactttaggactcgttcttttactcaactttccgcttcaacatcttcattttccccatttttcattagcacgtttttaaactattaaaggtatgtctaaaaatgattatatatatagaagttgtttaaaaaacaaataaatttattattaaaaattgttatatgaattttcacatctcgcgtgcgctcgaaattcctctccacatggagcgaacgaacgagctcaaaagaaaatgaaacgccagaaatgaagccccattgttatatccagatctagttgtgtttagttcacaccgaagtttagaagtttggttgaaattggtacgatgtgatagaaaagttgtgtatataaaaggtttgatgtgatggtaagttggaagtttgaaaaagaaaactttacaactaaacagggccagatctgtagtgtatggcaaaatccaagctattaatgcctcgctagctgatcaactggttaagtcaagtctgcctcaaaaaaaaaatatatgattaagtcaagtcaacattccaactgccccagtcatctccacattataacacatggactgcgaggctccgacgtaagctttggggcatggcctcacactaacattcatcatctagaggtaatactactaacaataatatttagctgcatttttgtctcattttacctttttttctcttacaaaatacgttgtagaaataagggtgaagacataattttttttcatgcactgtagctacctttttctaaaaaacactgattataaatgaatttgtattttttaataatattttgtacaacgtattttgaatttaaatttttcatgaccaactgttcatatcattacagtacacgtctgaaaatggcatgttttgtcgacatttttacttgtttcgaggcaataagaacagatcaaccataatgagtgactaatgaacatgaggtatgtttacgtttttatttttcctgcaggtcaggtccttccgttttaaaatataaaatatattagcttattcaccgtcttcaacattgtacatttaccactatattcttttgtaatactgtaaaatgtttaaataatacagataaagtgataccacatcactaccagaaactgtattacttctgacggccaaatcccgtcagagataaagaaaattccgtcaggaaaataggacctgacgtgttaccgtcagaactagcttgtcggggaaaaataaatttgcctagcgtgtgtccgtcagggttaattttcctgaaattcaatgcgcgcgaaataccaaaaatattgccgctctgtcttgtttcctcgcgcgccattgcaattttattttacatagtctttcctgtgaccccaaatttttgcactgatgggtacgttcacgtcaggcaatttaatattactgagtttaatataattttaaggttgagaaacgtctaggggtcttcggctagcttgtcacgccccgaaccagtcccgaccggaactagcccgtgacgcttcaaattaacctgttaatcgataccagtcccaggaaacagtgctggtatcacagggagacagaatatcatagcaacagaggtctctttattatagtaggggtacagtcatgttgggccgtggacagatcccgagctcacaactgtattacaaaagggaaacggaagccaggacttggaccaaacaacacaggcgcgacttaggaactaggccgaaaccctaaaactcatcgtagccggcttgctcctggaagaactcctcatcagcaggatccgcttcatcttattcagcaactggggggggattatttatatagagcaagggtgagtacgggagtactcagcaagccatgggaaataagtgtttaatgcaggcttcaaggaagggctgttgtttttgcaattgattttatttgaactctttttctaaaaacaactaagtgagtgcttctcaaacgacacggatgagacagtgcgtctcgtccggtcggagtatgtgcaatgtatcagtctttagaattgattcaaggttggcacccggccaacagcttttcaaacggccacccgggccaacaactttcaaacggccacccgggcctagctgatcccatcagctgcagatttttcaaacatcgaacccctttccacaacagcaatttcacaagcagtagtcaaacaaaactacgctaggaatcacctcacatccgcccatgaccgtgggcacggctgttcgaacagtttgttaacctctgcagagggggtacctttacccacacgacattactaacccagatcacccagcccgtggggatcagccacgtcgggagacctccaagctttcatgacaaggcatttcgaaagccaacaaaggtttaccatatgccgacgagaggggtcccagaccaacaacaggttaggtcccagaccatactatgccaggaagcccaggagtcctccccgacaccaccccggcgaatccacatgtctctcggcatcaaggctcccct

SEQ ID NO: 42129 - DNA, 8227 bp, Oryza sativa
gggagatgggccgagagaaattcggcccatcgaccccggggaggcaaaatagacttttgcggaggaatttgatttggaaggatttggattcgggattgaactcgacgatagatcggggatttgagatcttgagatggcacggacactagacaacaagcaaagaaacaatttcgcaattagggtttttaagagataattttcccgctaggcgccacgacggaacgggcgctacatagctccacaaagtaatgggctagctggcctgggtttgaagtttcaacctttctaattatttgatattaattccttctcaaatattcgtgttttttttcgtgattttaaaggctgactttgtgaaaaacatgtacttacaattgttggaggccccaaccttaaaagttgtgttgctcctttgctttacaacaaaaggacttttttttttgttgaaaaaacataagcaaatggacataaaccccaaggccatatgtaaattaattaactagctgcttaattgagtgcatgatcttttctcactacgccagattagcccatctgtgacggcctatctatgatggaccaaaatatctcgtcacagatactatcacctttgacgggttaaaataaatctcgtcatagatgaggctaaaaaaaatgacccgtcacaggtaaatactcacctgtgacgggtatatataaggacccgacacataatgattgtgacgtgtccacatataaacccgtcactgatgagtacttacctatgacgggttttaagtttacacccgtcaaagatgagtaacctcacctcatatattcaattaattttcacttataaaaaaggaaacaccaaccctcccctaccgcccaccaccccaacccacccccaccgcccaccgcccacaacccatctcttttctctcttctttctctcttctctcttcctccaccatcgcctctcccctcaaccatgcgccagctgcgtcgctgcctccttcgcccctcgccgtcctctaggagctcagggttgccggctgcgtcgcctgccgtcggcctccaggaggtcgggcccggcggccttcaacatcgatgccgccgccacctcctgaccgccggtcaccagatctggccgccggtgccttctctcgcctcccggccactgacgtcgccgcctcccgaccaccggctttaaccgccgacgccgtcgccgcctcctaaccgccggtcgccagatctggccaccgggaagccggatctggccaccggcgccttccctcgcctcccggccgccgacgccgccaagtttggcctccgagaagccggatctggcctccggcgccttccctcgcctcccggccgccgacgccaccgcggatccggccaccgacaccttcgccacctccacaacctcttccctgactgccggacgccacctcctccgccaccgatcgatgaccgccagatccggcctccacgaggtcgggggacgcggatccagcgtccgcggcctttcccctctgccaccgactgccggccgccaccgccaccgaccgccggccgccggatttgtttgtgcttgatgttgtttgtgcttgatttgctcatgtttgttgcttatgtggatgtgtagtttgttaaattggacatggatacttgtgtgatgtatattttcagattgcttcatgtgtagttgtttgttgagatgtatttgatttaaaatacaaagttgctgtatcatgtgcatcttgagatgtatttgatttttcttcatttcgtacatttgggctgaggcatttctttttttttgggtgatttttgacatctgtgacgggtgagaactaaaaccagtcacagctgtttcgtcacctttgacgggttgcaaagagtcacccgtcacaagtgtgagtcacctgtgacggctatattttttagcccgtcaaaggttttaattaccagtgacgggctttcacccgtcaaaggtgaggtgttgtcatcagtgaccactagtctctaaccagaaccaaatccgttaaaggtgagggttagagcccgtcacagatgactggatccggcctagtgtctatggttctcttgcaagtacatctctgctcctccatccagctcgtaattaaaacggagaccgatcgaggtccatcgccgattcgcgttcgtacgtcgtccatggaactgcatttacgtacccaacacgtgatcgcatccaaatcgcagtactcaaaagcagctaatacctagtcaactacaagtcaagtcaacacaacaacatgtacgtgccaataatgcatgcgcatcttattcatctcgattggccaacttgtcgcaggttttacaatttcgatttcgtccaaaattttggaaagtcccgaaattttgggatttttggcacttcttggaccaattttttttgaaattttaatagaatttaaccgaatttgattaaatttgactaaatttgctaaaaattgagaaaaaccaaatatttcggccgagataataacttaccggggcactactacatgatggattttcacgtgcggatatttcaactgtgtaagaaagtgtctgcaaaaatcgctatttttccatgcaggtggcgcagccgcacgcgaaaatcgattttcgtgtgctgattatgtcgcccgcacgcaaaaatgaaaaaccaaaaaaaaataaaatccaaaaaaacaataagctaaccctaaagctgccgccgccgccctcctcgccgtcgtcgccgtcgccatcgctggtgccgtagcttgatccacagccgccccaccgtccgctcgccgccaccggatcccccccccctcccagagctcgctgccgtcgacacgccactcccggtagcccgctgccgcgagctcgccgccgtgcgcacgctgttcccggtcggcgagcccgccaccggaggagaaggagaaggaggcggcaccggaggaggaggggaaggagatgtgcggtgccatagaaggagaaggtgagagagagagagagagaaagagggaaaagtgaggagaagataagggggagagaggagagagaagggggcggggggtgagagaaggaaatttaaaattttttttgaataggatgagttggaacgagtattttcctttgcgggtagattatgaggcccgcgcgcgaaaatagacatatttttgtatgcgggcctattaagtgatccgcacacgaaaattgattttcctatacgggcgatggcccggctccggtccccctatttttccttgcgatttcacttacgacccgcttgaaaactaaacggtccagcgtccatgaaaatatttgctgtagtagtgggggtccgaaatttccgaaattgcaatccctgagttgtcgtcgtatcagtcacggtacatatactatgcgttgggactatttgataattaaaccgataacgagaaaaatcattagcacattaattaattaagttttaattattataaacttgataattgtatttaatattttaaagaaacttatatataaatttctttacgggagacatcgtttaatagtttgtaaagtattctaacgaaaataaagataaaaatatgaatcttactcagaaaatggaagggcccggtctcacattaaatactgcactcaattgcttccagccattcacgcattcgatcgcatcatgcatccggcagccaagttaccgctgctcttcctcctcctggtcggggcaaccgccacgacgtccacggcaaaccatgcgccggctccagccgccggcagctgcgtgccgcgggagagggaggccctgctggccttcaagcgaggcatcaccggcgatcccgcaggtcgcctcgcctcgtggaagcgaggtaaccatgactgctgccggtggagaggcgttaggtgcagcgacaacctcatcggtcatgtcttcggccttcaccttcaaaataacttctcgtggtacaacgaagcaacagctttggtggggcacataagtacttctctgctcgctctcgaacagctagagcaccttgacctcagcaacaacaatctcgtgggtccagccggccgattcccagggttcgtcagctatctcaggaacctggtatatcttaacttctccggaatgccattaaaagggaaggtgcctgtcgaaacatgaattccgcaataataaaaggggtagcgcacgagacctaaaagtggatggatgcagagacaaaggatttagacaggtggccctctcaatgagaggtaataccctactcctatttggggatttgaatccgccaggtgaattatagatctgacgatctaattgtctcatgccccctagagggcctcctgcccaccttatataggatggggggcaggattacaagataaaaaccttaaccaacacggtatcagtttcctaaatctactaccaaaccaggactttaggccgttctgtaatatacaaggaaacgtaatacccaagtcatgatctgttacatattccatatatataagttatcccttataactagtcggataaccatgccgtgtgggtatggggtacccataatcttcacagtagcccctgagaccttcatagtcgaaaagataatcttctctcgaaccagattactctaaagccaagtgcttcaatcatctttgccatggtctcccgagtacttttaccaaatatgaagactgtggagggctgaaaaataaagtcaggtgcatcgactagatgcacctaataggtgtagcccccgactatgtggttagctgaacaaactaagcatatagtcaaggaataaataatccaaccaaccgagtggttttgataattgcaatcaaccaagtaacttgatatcaatatatagcatatgcggtatgaatccctcaataacatgatccaagtgatataccgactgctttgtaaaatataatgagtgtaacctaaagttggctacatcattgaaaattcacatagcaaaacagctataaagaagcttgtatgttgtgaataaagaaatttccaaagtattaggcatacgccatgcgcacactgctttaacagatatgcttaagtctctaaaacacacatggtttcaccacacctagaaatatatatatggcatatgtggtgtaaaatctgtgtaaataaactcataaaggatttaccaaccgcctggaaaatgaccaaaatatataatcagcctaagccataatattggtcaataaaagtgcacacttacgtggcaaaaagcaataatattgtatccaatcaattactttatgaacccaaacagcgccttgacttatataaaaaagtcagcgggcagctatataaagtattactgtttggcaccttttaaaatgcattgtaccaactcctaaaaagttgagtaactgtggtataaaaggattttaaggtattggacacttgatcacgtgcactttggcctaagcaaaaagtgcctaagtccctaaaagaacgtgacaggccacacctgaaaatatgggctgcagacatattaggcctaggccaaaaaatatgccttcgacaccctttaaaggatgacgcatgtaacatgctcccgagtaataaatcttccgggtaatatagaccaagtgtagctcatataaatagcttctgatctaagtgattatcctttatgggatactccaaaatagatataaagattgaatcctgactggcgcaagtattcagttgataacccttacggggaataataaatagtccagtctttgagcacagaaaataaacccatgatcatgaattcatgttgcatgtatccggaacaattccaaattgaaggtatgatacttgtgtttgagctagtaagcccctgagcatatagcttatacttttggagtagttgaaattatccatcggtgatagctgatgcaatcggcatggaagtgaagaaaccagtcggcagcagtcagataaactaacagtgaagatgaatgcacccagcaatagcggcagcgttttgtagccttagtgacgaaataatcagtcggagacgaaaaggcagctagtgaagaagatgaagatgaagacgaggataccagtcggtggtgatgaaagcaagccgacggtgaagatgtagacacgcatcaaaggcgatgacgaaatccactaatcatgaagatgaagacaatagtcggcgacgacaaacgcaactgacagtaatgatgataagcagcaacagagatgatcaaatatgatgacgaagttgcccaccaatagcagtagagtgggcaatgttgaagaggcttgacaagttattgatgaagatgacgatgtcggtgatccagtcaacagcggtgtaacagccgatgataatgacgaagatgctcatcagcgtttgcatagtaggtcaaccatgaaggcgaaataacaagtcggcaatgacggaagcagccagaggcgaagacgtagtcacccattagcaacggtagagacgtcaggaccgatgaaatagaggtgctggtgatgatgtcagtgacaataatccatcaaactgttgagaagatatcaaagctcgagtaatttccttgatgcgagcatgtgcataacgaagatgatgcaatgccccttgatttatgaagatgactgcagaacttagtgttatagcgttgcagatgcttcacttgaaagaaagtagatgctgttgtccaacttgttgaatctgagttaattggttgataactctaatctcccgaatatttagattaaatctcacacttgatacttgaagtagattatggcagcatggggcatctaaaattgtcagtgaaataattgaagttgctgaagtagaacgtctgctccgaagcaaagacgaagataatgactcctggagttgactcattgattgattgattgcttcatcttgacctaaagcttgtcgaattttgagagtcttgtatttgtgtagcccccgactctttggttaattgagaaacaactgaacatagagtcgagaactgtagcttcttgtcatcgagtagtcattgcttgagtgaatatactcatagaagatgtccgagtagaaatctttaatattggaacaccacttgttgtagtaaaataacatggcattatacttgttgacgcatgccgagatgtcgaggctcctgtagatgtcgtggtcggcgaagtagcaaagcttgcgaagtagaggcaatagagtttgccaatgccgaagataataaagatgatgttgctccaccatggtgacaaagttgcatagccgtgatgacgtgaacaggagttggcggcaacagaagcaaaccggtggcgaagatgcgcagtcatgaagataaaaacaccagttggtggcggcgtaaccagtcggcaacggaagaagtagaatgatgatgaaaacgaagacgttctttaacagcggcaaaataggccagccatgaacgtgaatacatcatgggcagcgccgaaggcaaactggcgatgacgatgacgccagtcaataatgacaaagacgcgcagccgtggaggtgaacaagccagtcggcgtcagacaaggcggccagcaatgaaaacaatgacgtctatcagtagtggtaacaatataaaccagcagtaaaggcgacggcactagtcaacagcagaagagacgaccggcggtgaagacgtagacgctcaacaacggcggcataataggcaagccgtgcaggcggagacaccagtcggcggcagacgaggcggccggtcggtgaagacgtagacgcccaacaacggcggcataataggccagccttgtaggcggagacaccagtcggcggcggtggagacaccagtcggttgcggcgaagacgtagatgcccaacagacggtggcataataggcccgccgtgcaggcggaaacaccagtcggcggcagacgaggcggccggtcggtgaagacgtagacgcccaacaacggcggcataataggccagccgtgtaggcggagacaccagtcgacggcagacgaggcggcctgtcggtgaagacgtagacgcccaaaaatggcgacataataggccagccgtgcaggcggagacaccagtcggcggcagacaaggcggccggtcggtgaagacgtatacgcccaacaacggcggcataataggccagccgtgaaggcggggacaccagtcggcggcagacgaggcggccggtcggtgaagacgtatacgccca

SEQ ID NO: 42130 - DNA, 6551 bp, Oryza sativa
agacgcccaacaacggcggcataataggccagccgtgaaggcggggacaccagtcggcggcagacgaggcggccggtcggtgaagacgtagacgcccaacagacggcggcataataggccagccgtgcaggcggagactccactcggcggcagacgaggtggccagtcggtgtaaacgtagacgcccaacaacggcggcataataggtcagccgtgtaggcggagacaccagtcggcggcagacgaggcggccggtcggtgaagacgtaaacgcccaacagacggcggcataataggccagccgtgcaggcggagacaccagtcggcggcgacggaggcaggccggcggtgaagtcgtagacgcccaacagcggcggcataataggccagccgtgtaggcgaagacaccagtcggtggcgacggaggcaggccggcggtgatgttctgactgatccattcctggagcgtaagagataagcttaaagccatgaatcccttttatgcatatctggatctggatcctgcagaacaaacatataggatgagtagtatctgatataaatataatactcgagaaaaattcaagtattttaaaatatttataaatatgtatttcttctcttgtcaattttgatttccccgagcagatgacttattacgtttaaacactctgcccgactagtcatagccaccaagcaccgggagtcggcctaagcacttcccaaacatgcatatgagtgacatgagttcgtcattaatggaacaaagtttcacgggtcggagtttactactcgggtacttttgcaattattaagagcggaaaataaattatcttatctctatgcttttgatttattccaaataatgcttagcaccttgtgttattcggtccatccaacaagcccccgggtgctaggaatcggcccaaaggcaactatccattggcaaaccaaacggaaagtataggaagatggaactccataactcgataggcacttttgtactcagaataagtcgcaagcaatcaagataaatattatgaaaattgtttaaaaaatatgatataacatctgtaacccccgactcactagtcaacggcgaaccagttgatgtagtgaggcaaaggaaaaggcaaaatatcatataaagaatgaaataaatgatgacttagctttatcgtattccctcgatgacagcaaaagtagccgatgtgggaacgaaacagtccatcaatggtgacaaaaacaccagttggcgccagtggaaccaagccagtggtgtagatgatgaagcccattaacggtggcgaagtccgccaaccgtataagcgaaaacaccagtcagtggcggcagaggcaagccggcggtgaagtcgtagacacccaacagcgacggcataataggtcagctgtgtaggcggagacaccagtcggcggcgacggaggcaggctggcggtgaagtcgtagacgtccaacaacggcggcataataggccagccgtgtaggcggagacaccagtcggcggcgacggaggcaggccggcggtgaagacgtagacgcccatgtacggtggtgtgaccaaccaaccgtatatgcgaggacaccagtcggtagcggcgaaggcaagccgattggtgattagatgatgtcacccaggaacagtggcaaagtcatgttgccacgaaggcatatatgcacaaaaaaagcaaaccaatctggttagtaccaacaaacagaatagttatagatatatagacaaatatatgctcctgttggcatgggcgattgtgttgatagcgccatgattagttgaggcgtgctgacatggattccggccgaaaccatcgctaggtgacattcatgtgacagcacaattaataactgtcacgcccagccacggacaaccggttgatcttggtcagcatatgcatacatgcaaagaaaacgattagtagattaatctgttatcaagcataaaagcatgtatataagcatatgtatatatcaatgtatggctcagagctccttgtaatcggctgctcctatatgcccctggtaatcagcaatgcttctcgcgtgaagaccgccggttaacctatgctggcgtgtagatcggtacagagcgcgaacggaattacatcagcaggacacatgaggtcgccgactgcttcgtctctcaattggcataggaacagccacaaaaaatcagaagatcgatgttaacaacccacttcttctaacttaatagcaagcatccaccatacaaggaacaattgttttgggatgaaaagagaagaagaaactaagtaatacaaattctggaagcttctagagctgagagagaaggctgtaagtaggaggagaggtaggggagagagatcgacaagggtgcccaccggctgcccaggtcgccgccgccgtcgagagcttcagctccaccaagtccaagtgatcaatcgatgcccccaaccttcctgctgctgctgcttttgttgcctctccaactgggccttcttgggctggattggaggattgttgtaacggtccaaccatagcccatccggtcctaacaatcccctctccttgaaaatcggcttgtccccaagccgatgaagcaaacctcctggatcccatgggtgctccaattcttggctgctagacagtaaaccatcgtcgaaatggaatagatcatgtacctttttgctcctgttgagctcaaaagattcagaaacttgtagagcatatttcattggagctgcaatatctttgctaaaatccatacttaattcacggttcagtacaagagcaggaattttctggacactcgaatgcacctgaatcccttctgaataaaatccttggttttctgttgagtggataccatgtccaaaaacattcacccttgtggccatagttctatgtttgttgccttctggtagatagttgttggttactgagtaggctaaattcccaggagcaacaaatgtgttcctctggataacatgctttgcccctgtctggtttctttttaatgcatcacattgtaatttctgctctgaacaaacagccatcttggtataagtcccttcagttagaattgtataatttccaaccttccattcagtagctgctagaaccaaaatccagaatattgggcatccatcacttgttacctcaagcacttttaactcacaaaaatccattccttcactaggagccatcgtgtgacaagaaacattatcatcgcccaggttcacacaactctgcatttccaacttagttaacaacaccttgtcagagccccttagatagcagctgcccttttgaactgttttagcagtcgataagccaaaggagaagtaatgtaggttcacaaacaatctagacatcttccagtgtccattacaatcattctttggcatctttctgaacttccttgtgggccatccattacaagcatatttgaatttgagtatgtgttcctctccagttcctaacttctgcatataacatgttcttactagattcgaggttacttgcaccagcttatcagatgttaattctagctgcttcaaaaaatctaaattattgccaactatgaattcagaccatactccctgacacaggaaacaataatcacccagagcctccaaagtaccttccaactctagaatcaagtcaacaatgtactgtttaggatcacacccaattggcaacttcagttcatatcttctacagcacatttcacatagtacaagtttaagccacttcttgcataataggagttgaagcaggttatagtcttcataattttcattgaggattgcataacctgagtgccacatctcaacaaaccataggtcaacaactgataataactcaccttcccttgcctcagccaaatctaattcctgtaattcaacacttgcatgtgcactgatcaggaaatgcacactgccatttcccgaaggtggaggccatggttttagatcagcccaatgcaacactttatccatcatatcagtgtgagctactccaatttcaataaatatcagtgcaagccaacttactttaattgtcggcggccaaggttgcaagatatgtactcttgtgtcataggagttgaacgtttcacaaggtactggctgcagctcacattgtaccatcatcttgtcaacgaataatctggttgctaggttgcccatggggtggacggatgctgaaacgtccttggacaccactgtcttggtttggaatgcaaccacagcttggtcattgccaccattgacgtcgaggccgaccatcgagcacatggcatgcgtctccttgaaacaaacaggggcgtcaatgttagtgttgccagtggtgccgtcagaagctaacaacaccattgatgacacagcgagggtggtgcaagtaaccggagcaactacagtgagatcgggcttggtgtcagagctagagcatatcgtcgaacacttggtgggcgtgaccttgaggaggtccttggtgacaatgtagggagcttggtccatgtcctttctgtctcctagctcccaggcagctatcggagcaagcacctcaccaatgtgacttgaattcgcagccacccaagtgatgttgttgttggagcattccgtcaaacacttggtaggcgctagaggagacggtgccatgggtggtagagatgatccagcattgagtacggcagtggtcgccttgatagaggcacccatctcctcgaagaacttgttcctattagcatctatctcgtccaacttcttcaaaattcgatcaatcttctcatcacacctacgcttggcctccatttgttcaaacttctccaatatccgatccaaagcttcatctagccatttctcctcttttttcatggtggaattgatgggaatgggctcagatatgctctgatctttcttggacatcgcaggttggcttggcgttccatcgaacagttggtgggcgctgcttggatgaaaacttccccaacccaattcctgctccctcttgcatggctgcctccccaacacctccatgacaagaatcccaatgaaccgaacggctctgataccagattgttaacaacccacttcttccaacttaatagcaagcatccaccatacaaggaacaattgttttgggatgaaaagagaagaagaaactaagtaatacaaattctggaagcttctagagctgagagagaaggctgtaagtaggaggagaggtaggggagagagatcgacaagggtgcccaccggctgcccaggtcgccgccgccgtcgagagcttcagctccaccaagtccaagtgatcaatcgatgcccccaaccttcctgctgctgctgcttttgttgcctctccaactgggccttcttgggctggattggaggattgttgtaacggtccaaccatagcccatccggtcctaacaatcgaatacgaaataaaaattaatctcataaaagtttgactggaacggcaaatctgagtggaagattaaaaccgtcgaactcattgagatgaaggttgaaaccgtcgaactcgttgagatcgatctcagcacatctctagaaattgattccatcgcacttctcgatggaaagctcgacgcaaccctacctggcgcgccactgtcgaaacatgaattcggcaataataaaagggggtagcgcacgatacctaaaagtggatggatgcagagacaaaggatttagacaggttcaggccctctcaataagaggtaataccttactcctgtttggggatttgaatccgccgggtgaattatagatctgacgatctaattgtctcatgccccctagagggcctcctgcccaccttatataggatggggggcaggattacaagataaaaaccttaaccaacacggtatcagtttcctaaatctactttacaatattaccaaaccaggactttaggccgttttgtaatatacaaggaaacgtaatacccaagtcatgatctgttacatattccatatatataagttatcccttataactagtcggataaccatgtcgtgtgggtatagggtacccataatctccacagtgcctcctcaactcggtaatcttacaaagctacaatatctcgacctttcccattgaaatggaataggtatgtactcaacagatatccaatggctcacccatctaacatcgctacggtacctaggcttatcaaatgtagatctcagcagaatatcttattggcctcgtgtcatgaacatgaatgcttatctaagggcactctatctttctcattgctctcttacaagtgcaagccaatcaattttacagttaaacttcacaagacttgaggagctcgacctctcccacaataattttaaccaacctttggcatcttgttggttttggaatttgacaagcctcaagtacctcgatctttcagggaacaatattgtaggaagtctaccggccgcggtgagcaaatttaccagtttagacactcttgatctctctgagaaccaactttttggatctgttccata

SEQ ID NO: 42131 - DNA, 4191 bp, Oryza sativa
taactgacatcaacctaagggtcaataacttgacaggtgaaatcacagagaaacacttagctggtctgaagagtttgaaaaacatagacttgtcttctaatcactacttgaagattgtggttggtcctgaatggcaacctccatttaaactagaggtggcaatatttgaatcttgtcagcttggtccaaagtttccttcgtggcttcaatggatggtggatattaaaatacttgatatttggaacacaggtataaccgatcaacttccacattagttttggacaacattttctaaggcaacaaagttagacatgtcctccaacaaaatcattggtagcttgccaacaaatatggaaaccatgtcattggaaagcctctatctaggttcaaatcaaataaccggagtaataccgaccctgccacctaacctcacctggttggagatccaaaataacatggtatcaaggattgtggcatcaaaaacctttggagctccaaacctaggttatatggatctatcctccaataacatcaaaggtcctattccaggttctatctgcgagttgcaatacttgagattcttgaatttagccaacaattatttggtgggagaatttcctcattgcattgggatgacagaagtaaattacctttttctaaataacaatagcttatctggcagggtcccatcttttttgaaaggttgcaaacagctaatgcacctagatctatcacagagtaagttccatggaagactgccaagttggattggagacttcccagcagtacgaagtctaatcctaaacaacaatgtgttatctgggcatatcccaatcaacatcaccaatctgacaaatctacaggacctggatctatcacaaaataagttccatggaagactgccaaattggattggagacctcccaaaagtacaacgtatattcctaaacaataattcattctctgggcatatcccaatcaacatcagcaatcttataaaacttactcagttgaatctagcatacaataatatttcaggcattttgccttgacagttcacattttaagaggcgacgaaggttaagcatcatgctatatataccctagataccccatgaaagattaatacagtttgtcggccagcattatcatttagctatacctgtctgctacgttaagtgcatagaaaagttagattactatactgcctacttcctccgtcccaaaaaaaatgaatatagcattagatgtgacatagtctagtacaacgaatttagacagatgtataattaaattcataatattaggatatgtcatatccagtactagattgattttttattggacggagggagtatggacttgggtttgtgctagcatttgcttttgtcctttatattgttcttttttgtgagtctagatatgccgtttcctctgtaaactaataagtgtttcttaattaattattgtattgcatctacaacttctgttttcacctatcatggaagctaaattaagactattactcttgggcacctggcagggggcaccgtattttatccctctttcacggcaccaacaactgattaaaccaaaaagattatttttccaacttaggctctgttcgtttcctggagttcccaactcccccatctcattttccgcgcgcacgcttttcaaactgctaaacggtgtgttttttgcaaaaagtttatatacgaaagttgcttaaaaaaattatattgatccatttttgaaaaaaaaattagcaaataattaattaatcatgtgctaatggactgcttcgttttccgtaccggagggatgggttcccaactcaaccaaaagaacagagccttaaacaaatgaacataccaaagcagtcaattgtggaggactcgttattcatgtcgagagatttttctggctctggctgaattcgctctgttcgcacggtccagctcttcacggagctgcccggtctctgaccgaattaatgtgctagtcaactcaacccaacggcatcgacatagtaccattcaattcggtgcatgcatacatgcatcatttcgtgctagacgccgttgctgtcggtacgtcactcacacggttgggccagaaaattaaattaaaccccattaattacagcattaagggcgaaatgcaggtagttatactccacagtccactagtcgtacgcaagaacgggtcttttaaaatgagcttaatttaaggccggtttgccgtgcgcgcacacacacacaatccatacgtgctcactgctctcctccaatcactcaaacacacatagtaagcctgtgcaccccatgaaatcatgaatcccaccggcaagccgttgctcctcctcctcctgggccttctcctgctagcaaccaccactttgtcccgagcaatccatgcgataccgtaccgaaactcggctctggtgccaccaccgtcgcttgcgtgccacgggaacgggacgcccttctggccttcaagcgagacatcactagcgaccacttaggacttctcacctcgtggaggcaagatgaccatgactgctaccggtggagaggcataacctgtagcaacctcaccggccatgtcctcaagcttcacctcagtggcatatacactaatgagcatacaggtatggaaggtttggtcggccagataagtccccagctgctctacctggatcatttagaacatcttgatctcagcattaactatttggaggggccaagcggtcaaatcccagagttcataggctctatgaagagcttgagatatctaaagctctctggcattccgttctctggtacggtgccttctcaacttggcaatctttcaaagttgcaacatctcgacctttccgacctggagggaaaggaaggtatgcacttagcggatatgtcatgggtatctcgtctaggatcattacggtaccttgatttatcctttataaatctcagcgcggcttctgattgggctcatgccgtgaacatgatcccttccattagagtactttgtttatctttatgccaacttcaaggtgcgaaccattcactcgcacactacaaccttacaaaactcgagaagcttgatctgtcctcgaactattttgaccacccgtatgcatcttgttggttctggaactcaacaatcctcaaataccttgatatttcatcgaacaatttgtatgatcagcttccaaatgcgataggacacatggcatccctcagagtcattaatttttctgataacgctcacatgggcattgtggaaccagagttgatgacgaacctatgtagtttggagaatctaaacctccaagggagcctctcctatgggaacatgacagttgctcgatagtctgtcaaattgctccaacaaattaagtgagctgaatttagcagacaataatatcagtggaactctgccacctgggatattccaacaatatgcagacttagtcactcttgacgctagcaacaatcagctcgctgggcctctgcccgttgagattggtatgctcacaggtttaaatcacctggacctgagttacaataacctggcaggtgacatcaccgaagaacactttgctaacctaaggagcttaaaatacatagacttatcgtctaatgatcccttgaatattgtggtagaccctacatggatagccccatttagattagaacgtgcatcttttccagcttgcatgatgggtcctcaatttcctacttggctccagtggtcggtggatatttggttattagaaatctcaaatactggtataaaggataagcttcctgattggttctggaccacattttcaaagctcgaagaattggacatgtctaacaaccaaataagtggtgtcttgccaacaaatatggaaaccatggcattgagttatctctatcttggttcaaaccaaataagtgagtggtcaattacctcctttaccgagaaaaattgtaaaattggacgtctccaataactctctgtctggatctctgccatctaactttggagctcaaaatcaacaaatggttacgctgattctttccttcaacaacctatctggccatattccggaatccttttgcagaatggaacagttggccgccttggacttagcaaacaatctttttgagggagaattgcctcaatgtttcgggatga

SEQ ID NO: 42132 - DNA, 1540 bp, Oryza sativa
ttatcatatttgagtgatttggatttatcacacaacaatctatcgggaagaataccatcgggatcacagcttgacaccctctattttgaacatcctgatatgtatagcagtaacgatggtcttttcggatttcctcttcaaagaaattactcggaaggaattgcaccaaagcagggctatcacgatcatagtaaaacccgacaagtagctgagccaatgttcttttaccttgggcttgtgtcaggatttgttgttggcctatgggtggtgttttgcaccatactcttcaagaagacatggaggattgcctatttctctctttttgacaaggcgtgtgacaaaatatacgtgtttactgttgttacttgggcaagagtatctcaaaagacgaatgtacaataagctaattggaaaatttgattagaacgacgtgcgtatgttggtgctgggtcacactaaaagcatctaatactctaatgtggtgtggtgtggcacagtgatgcttgtttatttaattagttctgtgtgttgtatcttaatagggattatacgatattatccttactttccattattactctgtaattttttatcataatgtttgtttctttaagttgctttactaggaacatgttatactgttttttttatcaatataaggcagattctaacgaaaagtaataactatgaaggtagccgtgcgaatgcacgggcatgcgttttaaggtgtgtgtagaaatagatgaaatatcaaccgaatggcacctaccatgtttgaaaagtactttctccggtttttaatagataaattaagttaatttttttatacatgtttgatcatttatattattcaaaaatagcaaaagtgtaattaatgcttatagtacttttgatgataaattaaaccaagtcacaataaaatgaataatattatttatttatataataaaactgaattgtcaaacatgagtaaagaagtcgacggtgtcatttattaaaaaattaaaggtagtccaagttcttcaaaatattttttatcgcattgcttatttttaaattgtttgttaatacatgtgcttatagattaatactctgtatgcctcaaatattagtatttttggactttggtgtgttacttttgactaataatatttaacatttataaaaagtaagttatttcaaacaaaacaagttaaatattatgagaatgtgtttaatgattaatttagtaaaatcatttttacgtgatcggccttttttattttgtaatgccccgattttcgcccgtcaaaaaaatctattttattaagaacctatgtttaaaacttttggttctttgagtgtatctagtttgtgtgccaaaaatctcaattaattcattccttgtcaagtcaaaattgtggccaattttttttcttttcaatatctcagaattcgaattttgtaatttgagtctcccctaaataaatcatcccaaaaatctattaccaatgtccaagttagaatttatttctttgaacctaaaaacctttattcaaat

SEQ ID NO: 42133 - DNA, 15413 bp, Oryza sativa
ccaaacaaatcattagagttcacagtccagttacaatccttttacaagttcaaaattgtttacaacccacgagcaaaacgacagcagacaagcatatccatctttttaattaagataggcattttcacgcatactcacaccgttcacccccttgcccaagcctacacccccaattccttcccccgcactccacctctctgtatcgtccctggccgagtcagccactgtgtcccatgaaacctccactccaggcgccaagacaaagaaggtaggcagcagtggggattgtatgcagtattgttgatgcactagcagacacggacccacactgctactgtatcagcagtactgcaaggatctgcatccggtaggcagcaggcagccaccgagggaagctgtgtagggagaggagaccacaggagcgagtttgtccaccgaccgcgccatccactgtacctacccgcttccgtcaactgaacagggcagctggccccgcttggccgagcttgcctgcttcaccttcgttgccacccaccggtcgtgacagctataaacgatggcatgcttttgtcccctctgtccatttccccttcctgcgaagccacggctctgcttcgccccatgtgccaccactgcctccatcccgaaccgccatggccaccgccatcgcactgatttccagccaatagtttttatggtaagtactacacggtaaattaggagggatatatttattacagatctaatctaatggtgtaaactaatgggtccaccaacttaaatgaaaatcgagggctaaattatttttttctcagaatttctaagattttttttctattttattagagtgccatgtgatagcttgaaattgtttttagagtgtcgtatggtggcatgagagcacttgtagaaagtttaatagacttttagtatataataactaggaaggtagcccgcgcattcgcgcgggcaaagcatttcttcatcatttttctactcagtattgataagatgttttgtgctttactattaatttctaagttttttgtaatttttaaaatgtgacatatggtgacttaatagcgctcggaacttttattgtcaaaaacgtggaggggcattattgtcagaaaaaaaaggtgtggatggtataatcatcatttagcagtgactaaaccttttttcctccttttttggttttttcgatgaaatacgagaaacgccaatgcaatcgatgatcatatatcgatttagctaggaaaaaaatataaatgacaaagtaactcataatcattgtattaataaattactaatttacccctaataatactggtagtataatactaccagtagataggaccggagcatcgatcttaataaaaactatacggccacttattaagagtgtttgtacatgcaggagaaaatagaaccgatgaaactgtcgttgcaagtggaacaattggtgtcatgttgctcagcgacttttgcttgctatgcatgactacttctgcttgaatactcctgcaagttatgaaatgattgttgaaattctatcaaactcttctatatttgacaaattttctaacaacttgtcaatactcaaacatatttgaaataagtggacattcaggttaaaattgaggcaaagtttatgtcacatcctgatttttgtttcaggatttataaattatttaataaattattattagaatttatattaaatgttctttaatttacaagtgaagtaaaatgtgggaaataaaatttcttaaatataaagcatggatggatttaatttttattaaattctctatgattaagtatactctctgaaattttctcggatttttcggagctcaagtcctaaatgatacaaagaacagttcagtaattatttgatcattaataatctaattatattttttaagagcttttcttggttaaaaatcctaaatatataaattgttgtttaattggaattattagaaatgattttaaaagcctagaagagaagatctaattttaatttgttaaatctcaatataaaattgggctagataaaattttattaaatactttgcttaattctataattcctagatttttctgggatttatttgagctaaggaagtatttttaataaatggaattgcatttcatgaataatttaaattgaaaaaggtttttaaaagtctcttttggctttgggccgaaagccggcccaaaacctctctttttctctctctctccccggcccagtcggcccagtccgagccgccgctctcctctctctctcgctgtcgctgacaggtggggcccacctgtcaggttcgtcttcctcgtgccgccgccgccgcccgaaaccctagcgcaagccgccgccgtctccttccaaattcggccgcgtctttccttctccggtgaaatctttagaggggaaatgatcttctcgatctcctcttccttttctcctcttcgtttggaaatcgacggatttgagctcaattcggattcgattttctcgaagtttccttcgcgtcgccggccgtcgtgggccttcgccgccgcctccttgcacctatataaggacccctggtgtctccgctacccgccgcctctctcgccttcgcccgccgtcatgtgtagcgccctagcctcgtgagcttttgcaccgccgtcgccgccgttcgtccagccgtgcgccgctgtcgctacggtcgtcgtcgtcactcgggaaggccaccgtcgggatcgcgaggtcgtcgctgtccccgtccaccgcttcacttccgccgaagaccgccggagcaccgtcgccgtcgtcgacccgatcttctccgccgctccgttctcgtcgccggcgccgtccgttgcttttccgccgcttctttggtcaccggtgagttcgccgcgccgcgctctacgtcctggtgcccttcgttctcgtcgtcgcgccgtcgtttgccggcgagcatgcgcgcccgagtcgcccgagtcgccgccggtgctgacgacatcgctgacgtcatcgctgacgtcatcgttgccgttccccgtgagccggtcgtggaccgattgatctcggccgtccgttttggatagggttgatctcggccgtccgttcccgtgaaccgtcgccgtgcacccggtccaccgcaaaccctagccgctgacgcaataatcctccttttccttttcaaaaataattcattattgcgtcataattcaattaaaatccatataagtgttttaatccgatttaatctttaaaaattcataactaattcattataactcagtttaaggtggttcaagttgcaaaagttatataaaataaagatctacatattaaaattgtccataaattgaattaaatttatttaattctttttaaatgggctttaattagatttaatcttgtaaaattcataataaattcatttgaagtcagaatgaggccgttcaagtctcataattcatctaaaattatgatctacatgtttgtttactttttatgtattgtttatttggtttttattagtctttttctttgttttgcgtgttagcttgtcgtttccgtcgttgcgaaggttcgtgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcactgggtggtgtaaatctattcctttgttatggcccgtttgcattgattactttatttcttgataccttgggttattataacttgactagttgggctttatatatattggttcagctagatattagttatgattgcttagccatgcttagaaacattagcacactattgggataacttatgactcattattatttaatgatggcttaatgatagttcacgatggttaatcgtgattggttaattaattacttgccaactaaaacttgataacggtgggttgtgagcacatggttttgagagtcgtgctcatgacaattaaggaccggttcgcgagctactgttgtgaaacattaatcgtgccaaccacaagccagcgtgggcaacggctttaccttttatataacatggttcattgcggagcaccagactgagaagtggcggagataagcccacgggggtcgctggggagtccatgccttgttttataagggggtgattatgatccaggaatggtgcactgtggtgagttgtgttgtgcgaagggtattgtcacgatttccccctttgcagtgccgtggtggtacttcggggcatggcaacatgtgtgaaatcgtgtcttgtgggtacagtggtacacctctggccagagtaaaactattcgaatagccgtgcccgcggttatgggcgggttgagcaatgtttttcgtgattagtctcacacctctcacaataattatagatgttatacctggtaataatttgcttagctcctggtttggagattagatctgtacagccgggtatggttgttcaggatggttgggcctgtgcagcatgggtatgctgttcggtgttgattaaaatttctgattaattactccactgttttacttctcttaaatgttttgctaaatgctgcttttgcaaatgagccaatattatgccatcctttggtatccttgtgcacttgcatatttgctgtgtggcttgctgagtatgtcatatgctcaccttgcaataatcaatcaacctcagttgaagaaaaaggatccagaaggagaagacgtttggcttataccccagttgagctgtctgtgggagtggagccggagcttcgctagattttattttccgctgcagttttcttcttggtgaggactaagtgcctcttaagtaagtatttatcgttttagtaaatttgatgaatctgtatattaaattgtcagtttgtgtacctcggctgattcctggacgaggattttatgcacaaataagttcggaaattactagtgaatttccgggcgtgacagtttatgtcaaaacgcttggtataaaaagaagggaaaatataactagtgtagaaaagtaagggaaaaatataactagtttagaaaagtaagataacccttaggatgatttaacagaccggagatagacctaagcttgctttcgtttgaaaacatgatgccattcccagtgggaggtgtcacttttacgttttcaatggtgtcacataagtaacaagacatttaattgatgattaaaatagctcatactcccttctttcacacaagttagacatataacttttgtgaccaagatcatgtagacattaacttatcttacatgtaacaaagatatacacgcatgcaaccaatgagtattaagattactcctcgggttttaatcatcaaacatttaatttacctctccatttaagttttggattcatacatagaataacttttttggaaaaactaaataaaatatgaaatatatctaactcttgtggacggagagagtactataatacggttttatttttgttgttttataggtagtacatgcaagatacaaaccgtgtagacattattttatttcatacttcattaattttttaccacactatgaaaatattgatacgacaccctatttaatgagaatgaaacttccactaaaaatggcctaaaaagaagtggtaaaagcataaccactcttaaaaataggaaacataggagttgaggtcctctgcattgaaaaagaaaatgcagagatgctacagtacctttcattgacgcatggtttaatctgttggatcttcatcgaatggtacaaaccatcttgctataatacctcactacagtaaaaaatacccaacagtatggattactgttagaatactgtctctagtgtgctaatagaaatcactgtagcgcgagactcggatcactgtgcaaacagtgtcctcttccgttactgtaaaggacctgcatccgtaacatagttgcccacgccaccggaccgctgtaatccccagctgccttaaaagttaaaattagcagcttgaggcctggagtgtatgctctcctgcgtgatgcttgcaacttgtgcatgaccgagatcgaccgatcgaggccctttggaactgaataagttatcccatccaaatgaactaagtcaagtcaactaagtcaagtcaacgatccaacttgtacttgccaaataatgggcatctcatctcgatcggccaatgcaaagccgtcgatcgtatcagtcacggtgcgcagtagggccaactgataattaaaccgacggacgatgactcagtcacacaagaaccagtccacccgaggatttaagttctaaatcggacagcaagatgtctgatgaatttattaatcttaagatataatggtcgctgatgactttattaatcttaagatgtaatggttcaatgtctcatatgtgcttataatggtaggttgtacgtacgtgcgtttgtgggcacatgtgttcctactgtgtttttaaaagggaaaaaaaatattggtcttactaaaactgaatatgacatatcttaatacaataaatttgaatagcaattggtatatgtcatatctggttttagatttattttttgtgacatagggagtacttttttttttgcgggggacatagggagtacttaacaagagctgcatggctgcatatccgcttgcttccacagttccacttgcatcttggagccattcacacgctcccaccatgcatcccaagtcatcctgctgttcttcctcatgatcggagcattgctcaccaatgccatggcaaaccatgcaccggctccagccgccgtcaactgcgtgccacgagagagggaagccctgctgccttcaagcgaggcatcactggcgaccccgcagggcgcctcgcctcgtggaaggaagacgaccatgactgctgccggtggaggggcgttaggtgcagcgacaacctcatcggtcatgtcctcgagctccacctccagagtaacctcaccggtgttgtttatgtagattatagccctttggagttcaacgcggtagctttggtcggccggataacgtcttctttgctttctctggagcatctagagcaccttgacctcagcaacaacaacctcacggggccggatggccgtttcccggtgtttgtggcctcccttcgcaacctacaatatcttgatctctctggtttgggattcactggtatggtgccatatcagcttggtaacctttcaaagctggaatttcttgacctttcgggaacaggtatgcaatcagcagatatatcatggctaacacgtctacaatggttgaagtacctttacttgtcatcagtaaatcttagcgcgatatctgattgggctcatgtagtaaacaagatcccatcactaacggtgctttctctctctggttgctcacttacacgtgtagaccactcgctcaaacacgtaaacctcactagacttgagaagctccatctctctggcaacgattttagccaccctttgtcatcttgctggttttggatcttgaaaaccctcatctacctcgaccttgaatcaaccggtttatatggtcgatttccaaatgcaataaccaacatgacgtccctccaggtcttggatttttcaagaaacaataatgcgggtattttggaaccaattctgctaaggaacctttgcaacttagaaagtctgaaccttcaattgggcctcttgtctggtaacatgacagagctgctagagagtttgagtcattgctcaccaaacaaattgcggaaattatatttgtccaacaacaatattacgggaactctaccagctcagagtatgggccaatttaccagcttagccaatattggtttctctttcaaccagctcacagggcacgtgcctcctgagattggtaaactagctagtttgactcaccttgacctaagtgaaaataaattaacaggaaccatcacagatgaacacttcggtggtctagtgagcttaacatacattgatttatcttacaacaaactcaagattgttatagaccctgaatggttaccaccatttaggcttgaaactgcgtattttgcatcttgtcaaatgggtcctctgtttcctgcctggctccggtggtcatccgacattgatatgattgatatttcaagcgctaatataatagacgagtttccagattgggtctctacagcattttcaaaggccatatatttggacatgtctaataacaaaatcagcggtaacctgccaaaaaatatgaaaatcatgtctctggaagaactctatctaaattcaaacagaataatcggtgaagtaccaacgttgccgacaaacctcacctatttggacatctcaaataacatactatcagggcttgtcgcatcaaacttcggagcgccaagactagatactatgaatctatcctcaaacagcatccaaggccagattccaagttcgatttgcaggttgaaatatttgagcaccttggatttatccaacaatcttttgaacgggaaacttcctcgatgcattgggatgagaaatcttcagaagcttctactaagtaataataacttatctggcacattcccatctttactgcaaggctgcacactgctacgttatatagacctatcatggaataggttttatggaagattaccgagttggattggagacttccaagaattagtttctctacaactgaggaacaatactttttcttggtaatgttctttcactgaacatagcaagaattactctatgtatatgttaggtgcctcaaggaaagtagtcgtattcagaggtacagcagcgttgatgagaatgccgtgccatgttcaatgatgaggatcaaactgcttatctggtttgggcctcctgaaaatacttgcatcaaagcaactatataataaagttagaggtctgtcagtaaccttctgcaatggagctcaagcttggtataatatttgctattgtcttccttattcgttgatgtccgttgttagtttctattgtaagttagctgttaatacatgtacaccttttgtctggtggtggtgtgaaaggagaaagaacaagatgttgagccactgaagagatttgctctggtcaagcgaaaagtatctcacggtacctcaatgcactttgagaccaaagatagtatcgtctctcctacctctgcagttcggctgccagcgcagttggaataatttctcgtttactagagttattcttcctcttctaaggaaatattagaaactaaattatatatctaaccttttctagttagcacatggcccatacttttaagtacctttccgtaggtatcttttattatagttttttaaaaaaaaataaaacatttttattgaatttgaataaattataaccaaattcacaaatatttgaaaaaaatccaaaaattttgctcgaaatatttgcttgccagaggaggggggtgaaatttccatccctgcacctcccttgcgcactgctctcctcacaagagctagctctgtgaggctttcggctaaggggacgaaaactggagattgccaggaagagaagaagcaagaagagaacatgaaggaggaggagagggaagaaggggtgctgaatgccatgccactatggatgggaggctgagtcagtgtgccaacatacattcagcgccatgctatttggcactgaggtatctaaattcagcaccacacgatttggcgttgaacaaaagggtcagtttttaaataagttttgacggcggttcacttgtaaaattagtttttgcaaagggtcaaattgtcaaaatttgtgtgctactcaaaatttgtcaaaatttagctagataataccccgcgcgttgctgtagtaataattgagaaatttcaaattttcaacatgagcatagaaatatttgagtagaaagaaaactactccaatataattaacttcctaaaaactttattgtagtaatagtaattatagattatatgatgaggtaccttgttaagccgctgatcggatagagctagtactggaaacaacaaaattaaaggatgttcactcagtactgaagaatgaaaaatatacaccatcaataacattatccagaattatatgtttaatttctatatgaactaattaagcctgaaaggataggtgttgtactgggattgattttctcgttgacttgatagccttgtattttgcatgatatcattccatggtacaaccctccctcaccgatccatttagcacagttttagaacctctgcagttaatcttgtaatagaatgccaatcagttcatgaataaggtgctagaataacatattttactatggtaagaaatatgcatttagcaggaagtacaactatcatataaatacgccaggaatgtgcagtcaaggcatgtatcaaacctggactatgattaccatacaattaaaaaaataacaaccataactaaaaaaactaccattttatatttatacatgtacatagatagtccaatctatctattatatactaaaagttcattaaactttctaaaaatactctcaagacaccacatggcttactacaaacgctcctaagtcaccacgtggcgctctaataaattagaaaaaatcctagaaattttaagaaaaaagaaaaacatcccgccattggttttcacttaaatcagtggacccattatttttaaccattggattaattttaaaagaatatatatatactcaatccaacctatgggtttatacttctaacgttccccctcagtcataatgggagcgaagcgaatgattgtgactggatttaaaatcttctatttcttcatctttttcgactcaccatcatcgattgcatctctgacggatggtcctccacctggtgcctgtgtccccttctgtgtcgtcccttaactctcctctttttttgttagaagtatagatgttagttagagataagagtcatatacaaatatagagataaaatatatcctagagataagatagagtcctagagatagaatcctggagataaatctactcttacttgtattatactctaagtctctatctcctatgtactcctatatataccctatgagagggtcgatgtaatagatcagaaaacatcaaaatacaacatattaaatttttacgcatggtatcagagccttagagactaatgtcggtcgatccccgcatcaccctggggagatgagatcaatcctataatctcattggggtgccacatctttagatgccacaaataatccatagattagattttactaggattagattagatcaattccttcattagctacatagaacctaccaatcctcccgatcagatcaggaaccttgtcaacaacacaaccgtcttcgctgatcctacatcactagtagtcttcatcaacttgctgccgccaacttgtccacatagatggacaactcgcgtcctctacgacggcaacgaccgcgacaccgatggcattgatcacatcatctataatgacaacgactacatcaacactgcatcaccattgtgatgactgccacacagcacagaaggaccaaccaaattggtggcctcatcgccaacgacatcctctgatatatgcaagacgtcctcaatagcattcttctgacatctataagatgcaagatgctaataattacattttcgtcttcacaccatggcgtaaatttttttttcgcctttgactatgtgtggctacacctacaatcacggctactgcatgatcggttacatcgactaatgtctacaacaaaaatcattgatggcaactccagtcaaagcgtcagtgttatcgctatcgtccatgacactcccgctatgattgcggaagggaatagaggagagtcacgggacgacacagaagtggacgcaggcaccaagtggaggtctgtccattagatatgcaatcgatgatggtgagtagaaaaagatgaagaaatagaagattttaaatccaatcgcaatcgttcgcttcactccattatgactgaggggaaatattagaagtatagatgttagttagagataagagtcaaatacaaatatagagataagatagagtcctagagatagaaccctagagataaatctactcttacttgcagtgtattctaagtctatatctcctatgtactcatatatacgtatataccccatgagagggtcggtgtaatatatcagaaaacatcagaatataatatatattatatttttccacatgatggacctccacacgtcacagatgagttacgttattactaaccactgatctgtgatgaggggtctacccgtcacagatgagggattaagcccgtcacagctattttgttctggcgtagtgtaccgcggccagtctcacgaagatcaccactaaatgtgcatcctccatgtgcagcacgacggcggtggcggaggcggcggcgctagcccatgacgctgagatcgaggtgcgcgggattcttggcaacaacgtgaagaccaacttcaaaattctttttaaaatataccttttttttattggttttgtataaatatgctcatctctactactttaaaattttatagtggtggcggtgactccaaccctaacagacacgtgtgatattatccgttggatcgggacatcggacggtgctgagatcccatcgcacgcgattcacttttcttccctcccccgcatcgcgcgtgtggctccgtcgcgtctcagccggcccacgcacggctccgccgcctccgtcggccccgcgcacccgccggcgcacgcgtggctccgtcgccgccaatggccgcgcaagcctgcgccgcgtccaccacctccgtcggccccgcgcacccgcgcgtctccgccgactcccgtggacccgcgaggctccgtcgcctccgcgtgatcccgcgcgcctccgccgactcggtagcggctcccccggctccgctgcctccgcgcgggcaagccccgcggtcccctttgttgcgagttgccatccccgcgtcgacagcggccgaagcggtttccggccccgtgtggttcggttgcatgcacatgcacttgattcccatcctgcgagtgtaagtgacatgcacgggcgcatgctgcatgcatgtgcatggcactgttcatgaggaaaaaaaaggaggaagaagaagaagaaggagaaaaggagacaagaaagacagcacgacttaatggctgcggaagcggttccgtgtcgtgcgtaatcgctaagcggcctacgccggcctcgctgcgtgaagccgcccccgcgcatacgaccaagactccgcgggcgacaccctccgccgactcacgcccggcgctggccccgtgtggcgcgttttgcctccggctcggccccttccgccggaccacgtcacgacacagaggctcgcgcccggcggactccacagtccttccgctggccccggacagctccgccggtcacgccggccttaaaagccaagctccaccggccacacgcggcttcgcgcggcacccccggcactcgccttcgcacactccggacggcgctgcctccgtcgagcaccgcggctttcaccgctagagggggtggactgaccttcatttctagcgggctccggacggtggtacctccgtcgagcaccgcggctttcaccactagatggggtggaccggactccacatctcaagagctcaagatggcgccgccttttcagtgtggtctttgctgagcgtgagggtatccgatgcaaaatgcaggcatagatcaacaccctaagaaacaggggctggaaatcatctgctcccccgaacctcggagtcagcagatgagggggtaatgttggggaataactccatacttaaggtgttgtataaactaatgtataaaagattaaaatacccctaggagaatgttgtatatatgtagccaatcaagggtaaagatgtaatttcccgttacatatgaataaaaggagtcctgcaaaggcaagagagagggatctctcccacattccatcgattctctttctctcttcattcactcttgttgtcctcacagggctaagcttgggggatcctcacagggctaagcttgggggatgctctagccatacatgttggattttgttccaacacctacattgttatattgttcaatatatataaagaatatcatttcacctttttatgtaatatataaacgatatactttattaaacccgttgcaacgcacgggcacctaactagtttagaaaatatttacagaaatataccgttgttgccaaggatcctgcgcacctcgatcgatcggcgtcgtgggctagcgcctccgcctccgccgtgtgctagctctgccgatccataagcagcagcccccgcaacccagctccctggaaaccatgcttgctcaatgccagctggccaattttttcaccttgtcaggacacctgccgctgctatccttacagccacgcagtggtggacactcatcgacggcgcggaagggatcgcctcctttcacggtgctgatggttggggatgggaaacactccatatcacaattcttgtttttttagaagggtaagtatcttctacaggacggcctttacatcgatccaacaggatatatatagtcttttttaaattaggaacttatattagcctatgaagtagggaacttagccctcaaataactttttttagataatggaaatggattacatctccggcttctgtcataagacacatagccataagtttaatagtaataaaaagataaaggtaagattaaatcaaaatgagaaataaggtgatgggacaaatacccaacttccctttattattgactagagttaaaccaatttttagctagcaattataatggaactacgccacccatagtggaataagagaccctttggctaccgattacaagagtatagcaccattgcacataatttcctgctcctcctgtagtagcatcgtaaccaaaagtggagccagtagaaagacatgaagataacctgcatagggttagataattgtttaccattaaaaactttatcattacgacaacgccaaattgaccaacatacaacactagctccaattagaatcatcttcttaatggacctagatacctctctaagccaattaccgaaaatgtttttggcgttacggggtaggggatattaaaagcaaaaaacacacatctccaaacaaactgagcgacatgacactcaaagaaaagatgttggattgtctcttgtgcatagcagaaagaataatgtttgcccccccc

SEQ ID NO: 42134 - DNA, 12844 bp, Oryza sativa
ataaagctagcatatatctcgattcatttatgaatcaattaaaaccctaaaatattttatattgtgaaatagatgaagtaattaacaacatatttgcgggcacattcgcagatcatgaaacaatttcttcgcccaattgccactgtggacggagacgtgatcgggactagtatttttttaaaaaaaatcgtaagttacatattttctgtgggcctgttccggtcaatgtcacaaatgttaagtatgcatgcttaggtgcatatgaatctaagaattaattacggcgataccttatatattgtgattcattagatcattaagcttcctttagaaagaaaaataataaagagcagaacaatagagaaaatacccgttgtactatggctgtatatatcatagtgcagtcctcaaggagctaatccctgttccgtgtgaaatgctgggtacttctgaaattgaatcggagctggagttgtagatcgataagaatgccgctccacatcacaagttcaattttctagagcgatccggtctgatcggctccatatttttgtgaagttagatcgtttggttggattctagctctaggaaatatgaatctaggagctggagttctgtcaagtagacccgttgttcagtccgattggatgggccgcacgcgtcatgcaatcccgctttggcccaaccatatatgtggggacatgcacgtcccagacagtcgtgatccggcccaaatgttatgggcatttcaaatgaatccctgtattgacccaatgagctacataattatttcggtcttcagacttctaaagcttaaaattaaggttaaatactcatttaacgctatatgtacaagtaccgtgcatgccgattttctagttggactaacttttggttaaaatcttcctagacagaattacaccttataaaaatcatcttgtttggcaggcaaccaaaacacagctttctatggaaagctgcactcagctaggaaagcatcaagcatgcactcaagatatatcggcctaattaatactccctcctttttaatgtatgacgccgttaactttttaatcaacgtttgaccactcgtcttattcaaaatttttatgcaaatataaaaatacttatgttatgcttaaagaacatttgatgataaatcaaatcataataaaataaaatacaattacataatttttttaaataagatgaaaggtcaaacgtttgttaaaaagtcaacggcgtcatacattaaaataaaatacggagggagtagtatatcttccaaagtatttataagggtatggtaaggtacatgtatgtgtgtgcgtgtttatatgagtatcgtgtctatttaaataataataatatatctgcgtatgccatggggctcatggccatggatttatcaaggtataccaaccctagtcaagtctagcactttgtgcgtatgtaaagcgtcaacaaagcaaaaccactgccatcaggcgcagtgcctaaatacaataaggttattttactatagaaaagcacagctgtgggtgagtaactattggtgccaagtaagtgaagagacctgtgagtgagtcaacaagagtcaagagacatgtatacatatatgtgggtcaacgtagcgcccgttccgtcgtggcgcctagcgggaaaattatcttttaaaaaccctaattgcgaaattatttcttgcttgttgtctagtgtccgtgccatctcaagatctcaaatccccgatctatcgtcgagttcaatcccgaatccaaatccttccaaatcaatttctccgcaaaagtctattttgcctcccccagggtcgatgggccaaatttctctcggcccatctccccccttcctgccggctatctctctctctctctccctctccccctccccctccgctccgcccgcgcaccgcgcgcgcgtgcgcgtgagccgccgagccgagccctcctcttcgctccctcgctgctgctccccgcgcgtcgttcgcacgcgcgcccgcgtggtcgtcgcccgcgtcgcgcctgcgccgtctgcgccgcccggccccgctgctctgccgcgcctgcagccgctcggccccgcagccagcgcgcgtgcccgagccgcgccgctcaatccaccgcgcctcccgttgccccccgcgcgcgcgtgccgtggtggccgaccgcttggtcgccgcagccgtcaccctgtgccgcgcctgtcgctcgtgtcgccgctccgctccaaaccgtcccgccgtcatcgctgtcgtcatcgcctcggccccgccactccgcgcgcaagccaccaagggacggaggcagagcccctcctccctctgccgcgacgccccgctcccctcctccttttcccaaagcggcaaggaggcaaacccctttctctccctccttttcccctttttctcccgctggcgtcatcctccctccgtcctgtcgccgatttggccgcgagcgccgagcgccagctcgcgccttgaccgcccaaagtcggtttccaaaccgacattgccgcccttaaaagccccaggcgccctcccttcctcttcccccccccttcctccccgtttctcatctgcgccattgccgccgcccccgtgctctgttcgccgtcgccgttcgtcgttgcgcgtgtcggaggagccggcacgagcaaggacgcggaaggggactccgggcgcgccctctccttcctcttccccggcccgaggccggagagattactcccgcgccgtcggcctctcgtcactgcgcccgcccgcacggtagagcatctccccgttctccctcctcgctcagcgtagctccgcccaatccgacgctagcatcggattcccgtagccgcgtagatgctctcgccgccgggaattggcccctcgtgacctcgtcgtcgtttcccccttttccctccgccgggcgccgccgccacaatccgccgccgacggactccctccggcgaatccgagctattggctcgtctcccctcgtcttgtgcaactacccggtgtgctcgctttcgcctgtatcgccatggttcgctccgccgctcgccgctgtcgtccgccgtccgttccagccggcgtcgtcgtctacctcccgccggcccgcgtggcagctacgtaggcgccacgtcggcgccagtcagccaaagacctggtcgagccgaccccggtcagtccatccccgtgcgcgcgttccaccgcgagccgtgaggctacgcgtgggcccgccgcatccgcgtcctccgtgaaccgcgcgcgtgcaccgcgtccctcccccaccctagcgccgcgccgcgtgctccctccgcacggtgaaccgtgtcaccgacaagcgggtcccacccgggaccacgcgtggtgagtccggtccaccggcgctctctctctcctcccctcccgcgtgcgcgcgtcttgggtcgccttgggccggccagcccatttagctcgaccgtaccgctccatttctcttgggccgcgccctagccgcccgagaaaagtctatattcccttcctcttttcttttcttttcttttcttttccaaaaaggatttaattaaatccttttcctttagaccaaaaatccaataatcttagaaattcaatatcttcccaaccgtaaatccgtttgactccgttcaacttccaaaattcctcaaatctcgagatctatctaatggcacgcttagaggtcattaatagggctttattttcgccgtttgttgagttgtcccgtttcacgtgtagtttcggagcccgaagacccgcagtgcgaggatttcgaggatcaagctccagatctcgagcaaggcaagccacctttgaacatcttgagcctatatttgaaatttaattatgttgcttgaaaaatattatgcattgataggatcgcacttaatctgtagtcccgtctgcaaggcagatcggcggacttacctaatttgttgcatttgatccttcctttgctaattgatataccatgtccccttgtaaccatctagttgcgtctcggtattcgtgcaccctgtgcgagtatcgacggacgccttcaaacttaaaattctgagtaacttcttgggtaaaacttgggttttacaaaagacttggaaaacccgacacctgggtcggtgcttgcgaactaaatgaatttccaaaaccgcggaccggggaacgtaccgggtgtacggtttcccgctcttgcacttaaggaccgattccttggaatttcatccaaacataagtcaagtacgaccacatgggtggaatgggacacccctggctgagtaactagcttatcaggggagccttgatgccgagagacatgtggattcgccggggtggtgtcggggaggactcctgggcttcctggcatagtatggtctgggacctaacctgttgttggtctgggacccctctcgtcggcatatggtaaacctttgttggctttcgaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggcggaggtgaggtgattcctagcgtagttttgattgactactgcttgtgaaattgctgttgtggaaaagggttcgatgattgaaaaatctgtagctgatggaattagctaggcccgggtggccgtttgaaagttgttggcccgggtggccgtttgaaaagctgttggccgggtgccaaccttgattcaaatctaaagactgatacattgcacatactccgaccggacgagacgcactgtctcatccgtgtcgtttgagaagcactcacttagttgacttcagaaagagttcaaatgaaatcaattgcaaaaacaacagcctttccttgaagcctgcaataaacacctatttcccatggcttgctgagtactcctgtactcacccttgctctatataaataaatcccccccagttgctgaagaagatgaagcggatcccgctgatgaggagttcttccaggagcaagccggctacgatgagttttagggtttcggcctagttcccaagtcgcgcctgtgttgtttggtccaagtcctggcttccgtttcccttttgtaatgcagttgtgagctcgggatctgtccgcagcccaacatgactgtacctctactctataataaagagacctcggttgctgtgataatctgtcttcctgtgataccagcactgttttctgggactggtatcgatttacaggttaatttggagcgtcacgggctagttccggtcggtactagttcggggcgtgacagtcaataacagggagttatggcaaatgatgattttgttgatctcaacatatgttgacagttttctagagatgctcatatatatgaataggatgtgtgtgtagtcatagagatgagtaaggtggtgtttgaagtgtttcatgcaaaacgaggtggtaataacatgtgattaattgagttttaattgatacaaacttgaaaatggattgatctgatattttagaacaacttttatatagaaagttttcgcatgaaacgcattgattaacagtttggaaagtgtgccacgaatatctaaaactttatccactctctgtagtagaaacaacgaagccaagcgtctgcatttatattatgtttctaaaaaataatttgaaaccttgactataaatttttaaataacaaattgtttgcatagatcaatttgtcttaaaagtattatcacaatatcataaatgtagtatatttcatatacttattttcatataaaatagatctaagtttgacaaaacaaatcactactacaaaaccatctttcgtggcggccattttaggttttcgctagcagaatttggtaccgccataaaccaaaagccagtgaagatcaagatcttaagccagctgccagcaaagatccattttcgctggcggttggattaagacggccgccagcgaaaataaattatcgctagcggctgtgttaaatcggccgccagtgaaaatctattttgggccaaaaaaaaatacccatgcagctgcccagccgcaagcgtagatgatttggagaaaagcccattgattcattttcaaaattcaaatccacatctagagatctagattcgatgctcatttccaaattcaaacatgaaatacaaaatcatcatttacacagatcaaacatcatttacacagattaaaacatgtgcatcatctggaacaacatgcaaaaaaaaaattcaaatcgaagaggagggagctgggagcatggtcaggacggcgtcatggtcggagaggagggagccgggagcatagtcgacggcgtcgaggtcagtgccgccctccccgtggtccggcggtggcggatccggcctccccgcggcctggtggcggcggatccgtcctccccgaggcctggcggtggtggatccggcctccccgcccgcgcccaagcgctgccgcccgcgcccgaactcgtcgccaccttcgctgcgcagtcctccgtcacccggcgctggaggattggaggaagagagggttggagggagagagggagtggagaaaggaggaggagagatagcataaggacaaggctggtgtgggggcggtcattttatagcgttaaattttatttcgctgacggtgttgttacatgccgccagcgaaaatcggacgccagcgaaaacccgatttttttatgacgggcctcttagcgccgccaccataaaatagagctgttttttgtgacgggcctcttagcgtggctgccagcgaaaaccgattttcgctggcggtccgtaacccctcacctctcgttacatttttcgtgacggtttttgcctataaccgccagcgaaaattatagggcaacaccataaaaaatctttttttatagtgaattaacccaatcttatcctaaacggcaaatatttatgaactgattttttggatggttctactaagatgcaaatcgaccatacaaaaccacaaaaaagcacgtccatcttgcatttcatgtttagcatttaacttaacaaattttctacaacaacacacggggatttaacaattatcttgtaaaattgatccaaccaagtgtagttgttgatatttcctttttttttataatacagaaccacttatattgaattaattattcactactacaaaagtgatttttctgtacgagaccccttcatttttgcaaacagaccataactagtggcgtctgcaaaaatcaagcggcattttcgcagcggctccttaagacgcccgtatggaaaaatcacatatcttacaaaatttatatatatctctcttatagtttataaaacaatataagagatatgtacattttgtgaacaatcttacaaatcactttgttggatgaagaaatgaccaaaataaaagttatcgatttcgatgagttatacaactttgttatagaagaattttccatttgaaatcatttagtatttgaaaatgttgtttgaaattgtcatcatttgaaattcaaattcaaactgtcgaaacaaagtcatatagaaaaatgaccaaaacaaaagttgtagatcttgataagttatacaactttgttgttggcaatttttttcatttcaaatcatgtactacccgaaaaattatttgaatttcctatattttaaaatttaaattttatatagttcaatcaaactcggatcgcgaaatgaccaacagaaaaattgtagatctcaatgagttctacaactttgcttttgacaactttttcacatgagttcatttagcatctgaaaattcgactcgaagtttatttagtaccaaattaatatttttaataattattttcgcatgcggacggttatgtggtccgcatgtaaaactgccggcattttttcactcctcctctctctctttccctcctcaccatttcaaaatttttcaaccaccccatttaatttctctctctctctttatctcctctctctccctctctctttctctcctctcctctcctctctctttcttctctcctctcttctcatcgacagcgggcatgggtgcacggcgatggcgtcggcgggcagcgagggcgaaggatctggtggcgccgtcctcgggagggccaatccgtcaccctagggaggagctcagcgctcgacggcggacggcgggcggcgggcacggtgatggcctgcggcggcggatccggcggcgccgtccttgggagggccagatccgccgccctagggaggagctcggcactcggcggtggatctggggtcggcggtggcagcggtggtctcgggcgacggcggcagcggcggtcttgggcagctggcgacgaacggtggcggcggatctgattggagcggatccggcggcgccgtcctcgggagggccagatctgccgccctacggtggagctcgacgctcggcggtggatctgggggcggcggtggcagcgacggtctcgggcggtggcggcggcggtctcagcggctggcgatggcgacggcgatggcgatgacgagagcagaagcggcggctgtgacgatctcgcgtgggcggtggcgctaggttttttttcgtttttttatttttggaaatttttttcgcgattttttctctttgcatgcggtcggcttaagcgcccacatgcgaaaatccgattttcgcatgcgggtgccctggccgcatgcaaagatttgcatttttgcagacgatttggcgcatgcagttggcgcaactgcatgtgaaaatcgctccggcccgtttgcgaaaacggtttctgtagtagttattgagcaatcaaatttcatgtaaaaccctaggtattatagtttttgttgcaaaaaatcatagaaattttagcatgtgatagataaccacatgcaggtatagtttcacaaaatcatgctattaatcatttgttctttgattcatgatacttctgaaatcaaaaatcaaatctcaaatttatggtttattcgatccatcacataagttttagcctctaaggtatgctttttttatttttctacaataacaaattaaatttgattaacatttttgtttttcaaactataaaatcatgatactcgggatttatgcgtcacttgtggctttgctaacttgtaccataatacgcgcgtaggtttatgaaatacgtaccctttgatggatggttgacctagggtttttgttagatgacagattgacagtccttgtttttaaatactatacataattgtttgtagcatttagatagtttatctaagtacatacagaccgcaaaaaggctattagacgagagcgagactaatccgctagccatgacacagacagtgtcagctgtttttgaaacttactaaagttgagctatagtgcgttgggtaaaaaaaaaaaagcatttgtgcctccagctttattctatacgtatacgacgactgtgtgtgtattattattaaagttgacctactacggggggtgtttagattcagtggtgtaaagttttaacgtgtcacatcggatattatatatggtgtcgctgaggtgttcgtgtactaaaacaaaaactaattatagattccgtcagtaaaccgcaagacaaatttattaaacctaattaatccgtcattagcaaatgtttactgtacgtagcaccatattatcaaatcatggagcaattaggcttaaaagattcgtctcgcaaaataattatttttaggctatatttaatactttatacatgtgttcaaacatttcatgtgacagggtgaaaaaattttggttggaatctaaacagggcctacatacctaaacaaaaacttgagccaacagttttttttcaagaataatcatttttacctctatatatattgtgactttcatgatccaagctagcctacccagtatccaccatggatcctacacagaagttccttctcttcctcctcgttggagtagccgccaccttgtcccttgcaaccaattcaccggtgccgcagtggccagccagctgcacgccacgggagagggaggccttgctggccttcaagcgaggcatcaccggtgatcccgcaggtcgtctcacctcgtggaagcgaggtagccatgactgctgccagtggaggggcgtccggtgcagcaacctcaccggccatgtccttgagctccaccttcggaataacttcccgcgatacgacgaagcaacagctttggtggggcacataagtacttctctgatctctctcgagcacctagagcaccttgacctcagcaataacaatctcgtgggtccagccggccgattcccgcggttcgtcagctctctcaggaacctgatatatattaacttctctggtatgccattaacaggtatggtgccgcctcaactcggtaatattacaaagctgcaatatctcgacctttcccatggaataggtatgtactcaacagatatacagtggctcaccaatctaccagccctaaggtacctaggcttatcaaatgtaaacctcagcagagtatctgactggcctcgtgtggtgaacatgaattcatatctaatagtactcgatctttctggttgctctcttacaagtgcaagccaatcattctcacagttaaacctcacaagactcgagaagctcgacctctcctacaataattttaaccaacctttggcatcttgttggttttggaatttgacaagtctcacgtaccttgatcttataatgaacattttgcccggtcagtttccagattcactaggagacatgaaggccctccaggtcttcagattctcgagtaatggtcacagtatcataatgccaaacttgctacaaaacctatgcaatttagaaatcttagaccttggaggcctaagttcctgcaacataacagagcttctcgatagtttgatgcattgcttaaccaaaagaatacggaaactatatttgtgggacaacaatatcactggaactctgccaactggggtgggcaaatttactagtttggacactcttgatctctctcataaccaactgactggatctgttccatatgagattagcatgctgactagtttggctaagatcgacctaagcctcaataacctgacaggtgaaatcacagaggaacacttagctggcttaaagagtttaaaaagcttaaacttgtattataatccctacttgaagattgtgcttggtgatgaatggttaccgccctttagactagaggtggcgagatttggatcttgtcagctaggtccaatgtttccttcgtggcttcaatggatggtgaatattaaagaacttgatatttggagcacaggtataaccgatcaacttccacattggttttggacaacattttctaaggcaacagacttagtcatatcctccaacaatatcagtggtagcttgccagcaaatatggaaaccatgtcactagaaagactctatttaggttcaaatcaaataaccggtgtaataccaatcctgccacctaacctcacctggttggagatccaaaataacatgctatcagggtctgtggcatcaaaaacctttggatcagctccacaactaggttttatggatctatcctccaacaacatcaaaggtcatattccaggttctatctgcgagttgcagcacttgcaatacttgaatttagccaacaatcatttggagggagaatttcctcaatgcattgggatgacagaactacagcattttatcctaaataacaatagcttatccggcaaggtcccgtcttttctgaaaggttgcaagcagctaaagtacctggatctatcacagaataagttccatggaagattgccaagttgaattggaaacttctcagaagtacaaattctaatcctaaacaacaattcgttctctgggcatatcccaaccagcatcaccaatcttgcaaaacttgctcggttgaatctggcaaacaataatatatcaggcgtcttgccttgacagttcacattttcagaggcaaggcgacaaagagaaagcgtcatgttatatatacccttgatacccccatggaagattaatactacagtttgtatgtcggcattgtcgttgaactacttgtatgctatgttaactgcagagaaaagttagatttccatctactacctacagtcttgggcttgtgctagcatttgccgttgtcctttatattgttcccatccatatgttgtttcctctgtaaactactaataagtgttgcttaattattgtaatgaatgtagaccttttctcacttctcattgaaactaaattaagactatggatggtaatgggctgatggctagagaatagatcagcatagcaaattactcggatctcaatacaagcatgaacaaatgagaccattaatacacacggttcagctcctgaagcttcctgagagcaagtttaatatagccaattactagctccaattcatatatagccaatctaatagctcattcatacaatagttacatactacactatcaatacctggtcccacctatcatacacacactgtgtcttggagtccgtgctacaactggctacaaatctgtagcccgctgcccttctctctcctatttatctacttaaaatatgtttgcagctggcttatagcctgctattgtacctgctcttagactgcttacacttaaaaagcagagcagtagacaatttaaagcattagctgcgatgatagcctattaatattgcagttcattgg

SEQ ID NO: 42135 - DNA, 16768 bp, Oryza sativa
tgcacgctgtgttgcgatgagatagtgagccacagacttgtacccaaggctgacaacctgcatgaagggaaaatgcttgcttgctcagaactgttggatagattactacattgtttgtgaaatagagtagtaagcaccatcttacatatcatccattatttagtttcttgtcctaccttgaaagtaggacaagtaccacaaacaaacaaaagtgaacacatgaaattggcattttgtgcttccaaatgtaaatagatcatatcagtaccttcctatacgcagcaccagttggaaaccatcctttcttagttctgcagatactgcaattgcaaatgccacgacaaactggacatatccaatcaggattcttcttagcttcgagcacattctcaccatacctgcattaattataaagtcagtccaaaatggagagctcaatcggtttaggtactagtagtttatgtacagtctatttgtaatcttccagtaactaaaagtgtgtgggaatttactactttccaatatctattgctgatcatttcaacttgatattttaatgcaagcaaaaactaacgggtaggcagttaaaaaaaacactaacaggtaggtgattaccaattcataaaaccctccatgcttgcaataaattcagaagtcaaattttaaaacttgaatactaggaaaccctgttttgattcacaaattaggacacggatattaagaattctgttttgatttgcaaaaacttgaagttagaaaacatatccagatgcaaaaactgagtagttttgttcctgtaacttgaaccctggctcaaaccttcaagttaaaggatacagagatgcaaacataatgtaatagacaaagatggcagagaaggatgtatggaacaatcgattaaaaaaataatagcactaagaaaagatgcatgttcgctacagctatcatatgcaatagtgtgtccacttttttcaggaaaatcattggtcgattgagaaagtatgagaaaagaaaagggccccacctcatgtacaaacaatccccacagaactgcccctggacaatctggcatttacagcagctggtatgatggccaagagttttctgcctgtatcatggaaacatcaaactattatgtcacagtttcacaacatgaacagcatttaacagattcttcagtagaagtaatttaaattgtaaattggcggctacactaacttggtttatttttctcattttgtcattactaagaatgtacactgttccatacagatcctattagtttaatattatagaaggggaaccattgtatatttgtgcacattgtctttcttaaccttacagtaacagtcaatactattacatctaagcaaaggaacctgtagcaaaagtacagctatacaacattgccatatgattcttccagggaaacttaccggcactgatgacaggtttggcccctcacttgatcatagatgcgcttaccatctttcccataaccatccacaaagagagtccagggttccacacaagggcctaaaagtttctcatcctcttccgtgtaaacttcttcctttgatccagcctcgattagaacagagtttccaccttcattgtcgtccttgtcctttttagtccgaatttcacagtagctaacaggctctacgttcttcagcctacattaaaaatggatacagaacaagacgattcttgttaagccattcctatacaaaccatagtaaaggccaagattgaaggaatgcatatgaaccaacagaaacttaaatcaatatatagcttcttgttaacacaagaaagaaattaacacactgcagttttaatttgtggcaaataaactaggtgccagtaaaacatgagaaagccatacactttcatgaacgtaaaaattgtaactgctggttttagtagaatccttaagaggaaaagcatcagttgcaactatcaaccatatgtagcattcgatgattgaatattgtgttaatcacaggattcagtaatgggattatgtttagagagttgcctttttttttccaactacaacgattcatattcaggtaccaagagaggtgcgtgcaagataagaacagcatggtaagcaaagatttgagcatttagtactgacatgagccgtaatgaagttttaacacatgtaagcaagtagcagaaggggatagaaaataattctaacaaaatcgcatgattgatgaactgatgaacaagaactgtaaatgagcctaatcacagcataccgtacaataatttcccaaactatcataatcgaaatgtaacggattattgaaccaaagatacgcatatccaaaagaattgaactgcatgaaagaacatttcctttttttcccgctacatcaatcaaccgcagtccgctcaagcaccgattattacaacaaataaaaaaagaaaaagaaagaatagaactgcataaaagataagtaacagatttccccgcgactaagcatagaaatttctcgatccatcgccaccaatcaaccactcaagcaccaaccatttctgcataaacccccccaaatggaaacttccccccaatagagttaaatcgcccaacccccaaacctgagagaccgacgagcaggcgatggcgaggcgggcttgatcatcctccccacgccgacggaccccggcgtcacggccgccttcctccgcccgcggcctctcccgctcccgctcccggcgaggccgcccgcggactggttgaagcgggtggcgaggtcgagtatccccagcttctgcatccgctccatgttctcccggatcctctccgccctctccctctcgtacccctccgccgcatccgccgccaccaccggcgacgacaacacggggctcctcgccgcctcctccgcagccttcggcggccgccccctccgaccaggcgcattcgccgcggccccccgggtgctcaccatggcttgctagctagctaatacaacttgtcttggttggtgggtcgaagccttctcgctcgccggcggcgaagtcgtcggcggcggtgagccgagggttttagcggcggaggaggaggagaaaagccgcgattgcaacggtcagattttctcgctgcctctccacgcggattttataggcgggggctcaccggggcggtgacccgaccccgctcgccctcttttgcacgcgttcggttacccagcccactcggctacgctcactgacgtatgggccctggattgggtgggtcccaccagtaggtgaggtgatgtgggtgggtacatttgtgcgtgcgcgcacgctgtgtcgcccgtgcgtagtggggtgagtggagaggggggagtagggtggggttcacgtgcgggggtgggttgtgtggcgctcgctgacaggtggggtcaggttagcggcgcgttaactgtggggcccatctgtcagtggaggtggggaacctaccttcgtgtgttcggggtggcgggaatggaaaggtgtgcgcgcgcgggtggccgaagaggcaacctacctgtactaaagtagtagacctacagtggacttgtaaagtacaggcgatggtgtgaattttgggaaattgtttaccagttgccaattgtatctcggttttgtaccgttggaatcgataaactttggaaactactaggatatttggtttttgaaatcgcattgatgcatttctgtgtgtgttgacagctaggacaacctttggtttaagatgatttcttgccgttgatttcaaaaattgccattacaaggtcattaggtggttgcttaattttgatgcctaattgtcaatatttggtaaaattgaaatgtgtaagttgtatttggtttgtttcctttctcaactttttttcttgtaagaggaagattttagaattgcaggtaatggaggctagtttaggcaacttataatttattttggcaacgaacatatcaacactatagctcatttgcaactccgtgtatgcattattttttttatctaatcccaacaaatcccttttttctattttttaatctaatctcaactaatccttactcatgagtaggaattgcaacaccactaatctccgatgagactacaactccgacatcgagaatgcaagaaccgagcaacaaagctactcaaaagcctgccctaacccttttttttcggatcaacttccatatttcccatagcctaatttttcattgataacgcaacacaaataaggttaagacaacaagttatttttaagggagagaggcataccatagagcatgtggtaaaagattagatggtgatgagacaacgacttcttggcaaggatgagaggcgtcatcttcgtcatgacgagcaacaacttctcgatgatggtgagtgccaatatcttggtgaagatgagcggcaacttgtggtgatggatgccgacatagacgaaggggaccttatagctataggtagatttgattaggagaaacatgagagagggggcggcgggtggaaaggagagggagaatagaagagggcattgttgacggaatatatagatgtccattttctgtcgggcctacttgggcttccaaacgataaaccataagatccaagccctgataggtgtattggccatcgaccgtttacgctttgttggaatgactagcccataaaaattgataaagcccaaattatgtacacaacatgggtgttatgtgctaaaacgagtattagctaagtagtggttgtatgacttcacctattcagattcagatccatattgaccacaaatattacatacacgtgatatgctttcaacgtaattttattgaggttagcaatttttcttttggaatgctagggaacatcaccggcctctacctgcatccccgcatggtatgttccctcgtgtgagggattcgctaccatgatctatgcatcctagtttaacacacacttcttatgcttatcatcgtcgcctttgtagctggtggcaaagttgccatgcagccaaccgtagaaggtatatttttccatgtactcgtagatgagcacgttgtcgtgtcatcgctgtcgttttggctgctccaaagatgaggatcttaacatggtggcagtgatagacgcgggcgaggagcatgccgatgtccatgtgcatgatccgctagttggacatatctcacccatctcgcccgtggatagttcatcgactgctctgccagagccgatgacaaactggtcgcttggattttccgttgtcttcgatcacctctgcctagaactttcgtcgtgtcgaccccttcaccacaaactatcgggcattcgtattgttgcttgcccatgcgaaatgagaatgtcgtgcagttcaccttcctagactgctgcttgctacccccacactatcatgaacaccaatgcaaccatcattgagcacccccatagcatagttgggtggcttcgacctgggctccaatgaggaagccgtgttcgaggtgtcaatgggggtggtcagggactcatgtggccacggtagggcaactccttcaacactcgtgggcatagctgtagtgcaatgggcgcgacggtgaggtaccacaatagagcatgtgtttttgaatatagacgtggtactcacatgtattagagcatgtacccacctagcacctatcacccacaggcatgagacctggtatcataatataatgctcgaaacaggttcctacctactacttttgtttcaggttataagactttctagcattgcccatattcatatagatatcaatgaatttaggcacacatatatgtctaaattcattaatatatatatgaatgtggataatgctagaaagtctaataatatgaaacggaggaagtaacaagttaacaacaaccatcgcttgtttttttctttggcatgttaatgggggcacactatattcacctgtgcgcgcgtacttgtaccgatgttcactagatttggcagcattttctttgctgataattctttttccggattccacccccatttaccttgttttctttttactgccaatatttttgggaaaatccatctgtttccagttttgtgaccgaattatgatgcaaaatttccacagggttagttatgcgaattatgcacaaacacatttaaaatcagtatccaattaccgttattacacttatgggttatctgaatatctgattccaattaccaaagcttttagaaacggcccatttactaacccgtccagtgaaagcccaatcacagtcatgggctgcgccattagcccattattcatgtgaatacttctattcacagggaccactacgtaaaagtcacacctaggttttcacctcgccgtcccactcccacccacgccgccgccaccgccgccgccgccgccgcttcactcgccggagcgccatctctagccgccgccgccgtcctccccctgagaaagcgtcgattccgtccgggggtgggcagcggtgggactcgtatccggacggccgcagattcgttgagcgacccgcgctgctggttagtccaaaacctttttacctgagcccctaggtttgatggttcttgatctggagaagtttaggggagaaatatggctgcgatcaaggattgcagcctccgcatttgctctcgcaagaaggtggggagtagtagggcggattttaggggcgattttgcaacacgtgtgagattgatttttttcccctgttaccgacggaactgtgactgtttcatttgaagttattgcattatctcgagtgaaaattcttgttccagtgcaggaatttagatgaactgcacaagctggccacgttagccatgtgatggtgatattggtttgatctttgtggacttgcttagtccaatcaggatctgactgtgttcataaatgtagtgttggtgaattgtattctccattatgtctggaggcgaattacttagtctgtacatgcaactggcaggaattgattcgttaatagttaccaaaaacctggatagattggatgggcattggttaccagagctcataatgaccaaattggcttcctcagataactttgtacgaacactgcccgtacctgttcctgatggcatttcattatcaataaattccatccttcttgtatgttgaccaaaaagatgtaaggccgctatcttgatttgtgtagtcatggttttttcagttgggcggtcatcccgaccgattaaattgttccaaattagtagctggttgtttctttgatttgtaagccatgttggttctttctgaattaatagttggttttcccgcaaaaaaaaagaattaatagttggttatttctttgatttgtaatccaggtttgttctttatttagaaagcgttaaacctctattaggagagtgtagtatatgcaaggcatataaaattctttacgtttctattgccgtttctggaaatgttacggtagctctattccgcatatgcttcctaaccattggtcatactattgtgtgctacagtattttgtttgccacatgttgggtgttgcccttgtatttatatgacatccatattgcccttgctttgattgaattgacagatggtagctactaccctgctttccctcgaggaactaatccaccgagagtcgtgtgttcccgtgattccgtaatattttagaatattgtggaattagagaaaataatgttaattgttattaaatcataataactggcagttagtgtaaaagtttgtactgtttatgccatatcattactcttgcatgtttttttatatgttgacgaatatgctaaaaatatgcagtttttcattctgcaggttttagtcttgttggcatccttctgttaaggaaaatggcaagcaaagcaggtggtgacggcaaagaagccatcaatgagcaaataattgcaaacacttatgggaacatgcggtctgaaatgactcaactttacaccaagattacagaattagagatggaagtcagtgaacactctcttgtgattggcgcaatcgagccactggatcactcaaggcgctgctacagaatggttggtggcgtcctggttgaaaggaccatcagggaagtcttgcctgcggtgcatcgcaacaaggagggccttgaagaggtaatcgctcgcatgcatgaagcactggagaagaaaaagaaggagatcaccgagtttgagctgaagtacaagatcaggatccggaaggcggacagcaacgctgatgaggaagaaggcagcaagaaggaagggtctgctcagggtgttcttgttggtcctgctggccagtgaagcaaaatgtcaagcttgcatactggtttttcctagagattatgaaagttaggttgctctttgctagatgtcaactgatttcggtctctctttctatctgtgtgtgaagtatactactattcttctgtggaaccgtggaatccgttccatgtacaattgaatgctatctggctatgctagttgataacttcggtcataactgcaggttttgtgcaggtattctaggtgagaactttggtaagattttgtgcaggttgcaacatgatttgttcatctttggatgcccatctgttctggtgtttgccatatgctccacacttttctgcttcaccatggcatgtttttgaaatttaacttaatccaattgcattttgtaagcaattcttttgtacatcctccatgcaaagctatccatataggaggttgcaaatcctctagcacgaaactcatgggagaacggaagttcacaagaaaacagtacaaggccaggctgctatatgttgaccaattactgataatacgtccaattatacgtcaaatggcgtattagcgacaaaaatataatttatggttaaaattttacatgtgttttttcatgacttgaacgccatgttaaaaaagaaactattacaaagaaaaaaaaatcaaaaaccaactctaaaattaagttttaagattcaaattttggtatctgtatataagttgtagggcaaaaagatgtagcagcaaaatccctttgaaattgaaattcatgcttcccaaacatgggcctaaattcgttcacaatctgatccaatcggcctctgtctcgtcggcctcccctcccctcccctctccccccaaaaccccacctcgccggaaaccctagagaaacccacgagatggcctccggcgagggcaagccgaaccccggcggcggcggcggcgtggtggccaaggggaggaagcggaagtacctcccccacgggaagccggtgaggaagggggcgtacccgctgcgccccggggtgcagggcttcttcctcacctgcgacggcggccgcgagcgccaggccacccgcgaggccctctccctgctcgactccgtaagctgctgatacgctggttcacttcccttcctccgccatctgcggctatggtgctctacactgctggtccgcgcgggttcgccggctcagtgtttgctcgtggtggtagctagaactcatcacttcggcgtttcgctagtcctattgtttcaaaaatctcgtgctggagcttgtggtgacttggatgttttgaaaattcaattagcagggacaggatttggagatgttaaatgttagcgttgtgttgtgttcattgggttcctctgttgtgatgatgtagttcatatgcttgtttaatttaccgcttaatgctgcaccctttgaacacattaagtaatgactgaaatgagaaattgatagtcgccgcgctggatgttggcttgtttgctagtcatatgtttgggattttctggctgtagagcttgcatgggcttatgctcttcttttttttttttcgagaaaatatacctcatgtgtgatactcaaattgttggatctgcagttctatgaagatctggtggatgggaaaggatcagatgggaagcccaaaagcatccctgataaaccattgaacaaaaaaattacgtttgcggattccgattcttcggatgatgaggaagaagatcattcaggggaggtgactgatgacacaaacaatgcagacaaaggtgaaaccacaccttctgagcagcagaaagaggtgtctgacacccctgtagttcccagcaaggacaatgaggaacaaacagataatgctgatgaatcaaaactaaagaagcagcgcgtacaagatcctccgatatctgaacagacagaaccaaaagagcctactgataagccaacagagtccactgataaaccaaaagggtccaatgataaacccattgatgatttgattgatgaggatttgaaggagcttggggataggaaaaaggtttgtttgaagttacttgctttctgcacaccctttttccccttatcactgaaatgtttgtttttgttttaaatattggcaaagcttagaatgttgtgattaactactctcttgatcaataattgaaattcttgctcagatactaaatttggaagttcacttgtagtagataaagggttttcaacaactaacatcttcaaaagtcaaacatgtatttagctattcattcattgatacttggttttattttggtcatgtgatgacattattgtgaacctatctggagctgtttaagtacattaaaggaatttttagtaacaaatttttttattaggagtccaatttgatgagtgacatgtattacatttcactatggtcaacaattagtgtgaatttggaggtgatgctgtattgagattattacctagcatgccaattgttcctcccaaacaatcccttaatacatgaaaacgatataaaatgatcaattccaagatatcctttttcccacaatggtttatgtactaacttatatgatgaaaacgattgtatgtcaaacagaggctcttcgcaacccttgattcaggctgcaacggttgcatcttcattcaaatgcacaaaagagatggagaccctggtccagttgagatcgtacagaatatgatgtcatcagctgcttcaactcgtaaacatatgtccaggttcagatttggttatgttgcaatctttgcatagatatactaggcagttattttcttgttttcagactttcctttttaatgcatgctagatttattctgaggtttttgcccactgaggtgacatgttatgcatcagaagaggaaataacaaaagcaattagtccacttgttgaaaagtactttccaaaggaatcttcttcggtatataaggtaactttctggcctaatttctatgttgatgttttcaatgtaatcttttagggacttagattcttagggaaactaagatctattataaaactgtaagagaagataggcatgttgccaggtcattttgtctatggtagctttattcatatttcgtgttgtccaattagaagacgtttctaaacttcattggagaggaattgttgttacttcaatgtgaattcaaccatcttaagtaaaaccagtcatgttgttacttcaatgtgaattcaactatcttaggtaaaaccagtcatcatgtataattgtgtgttaagtgttaacaccaggtgtcctttccatttaataaatggaacaatttagcacatggtaataaggctatgtacttatatatttgtatgatcatgtcagctgtaataagtcaatcgaatagcagtattactttttgttgattggataataatttgtaaatgatgagtcattagtttatcaccatttcccagttatccttcatagaagggatccaacaatattttatgatatttattccccttctccacccaatataaagtatatctgacattcaccacaccttgtggccatgttgcaatagctgatagtagtaataagaaaatataaatcaaattacctctattttgttttgctatacaaaattacatttctttacttggaggtttttaatctttgcagtttgctgtgttatatgaagcaaggtcgaacacaggtattgataggatgaaaattatcaacgcggtagcaaaatctgtacctcaacctcacaaggttgatctcagcagtccagacaggactattattgtccagatagctaaggtaaatgattttatcctgaatgcacttatgacgttattgtccgtaatgcatatgaactgttctgttagaaaaccatgcttatatcctatgattttcaccgaaaatccattgaatcagttgcttattcaaatgaaaactacatggatggctaaaactctgtaacatatcaggttaatgctgtaagaaccaattttgttaagcttttgaatcagttgctctgtcacacttcatgtagttgtagtgaaagcttttttgggtccaagggtgcaaatgggcaggcccgggaacccacttatagtacaaataccgctgggttacccgcttatttgtactataagtgggttcgtgggcctgtccacttgcacccttatttgggccccacagattttgaacaaaaatacctatcttgattgcatttaactagtaatatgcccgtgctaacgctacgtgacatctcacaacaacatcacaatgatactttgacaggaaaaaaattctgtacaaaaatcatgcttgatttcattgttatattttcttttgtataacagaacaccatattaatatgcattcaagcaattaacataaaagcccgagtacggtctgatataggttaacatgtaatactttacgaacaggaaattaaacatacacagtttgaaattcgaaacagtagtgatgtatatgtcttgactttttagattatacacagaatttgtgtagtattttatacaattattggttagatattgctttgaagaaaaacacgcatattttaatgataaataaattgaatagaccatgcaattcttattcaatagaacatatgcatcatgggttaatcccatctctgtagagcaggtcatcaaggcatacaaatacaaaaatatgaattaatattcattgacaaacgtaactaaaatctgattactgtgtctgcttggtgcctatgctttcttgcgctgcgatatcatcatgtccctcttctctaccttgaggataacaaaatccatttgttcctccttgaaaaataataaacaaggtcatgataaaaaagaacatgatcacaactgccagtaaacagatgaacaaaaataaaaaagatcatgcaaaacttacatctccaactgtatagctgtatcacctatgaagcacttaatgtctttattaacagcacgaataagatggattccagtgtaacattggatatgctgtacaattcttctatgaatcaatgatagttgcaacctggctgtgtgtgttagtatcagatctatgcaattagtctacaagaattacattattaggtggcaggacaagaagcactgttatatgtcgattgtcaaggacattcacattcatttgaagagtttccattaacctaaaacaggaaatgaaaccattgtatcgtatacccagccataccttttacctcttccaagccccacagcgttgatggagctgttcgattaaccagccagcacaagtacatcttattgatatgtttttcttcgactccaaattttatcttccttgttttccgttagcacacaattcaaactactaaacggtgagttttttgtaaaaaaatatagaagatatttgaaaaatcaaataaatccattttcaagtttataatggttaatacttaattaattatgtgctaatgagctttcttgctttacgcgcgtgaaaaatctttcttcaaactcaacaaaagaacgcaaccttatctcaagggatccaactgaacctatatggtctgattcactgtgcacccaaattaagaaatataaaccgagtacgtggtcaatatatatccacgaaaacactgaacatcttgaactaaacagatacttgaatagaaaatgcaacggccagctttgacttgaatctctcctctgaatgggatacttgaatagaggcaatgaccagcggttcattatttcctgaaacatataacaactgggttagaaattgttcctcatacccaataacctgaggacctcaaagacataacctgcaacattctcttctatcagattgaaatggaagatcaattaaaatgtccctgtttgtactatatattagtagatagcaaagatcctttgacaacatcagcaaatagaactacaagagaagcatttagtggagcataatcttctgcttcagtagaaatgattgaactcatatcactaagcaatgaaaatgtcaaatgccccttctttgctaaataaagcaaggactaaggagcactgctgcggtataacaacaagcatcattatgcatcctatcaagtatagagaaagttagtgacaatttagttttcaacattgatgagctgtttcataattatatcaaaaataaatgaaaaattattagtacagataatatggatatattatgacttactataagaaaatctaccagtaaaaatattttaagatacttgatcaacctttcaaaatattttcctccctcaacgagcacttgaactactgaaagccgagagctgtcctaagcatccatgccaattttagaactctaaagatttgtacacatccaactaaagaaattgtgcagttgtatataactttactttagtgagctatctgttagttctctcagaccacaaccttttcaaaccatgaagggcattcaacaggtggtgtggtcaaggcagcatactatatctaacactccaatactccatcctccactataactgacctcactcggtgattaaactttcgttttccagcaaaatttcagaatttcggtggccaccaaaatttccaaaaattcaggattttggtactttttgttcgaaattatttaaaaaattgacaaattttgaatgaatttgaataaattttgaccaaattaacaaaaaaaaatatcaggcaatatatgtgcttgccagtggggagccactgggtagctaaattaccaaaattgcaatccctgacctcaccaacacccatgtcctcacacagtaccatgtcaaatgcacagattttcggagagaatcaacagggagtgtgttttggtaggtgtatagcgtggggtgcttgagaaaggagccagaggagaggacgcaaacaagaagcaaacctgaaggcgtggatgaagttttgagtcaagagcataatgtttaatgtaatgaacataatgtttactgcaatgggatttcaattgtctgaacataatctttctagctatcagtctcagtccggaagtgtgcaagaacagcagcatatgcatagagaaagtggataaattctggtaccaagaccaacatccattatataccacttctgttcatggaccacagccactcagcaagaaccaatttatctacccccaaaaattagcttcaaaggaaccagtagcttgtgcaagtttgaaaatcaagtgtggcattactatcagcatggcatgatatggatagtgtaaagacatgaaaatggaacagttaaacaagagatgttatttggtgttatgcatgagaatagaccacttatacctactggagaagctatagggaaaaaaatactaacatattttagacccaaagatagtgcacggtgtatcttgaaacatgtgaaagccaatgaaacatctttcaatagaacatagaaaactggtgaatgatccaagtaaatgaaacatctttgcaatttgcagtatctagtgattcagacgatcgcacccaaactttaatttcagaagcatgtacatatcaaatataaagaatagaaaactggttaatgctccaagtaaatgaaacatctttgtaatttgcagtatcaagtgattcggacgatagcacccaaactcatgtacatatcagatgtaaagaaccacaagcatctgccatagtttagtttccgcagtatgcaattgaaacttaaagaaggaaactacttcggagtttctaagattgtgtcatcttcaaagctacattatggctatcagccaccatcgcatatcaaaactcaacataagtaaaataattagctccaaacagatttacctattctcctcagagtgagggagcaccgaaaggaacttcgctggaacagcaagacctgcccacatgcataaggccaaccccaggagcaattgcatcatcacctgcataatcaaaagcataaattatgcaacgcaaagacaccccaaggcctaatttatcgaatttggagcgaagttggttgatgccaagtagccagtaaaacaagcagctagatcagagaacaaccagcatcaaatttggaaccgggtcgcatgtaattatgtaaacatacagtgcaactcatacacaatgaaccgcaatttcaacctatgactggccaaggccaatttggcgggaatagattgcttaaagcacattcagtgatagtatcaaacaattttctcctgtcaaacaacctaaatcactcttttctttttgtttttgtcatctgtaaactttagtttacacaattcatggccatcatctaccctaccccaaatctcactttcaaatcaagcaacccaaatactacatgttttgatcacagctttacgcaacagaaaatcaaccattcataccccgaaaaaaaaagaaagtatcacgaagggataaggggaaacacttacatccataggcggactcaagaactccta

SEQ ID NO: 42136 - DNA, 1002 bp, Oryza sativa
tggggaggggtgcaggtcagggtggggagggaggtggggtgaatccggagcgttggatcggagcgaggtaatctgaacccttgagtgatgaataaaagaatgagtgaaagtatttgttgaactatagggtagatgagtaatatactcttgtagtattttcaatgcccagtacacagggaaaatatcatcctttaattgatgtcctttttctttctttactgttatcctaaccacttgcttgaacaagctgaggatgctctagtttgcaattcatgctctgtgttgttaactaatttagtaaaatatatgatgtgttcttttgcatactgctcctcggttaagttaaccaaatacaaaaacctgctacaaaggggaatgtggtcagtggagcagtttttagcttgtctgttaaatgtgccgtaatgattagttggcatttattgttcagaagtgaatgaacatatactgctccatgatctctatctgggcagcagccacactgcaaatttatccatgggatatcagattgtggcagatatacatgataaactgatcacataaggctatgagcatggttataaatttggagccatattttcagttgattccatttggcattctgatggcacccaatacattggatcattggtaataaaatggacttagaaaatatatgtttatgatgtttttgcttttcccccctttttgattaattgtactcaaccaagttcatgaatattgattggtatattgtgaatgagcacatgaactgttcatcatgatccaaactggcgttcttttattgttgttataaatgtcatgccaacctattcaagttcatgacttcaacttcctttgtttgtctttaatgtcatgtcaacctttccatggctcttgatgtatcaaccacaaaagctagctcctagtgaaactaggagcaatactcatggttcatgccagtagcctatcccttttagtttgctgttcatgccagtagcctct

SEQ ID NO: 42137 - DNA, 2561 bp, Oryza sativa
tcattcatgatttaattttggtctaagtgtgttacttttatgtgatatgcatgaatctggacattgggcattagcagtaatgcttaaacgtataattgtggctatccatggcgcacaaaaaaaaaaggatgcacgcattgattccatgattttgttataaaaaaagttaacatgtttaataccgcatacagagaacatatatcagttttcaaatattgatctatatttctatttacatagattgtacagaagaaatatttataaatttatatgagtatttgtgattttgtgtaccatgaaatgttatattaagccaaaaggacatctgatttccttgaatacatgggaggatgaactaaatgtgcttagaaaagtttcttaattaacataataaaaatctgccatactaggcaaagtgcatgcatggcaattacccttgatcaatggatggttcggatttaatactcatcttacctcatagcagctaagtggagcaccctaaaattgctcatataagtttagtagtctaatcctttttcttctattgaattaaaattcaggccctctttctattgataggtgtactttcagggtcatcctggactaatttaaacatttcaatgtacgaattttagattacacgggactacgggaggatgctaagtgttctatggtactcagcatgcatgatttgatgcatgatcttgctagatgtgttatgggtgatgagctacttctaatggataatggaaaggaatacaactctggagaaggcaattgtcggtatgcattactaatcaattgtgtcgggcaaacaaagttctcctattcatctactaaattaagagctatgcgttttttcaactgtgatggaattcagctacccttatttacaaaatctttgcgtgtcttggacataagtaagtgttcttgtggaaaattaccttcatctattgggaaattgaagcaattgaagttccttagtgctactggcatgcaacataaaacaattcccaagcatgttatgaaactttcaaaacttatttatttgaacataaatgggtctttgaacatttcaacattgccaacatcagtgaacaaactgagatgcttgctacacctggacctatctggttgtagtaacctttgttcattgccaaactcattcggtgacctgacaaatctcttgcatttgaacctagcaaattgttatgatcttcatagtttgcccaagtcttttcataggctaggtgaactccagtatctaaacttgtcacgctgtttatcattaaatttaatggttgacatcaatgctgtgtgctgccttacaaagctacagtacttaaacctgtctcgttgctcaagtctcatccacctacctgaaacaattaggggtctaaaagatctccacactttagatatctcaggatgtcaatggatagagatatttccgaaaagcatttgtgagatcaccagcctcaaatttctgctaatacaaggatgctcaccctggttagagaagcgtgtgagggagtctcagttcaagaatgatatgctagcattgcccaagtttattgttcaaagagcagcttttggcatgtgtagcaatatttcgcggcttcaatctgtacatcctgctgagctagaaattgaatgccttgagaatgtaacaagtatcggagaagtggatgttgtaaacttgacgtataaatcagcactatcaaaattggcattggcatggactcctgcagctgagcgttttgtggaggatgaagatttgctgcggaagttacaacctcctgacactctaaaagttctccagatacaaggctacatggcgacatcatttgctagctggatgatgaacttggcatcacgtctgccttatctagtccgaattgagatggtagatttaccaaggtgtgaatatttaccaccatttggtcaattacaacatctggaactgttgattcttaggagaatccttagcctcaggaaactgggaggagaaatttgtggtggtaatggagcattcaggaaattgagggaatttacattggtaaagatggataacctaaatgagtggatcaccaaagtatcggctaatggtgaattcatgttccccagtcttcacaagctggaaatttctcagtgtcctattttaaggttaaatccatgccttcctagagctcttgaatggagaatagaagcaagcgatcaaattatagcagatttctatcacacaggctcgtcatcgtctttggtactatcgaaaatgcatattagaagctgccgcctgctgcccaatgactggaaactgcttcagttccttcctgatcttcaggtgttggaacttacacactgttggttttacgaattgccaaagagcattgggtacctgacgacactccgatcactgcggatagatggctgcgatagcatgacgaaactatcaaaatggttggtcagtctgtcattgctacatgaattaattattactggttgtttgaatctggtatatttgccggcatttgtacaaaagcttagtgccttgagaaatt

SEQ ID NO: 42138 - DNA, 9065 bp, Oryza sativa
ccactccaataccttcaatgaatttgtatgacaaagtacgcctaatgcatggatccccaataaatgtagctgtgtcctaactcctagttgtagccttgtagggcttcaggtgaactttgttcttacttctatgatgtaatgtatgagatgtcactcggctatatattaattttaatttgccatatactacatttcatgttcctctatatatctattatatactaaaagtccattaaacttcctacaaacgttcctaaatcaccacttggcgctctaataaattagagaaatcaaagaaattctgataaaaagcaaaacatcctacccttaattttcaatacggtggacctattattctttaccattagatcaaaatcaaaaaatctatccataaccccaccacctcctgggcctcctcctcctctccccatcacgtaggtacgtacgtacatccatctgtccatccatcccctcctccgtctcctatcctataccattatttccatcttttaattttctacctaccaaaatttaaaatttatgatgattaaaaaaaatcaaacattataaccaatagattataatctacctattaatatcctaaaaaaatatattaaacttcctaccaacactcccaagacatcacgtctgtaaacgctcctacgtcaccacataatgctctaatgaattagagaaaatcatagatattcaacgctccaaagccgtcacgtgatactctacaaaccctcctacaccaccatatgatgctctaatgaattagagaaaattgtagatattcggagaaaaaataatatgtcatctttatttttacttaaattgatggatccattattttagatcattagattaaattttacttttagaaaaattaaaatataatatttccattctaatcaccgtccacgtacaagagaaaatgcgtacattcataaagttcaccaggaaaaatgtacgtgagaaaatacgtatgtacatcaagttcgccacatacgtacagttcactgggaaaaatgatacagcccaaagcaaaaaacccaaaacaacatacttatagtatgatggaaaaatatactttacaaactacatacgtagatgaaaccttaaaaactgccaatgcatccgaaaatgaacgcatgagatttgtccaagtcactacatattttccttaatatgattggaaaagaaaattcaactttgaattgggatattccaggttagaggaagctaaaatatattacttcctctttattttcctataagttgaccatccatcttattaaaaaattgtataaatatgtaaaaatataaattgggattatagattttttatgataaaacaagtaatgataaaacaaatatcatttatatattttttaatacaaatggtcaaatgtcatatcaaaatttaatagtgtcatacattcaaaatcattacgagtacttcacatacattaaattggtaaacatattattttaggccattaaatatccctatcctaatagcccatctacgtatgtagaattcaacagaaaaaagctaaaaaaaatacattccaaacggaaaatgatacatacgcacatagtattatttagaaaagtaagcggtctttaaaactaaaattttctatgatttaaaggtaatattagtctataatcaaacacagttgaactatatcaaagataaattatactgagttaaactacatcaaagataaaatatcaaattaatggcctttaaatgtccttacttgaaattatatatcacaaaatttttatcactaaatgaactatgaacggattataatggttatttgtagggctaaatacatcacaacacatggtgtcgacatgtaataattatagacacaataacttttaaataattttacatcataatttatggtgcacaatatcacctaacaaatatacaacactaatttgaatatacgtatgtaaactaaaaacagtagaatttaatcatcttttttgaagtatatctaatttaattttgtttatttttcaaaactatttgactggtgtagatatgaagtcaaaagcatacatggtcaaaaaaaccagaagcatacattctatgtagatatgaaaaataatatcaaaaatatttctagccactataatacaaccccttaatacatcatgataattatggtcatatatgtaaatttgttttctttgccaagacagtattggcaacaaatgaacaattcagtaacattgacattaaagtactcatgatatattttctaatagtggagaaattctgacgtgactgtaagtgcactccaataatgaataagctatagtaaataagtttcagaaaataaacaaaattttgaacctagtaaatttgtctagaacaacaagtgttaaaggcaaaccaggggttaatcttagagattattagtgtggtatctctctttaaatatatttatcagtaatatccattgatcaacctcggtcattttttaaaaaggatattgtttctatagaattaaaatttgagtaatattaatgaacacaataaacaaactatgtctactctataccataaaacaactcataacataaaaacaaattattttcgtcaccttcgtcttctctttgtacttttctgaagggcaccatgcatgatagtagagcattctacgcaatcataagtaaagcagaggcatacatatggcgggctgaggtagtcccaatgagaggatgcctttagcaatagagctcaacttcctatttcaggaggcaattctctatgagggcacctataattaattaggcattaaaattatgctccacgctggtctagaatgacatggctatgagaaacccatatttcaaggtagcatggaagaaaacctcggtgcccgcggttggcttcacccaatacatgaatatgtttatctgatttaacgttgttagcctattaattgatagaaaaggtatttttagaatatttagacatatatttggaaataagcgagacatggatagtcatctaaataatatagatgatttttgtagttaactaataatgtattaatcttattgtaacggtatgatgtagtttgatctattatagactcttagctttcaaaaacaataataatgataataagtatccaataaaacaatataatcatcataagaagaggtgacaatagaaaagtgatttttattttaaatttaggaaatactcttatcatttagtattgttgagatagtataaatgttttttattataagataatatatagtagtctataatggatatggtaagttgacttattttattattcttttcataaataaataaataagatgccaaccttcttcctagaccaaaagaagcattataaatgatttcttgtaggcatgaattaaatactaaataatttcaagctaccaaatagtttgaaaaaaattactgagcgatgctaataaagaaaagttgtgaagaaatagtacttttaaagcatggcaggtatcatctggtttatattccagttatataggtttccgaaacacaacatgttatgttatacatgcgcgaccttcctagttaaagaaaaagttacatcacaatgtcacactgcatgcacaattattggattcggtattcggacatcctgccaagctgttggggttttgccttgtcgggcatgagattacgagttgttttcttgttgcaaaaaaggctaatgacccaacatacgtacgactctctactggtgatttagtaaccgaagagtaattatcttatttagaaattttagaattagaattcctcttttgctcttattgactctaaaggtctcatggacttctctacatggcagattttagattgatacaaagttagggagtgcctatacatctttcgaaagatttttataatcgtatcacacagatttttaatctttggattaaaatccgatagatataataaaaagcaaaagacaattaagaaacaccataatagacactaaattaccatatcctcaagaaaaaaatcaaatccaatacaaaatttaaaatttgcgtgcgaagattcaaaaattacagtgtaacttaccaaagttacagtgtaagtttcataaattacactgtaacttacaagaaaatgcaatgtaaaattgagagagaaaatcgagtgatagataagaaaaaatctttcgagtgagatatagcaaaatcgcaaacttattgcaacttttgagtaaggtagtcatagtcttttacacatagtccattactatttattactccctccggttcgttattagttgacgtcagagacttgactgtttgaatgaaaaaaaaatagcgtttaagttttggttttggtgtgatcagtttggactaatttattccccttcatgcatgcaaaacacattaagctagccacatagatgtatttaatatgagtacaacaggaaatagtcactctaattaattactcattggtatctaaactcttgtctaaagcgtctataaataatgaaccggagagagtactaattaaagtttatcgtggttactatctccagatttattttgatggtaagttgatgagtactaagaagcaagaggacacagcagacattgacagaactgacgtccgtgattacagaaatccatgcgatgaagatgaatatgtagactgttttgcgatgctcgaacttggtgagtcgtcacggatggggcgatgaacccgtcgagaagtgttctgcaacagttgtttgtatctgatagagatttgtcttgtgagggtttatattaccggttgaccactaaatttcgagcctcatcggtatcatgttttttgataaattttgatcggtttcggataaatttcgactgaatttcgaccaaatctactgtttaaccttcgaaattccaatcgaaacttaattttgagccgcgtcgaaacgtcgaaatttcgcggaactcgaccggttttcatcggaattgtgaaaccctgcttgtgaccatgcatagaactgtactctctcttctttgtttgatattatataagttttaattttctcaagtcaaattttattaagtttgatcaagtttataaaaaatttagcaacatctaaaacatcaaattagtttcattaaatatattttcataatatgtttgttttgtgataaaaattctactatgtttttttaatgcttaattagtcaaaattaaattggttatgaaaagtgacttgcaatatgaaatggagaaagtacagtgcatccgccgggtttttattcatacctaaaagaattaacagttaccctccctccaaattcaccaattcggttgaggcacatgaaaagtcctaaatgagctacagagcaaatgagcgggtcaaaaaggatgccaaaacgattggatccgtgcggccgatcggacggaaaaaaatggggtgcccgcggagccgtccgatctcatcacgcgcgttctactgtcaggatcttccccgtgtcacccgttgccagggtttcccttaccgccggtaatcgcgcggttaccgggcttaccgcggggtaggtaatataaataccgcggtaaccttcttaaattcaaataaatttaaaaaataatttaaatttttgataaattttgcacggtttcgtacgatttttcacatataccacggtaatcgtgcttaccgccggggcacggtaaccccggccagggcagtttgggaaaccctgcccgttgcaactgcccccaaattacggggttgtaagttgcaacatcccgtaacggcagtattttctcttttttccccctgcaacctcctccgacaaactcggttggagcggaggtgagcgcacaggcgacgagggtttcctcgtctccacaacggcggtggtggaaggggcagccaacctcggagcatacgcgccagttgtcgcctctcccgggcccttttatttttctttttcacactttttttttttgatcttagacgcgtttttttcactgtttctttctgttttttttttcaatctttcacacacctctttacaaatgtagaattgaaaattttttattttgacttaaaagttttaaattttgtgttaaaattttttcgaattttggctgaaagttttcaaatttgatcaactcgaatttgaaaactttcaacccaaaatttgaaaactttcaactcaaattttgaaaacttttaagtcgaaactagaaaacttttaactcaaatataaaaatttccaacctcaaactcgaattttaaaactgtcaactcgaaaatttaactttcaagacaattttttgaaaactttctatcacaaattttaaaatgttcattgtatcgctgaaacttttcaacttaactatttatatattattttgataataaaatctacaattagattaattcataagcttagcactgttattagcgttaatgacgtgtgatcgtaatagcccacgcgcttaacctgcacgtgcgacgagaaaaaagaagcggaaaaccaaaaaaaaaaaggagcgtgagaagctacggactcggaaatgcgcgcgacttgctaatccggccgtctgcgcggattagcaatccccacctcggggaaccggattggggtgggaggtgtccgggtccggtgatcgccttggagaaaagagaggaggaagaggaaggtcctcgccgttatgtagatgcacgtcagcatcattcgttcgttccatgcatctatttccagagaatccagatgcaacagaactacagatgcgatcgactcgactatcccaacctcccaatcagtcgatttttattgataaatcgggtggattaggactggttctgaagcgttcgaatttctttttttttaacaaccggtatgaggtaatgcgatatttttaatgatatggcaagaaaaaagtttatagtcttggcatactatagttaggaaaaggaaaaaaaaacaaccgcaccacacgtctatgttttattctagtgctaaaaacgaaatagacacacaacacctgtaaacaacacctccaaagaggaaacaacacaaaaagctctaccgccgctcgtcctagagaactaggacttgatttttcaccttaataacacattgggagaggagagaaaacgtaacaacgtcccaagggaaaatcagcgcctgcaggcgtcattgttgcccgtccgaaggctaagatctttgcccatagttcctactctcccgcgccaaagagtgcatgtcagattcagcagaaccactagctattcccctcacgcacagccaccacaccaacaccttgccgccagccggtcatcaaatgtgtgttcttccctcaaggttcccaaactcacctctttcctttttcacaggcacgcttctcaagctgctaaacggtattttttataaaaaaaatagtttctatacaaaatttgttgtaaaaaatcatattaatctatttttcaatttttaagctaatatttaattaatcatgctttaattcatcgctccgttttacgtgcgaaggggggaggttcccaaccctccaaaagacacagccaaagtagagtctaaacctacgacacgcttcaacttcttccacgtggttggattggagaggggaagggtgagagagaagaattgatcccctctcccccgcactagcccgtccagcgtggccatcttacggcggcaagccgccggcgcgaaaggactaacgcctagaaagaaacttgccgcacgcttcaaccccccttcatgcgctactgtcgttactgccttgaccaggctacccgtgttctccgcaacgggcaggctcaccaccgttgtgcaccagccatgccatgctcgcaccacaacattgtccgcgccggcctttcgcggcccctgtcgaccttccactgccgccactcacgcaccactgtctgcttgcagcaccggacacccacaaccccgtcgccgtggggcacgcctcctagtgccaccgtgcccgcctaccaccgccaccagcctggttcctcccatctcagccgtcgtttacaccgtcctccctgcgacggcgcctcaccatcatgcccttccacctccaaacgtccgtcgcctccacgccatcaccagctcaagggttggctacccgcgttggggaggccagatccgggcagagggggccggatctgggtgttcccgcgccgcctctacgcagctgtgccctgccgcctcgccactgccaccgtcggatccagacgggagggtgtcggatctggccggcgacgccacctcgccgtcatcgcatcacctcagatctggttggagtcatgggcatcgtccgccacctgatttccgatggcccacttgggcggagagaggagagaggcgggggtggtggagcggcagctaaacaatttcagctctacctaaaataggagaggagatgggtgaagtgctctcacaaatgaactagaaaggtgaagctggatttatactactccacaactccactctaaacacaactcttgtagctaaatataggagttagagctttaacaaacaaaccctaaatataacataggcttaagcagcttcacaacttcattttaaacctcgtaatatagagagggggtgaaatgggctgacacaagagcagcagcaaacgcaacgatgggtcgatggctgatggcccaaaaatccactggcagccgcatagtgtgtggcccaaatcccacgcggccacgcgcgagaggcctagtccgagtccgaggccgcagcgcgtgcgcgtgggaggccgaaacggcgtggatcgtgcggcctccgctgccgcgctccgtgccgtcccacgaggccacgataagctgatgttgttggaccccgaaaatctcacgcgcagcccacatcgcgtgttttgcccgaaatctcacgcgcgcgaggccagaagcgacgtggttgggcagcgcgcggaatcgcgaataagatcactttgactccctcaattgaccaccgaatctaaatcgtatccctcaaccgcaataccagaa

SEQ ID NO: 42139 - DNA, 2331 bp, Oryza sativa
ctcaccctgcttcacgacggcatcgaaggcgacgctgcccttggcgtcgacagtgagcgcgaggatcttcgagccgcccttctcgtcccgtcggcccatgccgagcgggtactgcgcgacgtggatctccgggaaggccccgccgtcgctgaagtcctccagccgccgcggcacgaacccgccacggcggcacgggcttggtggggcccgaagactttgctgccgccgccgcgtctgactgcgccgactccccgccataccactctgggccttgcgtgccgcctctgctcgctctcgccacccgccgccggccgaagggaagagggggagagaaagagagaggtgccaccggccgaagggaagaatgggacagaaagagagagaagggagagagaggaggaaggactgatatgtgggccccacatgtcagtgggcccactttttttcttgtgtgaatgactaatgggtcccatgcatattttttaattctaccgctacgtagatgccacgtcatcatcacgtggaacgaagactcggtcaatattgccacgtaggcaccacgtggcgccacgtcagcaaaaccgcctcctaaaaccgcccagggagtcaaattgcaccggttttgtaagtttgagtagtcaagatttctggtattgcggttgagagatatgatttagattcgatagtcagttgagagagtcaaagtgatcttattcccgcggaatcccgctgcaatccatgccggcccacgacggatcggtgtaccgcgccccgcgcgcgggtcatggatcacacggacgggtgggtggtggctgcgttgacggggcagtctcgcgcgcgcgggggagacgggagacggacggcgcggcgccgacgcagcgaaagcctgagaggagaggacaacgtgccgcttcgctggcgcagtgagtggcgaccggcctagtccggccggcatccaacctgctggtgctgcgcgcgccgcccgcccgcgtggccacggtgtgcagtactacagccggccacggccggcgcggaagttggtgtaagccggtaatctccttgccgatacattttttaaaaaaaaacttttttttgcctgtttttccttcttcggatagcggccggatgagatgctctagaagcagtggcggagccaccgcccaccgccgggcgaccccgggcactcgtggcagtgaacatgaagtaaaatatgatataatatagaactgtactccctccgtttcgaaatgtttgacaccattgactttttagcacatgtttgaccgttcgtcttattcaaaaaatttaagtaattattgattcttttcctatcatttgattcattgttaaatatatttttatgtaggcatataattttaaatatttcacaaaagtttttgaataagacgaacggttaaacatgtgctaaaaagtcaacggtgtcaaacatttcgaatcggagggagtacttgtcttagttagatttgcttggggtttaaaaattttctagctctactactgtctagaaaatctagctctgtatacatgctttcatcaaaatatcattctagatcatgttttgcttgccaatccatctgcggaaactgagacctcccaaacacttgtatcactaagggcattagcagtgcgacaacacattttgctgaacctcatgcgtcacataggctcaagaacacctaagaataatgtttaacacaagtttcacagtggtacctagtctcaagtggggtccacacaaataaaaaagtattttttttctctctcccttgtcctcccagtgccacgcctcccctccccctcctccggccatcgcgcctcccccttcctcctcctgctatcgcgccttcctgataagcgacggcgccgggcggcccaagcggcgacagatctggctgcggatcaagcctccccctcccctcctcctccggccaccgcgcccctcctcatcctccggccagcgtggagtggagctcgccaatgtggatctagtggtgggcaacctcgacctcctctccggtggtgcggatttggtggttggccggtggctacaaggggaaatcaacgttggcaccgccctccctcccctcccctcccctcccctctcccctcccactgccggccggcacctcttaggagaagatgcggaggcggtggtaggtcgatggaagcggacgcctctcccctccctctccccaacggatctgccagtggcgatggttggcgggggtcttagcggcagcggcgtaggtcggcgacacagattgggcggtgacaaaaatcccggtatgcccctccctattccggtcatcg

SEQ ID NO: 42140 - DNA, 6422 bp, Oryza sativa
gcctaataccgccagtttggcacgattggcatttatcgcctgcagccgtgcgtgcatgcccatgcagcggtaacagtatgtatggctcatggctggcgtgatctgacacaaaacagtgctaggatagtttggagagcatgaatccaacacgcgatcaatgggttgattaaattaatttcagctggatcgtcggagctagccatgcgcggccggcccggggagaatccaaatccgattcgagcctgcatgtggccgagattagccgatcgattagctcaaaaataatggagattccaacccccaaaatgctcgcgtcggagcacgttctgcagtgcaacatggcgcgacgccgatggctgcagcgcaggaaggttctcacgattaagaaatactagacactaatataattatagtaacaactagctgcagatggaatcatggatgcatgatcaatcatacatcgagatcgtcatccattccatcgatcgatcttgtttgtcgttgtcggatattggcgattaagacggtacagagtgatttcttgaattgttagtttgcccttgttatcgtccattctctcttatcaacttaaagctcagattattgagtgattattgctacagattatctatttaaattatagagattaactaaacatttttataaataaacttaaagtaaattaaaacaagtgatctacgtaatgtagtataataaagttttttttaataaattcgagataaataattcttttgaataattcgattaataatctgaaaataatcaagcctaagctttcgtaggagatggcaagctccataataatccatatatgggactgaaaaataccaacacaaagatcttaaattaagccccacaaggccaccttaaccacccctctaaagccacaaacaatggagatcataaacacatacctttagagctactcaagaaaacatgcacaccgtgcacacgtacgaagccggtctcacaaatcatcatctcccccctttgtgttcagcaagacggcaagcaaccataggccatgaactaactaattaagctacctgtgcatgttgcccaaccattctactatcatcatggcaataatctaattgagacgcttatgggctcgctaaccgaccaccccaattatcatgttcttcttctttccctccaagtcctatcatcaaaagctcatcattttttggcgccaacctcccatgtgcaacccccaaacttgctctttccatgcagctcgaaaaacatctcaacattaattaattttattgattgattggttagtactacagtactgtaggagtggtactcctcataatgtttaatagatgttgtcattaacttttgcacatacatttaactatttgtcttattcagaaaattacgttcacttattttgttataacttgctttatggttaaagatatttgcatatttataaattcctatataagacgaatgatcaaacaaatgatcaaaagttaacgatgtcatctattaaaaaaacggaaggaatagttctgtaacacgggcccttatattttttaattgggtcccattttggactttggactttgcagagattgcagcatgcgtcgttggactctttaagcagacgcacgcttccaaagtcccattctgaaacctgcctatatatacagcgcacaagcctccttggcactgtcaccacttagccagccttcaccattttcagacttcagagttgtgtacaagtgagaagccatgatcaagctgaggtactccaagaggctgttcaagaggagctgctcctcgtcgaaggcgactgcttgtgtcggtggcggcggcggcggccatggcaatgcggtggccgccggcggcggcggcggcggcgcgggggagatagggtgggaggtgaggccgggagggatgctggtgcagaagagggaggggagaggcggcgaggaggtgatcttggtgagggtgtccactggcttcgcctggcacgacgtgtccattgctgcgacctccacattcggtgagttcagagttctcagtctttgtttctctcttgagggaaactgaatatttttgtttgcttactttggtattgtttgggctgatgtgaggaaatgttcatgttggtttctatctctcttttttttttgaactttagagaatgttcttggaacttgttttggtcatggttttctttgggaacctcatcaccaatgcacaatctttttgcaagaacgataaagttcaggactgaatcactgcactccttttcatcagctcagatgctttgccatgcatttgaatcctagagtaaggtctattagtttacagctaaaagctggggggcaaagaagtgtaaaagaaagagaggaagaaaatttcatcaattttttagggaaattccactattttttgtttggtagtaggtgggtcattggttgcagttaagaacccatcacacctcccccacacactttgccagtttggtgtgaagtaaatatcggttcagttagtagtagcactcttttgcttcacattttccttgcaaaactaaaatgcttttcaagattgttctagtcagataatggctcaccaggtgttcataaagacacaattagcaaggttaaactacctttggtcttgactgttccatcatttcacctgcatatcctagacaagccaaaatgtgaccttcttccttttgcacttgggcaatgccaacatttttgttaacttgacaactaggagggttgcttgctttaattgaaaaaaagaatagcagtgtaccactactgctccataactgtacagaatggacttttacttgtaaaaagtcatacacgctaaagaaatttatggctgctaccggcactgccagcacatgctcatatatgtattgtatgcatctgccggtgcctgacaataataacatggcttggaggcagacaaaattgcaaaacttcctgctacaatttcctttttatttccaagcaagcaaacaatctactattataaatgaagcccaagcctgaatttaatgttctgtatatgtaacaacaatattctgcatcttatattgcaggtgagctgaaggtgaggttgtccatggtgacagggctagagcccagggagcagaggctgctgtttaggggcaaggaaagggaggataccgatcacctccacatggttggggtgagggacaaggacaaggtcctcctcctcgaggaccctgcccttaaggacatgaaggtccgggctgccctcgcagcagcccgggtcatgcagagcccgtgccagccttttatccaagtctaagggttagttggccgtgacccctgttctgttaccacgctaactattagagtactattaataagttgtactacaattttagtcgatcgacatctcaatttctggaaggttttattatatccggaataggtggggggttggtgctgttcaccccctcctctctttagtttactgtcagtggtgccactccatggtagggcaaagggtccctcaacatgagagtgtatgagagtgtgtgagttgtttaatgatgggttagttagttgcaagtgtccagccatggtggttgtgatgtgatgtgatgctaagctttggtgctgggctcctatggtccctggtactgtgctctggtctttttcccattcctacataggttatggacaggaaatgggggctaaagacgatgtattttgtgttttcttgaatggaaactgaatgtgtgtgttcgtttcgttgttcctgccttctgtcggattcctcatgattttgattgcgatgttgtttgtatggagaaagagccatgaatgatgcttcaggttgaagaaacggaacattggtgatatggaaaatctttaggtgataatggaaaatattgtgcggttgtgccattgagagttttgagacaatgtgctaagttgtcttgtgcggaaattgctacgtatacgacctaactgtccaactcacgtatgaatgaactacatcaacgattgcaaacggctgcaatacatatgaatatactctcctttgattgatacatggttgcatatctctagttgtatgtgagttgtataactgggtcgtacgtatagcagtactcgccttgtgcttagggcttatttggttcataggatttccaaaacataggattaaaagaagtaaattattaggatgacacatgcactctaatccttagaagttttttttatggaacaagattataaggatacaatccttacatattccgtaggatctgttactatgaaacaaataatgcacaaagaaaaaaaccatgaggtttcaattactacaataatcctttggaaatcttttgaaaggaatgagcccttaaagatttcagattgggctgtcagtgagtacaaaatagtcaccgagatgttccccatttacagacatcaacaaccaacatctgcactggaataaagctttcgcttatctctttcatgtttgaattgacagcattgacactgaaacactaaaaaagaaaggtcactaggcttcagaagaaagcaagtgcaaagaccagggcatggcctacttcatttataagctgttttaattctcaagtatttcacttctcacgctaagaccagggcaattgctaattaaattgatcctcgcagatccaaatgtaggaacaaagggaatgtcaaaaacagccaacattctcaaataccaagttcataagatttcctgaaaagtgggtgaaatgacaagttcataaaatttcgcaaaatggtaaacctgcctgaaagcttctgaataaaagggcagtgaaaaacagccacaattactagtaagatgcgaaatttacataagtattcttggagacaaggaatgcagcattcatagaactacctcatgcaaaggccaattgcttctggatgtacacttgacagttcagagaactgttcagcacttcagttttgtcaaacagccaagaggataagcattccccggccattcctgcactgggcagtacttgtgttgtatagtggagtagtacataaataaagctacgaaaggacgatgaattaggctgcgttttggcgccaaaaaggtgagaatttttcgctctatcttaactgcatgcatcgatgcctacccccagattcccaatctagtcttgttgatgcaaaagttgacctagtaatattctctgattctctcatcaaaggggggaaaaaagctcatgcctctttcctttctccaatccccatcatcatcagcaagaggaagcaagtccactaccactcactcatggtccatgactccatgggaagccatgcttctatccacaccacatctgccacatctgcggattgattgctcgccgatctcgcgtgctggtatcaacgtggaatagtcgcgcgcgcgcgcgtgcgattcgcgggtcctcgcgtcctgtgtgtcccgtcgaatcagcgtacgagcgcgcgtggagggagaggtggtactgcaggtctgcagcgttgcggtggccggcgatcacgggcggtcggtggcgggctccccgccgcagccgccgtcaaaatctgcggctgttgtgtgcgtccgcgcgaggctggtttctctctcgttgcattaattcgggtcggacctgagaggcccagttacggcccgtcagtcaggttagaatttttcactctcattgactaatactaaactgatagcactgtggtacgtaccaactgtgccgtattgacgtgtttgtatcaccgtatcaccttacgcctatcagttatcataatgtaccatccagcaaaaattacatgaaaatattgagctgatttgtattgaagtcaccttacattacaccttaaacacttttttttcaactttaatagtaagaaaaattagttatatgaaattgaaaattcattggttttcttatatgctattgaaaattcactgtcatctctctcactctccaaccctcgggacgttgttggcagtggtgccattttcatgttggtaacttcaatccctacgccaccaacgtcatgtcgtcctcccattgttgatttgttgcctattattctgcaccctatacacttcaatccttatacgttccactgccatttcattgtcccccatcctcccatcactatttcattatcccccgtcttgtcatcgctatttcatccccccccccagatccacccctctccacttcaatccttttctcccaaaaatctacaaccctagggagtcgtcggacgccaaatcatcgccccttgcttttgaacctttgcacttcaatcattgcgtgatctcccatcgtgccagtttgttgatcttgtctttctaccccaatctactgccccaagctccacccctacacatttcgatcc

SEQ ID NO: 42141 - DNA, 3137 bp, Oryza sativa
ctgctattgtccttcactgatgtatggttgttatccaaaagacatattggtacgctatcacattaaataggcatatatttgtataatatatcgtatacacttttgttctcttctcgtgttctcttctcgtgtgagaggaataatctaggtaccatagccctaccggttgataaggatttcatcaagattcagggggtgtttagatcctttattcctaggactaaaataagtcctaggactaaacacttcccgatcggagatccatgaatcacagacgctagtccacggctgtttggatatagggactaaaagggaaggtcattaattacactgtataatggccatgctaccctaaaagcatgtaaagagagatgcaccatgcctatgtgtgggggcagtgggtggaaaggagctattttagtcccaataagctcctaccataggaactaatggactaatgtactttaagtcatttttagtccctcctgtttgagactttagggactaaaagggactgaaactttagtccctccaaccaaacatggcctcatgctagtgcggaccgctttacataaaattaaagttatctaaccggttgactgtgctcgtggtgtgggaaattgatcttgtgtaccactgtcaactctttactaactaagcaagcagcaggtgttggttgtatagctaaaataaaattcacgttgcaatgacaatgttagtacactatagttatttgtaattttagtatatacgagttgctaatattattattttgaattaggatgtagcaaataaactacacaatatatgtatttgatatcatattatacgagagctcttaagggttgataacataattaaaaaaagccaactaatttcgattaagaaacatgtcaggtgctatatggacactctaataaggaaatagatgtatagttcattgaaactgatgattaggaatcctcccatcaagtgtgagtacacaaatagcaatacccgaatctcatgaaatgtctagggtttatcaaaccgtgcgattatcacggttatcacgtgcggtatccttttcagttttcaaagccacggtatacctcataataattacatagtttttatgataaccatgtggttaccagggtaactgctaaatcgtgggtggtactggcaagggtctggatcccctggagttaagtataactctaccgggtggagttggccaaatctgtgctatccattgtttcctacggctgagatcattcctcatcaatttaacctaataaattttttttgaaggaaatttcacctaataaataactccttaaattaattaatggttatgacttagttttttcatgtgtttgctcaataatagcgatttgattaagttctcacccccaaaaaaaaatgtaacagaacaacgttttgttattccccaaacaacagatatagtcgatcaactctaaagcggcagtcagtgtatatcaacatagtgctttcacatatatgcaaatagcaaaccatatcaatattaatgtgtatgattttttaaataatagatgaatcttgaattttttgtgctaattatacggtaaaaatgatctcgtgacaagctgttgatgcaagattatttgttgcatggtcagttactggtttttaagtataaattaatgtggcttaatcctagcccttgaagtatgccgaatggcacagatttgaccaactccacccggtagagttatacttaactctaggtgatctggctccagataatttggtaaacctggtcgggatccaaatcgcgaaagcttccggtgcttccctgcacaacggtttttgcaaacgaggctattgacatctttgtcttctttcccctgtccactgtggcctctcttctcgcagtccagaattcggatggcatgtgctccggtcaccacgcgactggatttttcatattttggtccttttaaaaaatttatttcgcaaatagacccctaaaaaaacttatcctagaaatggtcctttttggggcgccggagtggctggcgccgtcatccaacgggacggcgccagcctctctggcgccgtcctcctgccaccgtggcgcacgcgaaccgacgtggtaggaggagcagctggcgccgccccagggaggagggcgccagcatggctggcgccgccgcctccatttctgtttctctgtatggagttgcaacggtgtcatttttattttattttttcggatgttttttcacactcaggatcacgatacaaccaaccacaaaaaaaatttaaactcgaactaccacttagctaagtctgaaaatatctagcataccacttagtctactttgcaccttcactaaaattagaccataactcctttagtaaaaccctttgattagcatgttaaacataatgcactctaccactatatgaaattacttaatctaattcaaaatataatcatatgaaatgacatatataagttaaacagtacatagacatgcaatttttttatttttatttcatttttttgatatttttttcacacttaggagaacataggaaccaaccgtataaaaaataaactcaaacggacaaaatatgtgacatgtagaattttccaaaactctaccgaaacggacaaaatatgtcatctatttaaataggcgtaactttcttatacggactcgaaatcaggaaaataatatatgcacagacatctacagaaaaagttacatccaattctccccgctttgccgggttcggcgatattaaatcccccaaattccgtttgcaagattgtgttttcgaggagagaagtttttcggtggagctttggaaaattccacatgccacatatttcgtccgtttgagtttattttttacatggttggttcctgtgagttcctaagtgtgaaaaaaatatcaaaaaaataaaataaaaataaaaaagttgcacatctctctcctctgcactagttcggagagaagagaggagaggaaaaattctacatgtcacatattacgtccatttgagttcaatttttctatggttggttcttgtgtgttcctaagcatgaaaaaaaatatcaaacaaataaaacaaaaataaaaaatttcgggggggggggggg

SEQ ID NO: 42142 - DNA, 1857 bp, Oryza sativa
  unsure (1)..(1857): unsure at all n locations
agtccccctagccacctcagcatcaccccgccacattggcagggggacggcgccaaagaggctggcgccgtcctgttgaacgacggcgccagccactctggcgccccaaaaaggaccatttttcggataagtttttctaagggtctacttgcgaaataagtttttcaaaaggaccaaaatgtgaaaaatccagcaccacgcgacgcatccggtcgggaccatcccttccttccctccccttccctgccaaactcccagcttcgcgctgcctcgctgccgctgccgccgccgccgcgacccccacttctccgccagcaaagcgagctgctctgctccggttgccttcctccctaagcctgctctgctcgcgggcaccagattcggcgggcagcgaagcagacagctctctccgcccctgccttttctgtttcttgattagtataatatcaattaggaggcttttctttgctttcgatgggtgtgtgcgtgcgtgttggtaattttgattagttagcggcccatcctagccacgcgacgccgatctccagggcgcggctgttcttgccaaaccgcaaccaccactagcccccacttcgtccggttttaattttcaattatcttggcagttcgtgagcctttcgttttcttggggctccagggtttcgcgtctctctctggtttggactttgagacttgacgacgctctggtgagcggtgagtttcttggaaaattcttgctgcttgactgcttttttttttctatccgtttcctggagagattttcggtttactcattgttgattttgccgtgattgggttgggcagggttgatcggcgttgaggaagagattgggcggaaggttgtcgatggagccgccgtctgggattcgggcatctgcctggagcttcttcaagttcctgcctttcttccttggccttctcctcctggggatcatcaaaggtgaagagaaaacactggttgtattggttcatcttgtttggttgcttctgtttgtttgtgctaagaaagtattgtcatgagagtattagaggagaacttcacatagcagtgtctctgtaattatgtactgtggaattgtggcgcatttgttagtttttgatcagaatggcaagccgaagatctctctgggtgacccatttgcattttccttgcattagggtagtttggttgagtgggttggaattggaatcgctcagaggatgtcattgttttcctttttccttcttttttggctgattagttaaagttttttggattttagcctctctttttttttttgttctggttcagctggagttcgtcacttgcacttcatttagactgattgcaactgtccattgcaaaaggggaattgaagtacggtactaggtatctgtaaattccagaatgcaaaatcgttgtacgaacttaaatgccttttcagcatatgatcaaatactacttagtaatttttgccgtcccatgttcccatttttgaacctcagattctgacttgcaattcctccctacgtgttaattttgcctatgcaggtgctttgctcttcccatgggcatggcttatcatgatgatcggaatctctgcactcgttcttggcttatggcctatgcatgtgatctggacatactactgcatcatcaggtttaggattcacaactcagtacagatccgttccaaagagaattaccacataattatgaaaactgtacttatatatgcttgtcatctttttttcggaaagcagatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 42143 - DNA, 4388 bp, Oryza sativa
tgatataccagtgttttggcaaaaaaaaataaatttagatgttttcatatggaaaaaaactcaaaaagagtccatttcactcatccaaactattttaggttcattgagcattaagatatcacattggaattattaatattgagaaggcgttcttaatggatgaaaatttgatgatatactagtgttttggcaaaaaataaatttagatgtttttcatatgaaaaaaaaatcatttcgctcctccaaactattttgccacagcatttaacctcctaacaattcctcagcttagtttacaccctgaactattgaaaacagttcaacttactctctaataatattcctcaagtactgctgtactcctacttccgaagagatgacatgcatgagcgcaagagcaggacagccatccgtcgatcgaactcgaacacgaccaagtctgcactgtgttgatcatatcagctcagctcagctagctggtggccagctccgtctcttgattgcctagtgctgcaattatatcgacccagttctagctagctttgctcaagttgtccaagcagatcgatgctttgaaacaacagcctgccgaaaataggcaatcgattcttacttaccacgatgagagtaattatcctatgaaatggcatatgatcattgaaacttggtagcagtttcgccacgacacaccgcaaaaatcctttttttaaaagtactacctttaatttaaaatatctgacgatgttgattttgaacataacagctgaaagtttattttattttaaatttatcattaaatatactttaagtataataaattttaaagtttcactaaattttgacaaatgatcaaacgcatataactatataagttaacggtacgtacatttaaaatgagtacagtacaatggacatcggctcacacaacacaaccacacccatatcatcacaaacagctctatttttttccttctaacttttacatgatactcactctgtttcacaatataagtcattctagcatttcccatattcatatcgatgctaacgaatctaaacatatatatcaatctagattcaaacatcaatatgaatgtgaaaaatattagaatgacttacattgtgaaacggaggaagtactttcggcagaggactaggagtgaggtaggagtgaggtgggagaggtggggaatcgtgtgagatgccctagtgccctaggacacatttcctctcatatctgatatgttggtctagttgattaaagccaatgtttaaccccagctagttggtaacgataatgtattgagatccaatgcagttgtcactatgactgcacaatagcaactgcacacaatttgagcccacacaatttgagcccttcttgatccaatggtccaaatctattgatacagtaaaaatcaaaattttactatttgtcagagcaaatcgctgcagtatttagatgcgtctggaattctgaatcatgtgttttaaatctggtggtgctcgtgtgactgcttaacttgtggccacactagccactgcacctcaagcggatccaacggctattcatcttaaaataagtttatttttcacctattccacacatagtaattcaaaactaaaaagactataatactcatactttatcaaatctcaatacaactatttccactttatctactctcaatacaattatttcgtacttccacaaatttcaatgcaatgattattctacaaatgaacttattttgatacaaataaaatgagctaaaaatgaacttactaggagacgtaggaagtatgctattagttcttataaaacaattaatttatgatataccagttagacatgagccctagctatatttctatttaaataatagaggggaaaatgttattaataggaaaacgagtaaatttcggaaaagcacaactattttcgttaaaactactagtttgcgacaacttcacctggttttcttacaaagtggaatggaacaatagttgatgattttctgcaactttttttttgtcttattggttttggcctatatgtcagacatacatataaatatataatacttatactgttgcaagttgggtccacatgtcagacactcataccagttaaagttgtggggttttggtaaaattgttcacaatcgttgtagttttgttagatgtcctgctatagttacagctaactgataagctaactgataatttgcagttttacgaaatccactctaggaaatactactccctccgtttcaaaatgtttgacaccgttgacttttcagtacgtgtttgatcattcgtcttattcaaaaaatttaagtaattatttattctttttatatcatttgattcattgttaaatatactttcatgtacacatatagttttacatattttacaattttttttaataagacgaacggttaaacatgtgttaaaaagtcaacggtgagtattagggtatgcagagtccaggagcaaacggtcaaatttctcatttttagaacgcccagcagatggggtcaaatttatcatcaaggagtactactcaattgttgcaaaacccagtgtcatatatatgatcatcctcggtgtatctggtaatgttgcttgatggcatgatagcaacagcatgccggcattgacatggtaaaaacaaaaataactaataattaaaagaggacacacacttcatgtggggtcatgtggctcttaacaccggttaagagttacaagaaacatcattttgtttgacttgcctctatcgattagtgtgaaaatacagagaagacgtttggcttatcaactggcgtttagatgtcatgagactatgagagtgataggaggagagtggcaggtcaggaagaatgatcgacaccgggacagatcatacttaattatataatgtcgacatgattgttgagggaatgatacgtttttaggccttgtttggggcaaattcttgtgctggctgtcattgactaggagttgtgttcttcgccctggaatttaatctttcttgggtattgcttccttatcatttgatcacctatcttattaaaaattacaattatcatttactccctccgtctcaaaatataagcatttttagtatagtgacaagtcaaacatttttaacttttaccattaatagcaaaaaaataaaaaagattaatcatgtaaaattgatgttactagatttatcattaaacaaactatcataatatcataatatgtaactctttttatttaaaacatcttacttttatagatattgttagtcaaagtagcatattagagaccgtgttagggtctaaaaatgctatattttaggaactaccatttgtaaagaactaccattaatttccttgaaacttgatagcaatgatccaggcctgtttgggaacaataaatttgaccaaattgtatacgaaagaaagagattcctacggaaattctacctcccaaacgagatgaaacctagtaacctacaggctacagccataaattcaaaacatggaaagcttgatttttcccccatacatgtacaatgggcttacattacggagccgcaacaactcacagccggaggtgctcgaaaagcttggacgtcacaagagcagtttgctcatagaccgatattcgttagcgagattgcagttcttgaagcagagggccaatcctttgagcgccaagaaataatgcgtcgacaagcacgagtgctccaacctgttgttccaggaaggaacatataaaagcatttccattggagaaaagaattgatgtgtgcctctcttgaattcagagaattaccaaacggcctgtgaagatcagacggtagcccagcccttctttcacagcctgcgctcgttgctgatccgtccagctgaaatgaagtcgttgtcagtacacaaagcttaaagatttgtaatcagatggagtgctctggagtatggaggagcgatagtgcatgcttctgtggaagtctgaaacatatttctaataagaaaatcccattataatgctcatctgcctgtgtagacacaatctgaagttttaagttgttggcgagttctagcttgcctatctcattatcacattattctgttcttgtactcaaacaactgctttgattttaatacatgacttgtgtatgtagattggacagataataatagggataataaaccactaggaggggagaatagctggggtcttgaaacctacccgaaaaattccgaaaccccaccaataccagcaagcttgaaaggctggggaccttctcgctcaaagtcctgaaggggtaaaattataaaccataattcagtaaaaagaagtactccctccatcccctaatataagggatt

SEQ ID NO: 42144 - DNA, 2087 bp, Oryza sativa
attaggggacgaagggagtagcatatatgaaataattatttcttttcccaattcctacctcctcttcagctgcttccagtcctccttgtacccagaataaattttggaaaccagcaccatagagttgctcacaagcggccaatgatctgaccgaattacgggcaaaagtgaacacaactaataaaattacacatccatgaagggcaacacaagaatgcattactgaattgactttctcaaaaggtaaacaacgcgataaagtattgatatgcaattatgcatatcaaattcagcattgataagatagtgaattacctcagtcccttctggcaaactactatgatatctgtatctttagaaaacttctcctcaacttgttgtacaaagttcctagcaatttgatctacgatcagtcaatcttactgttctgaaaatagcagatgaaagttctaaattcagtagatgttgagcgtacttgttaactgtcattgttgagctgccactccaccagccacctagggaagtcatgggagttcgatcatttggatgtcccgaattgtaggaggggtgatgtaagagttgaaaaataaattcacaggctcacagaggatagaacactaacataaaacagaaagctacacatgccttggttcaagtaattgtgtttcatgaactactactgtggttagtatgatggtaatctaaaagacgtatgtaaactggtcaaacagcccagagaaaatcatcattgcattatccattctagagtgtacacatggaaaacattccatgttacaatctcctgtgcttagtttaatgatgaacaatgagaacaaggtttgtaaagaaagcattcaagaacaagagattgacagtcaggtttgcatatggtgaccctgtttagcatacccatcacatagttggtgaatttcttgccggcgccacccaaatcaaacgatgtatccacatcaaatacaggaatccaggtagagcctttcacccaggcctaaaatgcgccaattcaaatacaatcaaggacaacgaaaaacaatcccattccgcaataatcaaacacccctttactttaagagtcttgacaggcagcgagacacaaccttttgacgctcattcgagggcctaacatcaaggaggaccttgtcagtgagcttgaatgtatagccagcttccctgggtgtaagagtcttgatcttctgctccctaatcttcaggcagagcatcattcccacacacacatgaacagcagaagatcagcatttcaatagccatagatcacgcaagatgatactgaattgaaacccaaatgtgggggaaatcgtaagaagaatttgcaggcagggagggttagggtaaggtgaagggacacaccagagtctcccatcgcctccgggcggcggccatctccttggccagcttcacctcctcgtcctcgccctcctgctcccctcccacggccgctcccatcctcaccactccactccacctctgcacccaagaaaccactcacacagttgcagtcaccgctcagtggaaatgagagcaaaggagaaggggaggaaagccaagaaaggaaaatggccgcacctttgaaggaaggagacgagggcggaggcgcctggagcggcaggaagaggaccacgccgcggccggggtggcggcgccggcgccggatacgcggcgcgcgaggccgagaggtgacggtggcgcggccatgtctgtgagatggccgtgttctttcagaacggaggttttttttagcttctagccgtagctttatccccccaatccagttccctgccctgcaattggatgatgggggtgcaactccagacttgtgggaccctcgacagcgctaagccagattgcgatgtagtggtattttctcagtcccaaaatagatcaacgtataaatacgaaaggtgaatctaaaatgaccttttttaaaaaatgaacacgtgataaatgtttatttttcacaaaaataagctacctttttaaaatgggaatgctatgagacggctgccatttgtatcatgtcctaactgatatcaggcgacacctactaggta

SEQ ID NO: 42145 - DNA, 3406 bp, Oryza sativa
tcatcccatcctaggtgctatattttgaggcggagggagtaagttctaagttctaactggtactatcctgtttgaatgggattccgttctaagttttaagcaccgtcatcatgtatcaagcctacagttggtacttgggccggcacgtcccataatgggtctagaatcttggcacgacgggcggcctggcctggcccagcctggtaaatgggccattcttgtgccagctcggtacgctgataaaccaatagcatgtgaatggctcgatagcccaacaaacacaaggcctaggctgcgaggtcaccccggccagctcaccacagcggtgtcgtgcgctcgtccgtcggccaccgcggcacactgtgtcttctctcgagacatcgacattgaaggtgctcggcggctagcggcgatggagaaataggcggtggcggtggcagcacaaggtatagcgacgacgttagcctttctttaagcaataaaatcaacaatcaatacaaaatcataggtaagtgcaaaaccattattttatggtgcagtacagagtctagtggagtgcgagtatatactccatccgtggacttgtgggcccattaccacccctagccgtgagagacggcgacctggagaagggtggtgagctagcattggaggccggctaaagcgagcttgttgttaggacgtggtgtggatggtggtggatccaactgcagggagccgttcaagatgaggaaaacggtgaggctggtgcacctcactaccaactactaaaagatgagttggggggaggggggaggggaggtccaccaagggcgcataccaacggattaaaagatgaggagagaggggaggggagggggtggaggaggagaaggtcagccaaaggggcctcgttggcgctattgacgtcttcatactaatcgatggggtcgggcaatgacgcattggtgcagaggaggcatggttgagctgatgtcatgtgatgccatggagggaagagaaaaagaacaggagggttatggtttggagggatttacacgaatcttaaagcaacccgatgatctaaaatctacaagattgtaggggctcccaaaatttaactccaattaatcttggattagggccgaaacaattgatgatacttgttcatgctgatgttgctgaaacaatgtttctttgtagaaatgaatttacatcttatgttgcttgcttcatagagtagtgcgaaagagatgcgcacgatctcgcttcaatctgatcgcattgttgtccttggaaacaagacaacgctactagaacagggaaccaactcatttacctggcgaagtatgcaaggcgacaattaatggaggggatacactgaccaggattgggcatgcagaaatatgtgttcagagcacttcgggagatgccttagcctttatggccatccagttcccaggctcccagctttgcgattggatcaggggagtgcaaatgcagtcatgtggggccctggggtcagagaggagcctgaagaacctgcatcactggctcactggctcactgcatgacaacacaatacaacgaccgcgaacatagttacacaatccacaagtactcagcaaatatgcaaaagcaggatatggtgttacactattgccttacgccagtaatctacgaagacttcattgttcccacaagagagattactagtttggcaacaagcgtacaacagattatataagacagcacatgtccagagtaacatttacttcgaataaattacaggctcgccctcaatacaggcgtacaacaaattgcatcgcatctaatctatagtattcgtacatggcatttatacattaaaattggtggcttaaaaagggagaccttgggggcgcaatccaagacatttcttcagggcgattctggccttctctgccatcatataaccgtgcaggttgctccatttggacagtatgaaatgtcttgctgcacacatagagcattatctggcaacagccattgctaaccgcggtgacaaacttggccagtgtgcagtgccacatcgccatgctgatctggtgtctgatcctcacgtgaacaactctttagatagaagctgttgcgcaaggtactggccttctggttcctcaaggtaaaccttgtcagtcagataattctgtagattacttgcagcctcagcctgaattcgtgagccttgttccttcaaagcgggtaagaagcaccgcaatattacatctagaagtttcatgaactgtgatccgtatttcttgtgaagtgcaaaaccagcaacctgaacagaaacagaatccaagttggctacaacaaacctgctacaagcacacacgcataggaggggatgggggtcttgaagcatatttttaccttgaggaaagcatgaagggcacaagcagttgctgtggtggccgggagagtattaaggaacatggcaagccatttccacccctcagctaagccatgtggatgccgcacgcccctaatttcggtctgtagaaaaaaattgcggttgtatttcaattctaaataaaacatcaatttgttgaacagaagtctgctgctcaaataaaacgatcatatgaaacggtattaacactggatgaacttatggaactgtgatagtgaattcaattaatgtgcaaagcaacacatgttacactcagagtcagtgcactgaaaagagttatctgatcactgagagtcgtatgcacaatgcactgtgctagttggagccattttggcaaactgtctttcacgttggttgtaatggtttttctgtgagctcgtcacctctgtggtggcccatgtctaaataatatcccaggaaagaaaaactgacaaattgcaattaaagagaaataataagccctttttgcaacaaccaacaagacaagaaagcaccatattagtagagagggaaccaacaaaacactcaaaaccattaaatgcatacccatttctaacaattaataaccctaacagctatttttaccacactagtaatattagaaaacaggccatacacacctgaatcattgcagcatacagcttgacgtatgcggcaacatatgtcaaataactttcagtgctctcgagttgtccattttcttcctggtagccaatcagtctgtaataatctctattccgtacttgtgcctaaacaattacaagtaaaatcaggaaaaaaaatacatgagctaaacacaaaaataattatgtgaataaaacatcattataattgttcaaaacacctaaatagaacacctcacttgttttttccattgctgctcatatataagcaagaatataaacaagctgcaaagatattgaggagtttagtggcatgaagacttacgtttaaagcatgcagatgctttggaac

SEQ ID NO: 42146 - DNA, 7442 bp, Oryza sativa
aactgtgtatcccttcaagttttgcatggttcctggatcccactacaatggattttaattatatttcaaatattgctgttaggagtaggttgtctcagtaccacaacctttgtgctaattaaggaaacatggtaaagttctaggggctgaacatgggttttgcatagttgaagatcagttaggggtgattatccttctgacatgttataatacttttacatgatatatatggcccttcatgagcctaagcccacagtctaaataagtaaatatacaagaaaaatgagaaggttaatccttaaatttacgttttagattaatatccaccatttgatgttcataagcattaagctgtgataatggctgcctgacttagtatgaaaactagtttttaagaaatatgtatatagacacaacctgattctactaagcatatcaatcagcagatcttcagaatagctccataaaacattgcgatataaacttataatggttctgtaaaagcaagaaatacctggtaattcagatttaatttcactcttgtttgccctcattgttcctgcaacgttgttctgagaattttggctggatttggaaacctcagctgctgctttctgagcttctgctgcttcctttgcagcagcctcagctgctgctttctgtgcttccactgctaactttgcagctgccttctgtctggcctgcatcatagttcatgaaatttctggtaaactggttatgcatttaagcgactaccagtgaagtaaagaaaattaggtttctgaactacgtaggttgtaaagaagttcagtgaagaagtaacatgaataacaaggtattagatataactgaactagatggaactcaatggactaagtattatgataaataccagagccaaaagaaataacaatgaattaagtctcacatattgacatatatcaaaagaaatatatcagtttatgttaacaaaaacacaccaagtgaccagcacatctaggcaaacaaacctctgcttcttgtttggctctttcctgccttattttttcgtccttcatggcttgctcctttcttttagcttcttcaagagcagcatcatctcttattctacgttccacaatttgcgatttctgttcatgatccctttggaccatagacaaatgtttatcaagtacttctgcactgcaaaaaggcaacaattataacaaggtacagaatccaacaaaagatcatcagaaaatccaagtataacttataacgaaagatcatcagagtatatgtcctttatcctgtgagaactactacaaaggaaaacaaatacaaacgctaacatgcaaagtttctgaaaaaatatttacagtgctaatgattgaactggaacataaagttactacacaaagaagtacaaaaactatataattgtgtcacagatagttaattccttatataacacaaatagagcatttaaaaaatagtcaacccttagtctcagtcgctaatcatttgaccaaacaccacaggtataagtatggaatatttgtacgttaaacccacacgatttaatcagttgtgaatagaatatataaattgctgcaaaatgtaaagagctgaaaccttgggcttggaatttctcattgatcatttaagtagcaaatttaaccaaataacgatgaggataatagcaaatggtggaggaaacattaaggatcttagtattagtccacaatcacccaataaacctttatattggaatttgtgcatataggagatgattgttttctcttcaaaactatgtgcactagaaataatccatgataaactgtgtagctactagcaaggtccgtcagccttcatgaatatataccttttccactcaggagtaataaactatattggaatgaaaaacttagcactttgtaagccctctttacaataaaataaattgagttatgacaaataaaaatggcataactttacaaagcaaccaccaataaaaattcagtcttgacaaactagtacaagaatatcttgatatgtgccacagaaaatcctccagtaacaaaagagaacaaactagtacagaagttaaccctagtcccagaaaattgcatcaccaaagaccttgtaaaacatacagtttcctcaaaatttgaaaaatcaacagtaatcatgaaatgtagatttaaaaagacacaggagaaacaattcaacaacaaaaacatacatttttctctggaagtggacatctagccttctgtctatctcttttcttgattctgcgtatttctgtagtcgagcaaatgcagaaactgttcgctggatttcactttggtggcatacctccaatgcagatagtttacttctgacttcctcctgaagaaaaaaaatcatatgaagaaaatgaacaaaaaggattcagcagatttaataaatccatcatggtaaaaaataaaggcatgcaacatcagccaaaaagataattagtactatgatacccaatacttagaaatttagtcatatgacatccctgttggctttctatgttaaacttcttggatcacaatatccaatttgaagtaaatgcagtattgtatttgaaaaatcttcttcaagtagcaactaacagaagtgatgtattgtttttcttgaaatttcatcatgtcattatccaaccatatcagtgtggcactacactaaccttaaagggaacaaacaaaagcttcattcaggaattcatatacagtataaccttagaaagatgaaagataatggaagcatccacatgcctggatagcttaaaatacctacataaaggtgaggaaaaagatataaagttgatccgtaaagtgtaacctaatgccatggtaaccctaaactagaatgaggattaatggtaatgaaaataattcaatggtctattgccaacacatcaaagaaaaatcagcccataagtactgcattcagtaagaaagatataacagtatagattgatgaatacacacttgaactttcagatgatgctcacgttccagctcaagcagaatgctcttctctaggctccgtttctccatcaggtgatatggtgcaatcctgccatccatttcatcctctgattcttcagcatcactaggaagaaaacaaaagaaggggatatctcacacaatacgccattcatttaaacttaattgcagataatgtaccgtacttcaaagcaaataaattgcaattgcagtggccaaatttcagcatcaaatcttcacctggattcaagatcattgcatgagaaccttgctccagtggccttggccacaagagcccgggactccccatcactgtcgtaatcgtcctcatccgtgtcatcttcctcttcaacccgcatcacaaaggccttctccctcacgctgccactgctagccctaaatgaaccaaaaaaaaatcatatagaagcaatgtagagggaaacgattgcagcttatcggcgaaaccataagcaagggagcgcaagggattggagaatagagataccactccggcggctgcttgaggggcgtgggctgcgcggtgcggcgagtggcctctagcgcgtcgagctcggtgaggacgtcgccgagggtccagctcgggcgggggtcgagggccctagggcaccgcagctccacgcgcgcgaagcccctgcgaggaggaggaggaagacgtagagatcagcctgcctgccattaacgaacaccaagcggtgacgagcggaaacggcgatggggggctcacatggcggccgtcgaccggcgaggtccgccccggagcggattggagccgcgccggcgcatcaaaaccccctaagttgcgggaggcggcggcggcggtggcggagaggcggtggacgctagttgggtctcccggctccagtcccacctccagccgctaatggagccgtgcagacaagacgcggtctcccttgctgccgcgcccggttggcttcctcgccgtcgccgctgcgccctgccctcccgtgccgcggtgccgctccgcctcagactggccgccgccgccggagcgcgaggccgggatgcgccgccgccggacgtagaggagagatgggccttgggccgaacactggttccggaggtttcgcttgcttattttggaagtacggttttctgagagcaaacggcaattcgaaataaaaccccagaacggaactacgataaaaaaccaaaacggagaacgaaaccgaaaagcaaagaaaaacggtagaaattcgattcggtggaccgacttggatcggcgatgcgaggaggtcggcggcgcggatagacagcggagcagatcgacgccggaatgggacggggaggcagccgtctaggccatggctgggccaatctggcgggctggggaagacgaagatgacgccaaggctgggccaacctgagcttaaaatgtcagaataagtctgtttcacctctctctctctctctctcttctttttctttttctttttctttttgcccttggtcgcatcgcatcccttaaccgtaaaaccgagtctaacattccaacttcaaaaacgggtttagattgactccttagatggttttggaagcggcttttgctgacatggcaatttgactttggtttaggtatgctgacgtggtagcccggtcatcaaaacaattgaaaatagaaatttgtcctatatgtaagtgataagaatgaaaataaaaaaatttgggacccaattgtcagctccattcctcccttcttcaatttgtatgtgcttcaagccgcactatgacacgtcaaagtgcggcggtgtggcttgcggtgtgtacagattgaagaaggaggagtggggctgacaactaccccttcccctgtttttgtttattttcatccttaccacttacatgtgagacccatttatatttttaattcttttaatgactgagataccaccttaaccaagccaaattgctacatcagcaagaaccgctttcaaaaccaccgacggaatgaaaaactggtttttgaagttgggggaggtgttatatcctgttttgtggtttaaggatgtcatttgaccaacagcaagggatgagtgaggtgaaaatagacttattcctaaatgtatgatcggacttggatgtcccattaaagaaacatttcgggcctattcagattgtagccaaaataaaccttaccaattttttttcaatttggcaatattgccaaattttgatatgatatcttatgtatttatcagagtttggtaaaaattaaattgatgcacatatttaacaactttaccaaaaaaaatggtatgatttgaaatggcatcaatcttaacaacccattcatatgatcaattgatcatgttattacaagaagcaaaacaacttaaattttgtttaaaaacacataattatatattatcccaacaaataaaacgaaagaaaaattatttttcagagataacaaaactgaagagaaaaataataatgttacgtaacatggttaatcaacaagtctcggagatcgattagccactgcatccgaagttccgaacatccgtctcgcaaagtgcatgctcccagactgacagaagaaaaattattgtatgtttagttaacatcaaaattgaaagtttggttaaaattagaacgatgtgatggaaaagttgaaagtttgtgtgtaggaaagttttaatgtgattgaaaagttgaaagtttgaaatttttttttgcaacttatcacggcgtaaggcgcaagaagtatagttaaccaacaccagtaatatcgtacagtactactccaacatgtcaccaaacttctctcggcgcgcccggggtgaactccaatctacccgggatcctaactcgccaccaaacctcctcgtcgttcttcttttaccgcggccggacacggagcaggagcacgcacgcacgtacggcgcgcgctcgcctcactgcatttctatcccggccatcggtccggccgtcacgatgcgccgccgcgtcgctctgtgcctcgtgcttttcgccttcgccggcctgcacgcggcggcggtggaggccgtgacgctgtcgacgtcgtcgcggtggatcgtggacgacgaggccggcgggcggcgggtgaagctggcgtgcgtcaactggccgtcgcacctggagccggtggtgacggaggggctcgggatgcagcccgtggacgccatctccaagaaggtggcgtcgctcgggttcaactgcgtcaggctgacgtaccccatcgcgctggccaccaacgcgtcgctgtcgtcgctcaccgtgcggcgctcgctcctcgcccacggcctcgccggcgcggtcgccggcgtcgaggccaacaaccccgggctcctcgacctcacgctgatcgagtcgttcagggccgtggtcgacagcctcggggagagcggcgtcatggtgatcctggacaaccacgtgagccggcccggctggtgctgcgccgacgacgacggcaatggcttcttcggcgaccggcacttcgaccccgacgcctgggtgcgcgggctcggcgccatggccgcgctgttcgccggcgtccccaacgtcgtcggcatgagcctccgcaacgagctgcgtgggccgaggcagaacgccgacgactggtacaggtacatgcagatgggggcggagcggtgcacgcggcgaacccggcggcgctggtgatcatgggcgggctcgggtacgacaccgacctgtcgttcctcgccgcgaggcccgtggacgtgagcttcgcggcggcggagcgggggaagctggtgttcgagctgcactggtacagcttcgccgacgcgcgcgcctgggagtccgaggacgccaacgaggtggtgcgggccgcgtggtcgcggggggcgtcgcgcggcgtgggcgaggttccttgctcgacgccgaggttcccagctctttcctcgagcgagttcgggcgccgacacatcgcggcgtgctcgcgcaaggacgaccggtacctcccctgcgccgccgccgtcgccgccgagctcgacctcgactgggcgctctgggcgctgcaggggagctacgcgctgcggcagggcgtcgccggggccgacgaggtgtacggcgtcctcgactggtcgtggagcaagccccgcaacgcgaccgcgctctcgaggatccagtcgctgcagcgcccgctccgaggtcagttcgctgtcaacggcgtcgctcgctcgcgccatcatcgccggtgcaacgtttctaattgaccgaagggttcgccggcgatgcgatgcgtgcagggcctggctacgacgaggcgaggccgtacaccgtgctgttccacccgctgacggggcgctgcgtggtgaggcgcgcggcggatgacccggcggcggcggcggcgacgctggagctgggccggtgccaggacacggactcgtgggccta

SEQ ID NO: 42147 - DNA, 18257 bp, Oryza sativa
  unsure (1)..(18257): unsure at all n locations
aggggcggggctagccgccgctctgcctgagagccgaggggagcggccggccggcgcggctcgccaccagcgacgccggcggctgccgcggcgacgccctgtcgacgtggcgcctcgtgtcgggctcgacgatgcacgtggccgtcaacgcgacgacgacgacgacgccatctcgggacggcggcggcgggctgctgtgcctggacgtcggcgacgacggccggagcgtggtgacgaacccgtgcaggtgcctcgacgacgccgccgccggcgagtgcgacccagagacccagtggttcaagctcgtcaccagcacgaggtccccggccaccggcgccgccgcggcggccaccgtggcgcgagggctaattgctgcgtgaaaatcgaccgatcaatcgatcgtgtccgtgcattcgtcatcagagaatcgaaatcttatttaaaatccgcgaacacaacactatactagctgctagctgacttgcattgatcttggatggaagttagagagttcgtgtcacgcacgtggcgcgcgccaagctgcagttcatgtgtggtcgatgtatccatgtactgttactgaacagtgcgcttgagctgaaccattgaacggatcaagaactaattaaatactccctccatactggtaaaggaagtcgtttaggacaatgtttaagttaaactttaaaaatataaatcataaataactctcaagttgttgagtttgaaaatgttaaaattatatgaatagatttgtcttgaaaaataccttcataaaagtatacatatatcactttttaataaatatttctatagaaacaagaagttaaaagttaaagttatgttttgaagaccgtgtcgctatctaaaacgactttctttagtagtacggagggagtatttaattagttcttgatccgttcaatggttcagctcaaaaaagttaaagttgtacacaccagaggtcaccagctatattattactcgtatggtttaagagaacacacaccatattaagttttttttgcatgggttcgtgctggtcccacatgttcactgcaggaacgaccattgggagggtgttaattcgattagcgcgttaattaatttgggaacagtagccactagccacgcacgaacatgagatcgttgcacggtaggcattgccgcacacacgatcgacgacctaacaagcggctagacaagtcgaagaaagagctcgagatcacttttccggaaagtgttttcacatttaagggacactattcattttcttaaaaatacgcacaattgagtcatgaaatcctttttaaaaaagattaataatgttggtataatgactggctgtttgctgcatgcggctgcgctgcacagacgaacagaagaaatgctagttgggttcctgtagcagatggctgtggcgcaccgaacaagccctatagtaataaaacattccgactgagtttttacgttaataaaaaagatataggcataggttagtgtggagattatgggtatcccatatctacacggcgacggtattcgaactgggtaccggatacttaatgtagatagaatatcttatctgtatctcgggtttgtttcttaacttgtgtatcaaggaaacaccctgagacttagtcggttacgactgtattttacctctatcttcatattccgttaggaatatagattatcttttgtaatccggactccttcccatatataaggggggtccgggcacctctaggggcatatgctgatttttcccgaatcatacaattaataatacactcggcggattcatccccggacaggagtagggtattacttcttttataagaaggcctgaacctgtataaatcctttgtctccaaacccatacactttccgagcttgatagccacccccttttattattgccgaaatctagtttcgacagttggcgcgccaggtagggggagcgtcaagcttttcgccgatcagtgcaatgggttccgtctccggcatcgacgacctcgtcttcccacccgggcagacgtttcggttcggcagcctcgacttcatcaccaacaacttcggcaagatttctctcctcgactcggaatcagaccagtcgggagagaaccggctttcggtcccgtttggattcccgaacgcggctgaaagctacttcaagaccatctcaaccgagtcggcttcaaaccactcggccgagatcgcatcttctacaacgacaccagatcaagatgatggggcttacccaccggtcctgatgaagctccccgacgatttagcggccgtcttcaccatgacagcgtcttcatcccgtaggcctaggcggaagtcggcttcaacaccgctttcgcctagcttcagggaagtcggcgtcatcctccaaccactcggcacggtttcgacggatcagctggatgactacaacagctctcccaccgtcgactcacgtcctactgacatcgtggagtacgacgaattcagttctcgctacgacgacttcgacgacttcgacggaagcctagatgacaattacacccctctctactttggcgttttcatggccaataatgagacggaggagcaacgccaagcccgggagactgaagaacgtcgccgactggaggaggagcatcaagtacaagaacaagaacggctacggcgtgagcagcaggaccgtgagcggatcgccaaggaggctgaagatcgacgtcagcgagctttggaagcagggcgccgagcgcgtgatctcatcggccaacaagatgtcgaagggacaccggttttccgcacccctcaacagaatgcggttgccgcgatcacccttctcgacaccctcctcaaccaaaacgagctcaatcgttccgaccacgtcgtcaacatcttgaaccagacgaagaccatgatcgcagcatcggtcccagttaactccgaaagcgtccacacgccgactggcagccgggtcccccacttccgatctcatgactaccgtcatccaagccccagcatcactggagcaggatccaatcgcaggagcaggggccacgacgagcggtctgttcactcgcctcccgaacttcatagggagcgccgagtggaacggcctcgctcaccacctcgtcgccgccccatcgatcttcgcgacacaatcatacagcgccgagcagctcgaggctaccatcactcgccggatcggcacaagttatctcctctatgggaagggccatttattatctctgaagttacccgaccaggttcatatcgactcaagcgcgaagacggcactctcgtcgacaactcttggaacattgaacatcttcgtcgtttctacgcttaactttatcattgtatctccctattttgactgtcaacatcaagttttcttcttgccgttgtcagtcgggggctattatcacaataatggagtgtgattttttatcaattcagtttgcttacttggtttatcattgccttgtttggtttttctacttagtttgagaggactgaaagtttttaatagcttctttgggttttaggctcaacaaagcttagcaaaaacttttaagaaatcaaaaactttgcaagaatcatcaagcacagcataaatacaccagtattgtacaaattgagcctccatgtattacatccaaactcagtcagagtcagtcctttcatcatcagagtcatcattactcggctggaggtcgttgttgcgaaattgctccacaacatcactcgctattttgtcagccgcagtttgcgcactactgataagatcaagggcagcttcttcacttgtcccgtctgcaaatccatcaatggtgtcgacttcaattctcgggtacaaggattttgtcatcgccaaggccatgccagctcccatacttccagctttcttgatattcttgaaatacacttccggagcaacactcagcttgtcaaatatttcggttgcgtcgagtgcactcggaccaccattattgaggaacatggcttagatgattggagcagcagcattggcgacatcatctcttgctccttctagcctcttgatcttaccaaccaggacgtcgaattgagcttgagacttgatcttgcggtctacaaaacatatttatggtgagaatctgctgcattaaaaagagacaagttcaggccaatagctggcagtaccttcaacttccttcaaggccgagtccctctgcgcagccagttctacattgtctctctccagggcttcaacttgctttttcatttgttccattctggcggcttgcgctgtttgagatccagatggttgaggatacagttatgttggcctaaatcaatggaacagatctggatgattaccttttgatgaaccacttagttcgaagtttgcatcctggagctgagcgattcgatcccttaactccttctccgtcttcttggcgtgctccttggcctcatgtagctggtccctaaccgcttcaagagttcccaaatgaggaaccagcttttccaaagttgtggtcttggcttcattgcgaagatggattctctgcatgatggatcatagttcagttctgctaaaaagaaaaacaaagttaccgaaggctgtcgctcggaagacttacatttacaatacgagtggcctctccaagcgctttcttcagctggcacacttcttcatcttctttttgacggtttatgactataccggcggcttgtgagttctcgtcccaccatttgatcaagataggaggacgagagtcgtcggtcgcctttatgcgagggatttcttctccgtcatcacctgatggtcctgatgtgtttccaggacattagacggatacactgaggttatttaaatcaccgttgtatgagaagacaactaacctgaagatgtacctagctgagcgtgaggtgatctttgttctttgcctggagatccagttatcgagtcattaccagcttctggcccttgggaagctgtcgtctgcgcttctacttcagggatttcttgatcagggcttgcgtccaactggtttccagtcgggggctcttgagttgttgctgcttcagttgttgccgactggtttccagtcggcggctggtcactcggattggcctggtcacccgaagcatgggcgccggtcggctggcttttggcagtcggctggctttcggcagttggctcggggtctttggatatattttgctctgccatggctggatcggggtcttttccagatggatctatatcagatggtttcctgcaaagtattctttcagaatttagcatcattttcatgagagagcttaccaaagtgaaatcataccgagaggtcttatacctggaagatgttctaatttttagcattgcgcggccggccagttttttcctgggcatggtgcgctttgggggtttattaggcgagcccttatccccagatttatcatcgtcgccttcatcgtcatcaagcaccagtttcctcttgcgaggacccgtctgaccagttgatttggaggtctgaggttgcggatctggtctgatcgttggccctccacctccctgagcagtgtgttggcgaggagaccggcgctgagtgactggtggatctgatttcatcagtgcatattcctgaacaagatgcttccatagttagtcaattcagcatgaagacaaaattatgttctgatcatggtttgaagatttccgatacatacctgcggaggcggattgaatgcattatatggcacgactggcagctggtgtgagtagctgacgacgattgcatttgagaagattttatacatcctctccttcatgattctgaaatccagagagtctgattcttcacggttaggatcatacttgccgtcgaactcgaatgccgtgcgagatctttccttgattggcgctagtcggcatttgatgaaatgccgagtgatctgttctccctgtaagccttgttctttaagatttaacatacgatccaacaactccaaggcttgtactgcttcatctccgattggaagagagttccaagtatcttgatacactggaggaagacaagagtacccgggaagagcaggttcaggattctgaacatagaaccagtttgcatgccatcctttgttcgaagtcttgaagggcattgagaaatatttttggctcagagttccccttagttggaatcctgcccccccgactacacacggtttgttcttgtttggttggggcttgaggaagaagattcggcggaatagggcaaagtgaggtttgatccccaaaaaggcttcacaagcatggacgaaattggcgatatgcactatggaattcgggtttaggtgatgcaagctgattccatagaaattcaagatcccgcggaaaaattttgaggtcggaagagcaaagccgccgtagaagaaatgcgagaagaccacaatctcatgagtatccggagacgggaaagcctcaccgtgcgctggtcgccacccgatgatctccttggcagggagaacgccgtgcgccaccatctccttaagattctcctccgttacatcggatgacgcccattggccttcgaagctttctctctcttccgccatcggtttcactcaaatgtgctgatttgattcgagggatggcttgggagaggtgagggattgaggcggtggatcacgggaaggattttaatgcacttttcggaggtggatttggccggagtcgtgaaccctagttcgccggcgcagctttgcactgtagcagggaatggggaaaatggcggggaagacgaagcgtcgcttggatataggatttttcagttaagggtatcggaggtgctaatgggcctaggcctgaacagtacttcagcccaatacttttaacagcgtggcccattgtgttccttagggacttaggcatattttgctttggcaatattatgcgcacaacagtgttgcccaatgctgatgaaatcctttttatgcggtcatataattctttggaattattgcaatgcaaattaaaaaggtgcccgacagaaaggcgttatgctgtttttgcaagcttttttaggctacaaaagctgtttgggttaactagggatgacttgtttttattatagtcatttccttggcgtgttatatgcctgttttcatggtaaatagtcatggcctaggctatttgacttatttattaccataatctttatgatacttgatgggtaatctttagagtttgtatattcggatgcctgtcaagtgtgttcattcgtgaactttttagaatgtaaaccactcggatttcttttattgtggctaaaaagcagtcggctagcatgcctatttaggcgccgcgtatgcttttgtcatataatgcacaattgtgttattattttgtctttcaactatatgtttagtttgttaactaatcacatagttgggggctacacctaattaggtgcatctattcgatgcaccatattcttcatcttttcgccctttacagtccactcggcaggttttggcttgaagagtttgaagtactcgggttatcaactttgagaaggctacgatggtcgactgcaaaggactcgggggctactgtggagattatgggtatcccatatctacacggcgacggtattcgaactgggtaccggatacttaatgtagatagaatatcttatctgtatctcgggtttgtttcttaacttgtgtatcaaggaaacaccctgagacttagtcggttacgactgtattttacctctatcttcatattccgttaggaatatagattatcttttgtaatccggactccttcccatatataaggggggtccgggcgcctctaggggcatatgctgatttttcccgaatcatacaattaataatacactcggcggattcatccccggacaggagtagggtattacttcttttataagaaggcctgaacctgtataaatcctttgtctccaaacccatacactttccgagcttgatagccacccccttttattattgccgaaatctagtttcgacagttaggtacttaattaggtgggttgtattactatgaatgttgatcgaattaagaatccatgtataccatgctcgatctcttttaattacagttgttctgaaatttaataattttgaaattcagaatcaacaaatgtgagatgtactcttagtttattaatactcatgaattcaattctaaaaatctacaataaataattagcacgatgtaattgacatggacgtactcttctattaatctaagctcttatatttcagaaaaataataatcgatgtgttcatcatgattaacattttaatatttgtaacatcaataacaatagtttgtgtaagacatgattggtgactagcacatacatataatatcctagtagaacatttgaagtctaagtttgaccaacacatcaaagaaaatccaaactgcaaacagtatgtgcactgtgttaattaccaccgtatttaattaatttttcttctcactttatatacatgtcaagcttagactaggatttttgtggtgtactagtagataccaatgtactgtttttttactaattccttacaagtatttgaattatattttaaaactaaaatatacacattcagttcgttgattatggccttgttccatttgttttggtcccttatccatggaaccgattaatgttggtataaaaaaccttcaaaatcatttatatttcatcgttggacccaaaaaatggtggtttttggtacattgccccctgttgcatcttactgacaaatcaaaaataaaaacaatatctacgagatggaagatatagaaaatagataaggatgacattatttatgttctattatttgcttatacgtttctctatctttctattgtttactatcgttgattaattgatgacattattgttgtctttacgtagacgtggacgtaaaaaaaattgcaacagatgacacatgaatgattttgagaaccaattgtaaaagatggaccaaaacaattgctgatggacaaaattaaactatgcttttttctttggaaataaaggtacatacacgggcagacatcctctttgagaggtagaatacacttgtttagtatcacaatatttagtatccatccgctctaaaataaactatcttcgtactagcatacgaatttagatatagagtccacttatttcgggacggatggggtacaccagagatgaacacacatacacagtcacacaggcaagaaaaatatacggagtagtaagcagaaatgtctgatgatttgatcgatcgcgtctttttccgccacactgtagtccagcgcgagacggcaccagctgctcttcactcttgagctgtttcacagtacagcgatcagtccagtcctcgagattacgattttctaatgacaattagcgcgggaaagcaatgtgtgtgagtagtttgttaattagcaatgcggagtaacgacagagactgtttggttggttagagatggttactgttgcagcttccgacagcaacgtggcgaccggctgcaacgtcgtcgtcgtcgtcgtcgtcggcgacgacgtggcgcggcggcggcgacggtggcggcggcgacctcctcctgaagcgcaccatgaggccgttcttcatgtacagcgtcgtggtcagcttcggcttcacctcctgcccgggcaccacctcgacggcgaacctggacagcaccgccgccgccgcggtcttcatctgcgtgtaggcgaaccgcttcccgatgcacagcctcgggccggcgttgaacaccgcgtacttgaacgggctctcgccgccggcgaacgcgccgccgcgcatccaccgctcgggccggaacgcggccgcgtcgtcgccccacgacgccgggtcgcgcccgatcgcgtaggtgtagtagatcacgcgctgccgcgctcgcaccggcgtgccgtccgggagcacgtcgtcggcgagggcctccttgaagtcgacgggcaccggcgggtacagccgcatcgcctccgtgagcgccgcgtggaggtagtccatcctcttgatgtcgccgcccgcggcgaggacgtcgccgacgacgcgggactcgacgtcggggtggccggcgagcagccagaagaaccaggcgagccccacggagctcgtgtcgcggcccgcgaggatgaagctgatgcagaagtcgcggaggaactcgttggagtagtcggcgcccggcgccgatgacatgagccgcgacaggaggtcgcaccggccgcgcaggctcccgaccttgcgcatctcgttccggcggtcggcgaccgcccgctcggcgaactcgcggacggcgcgcgtggcctcgacgagccgccgctcgctgccggcgcggaggagccgcttggccttccagatgaagggcggggtgacgaaccgcaggagcgagagctccgtggcgagctcgaacgcgcgcgcgaacggcacgtcggggaggccgtcggcgaggcacccggcgtccaccccgaacgccacggcgcannnnnnnnnnnnnnnnnnnnngagcagcacctcctggaggtcgacggcggcgccgccgccactcagccgctcggccagcggcacgaggcgcccgtacaccagctgctcgatgctcctcaccgagaactccacgaaccgcgacgagtgcatctcggcggtgtccgcccggcgctgggcgcgccacgcctcgccgtcggcgttgaagataccgccgccgagcagctcgacgaagcgctcccggtagtagggccccttggggtagttgccgaagttggccctgagcacgtgctcgacgttggccggcgcggaggttatgacgccggaggagcccccgccccacgtgccgcggtacgggaacacgccgccggcgcgcagcagcgcggcggagccccactcgtagatgtcgtcgcggtggacgaacagcgtgggcacgatgcccactagcggccacagcaccggcgccccgcggcgccgcgcccgcaccgcgctcacggcggcgctgaacgcgaacagcaccgcgccggccaccgccaggtcgctcgcccgcacgtgctcccgcaccgcgccgacgatcgcggcggcggcggcggcggccatggacgcgatcgccatcgatcgtgtcgtgtctctctccggcgccggcgaagctgcgagactcagtgacccgtttcgatcgatggcgcgagagaccgcgagagactgagctaagcagctgggagtggagcgtatttatagctagggtgcatggcagcatgggggtggtgtcgcaatatgttgtttaattaatccattaattaattgacaaaaaaatagttggaggttggatttattaagtaagctagtgttgattatctttaaagaaaaaggaagagcgagcaattaatctactgtagaaatgatattgaaggttcaattctaggccccgcgcatttatacagtagctaggtaatttaagaagtgatcaacccatggatttaagaatgttaattttgtatagccgcatcgacgacgcctcacgaatctagcatgctagcattggagagaataatatcattaatttcgacggatctgcacacacactgcaacgctcatcgacatgcattggtttttcttacgacagataggtccatgagcaatccgttcgtgctgaaagagcttgtgtcaccgcaccggaaatcatcgggagacgatcgaaacgcgtctggcgtgttgggagcggattttttttttggtgtacaggccaggggcgatctcactgggcggatatataagaagtggttcttgtctctcgagactgacatcccctcatttcatacatatcgtttaaaaagttaccaatttttttaaaaaaaattattatgatagatcaatatataatatatcttttcgcaaacatgcgaattaaaattcgacttatacaattcgaaacaaaaataacaaatttgaccgtgaattacgcattatattcatagtcaaatttattgtttttgtttctatttgtataagtggaatttaaatttgcatgtttgtgaagtagcatatcacatattgttctatcctactaaattattttgatgactttttaagtgacatataaaaataataggatatccgcttaagggatgattcagtactctgggagaggaatatttttgtgtttttcttaaacatatatttctcttccatgtgataattaagacttgtgttgaatcttggtttgcatgcagtgtctcctgtgtatgcatatggcaaaccatgcattctcccaggaagaaggcctccatgccatgctgcagtaccacccggagatggatccagcataggggcgttggggtcttctgacgtaaagactgtaagaatcatcccactattttttttttaccatatccgtcaccggtaccaccggtacgatcgacatggtgcatgcaccggccggcaactcgatcatcctgggagtgtgcatgtatatatagtcggtctccatgcatgtatcgatccaccggcacgatggccagtcccagtacggccaaaattaatcgagccgcacgtgaggtgaaaaaaaaaaacacttaaattcatggctcaaatcggtttggatccttgagcgtcgtgatctcccttgggccattgtcgtcgtgcctctttcttctctctgataggactctccaggtgaaaatcagttatacgagtcattggatgaatagcgacggtactttcggtgtcacgttattcttacgagcgtcgttttaagaatattctgtttctatcctatgtcaccactaattagtaaggtcttcgacaaagctcttgggaatcgtctttgggtttgaagtttgaacgagggatgagtgaattttcttctctctcacactctccctcggtaaatccatctttgtggggatgaccacgagtgcgttggtggcttttctatttggagatgtgatagtacggtgcgtttatgccatcttggggctggcggcagccagcttggcgctagtctttttttttttctcaggaatgtgtgttacgagctatcaacatgtgatgatttgcctttgtttttttctttttgtggttgtcttctaggttataatctagtattttttttcttactacatactccctccgttacttaatataaggaatattgacattttgcttgtactgtttgaccattcgtcttattaaaaaaaatggaattattattttttttgacttactttattatccaaagtaattttaagtacaacttttcgttttcttatatttgcacaaattttttttgaataagacgagtggtcaaacaatgcaaataaaatgtcaaaatcccttataataggagacggagggagtatatttaagaaaattagtttgaatcaaatcgaacttataattgtaacgaactgagcggagccaaagttttaactcatttgcaaggctacttgcgagctactagttttactcattagtaaaagaaatatgtctattctaactaatatgtacttcctccgttcctaaaaaaaatcaactttgaatactattcttagttagtgtttattttctgttgtcgacgcatggcatatatcacatttttaaagctgatataattgggataaaactgattaacgaatctaactaggttgacaaagtcagctcacgaacctagccaaggcatggttttttggtttttttggggctgtttggaaaacagggatttgtcatgttacatccgatgtttggacactaatttagagtattaaacatagattaaatacaaaacacatttcataaccttggactaattcgcgagacgaatcttttgaacataattacaccatgatttaacaatgtgatgctaaagtaaacttttaataatcatagattaattagtcttaaaaaattcgtctcacggattaactcttatttatgaaattaattttttattagtctatattcaatactccaaattaacgttaaacatccgatgtgacagggacttaaaaagtttccccatctaaagagcgccttagcttgctagagttaatgaggctcgactggctcgttattccctcttagccgcatggacgcaagtggtcggcgcaaaccatgggagctcaccgtggatcgataaggaagtttcgcggagcccagccggcggccggtggccaagtggccggcgagtgaattccaccttccacacgagggaacggagaggcgcgcggatggggcggccgtcgagattgtgagaaattaagagcatgcccaagagatgcccaatactactcccaatcctaaaattttgaagttttatggaaaattttagctccaacagaactccaatcaagatcccaaaaaattggaaatcccaaccccgtcattctcgatctccacatgttgggaagaccgatggactcccaatccaccgatcgcacgaattcgcgcgcgctggtgaaatgtcctagccatcatgagctcgtctaccaccgccggcagcccccgagctcctccgtcgccggctcgttgcgagcttgtctggtgccgctggccctagagctcgtccgccatagcgtcaattcgcactgccgccagactcagagctcgtgtgccgtaggtctgtcgcttgttcctccgccgacttaattcgcgtagccgccggaccactattcgcgtcgccggcagccacagcaagcttgttcgccacaaacctgtcactagttcctcctcctccgacttgattcgcgtcgatgccgaacctcgaatcacatcgccgatagccgtcgcgagctcgtccgccacaagctcgattcacgctcccaatggagccctgattcgcacccacggccgagtcactccctcgtccacccatggctcgatttctattcgcacctcccggagctccgatttgcaccgcggccgcctgttgctagcttgtcggttgtcagtttgatttgtgtcaccggccaccgggatcctcctaccccagatacccccgttttatgccgccggcggtggtcgcgagctcatcggcctgcggattgattagcaacgccatcggacgtcgcgagctcacccaccaccaaaccccgatttgcgtcgccactggctgtcgcaagctcgtccgctatcggccccgattcatgccaccaccagctcgtcgtgcagccgtgcaggaggagagaacagagagaagatgaggaagaggaagaaaaggcacagctaggtgggcccacctgtctatataggaaggggaacggttgatagttttttaggtggtcccactttttattatacagaaccatgtttacatagtttgttggaagagaggatattttagatcctcaaatcctagttacaaatccctaaaaggtcattttgggagttgatttattggttatttgttggtgatgctctaagcgcgcgcccggcaaccgcctggcggggagggggggggggggggtggggtcagcattgagcctattgcctaagcattcatcaccggtcaagggccttggtgttttgttgtcgttggtggtggtgtctccatcccgcggtttactttaccgccaaactttttgctcgtttcggctgcaccgcttgcttcctcgctgccttgcaaacgttttccgagatgtccaagatgtcctcttgaagatgatggttttgtagctagaaaatggaaaaggatttgttggcctcaacaaccaggggacaaaaaccatcagaaaaagtaggctgcaggctgttgtgatgatactgtagaatagggcccggagcgatgcgatgcgatgcaaccgacgctgccggatttggtagcctttgtcgttgggctgcattttcgtccaggactcgagatcagtcaatactgcaagcagtgtgcgtgatataatatatcagtcaactaatgcacacaggagggtgcaagcagtagtagacaacatcaaaggtgaggaactaggggaagggggaaaaacaaacttacaagtacagcagcaaacatttgcacaggtgtcaatcaagagacaaaaaaacttaagctaaacgtaggcaggcttgaagcactgtgaatttgtgatagaaaagacccggctgtacttttcaaagaatgactcgaggcaatattctgttcactcattgggactattaaacagacaaaaagcaatccaactttccaagaattgataactgaaaatttgaagcaaacatatttagatgctgtacacattaaaattctgagacaacttgcgggtgtggtattacaatgaaatggcagataatttacaactcctgcagatttggcaacctggaggtccctatccaactcagttccatccccctatgcaggtaggggttcttccaaaactgtgatatcataaagtatcataaaaagaacagaaaaaaattgcataatgcacattaaatgtccatagaaacaaaaataccttttgttttttctgcagcttctggtctctctggtgccttagtgggtacatcaggaagctcaataacctcgtcaatgtcttctgcagcctcagtgacagcaggtgtttctgatttctcctcaggccgtacttcagtaactggagcatctggtagagactcaacggcaagctgcaacagacagtcatgatcaacaatagaagagataaaccgtttatggctcatgaaagttcagaattaaagcattttcatgttggtagtttgctcaaaatggaaaatgcataaaagctcctgaaaatcaataaaaacctgtgcttccaagttctcaaattcagccataacagcctcctcatcctcagcagatagctgctcacccagagcagcatttatctcctgcaatcaatattggtcgataagtaaacaatataaggaggtccatgcaattgtagttggagcaccaacacaacagaaggtaaggcaagtgcatagaccatcaatagaaaagaaaaacgatagcgctgtttgtgtaatctgacacgtcgatcacaaactcgcaaatctacaaatgttatgcaggtcagatccattcattcttaagctgttaactacatagaccaatgttacactcatgcacaactgtttccaattaaatccaattataggcacacaaatagagcacatcctatacaaaatcaggagacaactcatacattcaagaagcatatgggtgtaaacaataatgccgccattccagaaccaagactgctataatctttcagaaaacctacagagtctatttagtctggcataagttgatcaaaacagcttttataggaacccgatgtgataccaaaggtgtaactgaggatacagtaaaacaatttgagaccatgacttccagacaactaaggggataaaacaactgtaaatgtagtaacaagcaagagtgtagagtttattcaacttacatcttggtaagccttggcctcagctgtgtcgtccatcaacttttggacatcatcaatatttatctcattctggatagacttaagagcagcatttccagcttttaggctgtcaaatacagccttctgtttacttgctagttcaatgtctgacagctacaacaagcaaacaaaaagaggatgtcaatcatgcatcttaactgaacgtttcactgattatcaattccgattgtaagtaacagatattacccagtcaaattattttgaattcataaggagacagaatatgtccaatagactacgaacctgttgttcgacattcatttgccatgtgtcaacttgtttcagcagctcttcctgtgctttcttcttcttcagtgcaatcaaagctctgtctttcttcttttgttgaactagctgccgtgcagcttccttttctgcttcaatcaccttctcaagctggaagagggcaaaacaaaaaaaaaagaaaccatcataagcaaaactcattaggacctccatgattgttggtacaaaagaattgaactgatttaatgcgacatatgtgcactagcgcagtcaataatcatgcatagtcctattgtactacacacagcagatgcaacctgaagctatttcatgaacagaaaaatattctctgcggcagtgccacactacacagccagtgcaacaccgcgcagaatagtgacacgtgtttgatctcctgctacaggccaagccctctttggtgtcgagctgagcccatctcttgctgccgctgattggagtcaagctggggtgcag

SEQ ID NO: 42148 - DNA, 2881 bp, Oryza sativa
cctgcagccctgtggctctttttatttctgcaatatagaccaaatgattttacatgctgtacaaatatgatgttgtgaacctgccaacctggtttcaacaccagttgtgtttttaagttgtcaatgaacacattgtaatttttacttaagtggttgggtatagtgttagaattggttgtgttttgcaaactttcaggccttcatgtggttggtattcctgtatagctcaacactagtacaattaaagattatcggagctactccttaaatgttccgtgatttgctatgtcatcaaaatgtaatttccgagcacccgaggcatcttgataaagtctaggtaaaggacttatatattacactagaaaatctccatgtatattatcatcaacggttgcttaaaaaagctctattgaaaattgaaatcattcaggcttcacatgtagctggtagatgcggcttggtagcattttcaacgagttgacagatgtgtgggtgtaggagaccagacatcggctcggctccagagttgggctcaggctgcagcgtgctattggacacgcatcattattctacgcagtgttgcacaggctgtggcgtgcggcactgccgcggagaatttttttccttcatgaacaagacaataacatgctaatgcagaaaataaagtcgttttgtggccaaatttgcgaggacgagatagctgcaatgcactctggcgtgcactagaagcaagcctggtttctgcaataacccgaacgtgtagtggcatttaccagaagtactagacgcataatgaaatcatcaaatcatctcttactagttactgtttactactactgattgtcacctggtgctctcgctgctactacgatcccatcaatccatgatagattgaagagcttcatgaatcaggccacgagaaaaaaaaaaaactaacaaggcgacaggcgaattcacccgaaacctaatccccaaccacctctcgcacaacccgccgcgatgggcggccgcagcggagaccaaatctggcacgatcccgaaaccccccaacacgcgcgatcgaacaggagcagcaggggaggagatcagccgggtggggacgggggcgcacctgctgctggaactgcgcgagcttccggcgctgcgtcttgagggtgaggatggccctgtccacgtccgtcaccttgggcttcttcacgaagatgttccccatggccgcgtgctgctgctacctacccggcgccctcttcttccttccgacgcggcggcggcggagatggccggagaggggaggtggaaggggagggggaaaggtggactctcgaggtcgaggaggagacgggcacggtaaccgtaagctggggaagtcgggaagggaggtttggggatgatgtggatcgggttgggtgtgcgactcaaagcggatcggatctggatttgttgttagtgggctagcgctcaaagcccaggagagatgggaggcccatttctcagatcgacgttgggccgcctggtacgccgatgctgtcgcaaaaggaacgaagagatattatttaactattttgcttgtaactgaaaccacgtgccatagatataagacggtatacaccgtgagagatactccctccgtcccataaataacgaatctagaaccgaatatgacatattttaatacgatgaatctagacatatgtatgtctagattcgtagtactaagatatatcacatccggtactaagttggtttttatgtgaccgagggagtaataaatagttaaacgtaaatgtcaccaaaatgactgttactaataaccccatccataatttttttcacctaacatagcaatgcaaaactaaaaaactaaaataccactattttattaaatcctatgcaactatatccaattttatttactcccaatacaattattatctactttcacaaactttgatgtgaaaataaacttttttaaaaacacagcacgaacgcaaacgcttacaacgcgcgtatactcacccgtataaacgtgaacacacactttatccctatgagcttctccagaggactggacatatattttttgagattaaagaagccaccacatccatctcgctatcgacggttacgtcatctaccattgaaaaaataattagccttaagtctaatacttaaatttggatgggttggtttcctcgcaataaacctaaccagttgagctacgctcactttgcaacataaaatttattttagaataggttgaacaagcttgttattacgggactgagggagtactaattactgtcaataaataatttgggcacagtagattttatcatatctttcaatctttcatcacaatatatataaataaaatggattggccaaagtagcatctctcgctcacgttgctccagcctaggggcaacgcgagcgccccccgcgcaccgaccaccgccataccttcctcctcccctctagctcgccatcgctcgagtggcccaccggaaagccatctggccgcaaggacggcggcagcggggcttcttcttcaccaaaacagcgtcagctggggcacccggcacccatggtaaaggcggctagatccagcaagggcacgccggcgcccacagtggaggcggccggatctggcaaaggcacgtcggcggacgtcgtggcagcccctacaaggagtcgaaggtcgtcgagatggccgcaagcgaacggtaggcaacgttgagtaggccatgggcgacggtggccggcggcggcatggacgacgacgggccttcggcggcggtggtggaggacgcgggtccggcacggccgtgcccggatctggccgtcccgtggctgattccaacgctcccgcgatggcggcacg

SEQ ID NO: 42149 - DNA, 1998 bp, Oryza sativa
caaggaattttctggtcgaaccaagcctagtcaaatcatgtggtgagcttagctttcacctctgatccaccaactaatcatatattaaaacaacacaaagaatatgtggaccaagttagcaatttggattcaaaaaagtttttttctgagtaaagtgtatggacggtccttaaatttatagcggtatgtcatctaggttcttaaactctcaaaatgcatatacaagttccagaacttgtcatagtgtgtcatctagatcccaaatcgccacagccccttcaggatcctacatggtgcttgtggtgctgatgtggcatgtcacacggacatgacgtggcataattttgactgacaaatgggacccatttaaaaattttcttttttcttttttttcttctcttgtattttcctttcttctcctttctctgtgacccgagcaaaagagaggaaaaaaagaagaatgagaagaaagcggaaaagaaaaagaagaagaagaaaaaaagacatgtcacgtccatatggcaggtcacatcagcgccacgtaggatccaagaggggatgtgtcgatttgggacctagatgatacattttgacaagttctagaacctgatatgcattttgagaatttggggatttagatgacacaccgctacaagtttaaggaccgttcgtgcacattactcttttttcttgtggaaaaagagctactcgtttgtgtcccctccttccaatctgttgctaacatggcaaccttgtaaccccggttcacaaaaaaccaacacattctggcactttgggcataactaaggggttgtttggttcttaactaacattgtcataactcactttaggcaatgttaggcaagtgtggcttgccacactttttgtggcctacaaattgtaagccacacttgtggcaaagttagacaaataattgagtctatgacatgtggggtaagatggtaagaaagtgtggcttgctatatctatggcaatgaaccaaacacaaatctaagaaggtgtgacagtctaaagtgtagtgtggcaatttgaagtagtgaaccaaacaacccctaaggtacgaccttagtatgctcaggtacgacgacaacaaaacaagcaatccactgaaactcttaactacagtctacatgcgccaaagtaatctatctcaacagtcaaacattccactggaccttacaatacatacaccaaagagagctaactccagttatacaataaatcaaacaaactatgactctatgagtcccgtcggttagcctaataaaccaaaataaaagtcaatttgaatcctcaaacttaattttaagatattttcaatataatttctttcagcgttggcttttaagttgctacaaatagatatataaaagtttcacctaaaaattaatttttattccctaagggcaagtactatgggcatccaagcacaatttcctagattccacataagctaaaatagtgaggtggaggagagaagagatgagagagataagcatccacctctcatgcaagaggcaaccgctacacaaaattcaagacaaaatgacagagggaaagagtagattgggcaaacaaacattgaggctagtgtattagaattagtatagatgtgatatattgtacatgttatctctatatttatttgttgatgatgtggtcaaaattagatacaacatccatctcttttataaaacttgccctaataagccattatggacaaccaatgaggttctattaggcttcgcaccacgtgtcctgaaagtgctagttacagctgtacaacgggcaattaagcgcacacttaaggaagagtattagagcgtgtttgtcatgatatgaaaaagtaaaagcatgggttgccatctaaaaaaaatcttcaatgtacactactttatactaagtgtttgtttataagtttagtgatcaaatcagaaaaaatatgtagtgcaaaccacatatgtagtagaaacttgg

SEQ ID NO: 42150 - DNA, 1692 bp, Oryza sativa
tgcgcggtgtccgtggactcccactagttggtatagtggagttcattttacatgggacatgtaggtattttagggatcggttccaggcagttcttccctatatgccgaacaacaacattttattcggaactttcatgcagaaaaagctagaggagtggcgtaaaaaggccatgaaacatcgagctctagtgcaaggtacccaacagcacaggtttgagatactctgtcaagataaggcaggcacgggtatataccgcaagagagtgaagcaggaatgtgttctcaaagccgacggcacatgtcattgctcatgtgcaaagccgaagctgctccacaggccatgcacccatgtcattgctgcggcatcggagtgtggcataccagatggagtatatgtgtcacagtactcagtaagcaagcaatatatcatacatggagtggagagatttatggcttcagcatagctggggagttcacagagactaacgatcaagtaatcaatattcctgacccatcgaagctccgaggtaaggctggaaggaggaagactcgtcgcatccgcaacgatatggacgagtcggaggcaggcagggtgaagcgctgcagcaaatgagatgaacgtgggcacacctacaagcattgtcctaaagacaaggaaaatccaagtacggcggaggcaggactatcaggatcagcagcagatagagctcgccctacgggtgaaggcactacctcaacttgaccccgtcctatacatcgttgtgccacgttcggctacgtggtgtagttcttgtgttatatgttggcatgtggctttgcttgtaatttggttcgaacttatcgatgtgtttatgtttcgtcgtgtaatgtcagacttcggcatgtaatgtctttaggtcgcatgatgtaatgtcagacttcggcatgtaatgtctttaggtctcgtgatgtaatgtcaaacttcagcatgtaatgtctttagttctcgctatgtaatgttagacttcggcatgtaatattatgttctggtatattattgaactctacttatatgttaaatcgcaccccccttccacgagtaggcctcttgttgtgcccccccataggtacttaaaaaaaaccacactacatcgacaatcaatttacatgcattttatgtcttagcttacaagggtctcgttgtcgatgtgtaggtttcgcccaattcactacgacacaggccacccacttctcccaggctacagggtcagcgtctcaggcagttgcatcgacctcgcactctgcacagttctggcagtacaccgggacttcgtcacaggcagccgacacgtcgagtcggggtccaccactggaccatgccgggacctcgtcgaagtacagggtggcttccgccttgctcttcgacatgtgcgacttcgacttccaggtcacgacagaggacgtcatcggcccctcacagctgggaggcgcaccgccggtgcagacgcaggactagtcgccctccactccgcggctagacactcgtgctacccgtgttgtgccactggatcgtttcacgtactcccaggaccacgtgcgagaacaggcccggaggaccaagcttggttgcggcgcggggcagagccagtagagtagacttctctttgtttatttactttacatgctagtactgtatgcttgtataatgaatac

SEQ ID NO: 42151 - DNA, 6907 bp, Oryza sativa
gcacatgcacgactactttctgtcgcaccgatgcaacctcctttattcgcgtgcgatacgactgcggaatggctgacccaccatggcccgcatacgtccaatcttactttcggcgccaatcaggtgtacctaccatggtccgcaacgttgacatgtcaaggatatcactgcgatttttggtgcctatataagtcgccataacgagcgatgcctcacaatctttcataactcagtcacattcagtactctcttcctcattagcttcattataaatcccactagctttcgtcaatggctagacgcctgggcgttaaggatccgaactggcgtagcgatccttgtgtatacctactaccaccttagtgctagcggcctctctgcctatgcggtgaccgatgccaactaatggcttcgaggaatcctgatattcgaggaaggcgcttttttaggtgccctaactatgaccgtgaggtatttattatctgtatatgcttattcattctgtatgggcaaatgttttattcttcataatactactctattcgtcagacccgcactacggcttgcggatacatcgagtgggtcgatacagaaaatccagttctcgacctaaccacttgtttacaagaaggacgctggtatttcgcatccaaaagtactaagcaatacttgcagagaaaagcagcttacgaacgacaatgtcgtgaacaacagtgcgactggcgggtgctaactacggcactccctccatggaaagcccgtccaagatacagatgcggtgatcgttatcaggttcttcgttccataaagcctacgactttgggtcgaaggttctttgtttatccaaatattcttgacgacgatttcatggtaagaatattttgattataatgaatgcttattttctcacaacatttactaactttgttcgcttcacatctattcgtttctcacaagaaccaccaaggagatgtcaatacagagaatggatagacagttctaactccacctagccgtgcggtgtagcttgaactaccagaggaatataggattactaaagcgcggtttgagagaggagagagattctcacataggggttagctattatcggacaacttgccatattgaaatttgtaatgtcatgcttccttgtcccattactatatcgtcgttgtgttcaactcttgcactacctccctcctagttcgaatctaatattatctatgtaaccgcaatggaaccagatgtatcatgttcaaattctactactatatcttcatgttacataattctccttgtttaagtgtatataatgtttctatgaccgagactgcgataggcctatatcaatttcgtacactaatacgtcgaataagttacagattaatatcttacttaacagatgaaattgcgaaacaacaaacttcaatatatttttaaaacattattaacaagttttaccaataaataattatttaattattatgaacatagcagagaaaaagcatttggctgatagattttgcatctaggccccttgccgcccttttaagttgcatcaatcaagacaccatgcccaaattaaaacaccataccaattatacccttagcatgcacacattctcccttgctacattaaatatattccaatgaaattcgtgtccatgcagttatatgatgattaatttgagaaaatttagatttatttatatgatgatcaatttgagaaattttggatttaattatatgatgatcaatttgagaacaagggagtactaggtttaaagtggagttgtggagctgtggagctgcccaatttggtagggcttcaactcctaaatttaactccaaaagtttggtatcctaaatttaactccagaagtttggtactctggttagctccacctctctacttcattttaacatagcactctagccagctccactccgttttttgttggagttgaaaccgtttagttggactacagctctaggagagatggagatggagctagagttgtgtcaaatggtggatcgatcgggtttttttttcaccactttctttttttttttttggcaccatatagttttttttgggtaagtttatgtacctaaagtttataaattcaaagtttacatacctaaaatttataagttaaaagtttatatacccgattcaaattcaaaatcagatttaaatttttttatataaaatatttctatacataaagtttgtaagtacgaagtttacggtatatatttataagtataaagtctatgcacatagatatacttttatgggtattcgagattttttttctattttttttattttcttcctaacttgtttttcttttttgaaatttatgatgcagttggaagggaagaagggggactagcgtgtgttaggggtagggacatggggcgattgctgtgggcgatcaccagctcattagcccttatctctttaatttattttgtgagtacattttagccagctccatattttttatgtgaaattgaagctggagctatgctgaatgggttcttcatggaatttggacggctagttggttatttggtttgggttaatgtggcttgccatttcgcagtcaagttgcgatcgatgcgcatgcattaggcaggtgagggtgctgacgccggcgagcactccgtgccggtgccgtcgcggattatcctaaagctcaggtgtagacctgcacgacacatattgctcggatccatttgcgccttttgctgggcgaaagcaacatggaggatgcatggagctgtattcttttttgttatttggacaggttgtgccaaccaagtaagatgtcatcatcagaccattataataagtgtggttaattagtagcgagggcactggcatttcgttgtagatcagatcaggcgtccgacgcgcactgatgaaggtcacggcgacggaccgacggtgttcgggattttagtcccaatctttcacggtacaacacagcagcccgactgtatatgtggttatatatctccgtaaataaattaagcaaatggttgagctgaaagaacaggaagacgtgttaaggtatgaaaaatgttatgatgttaataccttaaaagagataccaggccacgtatatttttttatgatatgaagaaaagagaaatagacgagggaagattgtcgattgttggttaacaggcgatcaatttccaattatgaattgttcaaatagttaattgaaaggccatatttaattgccaaaattttattttagatcacccgtaaaccaacactttggacctgttgattctgccattgttgcattttagaccatcccaaacaacttattaagcacatgtcgacggctttaaataaataggcgaactttcccatctatgtgcatgccatatttttcctagatcagagatttgacatggatgaatagagagttggatcatccaaagtccaaaatggtaaaatggcaaattatttgtcgaagatgaaaagattgattcaagaatagtccaaactaaaatattggcaataatagatggtctaaattgtagttcactcttattcaaatttatttgagatagacaaataaagaaattgtcaatgagttgtctagacgtcgccaaggtataacatagaaatattataaatagctatcgtgtactacctccgtcccaaaaaactcaattctagatttgaacctgaagattcatgtgtccaggttcaaattcagaattgtttttttttttcggagggagtaagttactcatgcctatattgtcattcttgctttatggtgatttttttccctttctttcaacttaccagttttgtgtgtgatcaaattacactaaattggtcgcgtgcatcacacctgtcctatatgcttcgagcatatacattaggggtgtgtttggataatggtaaataagggatgggattgagattgagaaatgaacgaagggttaggattaaatgaaagagggagaatgaacggttaggattcaaagatgggtaggaaatcatttccctttcccatttgccatacactgtctaggtcttatttaaaacccatttacaatgtaaaaaatatatgaaatttctatgaccctacatgaaattcttacgcttcaaatccaagtcctaatccacccgatttttcaacaaaaatcaactgctttgggaagttgggatacccgactcgagtcgagtcgatcgcatctgtagttccgttgcatctggattctctggaaacagaagcatatggaacggaacggaacgaaacgaaagacgctgacgtggcgcccgctgacgtgcgtctatataacggcgaggagcttcctcttcctcctctcttttctcctccaaggtgaccacctcctccccaccgccccccacatccggttccccgaggttgcagcctctgcagccttgcgaggatcagatgaacccatcgtcaccagacgaattctccagtacgaacgatcggacactgaatctttgctcaattccgtgctgttttgattcctttactggcagctgagccggccctcaatctggattttcccggaggatttttgggggatttttttttcttttttgtggggataaggagttcaggggtgagggggaatctggtggaattggatcggtttttctgatcttgttgagccgatctgtgtgggataggaaaggttgctttttgttgttgttcttgggttcttggtttgataggagttggggggattcggatgctgtaatgggggaatttgaggcggcggatttgggagattttgtgatgcgcgcggggatcggggatggtggaactgtagactgtgtggccacgatcatcggatcatggatcgatcctcttgtttccgcttcgctcttcttctcatctgttgatcgtgtcggagatgagcggagagaaagatcattgtggtggagactgatctgtgcgttgatcttgctttggtggcatgatccggggtcaatccatggatttgtcttgtgcgtgctagtctcatctgcagttcattctgatggcattctttttgtgggggcaaaggctttgctaatttactactgaatgaaaatttttattttttatgtgttgtttgtgttgtttctgctattaactgtttttagtagtattgagttccactgtaagatggttcctgatctaacaagggttcatgtgtgttgttgtttttggattgaggttcaggctttctcctgtccatgcgctatctgacgaatatgtcactctgtctactgcagaacacagcttagaaatactgaactgccaacatgatcgaataattcaatgcttcctttaatttaacctccattgcaaatgatttgcttattagtgatgccggggtttgcactataatgtgaagtagtagtaatttgcctctcttcttttattcttgtcagactgagtactctgctcccataatcctatttatccacacagcgaggggcactgcaagaagcatgcagtgcccaatggacgcagctgcaagtggaacttcgcctgtgatgcagttccatggcattgttgatgagccaccctcccattcatctccgctgcacacggcgctggaacgttcgcagcgccattgctatggtcatgaaaccccaggagaattcccccttgctgtgagcccctccattgtgctacatgtgctctccacctgcgagctagatcctaaagatctcgctgcactggaggcaagttctacagctatgctctctctgtctcaatgctttagcaggagctgctgctactgatgagcttctcatatgtctgtcgtttcaggctacatgtacattcttcagtaaacctgcaaatttcgagccaaactttgctctatcgcttccagaggttgcggcatttgatatgtgccataaaagacccatggttaagctaatggcacagcaggaacgggagcaactgaagcagaggtgtggtggatcttggaagcttgttttcaagtatattgtggctagagaaaggaattactctcggattgtcgccgggccgggccatagtattgttgtcaccacaaagggagatgcatactcatttggggctaattgctggggccagcttggccttggggatactgaagatcggttcaagccatgccttattaggtaatgtgttgatattgataaaatatatgattgtttaccaatgtagtaaaacgttcaccttcttgttaggtctttgcaaagcatcaaaatcacacaggctgcagttggatcaaggcagacaatgcttgtgagtgacacaggaagtgtctatgcatttgggaagggtagctttgtgtgggaagagctttctgatgcagctgatcacattaccactcctaagatagtggagtcgctaaagggtgtgtttgtagttcaagcagccattggtggttacttctctgcgtttctatctagagagggtcaggtttacacgatctcgtgggggcgaaccgagaggcttggccatagttcggatccttcagatgttgagcctcgtcttctctctggaccacttgagggtgttcttgttgcacagatttctgctgggaattgctatctccttatgttggcctaccagccaactggaatgtaagtttttgctcttgcgccaacttttcatttattcttgaatgataatctttgaaacaaatttgagtgcttggtatttggagcttctcttgagacgattaacagtgctaactactttgcaggtcagtgtattctgtaggctgtggtttaggaggcaagcttggtcacggatgcaaaaacaataagggcacccccaagttgattgaacatttcctgacattgagctttaatccggtttcagttgcggctggcacttggcatgct

SEQ ID NO: 42152 - DNA, 10204 bp, Oryza sativa
tttccaggttagatcattattctatcacattcattcttgcaaaatatctaccatgatatgaaaaataaagaatttctacctgatatgcttcttgtcaggaggatgaggaagcagcagatgatgcagatttttctaccccagcttggtagaatcactgaaggtgttgaatgataaggctgtacagattagcacaacaaattcttcatattggctcaactcagaaatgggatacccgcatacgttcgcgctcatggaatccggtaaactgtatgcctttgggggagggatcaaaggccagcttggtgtcaagctctctgagggtcaagaaagagctcagaacccagagcgagtcccgatcgatctctgctaatttcaaccagcattctggtgaccatttgcaatgacatattctgtgatctgtggttagcatgccctcctgaatttcataggaggaactcaaatgttagcatcgatgtaaatactaggggcacttacctttggttcttctctgaagtaacagtgtggttgttggtagttcttgcattttgaattgttggtgcagccaagtcctgaccgagtcttctgaattgttcgtgtgtggctttagcctcttgatttctagcctcattctgcatattgcacggttagcagtgagatcattgcatggttgaattcttttcaaactcatcacgtaggcagtcttatcaaaattagctatagttggaacaaaatcaagccttgaaatctttgctatacctgcaatttcagacttgcagtacataagtaagagtcagaaattatgaaatcccggagcaaccgtgggcaggaacaactgtgggtggtggccttggccgaatcgctgaagggataatgttgttgaccgacgacgatccttcttgtgcggattggtggtgtgggtttggacagggaatcgcgggcgaaagccttgccgagccatttggctggctgacaacggcgacgccgtttggcgtcgttcccctccttggaggcgttgttttagcatacccctttcctttccctaccatattctccgggtgaaaaccttgcttcggttctaaacaagcggtggcggcgatccacgtcgcatcctccttgggggcatcgctttggagaaacctcttcgtgcaaggatattgtcattggtctatgcattggcttcaaacttcagtcctaggccttgacaaggccttctagctccacattttgttttgcttttctcagtttgggtcctctcttctcttatttggtgtgttcaacttgtattgaactaacactctcttctggagtggatctttgtaataattggttgtagttctttttaagcaaaggccgggatattatattccattatctaaaaaatgaaatcccggagcaattcagaggaaagagattattactagttaaccttcatcctaaaatataaggaattttagaattttggctatgcatttatatgtatcgtcaaaattaggaaatcccaaagtgatcatgaccagttgactactaccttcatcccaaaatataaataattttggcttcatcccaaaatataagaaattttggctatgcatttatttgtatcgtcaaaatcccttatatttcatatttcggaatggagttaatactacgtaataagcatgagacatacaaagatcaaaaccaaatcaccaacaaaaaaaacaatgtcgtaatgctacaccgtcaccaacaaagattatacagcagcatgaaacatatattttgcccatgccgttcggtcatattgtttttgctgctaggctagcaaaaactgatgaacatgtggaatgtattaccgaaagagtggatctatctatgcgcctgctagatttgtacaactcataacagcgaggctactgcaggatccccctcggtccccaacgtcagttgtaccatgctgggcagtgcagctggatcgcgttgggggtgccactggtgatgtctacagaagctttgcgccgtggtttagtacatccctttgaaaacaggattcgtccggcagatgcttgcgccatactcttcatactctgcttttgtgtggcaagcctggttgggaaaactaccagaattagctttaatttctaaaatggaaaaaggaaaaagaaaccccgaatatggggatatattccaacaaaaaaatttaagctttggaaacaacttgcaaaagtaaacgctatgcactagtttcaagtgatatgagtgttcattactactgtacatagaaatagaagtttgaatacctcgtagaattcagcggtagaggcaagcacagaaccaccaaaccagacagcatatctttgaataggatggctaactacatttacttctataggttgggcctgaaataaacagaatgtagctgtagcttccaagttccaatatcacaataaagtttctggtttggccagtgttcttctgcaatcaggagagagccagagcaaacatgaaaagtttgtacctttgcatctccaccaagtcgagcattagatgcaaggactcgtgcatccactatcttttttaggtcccgctgcagcctcctgtggaaatccttaaacatagttgatcccccggacaagacaatattctgtccaataaaatgaaactcagaaccactgtgatattttgaatcataagacggcattttgataacacaaaccttataaagagcccttcttgtgtcaattggggatgattggatgcacttgtcaataactacatgcaaaggagtggtgaagtcattgttgtaaatctcagggtggaagaaaatctgcatggttcacagcaacgtggggaaattagattaaaatgatagtgcaatcaaaatgtttagttagaaaatgcatcagaactactagagatatcatgtacaaagcagttatatttatgaacataaagcctgaactcaaactggtttatccatgaattggagttaaattatgatcgcagttaagttttgaacctaaatcaaatgttacattgtagaagccacagttaatggtgaacacattaatgcaaaatcaattacctcaggccctaggaagcgttcatatccaatgtcgcaggtgtatttggcaccagtttttggtttgatgccactccagtgctttatgtacttattgggctctctgtcatgcttattaaattcctaaaaaggcaacaataaagttatattattatttttcttttcatctcttagggactctattttttgtcgtacaaataacaaagtcaatggttcaaagctgggaagaaccgagacaacatattcgatactgaaaacaatcaccagttgcaggaaaaagtgaatcagaggaaagcagatgcattgtttgacatcaagcatgctggaacagtgctttacaaaattagattccaggcagggtaagccttaaatgccaatgcctaggctgctataactgtgacagtcagtcaactgcaatgctattatgaggtaaaagcaatccttccttttgaagtaacactcatcctagaataaacgagaacatatactatccatgtttcaataattgacagttcatgtatttattgtagtagttaataccttcacaatatctgaacatgtatagcagtacatttctttcactctccttgccacatcaaaagattcttctggtggaatgtgctcacctctttcctgcaagaactaattggctcagtgacttataagtgcactgccattatgcagattcgctatataaaatatgaaaatctcaagaaaattatgaggtaaacttgttatatatttatatatcctttcttgatatatcacactcccaagtcccaagtcaatttcacatgcaggttaaatggcacaagaagagaagttgtctctctcatcacatacaggtaacgataatttcagcttgtcctctagtcttaaccatgtgtattcatttgttcagaatgatatacttgatatgcttatttgacaaccacggtgaggtgactcaaataatctcaggtgtgtttacaaaatttgccatggcgcatgattgcagctgcaggctggagttgcttgtaaaactttgagtggaatttattgtgcatcattagataaaaattgacagttactttccaccaattctacctctatttcatgcattttatccctttcattatttgtggctgttattttcatgaatctttgatttccttgtgcagttatgatggacatttggactctcaaaggcatagatccacagtaatgtaagatcagtgacatctgttgacaaatagaaggttaagtactatcttgtgacggcccacaagaaagcaatggtaactacctttaagagttgctgaataaactgggtaacatccttgcctgtaattggaattgatctgatgctgcttcctataacataaccatcagcaacaggaacaatgtgggtagccccatcacccacatcgactacaacacctgtcatttcacactgaaaacaaagcatgaaattcctcataaatatatctctcaacatagacgaaaggaaaaagaggggcaaataatgtagtacttcctccgtcccaaaatagttgtctctttagggtttaaaatttatcccacaatacttgtcacttaagagtactatatgtccaatcaatcacctcctattcaaatttctacacattctatcctcaacaacctcacaattccattcaaatgagaggcactttagtctttgattgctaaaccttaatttgtgctaaacaaaccagaaagacagtattgtgggatggaaggagtattgtagagcaaactaagcacaactacgaagctcaagagtccatgcatggctagaaataagatgccaacacaatgagctttcaaatgaaacagaaaaaccactatagaattaaaatttattggaaacgtaaatatttcaataatgtagtctctttcacctatcaaattaaggttaagcagaaatattgcatattgaaagcgtgtaataaaacagttcaactacaacataaacatggccttgagaacgaaattcatgttctcatctcaaggaattcttgctctactaacctttgtggtggtgtatcctgctgcgagggcaagaaccggctggcacgctatgtacagaccaggcacattgaaagtctcaaacatgatctccccggtgtactcgcgggtctcgggaggagtcagggggctctcggtgagcagaaaatagtgatcctccggatcacaccgcaggtaattgaaaatgcactgctgccagaacctctccatggtgtcccaattctcaacctgaatatctagcccatatcagcttgagtaaatgaagctccgcaaactaagatagcaacgcagagtgtcagaagaggaaattaacgctcgctcgcgcgcgcgcgcacaaacctggccattgtgaattggatagctgaggttgtaggtgttgctggagcgggagcgggccagggcgtcctccccgatgaagaagtcgagatcggccatgacgccggcgctgtgctgcgccatccagttccccttggtggtgttggccctggtctggccggcgaaggtgtcgttgacggcgacgacggtgggggtgatgaagcagggctccacgttcccggcgaaccccatcttcgtgtacctgcgcgcgcgcgccacccattctcatcacccgcctcagattcgccgcggcgcacgctctccgcgcgcagatctggaaagagagagagagagggaggcttacccggtgccgttgtcgatgacgacggcggggcgggaggcggcgtccatggcgtcgcgcgtggtcccaccgcaccgcggcggcgcagtcggtcagtcagccagtcagtcaccggcagcggcgaggcttcccccgtccgctttaaccaccaccggccgcggccgcaacgcggggaagaggaggcgagagcgggtcggcgtcgcggcgggcatcccacacccaccgccactagcttctgccgcccccagcagcagcagcagcagcaaccacctccacgcgcgcccgaagcggccggcaccgaccgaggaatggaagcttgtagaagaagcgaggtatcggggcggcgcggcgcggcgggaggagaagggagtgagaggggggcttggcttttgcttttctcggggtatcgtgggatttgtctcggcgtgcgtggtggtttccgtgtttggcgtcgtaggcgtaggctctcgcacgcacacgcacgcacgcaggctgcggcggccgggagtaggaggagacttgggggacgttggtattggtgttggtgttgctcctcctcggattggtgtggtggtgtggggttgtgggggtggggggcgtgcgggatgattgcgacaccgccaccgacgccaccgtgtccactctgcggtctccggcacgggtgtgggcgccactgacgtactcctacgcagggagttcccggttgagaaatgtgggtcccatgtgacagagggtgatcgtttttttttcccccgttttaatgccaaccgttttagctgatacctgaagaaaatgacccctacttggcccgatttctgcccgtcattcagcaatacggagtacttcatcttcagaaatggagtaagttaattttgtccacggatatagtaataagatatgtcacatatcatactagattaacttatcttaaaacagataaattatattttgcccatcctaaaatgccaatttctatatgtcattcggtaattcttcctcctagaccatgcagtactgagtttcaattttaagatggagatagtatgagttattttttcttttctgcggcagaaattgataataatgagtaatgaagagttatagtgatagctacttggttctgccaaaataaaacaatgcttcgttgaagaccccaaacaaaacacaatgagctttcctaatccctccccaagaaaaatgatcctccgactcctccgagtgcgtgccgtggacacgtacgaaatcaaatgccatagcgtacagagctcgcacggggagacgttgccgaggctcgtagggataaaactagctctgcagctgctcttggccccaggaaaaaaagagaatgcaaccgcgcgtaggaaaggctcgaatttttctctctctgttttttttaagctcatcgatgagctccagaaacaagagattcttctcgtaggacatcttgagaacactaatgaaattcaaccaaggcaaagagaggccaaatggtagaggtgtccaccaaaaatttcctactatctttttgacctgtctgtctactctgaaatgctctgacatgaggcatggcctatatatccattgctctagccacaactgctcagtgttacggtgcaaggtaattaatttgcagaggcaaagcaagatgaggttccttggtctcctgagcttggttgctctcatcttcctcctcagcttcaggtctctgattcatcagcaagttcttgttggtaagttttactactactactaactttctgccagcttttatgaatgctactgcctatctgaagagcattcagtgagattgctactggagggaagagtatgaaactgatcttgttctttccgtggaaggagaaggcgcagcagccagcgggttcctccatggcagcggcgacgacggaaggaggcagcatgcgagggagtgggaggaggagaggaagaagatgaggtggttcatggtcagggactacgcccacgcgcggcgccacgagccgaggaacaaccggctggatccttagcgtgatgttgatggcttgatgccttgatggcgctggatataatggctagtcctaagctcatgtttaatctgtcccctagcaagtgtgcagcaattttcacacaaattttgcaacccctgaccatagaattcccttatgattgtagaaatagttctatcttttgtgaggttttgtaaggagtattcaggttttgtagttttgaaactgttttagtatatgttgggtaaaaatacaagtcttttttatactttctagttcccttttctgcattcatctttagaggtgtttgcagattgtaaagccgctggtgaacagtagtactgatcatggataactaaactgcagcctgatggagaaatggtaagcaaagattagtgtccctatagcactgcaaatgctccttaattattttgggttttaggattttcaaagttcgaaggagaaatgaaaatgatcatgagggaacttcaatctgaatatcctcatttctggtgccaccagtgctatcctacaggatgtggcaatctgaatagtaaaaaaagtgtcattgatgttagtgaaatgcaatcacatggttcatctagggctccgtagtacttaggagtcaatgaagacttgaccaagggttgttcacacaaactctaccggtaattattcagatggttagtacggcttgttttgttagtcgtagactcgtagcttgtatatagcatttgtcggtgaagcagctaaaactgaggtctacttacagtacctgggcttgttgcaactcagcaactgatagtactacataatactgctagtactgatttacgcatgatttatgcattgatagacagaagggagtagtactttaatacggctactccgctactgatttatacattcttcaaagttaggcgtgaaaactcatggctgcacttattatgggatagaggtagtagcagttggatacacatgtactaatgactagtacgggccgaactctgcactgtacaaatgtatacaagctggttggtaaagaactggccacacaatttgattgcggtttgcaggttgcaaaatttcagcatttcctcctctcaaaaatttgcaggagcaatacaacaaaagaatgtcctcccagactgctaaatccttttttcctgaaagaagcttatacccaaaaaaaaaaaaaactatgctttgccttcctgaacttgtatcaaatctgtattttttttttccttctatctatctgaatctggctgctctactcctactgctgctgttgtactttgcccatgacttctgcactatctccggcgctggcaccggcctcttggcccatgcagacatcaccctagctctcatcaccttcttcacaaggagcttccatgtcttgtccactttccctttttccatgttagtcttgaagttgctggagcaaagggaagaacgtaaacaaatgaacggaagggttcattattagcttttgacatggcaatggcatgtggcatcaatcaatcaatctatctatctaataatatgtatctatctatctattataaaaacaactagaaaaaaagggtacaaattacttaggtagtcagagaagaaggaaaatatttgattcattagatcttggtgggtgtagattgatcgtatacaatgtacaactgtatctatagaacataaaagttaagagttgtgtgaaatatatttcatttaaatttgtggagtagaaaatacagttgtatctattgaaatggaatataatttaagtgttatatatatcaaattcagtcataccttaaaaatctagccttaaaaatctagcaccgtgtcatttgcaaggaccatcccaggttttattaggttatattataaaatagcgccgaaagaaggcatcatgtttgttgtatagacttagaaattaccacattataatagaaaaaagttagccgtaagatcttgatggaccaaattataacagtgtaaattgatagctatgcaaagtacaattgtctatatatagaaatagaagaaatgagttaaatattaaatttaatcctacttttaacatccatatagtactccagtatatagagtaggagtttagagtcgtatacgatgaatccaattcaacaaacacgtactgtaaatttgtacggggatatttcctagctgttcttcatgtgtgattatcctttatttttgtttattgtttacctgcaaaggggaactccgcaagaatcgtcgtcggacttgtcgcagacggaggagtgtagccggaggagcaggaagaagcgccggcagggcgtgcagcctccggcgactctcctgccgcagccggcgaagaagtgcctcgcgagctgcaggaggccccgccggtgcgcgcagggggaggccatcctgcagcactggccggtgcgc

SEQ ID NO: 42153 - DNA, 2352 bp, Oryza sativa
atcgcgcgcgtacgtgcggttgcctactagtacaaacctggcggatgcggcgtagaggaagcggaggaagacgacgacggcgccggtggaggcgccggcgatcgggacgacgccgccgcgcggcgcctgctcgatcatccgctccagcaccggcgacgccgaggccttcgccatcacatcacatcacaccaccagattccaaacagaaaaacaaagcgaaattcatcagaaattcgaaacaagaacgagaaaaatcgcatcgaagcaacggcgatctcttccttcgcttacaagaacagacgagtgcgcgcggatgccgctcccgtcggcggtgacgacccgcacgtcggccggcgaggtcgggagcgcactgaaggccgtgctgagcgccatcgaaaccaactccccgagtttctcgtccccctcgatcgatcctaaaatcctttatgcttccttaacaagaggattaaactaaagaaagtgaacaaagagaaagcgaaagaattaaagaagatcaagaaattccaattccaattccaactccaacaacagtagaacacatcttctgggttctgggttacgcctttttatataggagggattggaacgatcttccgaatcatacgcacacgcatgcgcagctacgcgcggcgtggaaagcaactgaagacttctggttctgagggcgttttgtttagtgtgacgagaggggttagcttaggatttaatttaatcatttaaaatgggcttttataattaacacatgtgggtggtcgttttatgaaccggggatgcaacgggtttgccgtgtcagcgacagattaggaaggaagcggtgcgaacaagcagccattttctttttttctaaaaaatataaaataaaggacatttgtttaaactgctgacttggaaccacgtatcatttttgtggtgttgttggctaacattatagtcggtggcggccttggtctaaaaagtttgagtagttgctcccttcgagttgataatacttgtcgttttagataagggtgaggtcaaactttaaaatctttgattatgaattattttaaaaatatttgtctttcaaacatagtgactacatgtatagattaatcttaaaaagtactttaataagatcatatattttttaacacttttatacatattataatagaaaataatggtcaaagtttttttttggagaccgtgccattattcaaaacgacaaatattatcaacctagagggagtataaggattaacacgtgatttggtcgctaaacttatgaacacttagtatttacttgtatatagggtatattataagctttttcaaaaaagaaatactcatacttttgcttttataaattgtgacaaacacgcttcaatattcctctttaactgctacgggcttaattgcatcttatacagctggaactagctctccgggacacgcggagtgaggcctagcggtttggggcctgtctagttcgcgaaatgaaaatttttgagggtcatatcggacgtttgaccggatgtcggaaggagttttggacataaataaaaaaactaatttcataactcgcctggaaaccgcgagatgaatcttttgagcctaattaatccgtcattagcacatgtgggttactgtagcatctatggctaatcatagactaattaggctcaaaagattcgtctcgcaatttcccccctaactgtgcaattagtttttcttttaatctatatttaatgctcaatgcatatatccaaagattcgatatggtgtttttggaaaaaaattttggggaactaaacggggccttgtttgatttatcttacaactggagataaccctatttgttgtatgtagtctgaggtagtgaggtccagtggattgtgctgagctagctagctaacttcggcgcatgtagttaagagttccagtgggttgtttggtttgtcgtcgtacctgagcagagcaagccattattctcacatgcacgaaatcaggaatgatctttatttaatttgtaattggcagaatgtggtggttgtttgttgaaatagctgacttggatctatgtatttttgtgttgttcttggctaacatgtagtcagatggcgttctggtagaacagtagcgaaagtttgagtactagaaggctagaagctaagggttaacacatgatttgatgggaaaatatgcagtgaaaacttggaaactaccgttggatcgagaaatagacgttcgagattcgtccacgtcaccatgagttaaaatttaactcgcggattcactcacggattcactcatgagttaaaattttggttagagttaaattttaactcatgg

SEQ ID NO: 42154 - DNA, 1821 bp, Oryza sativa
aaagcaaatgccaagggcaataactgattgttcccatctaccccaattgctgttagtatttggccctgatactttccagtcaagaatgtcccatcaatgcagagaacaggaggatagtacacgaatgccatcttgcatgcatgtagagctaagaacgtcctttgcagcacacttttgccaggatgttcaattgaggggaatttcttcactgtgtaagagctcccagggtttctttgttggataacaccaagcaagcgtggcaaattgccatacgaggtttcgtaagttctaaatctcatctctattattttctgtttggccctccacaccttggcatagctaatagtatacttgaatgtctctttgatatgtcggattattgactttggttcatatgtcagattatcgatgacatgcacatacatctcagatgcaacaaatgcacatgtaatgttcttgtggtatttctgaacaccaggtagaaaacatgtatgcttggtaatgactgacactgtccagtaatccttccattttcccttataagcgtgcactctccagggacactcatctttttccttaacacacctaacttcatattgcgaccggttggacttggcaatacaaaactctctatgaagtgacactgcaaaatgctttaccgcctccttcatatcttctgctctagtataaatcgctccctgaataacctcattttctttgtgctcccatctcacactatcctcttcagagatgaccagaccagaaaaatcctcactagcccattcggctggattaatatcgggatcctcatcatctgacgaatcatcttcctctacacgctcgttgtcagaatcctctctctccatttcatccacaatgccactgatagtctcctcctcgtcagccactccactaggttgaatgcccactggagctactacgccaccttcctctggtgcgttgacctcttccacggaagtctccttcacttcagcacttggtccctcgctatcatccatgttcatctgcgcacttggatccttcaggtgaacaaacggaaccatagctagaggccacccgcgttgcaatgcattctccacataccatctccacattcgagagtttcgaactggcattagttcccaataaaaactctcagttgcccgacttactacaatatagattgttatgtcatttgtctgtggatcaactctcaagcccctcatcaaccatccttttatagaaggtacactcctctcagccggtctatcaattccccttggtgttacaataaattctgacaaatctaccctagtcggcccgtaacggacgtttcctgggccatggtaaacttgaaatgtatgtttgttggacatatctgtcaacgaaataactagatcattcgttcatgtaataaacgcctacaacgttgacggagctcgtggctcctcaccgggagaccgctctggcccccctttgccggttcggccgggggcttagggtgaaatcccaagctctctcggtatgtggaaagatcgcgagccaggaaggaacgcgagacacgggcgatgtatacaggttcaggccgcccggaagcgtaataccctactcctgtgtttttggtggatctgtgtatgaacaagttacaaagtatgaaccagcccttccccgctccaaaagtccaagatccgttttttttttcccctttctaagtgggcaaggtcctccttttatatctcaaggggataccacatgcacctctccctttccaaactggacttttcttctcttcataaatggacggaaatcggtacggttgct

SEQ ID NO: 42155 - DNA, 15085 bp, Oryza sativa
acatgcatgtttgcccttcttcatgtagcatcttgcctgtaatggttgggatgaagcctggtataaatctaaccagggctaacgtgccatctctaagagataacacgctagctccggcttgagacgagtgcctagaggctttcgtcttgacgggatggggcaaggcgtgcgtcagaccgccagtcgccacctaacccgtgatctgaccggtctgtgactggtcacagaccggataaaggaacgcgctgcactgcgctgcatgcagcgtgacacgcttgaccagactgcaataaatgtggttaggtgagcactaccgtgttcacctatcccatatatgtggcgcaaacctcctcaaggggtcggggtgcctcggccctcggggccggggcaggagtaacccgacccccctcggggaaatcaggaggagagcggacacctcaccctcgggcccgacgtccccgaaggtgccaggccacgtgggtgattgtgtctgcctcaagcctcaggtcacgatactcccggtcccatatcaccgacagtagcccccggcgttatgccagggcgatcgcccttctcaagggaagcggtcgggcgtgacgccactcctaaagcctggtgacaggtgggaccggtctccatggttgggcagaaacccaacggtctcaaatcatgcacatcggtaatggtaatcttggctgtcaataatgggcggtctcttcaagactgccacatcacttgagcagcgcacgaatctgggcgagccgatttgcttcgcctggagatatggcaacgtcgcttcgatcggcgagcgtaattaacgcgcgcacgatacgatctgcctcgactgccacaaccgcatatccacctcatgcgccgcaagcgggcgaatgggattagtggaagcgtgggcacgagaaacaagggagcgagatagtgagaaacgagggagcgaaatagtgggcgcgagaaacgaggagccgggctcatcgatggcaagggtataaagataccgaggaaaagatttgctcccttcctttcgccattattccccttgccttcgccgcttgagccctaactctttctctgctgcaccttaccttcgccacacgcgctcgttctcaatcatcccttcctccggcgccatggcacggggttccgctctgctcgacggtagcgtacttccgccttcccgcatcgtgagcgagaggcatgccgggctgccgcgccacttcatgccggaatctgccaccggccgggagatagtgatgctgggcgagggacgcccggcaccagactacccggggcggtccgtcttcttcctccccttcgcaatggcggggctggttccgccattttcttctttctttatggatgttctggagttctacgatctccagatggcgcacctcacccccaatgcggtgatgacattggccatcttcgcgcatctgtgcgagatgttcattggggtgcgcccatctcttcggctgttccggtggttcttcaccgtgcagtcggtgtcgccgccgtcggtggttggtggctgctacttccagccgcgggggccggtgttgaaccgctacatcccctgcgccctccgcaagaagtgggacgactggaagagcgactggttctacacccccctcgccaacgaagcgcgcctccgacttccaagccagcccccggcgcaggtctccagctggcgggcgccggtagatctgggggatgattatgacgccgtcctcgaccgcctggcgggcctgcgatcccaggggctcacaggggccatggtgtacggcgactacctccgtcgccggattgcgccgcttcagcggcgcgcccggggcgcctgggagtacaccgggtctgaagactacatgcggacccaccagggagtcagatgggattgggctcccgaggacttcaagatcgtggtccaaagggtgctgaatctcagctccgtggaggcgtccctcattcctcaaggaatcctccccctctgcagcgatcccgaccgcgcctccattctgaccattatgatgggggtcggggcctcagaggaggaaactcctaagggccacgacggcgcgggcgagagccgccggggggaacaatctaccccaggagggggtcgtgcttttgggccccgcgtcgggggctcggggagcagccgccctgccgacgcctaggggaagaggaagctgggaggaacaccttccccatctcctccccgagggggcggggcggtgcgtgccagcagtcggcgcccggagggggccgcgccgacatcgcagcccgagggggagcgcaagaagaagcggctccgcaagatgggggagacggaaccatcccggggaaacctaatttcccctccaaggtggtcatttaaccgaccccctcgcaggttcgtcccactctcattgcgaccgtctttcttctatcccaaaagcaagttttctcttacccatcttgtttgtcttctggttttttcttctgcttcagcgatgtcccgtcgcgttcctcccgccatcccaaatccggccagtccgaggccgaagatccggcggccgcagaggaacggaggcgagaatctgaccggtgagaggccgcagatcgccttcgggaagctgaagaggccgcccgggaggccgctcgggttcgccatgcagaggataccgctcgggaggaggccgcccgggctcgccaagccgaagaagccgctaaggaggaggccgcccgggctcgccaggctgaggcgatggcgtcttccgaggcagcccacgagaaggctgctggcgcgtcgcttgggcccactccctcgggcgacgctcaggcgacagcctccggggcggctcgcgacgaggccgcgggcgcatcgcctaggcccacttccccgggcgacgtccaagaccaaacgggtccgggggacatccccgagcccagcgcgtcctccggcgggccgagccgcgtcgcattctctccaaggcggctcttctcctcgtcttctgtcgccccgctgagcgccgagccccttctgcaagccttgaccgccgcaaacaccgcggtgctagatgggttcaacgccaggtggaggccttgcaagcggaacgagcagagctcgaggccgcatgggcgcgtgtcgaggaggggcggcgctcggtggatgtcatggtggaggtgggccgtaaggctcaccgccgtcacgtctcggagcttgaagcccgctaagcggcactggcggagatcgcccgagaggtggaggaggagcgggaggccgccctcatcgccaccaccgcgatgatcgaggcgcaggacagcctccaccttcaacacgggagctgggaggcggagctaaagaaaaagctcgacgccgcccaaggggtccttgacaccgccgctgcccgagagcggcgggcaacggagatcgaagcggcgtcccggcggcgcgaagaggcccttgaggcccgtgccatggcgctggaagaacacgccggcgccgtggagaggagcttggcggaccgcgaggccgccgctgctatccgggaggcaacactggcggtgcacgaggccgcctgcgccgaagaggagtccgcgctccgcctccgcgaggacgcaatcgctgagcgggagcgagctctccaggaggccgaggccgcggcgcaacggctggcggacagcctgtccctccgcgaggcagcgcaggaggagcaggcgcgccgcaatctggaatgcgtccgcgccgagagagccgcactggagcagcgggctgctgacctcgaggcgcgggaaaaagagctggacgcgagggcgcgcatcggtggggcggctgcgggcgaaagcgacttagccgcccgcctcgcagctgccgaacacaccgtcgcggacatgcagcgcgccctagactcatccgccggggaagccgaggccctccgcttggcgggcgagatagggcccggcatgctttgggatgcggtctcccgtctggatcgcgccggtcggcaagcgggcctctggaaaggccagacaatgacgcactccaccaatctggaaggcctcgctccgcacctcacgaagatggcctgggctctccaacaactccccgaggagctcgagaagaccgtcaagtcatcctcgagggacctcgcccaaggagcggtcgaactcgtactagcgagttaccaggccagggaccccaacttctctccatggatggcgctggatgagttccctcccgggaccgaggacgacgcgcgcgcgcgggtccgggatgccgccgaccacatcgtccacagcttcgagggctcggcccctcggctcgcgttcgcccccaactccgacgaggagggcgacgccagcggtgcagacgacggtgacgacgaggccggcgacccgggcgcaacggaatgagcccccaggcccccgccaatctccagttttttctttttctttcttctaaggccttcatgcctcttttttgtatagatcaacttaatctgcaatcaaaaatgatgaaaaaattctttgtgtcaatttttttttgctatgcgtatgagatgaggatgatctgtgccgtggcccttttgcgtcttagcttgatttaagggctcgtgctcaagtcccagtcctcaaatggctcgggtcggggctagtgcctggggagatccacatgtcgagactggccaggccgggaacgtggtgaccgagggttatgggtgacccgattgtgggtttttgccgattccccccccccccggagttcaccacgccccggggcacggctcggttctgggccccgtttggcgattttagctgaccgaaccgagcccccgagggcaaggttgagcacgagtgaccttatttcaagtcaagattcttcaaaagaaaaaaacgacatagacacagcctttaggaaattgaaactgcttttattgaaatgctgaaataagagaaatgagaatgtgcatgtgtggtagcccccggccaaccctgcacacccgaggggggtgcggggttggcccgagcccgaaacctgacacccgacccccccctcaggggtagaagcgacgaaggtgttcgatgttccacgggttaggcagctccgtgccgtcgcccgtggccagccgtatggagcccggccgggggacaccgatcactcgatacggaccctcccacatcggtgagagcttgctcaatccagcacgcgtttggacgcggcgtaagacgaggtcgtcgacgcagagtgatcaggcccggacgtggcgctgatggtagcgccgcaggctctgctggtagcgcgcggctcggagggccgcgcgccgccttcgctcttccaagtagtcgaggtcatctctacgaagctgatcttgatcagcttcgcagtacatggtggcccgaggagacctcagggtgagctcggatgggagaaccgcttctgcgccgtagacgaggaagaaaggcgtttccccggttgctcggcttggtgtggttcggtttgcccagagcaccgctggcaactcctcgatccaagaatcgccgtgcttcttgagaatattgaaggtcttggttttaaggcctttgaggatttctgcattggcgcgttccacttggccattgcttctggggtgggcaggtgaggcgaagcagagcttgatgcccatgtcttcgcagtagtcgccgaagagttcactagtgaattgggtgccattatccgtaataatacggttaggcactccaaaacgggccgtgatgcccttaataaatttaagtgcagagtgcttatcgatcttgacgaccggataagcctcgggccacttagtgaacttgtcgatcgctacatacagatactcaaacccgcccggggcccgcttaaacggtcccaggatatcgagcccccagacaacaaatggccatgaaagtggtatgatctgtagggcctgggccggctgatggatttgcttggcgtgaaactgacacgctctgcatcgccggaccagatcgactgcatcattgagagctgtcggccaatagaatccttgacgaaaggccttgccaaccaaggtgcgcgaggcggaatgggctccgcactcgccttcatggatatcggcaagaagctcaacgccttgttcctgaggaatgcacttcaggaggattccgttagccgcgcgccgatagagggtcccttctaccagcacgtagcgtttggaaatgcgttggacgcgttcactcccttcgcggtccttaggtagagtcttatctgtgaggtatgcttggatctcagagatccaagcaatcaatctaagggagcttggagcgctcccttcgggtcccgaggcctggactccgacgggcctcgggggccggtcaagcgcatccgtctcccctaaggggttgggtcgcgccgacggctgggtaagcctttcttcaaaggcgcccggtggggtctgggctcgcgaggacgcgagccgtgagagttcgtcggcaatcatgttatcccgtctgggcacgtgccgaagctctatcccgtcaaaatggcgctccatgcgccgtacttggcgcacgtaggcgtccatctgcggatcagagcaccggtactccttacagacttggttaacgaccagctgggagtcgcctaataccaggaggcggcggatccccagtccagctgccactctgagtccggcaaggagtccctcgtactctgccatattattggtcgctcgaaagtcgaggcggaccaagtatctgaggacgtctccgctcggagaggtcaacgtaacccccgcaccggcgccctgaagagatagggagccgtcaaactgcatcacccagtgggctgtgtgagacagctgcgaggggtccgtgctggtctcagggatcgagacggtctcgggagccggggtccactctgccacaaagtcggcgagggcctggctcttgatagcgtggcgtggttcaaagtgcaaatcgaactcagaaagctcgattgcccatttaaccacccgtcctgtaccctctcgattatgcaagatttgaccgagggggtaagacgtaaccacggtgacccggtgcgcctggaaataatggcgcgttttctttgaggccatcagaatagcgtaaagcatcttctgggcctgagggtatcgggtcttggcgtcccggagggcctcactaacaaagtagacaggccgctgcacctttcggcggggccgatcctctttgctaggggccgtattcccggggcgttcttcgtccaagtggcctctcggggcgcactcgtcttctgtgccgatgacctcggggtcggaggatgacaggggcggccttcccacagtggcctcggggccgtcctgggggtcgggggctcctggcgtcgtcggacaagcgggcaaaaggccaactccggtcgtcaggggccttaggccaccgttcggctcgggggcctcttctccctgcttcctcccgggtcgagtcagcacagggttagcctcggggtcaaagggtgataggtgcggccttcccgcagtggcctcggggccttcctgagggtcgggggcacccagcaccgtctgacaagcgggcaaggggccgactccggtcgtcgggggccttaggccaccgttcgactcggggacctctcctccctgcttgctcccgggccaagtcagcacagggtgggggtgcgcggaatgaggattgtcctcatcgcgctccacaaccaacgctgcgctaactacttggggggtcgccgctaagtaaagtagcaggggctcatttggctccggggcgactagaaccggaggagagctgagatacgccttcaactgggcgagggcattttcagcttcttccgtccaagtaaacggcccggagcgtttgaggagcttaaataagggtagcgccttctctcccagcctagatatgaaacgacttagggcggccatgcaaccagtgacgcattgcacatccctaagtttgctgggggggcgcatccgctctatagctcgtatcttctcggggttagcctcgatgcctcgggcagagaccaagaacccgagaagcttgcccgcaggtacaccaaacacgcacttatcggggttcagttttatgcgggcggagcggagactctcaaaagtttccgctagatctgagagtaaagtctcttggttgcgcgtttttacaaccaagtcatcgacataagcctcaacattacgccctatttggctacccaaagaaattcgagtagtacgttgaaaagtaggacctgcattctttaacccgaagggcattgatgtataacaataggttcctacgggggtaatgaacgcagttttttcctcatcctccctagccatgcgaatctgatggtaaccagagtatgcatctagaaaacacaaaaggtcgcaccccgcggtggagtcgacaatctgatctatgcgaggcagggggtaagggtccttaggacatgccttgttaaggtcggtgtagtcgatgcacatccgaagcttgccgttcgccttgggaacgaccaccgggttcgccagccactccggatggatgacttcacggatgaatccggcctccagaagcctcgccacttcctcgcggatgaaggcttgacgttccggggcctgccgccgcactttctgccggaccggccttgcgcccggccgcacggcgagacggtgctcaatcacctccctggggaccccaggcatatccgccggtctccatgcgaagacgtcagcgtttgcccgcaggaaggagacgagcgcgtcttcctatttgccatccagaagaccaccgatccgtgtggtcttggatgggccgtcgcccagggcaacctccttgaccgggacctcgtcgcatgtgacaatccgctgcctcggggcggtgggggcggaggtgccaagcctctcgtcaccaccctcgggcttggacgcagcagcgaggtggtccgcgcgctgctccatgcaggcgagcgcgactttcaggtcgccatggacagagatggggccaccggggcccggcatcttcatctggaggtaggcgtagtggaccgccgccatgaacttcaccaacgcgggcctccccaggaccgcgttgtagggcagactgaggtccgccacatcgaagttcacccgctccgtgcggaagttggctgatccaccaaaggtgaccggtaggtcgatgtgacctaacggccatgtgtgccccggcgtcacaccgataatcggttgggacggctggagcaccatccccggggccttgatggcatcaaaagccgcgggggaaaggatgttgagggccgctcctccatctatgaggacacgccccaacttcacgttgcagatggtgggggaaaccaccatcgcaatctgccctccccgggcaacgcacggtgggtggtcggtctggtcaaaggtgagggcaacctccgaccaccgcgcccgacgcgtcgcctcatgagtaggggccgcggccagaagctctcgcttcatagccttgaagctccggcgagaaacgtgagcacacgctcccccatcgacggtggcaatggtggccccaggctcttggaaacctaggtcatcatcgccatcatcgatgtcctcggcgggggccttctgcttggcctcttttcgccgattgccggaaggaaccgccggagacttgccctcacggcgttcctgcctcctgtcctcctcccacttcctcgtccgctcagccaagcttttgactgcgcggcaatccgcgagatcgtggagggaggtgttgtggacggagcaccacttgccggccgggcgctccctgctgggagcaccagcctttttctctttgtcgctcgcaggcctcccctttcgggtggcccgcgaagcgccctcgacggcgaggacatgaccctcgtcgccggaatggaccgacctcttcttcctcctcctgtcacgccgccctatctgagcggtggacccgggggcggccgaagctgccacaccggaaccggaggggttccaggtccacgcttcctccttacgagccactcggtccgcgagctgaaaaagctccgcggtagtctggggctctttggaagcgatcttttcgagcatgcggttgtgccgcacaccccccctgaacgcgtagatcaccgcgtgtgcagggatgcatggtatggtattgcggacttggcagaaccgctgaatgtacgagcgaagtgactcatcatcccctcgctgtactgcgtgcaagtccgcttcttcacctgggcgcggataagtgccttgaaagttcatggtgaactgttggcacaaatcttcccaggagtggaccgacgcgggaggcaggttcattagccaaccccgcgcctgtcctttcagggccatgggaaagaaattcgccatgaccctgtcgtcacccccagcggcctcaatcccggtcgtatagacctggagaaactcggtggggttgacgctgccatcatacttctcggtgatggtgggccggaaccttgggggccaacggacattccgaagactcgccacaaaggctctacagccgacaccaccaaccgggggcacggagggctggtcctcacgtccatgtcgaggtgacactctggacgaagaggcgccctccgttgcgcggggagtacgccggctattacgccggcgctcgatgtcgaagcgggcatccggctctccatgctgatcctcccgagtcggaggcgccgacgagggagtggcagccgaatggcgtgcaacagccgccgctcgccgcgccctccgcctgacgacacggagccggtggtggcggcgccggaggtcctggtggtggcggaccgtccaccagcacccaggcgctgctgtgccgtcatgaccaagttggccacatcgtccagccatcgctgggctggagactccgggtcagggacgacgggcgggtgacgtaggagcgcgccagcagcctgaagcgcgccctgaggcgtgctgccgtcgcagtagacgagtaggcgacgctccccatctcgccgttctcctgcatcacccgcgactggtgatgctgcggatttttcgaccctctcgagcgcctccccctgcttaggactttggtgtggaggaggtgggggagtacgagctcgacggcgtgggtttggctccccgtcgtcgccgctcacactcggagagaggtcgtgcgcctttgcttgctcggccattaggctgaacaagaaaaacttggcgcacacggaagagtgcgagagctcagaaaacacacgctgagccccctacctggcgcgccagatgacggagctcgtggctcctcaccgggagaccgctctggcccccctttgccggttcggccgggggcttagggtgaaatcccaagctctctcggtatgtggaaagatcgcgagccaggaaggaacgcgagacacgggcgatgtatacaggttcaggccgcccggaagcgtaataccctactcctgtgtttttggtggatctgtgtatgaacaagttacaaagtatgaaccagcccttccccgctccaaaagtccaagatccgttttttttcccctttctaagtgggcaaggtcctccttttatatctcaaggggataccacatgcacctctccctttccaaactggacttttcttctcttcataaatggacggagatcggtacggttgctgtccgagtgcccttctgacgggacggcccatacctacccccacttccgccggaaacaggtgcgacgtgggattatggctgtctgttgatgacgcgaccagtgtctgaccggtcacaaatcagtcatccttgtccaccacgtgtcagctgggcaaacatgcatgtttgcccttcttcatgtagcatcttgcctgtaatggttgggatgaagcctggtataaatctaaccagggctaacgtgccatctctaagagataacacgctagctccggcttgagacgagtgcctagaggctttcgtcttgacgggatggggcaaggcgtgcgtcagaccgccagtcgccacctaacccgtgatctgaccggtctgtgactggtcacagaccggataaaggaacgcgctgcactgcgctgcatgcagcgtgacacgcttgaccagactgcaataaatgtggttaggtgagcactgccgtgttcacctatcccatatatgtggcgcaaacctcctcaaagggtcggggtgcctcggccctcggggccggggcaggagtaacccgacccccctcggggaaatcaggaggagagcggacacctcaccctcgggcccgacgtccccgaaggtgccaggccacgtgggcgattgtgtctgcctcaagcctcaggtcacgatactcccggtcccatatcactgacaaacgtaatatcttgttatgtatgctaatgtaatggtaaagtgtatatttaaaactagtagatctacgcagttaccgatatctagcaatacgcagttctagattaatacaactaaaaccctagaaaatataatgcatttattcaaacaaagttttaaaaaatacacagtagttaactcaatagtcaaaaatataatgcatctatgaatattacatgaaatcggagtctcgaaccgacagagcttcgcctcttcttctcttctcctcccccttcttttttagagtggaggtgatgggaggaatgaggagggagggctgggcggcaaggggcctccatgcaaaaaagccagcccaggccggcccctttccaccctagcagtgggcggcaagggtttaatgaaaaaaaaatttcgatccgccgtcatcgcctgtccctcccctgtttgccacgtcagcttgccatcctagtggagggcagcaaagtctatttttgtaaatttttccaacgataaattatttatgtaaatattaaaaaaaattaaaaatgaaaaaaaattcgatgaaataggcggactggcccaagagcagcagcaaactcaacgacgggtcgatggctgaaggcccaaaaatccactcgcagctacaacgtgtgtggcccaaatccgacccggacacgcgggagaggccaagtccaagtccgaggccgcagcgcgtgcgcgtgggagcccgaagcggcgtgggatcctgcggcaatccgtgccggcccacgacggatcagtgcacattgtttttgtggtcgggagtgtttgaaaggagggaaaatagaaggtggagaaatacctaaaacgatatgagtcatcaacacatgattaattaagtattaactattttaaattttaaaaataaatcaatatgattttttaaaacaactttgctatagaatttttctttctaaaaacgtaccatttagtagtttgtgaagcctgcgcgcgaaaaagaggtactgtctctctcaattaccctggaacgagagagcctcgtcgcccatgcaccactatcaactattttgaaaagtttaatattacagtcaaccgttagctctaaaattgatatatcatctgctgtcaacctaatagcatatttgtataatagttttatataaatataaattgcaccattagtacttggctcacatatgtaacgtgtttttcatttctcttctccatggatgtttatagctatttataatatgttattggacttattattagttgatggctttcttctctctcatgctttctctctcctccacttagcttttttaacgtattaaatttagaaatcaaaacaatatgaatatatttatgtttatgtatcttcaaaatcaatgttaaataaaactattagcactgttaggcggttttctcttggaaatatcttttttatgtgatatcttattattattactttatttttagtaggctggctgcatatatttaatataaatattaaattaaactaaaaaagaaaatctcgtagtattttgatactaagatgcgattcatgatcatacttagacttatgatcatactcccgccgggccaaaaggagcgacaaaatatgattgattaagtatttactaatttttttaaaaaaatgaaaatgtaatttttaatgtaactttcgtataaaatatttatataaaaaaaatattgtttagccgtttgaaaagcgtgcgagcgaaaaacaatggacacagcctaaaaaacaatgggctggtttggtttgtggcctaaataggacttactaaattttgtcagtgtcaaattttggtatgactaattttgataaggcaaagttgtgcttggattgaagccaaaataggctaagttcactattaaaatggcctattttcttaggcatgaaaaacttagcttcaaaccaaatagatattaaacactatattaaaattatcaaatattgataagtctaatttaggtctcaaaccaaaccagcctaaagatcctgataatgaccaatctggaccgtgcgtgttctggaaaggaaaaagaacattttccgctgttccgcctaatgagtctacgcgcaggcggcaggttagttccaagagaaaatgtcgatcaataacgcggattctagagtaacgcggattccagactattcctccgtggtctactttatccagcgttggaaacccgctcctacacacacacacacccactaccgctctccgcaattcagccagactgcagttgcagcaacagcaaggatggctggtggagtcggggaggcgctcgtgtccgccgtgctgaaggaggtgctgggaaagcttggctccgccgtcggggaacagatcgtgatgcgatggaacctgaagcaagatctggagagcatcaagagcaccctgggtatgcttcaagcggtgctcagggatgccgagaggcgctccgtgagtgacgaaggcgccagcctctggctgaagaggctcaagaacgcggcctacgacatctccgacatgctcgatgaattcgaagccaagttatcggaggtaaaaaagtgtcctcccgctaggatgtcgtccttcacttcagttttatgcttatctatgctcctcccgtcaaaaaagagttgacatttaggacaatatttagtagtctcagctagattccctaaggctttgttcggtttagagggga

SEQ ID NO: 42156 - DNA, 1694 bp, Oryza sativa
aaggtcttccaactgcatttgtacaatttgctgcaaatttgttgttttaacattgatgatgaatgatggtcaccctgctggtttcagttcttttgccatatggatgagaattgtggtaagcttgtatttgactattattgtttttattgtgcaggagttcagcagatatgaccgacaaattgcaaaatctattggtaaacttatgccgactactgacagtgtaaagtgagtatatatataaaacatatttttaactgcctagatccgtatagctcaatgcacataagcacattcaaataaaaaagatctacatctattctcctttttccatcatttgacgcgtgataagaactaattgccttttggtcatatagttgtttttgaagggttttaaagtgagtatttgatttgaatatttatttaatttgaaatctacccctaaacatttgttgcagagcaagggctggtgagcttattaaagctttggatggacaggattgcccacgtccaattgcttgccgtatatttgcaaacaaggtacttttatgtggtaatggcctcttttttcaaacgagtagcatcataaatatgtgtgaaatgtcaaaaagtctgagttgaacgacatgaccatgcaatatttttatccatatgttcaatataagtacgaacatacttgctaatataaacttaggcccaaacacttgctttatgaactgacttgtcggtcaatagttgaaagtcgaaacatgaaccatcaaatacctgttttatagtttagataattggtatgttaactgcctacatgatgaccttacaatttttagacacatttttttaatagaaaaaatgtgtctagaatatgtaaagtaatagcatcatgtcaccatttaacataccaatcatctaaacttcagttacatttttttagaaacatggatttaccacttcactttttggctttgcatagtctctctattgtagtgtatacctctgcagtactggtctgttgttgccaacatgaacttaagtgtgctcacataactctaactagaaatttttggccttctcatgtactagaattagagtcctaccgggctgtccattttgacatactgaattctacttgatattgttgacttacatagctgacctgatattgatttgcagattatttcaatcgtcaagagtagaaatacaaaggacaaaacatttggaaatttggcctttgcttgtggatatgtcatgcttctagtcaccagccaggtatgtttgtgttttttagttttactaggcattacttttgttaataagtgcatatcgaattgtgctcactttctggacatttaccgcactcagttttctttcttatagctctcttctgatatttcagaaggcatatgttgtgatcatgaattcttgattggtggaagtatattgatacttaaaattagtttatagtaggaaaagactatttcttccttacatgacagctcatccttaataagtggaatggaaacccacagtaactaattttcgttatgtttcatgttaagtttaaaagttgaagctgcttttgacacctcatttaaacatgaagtggcatgcaatgatgaactattgcactgttcgtcatggttagaggaagtggatattaagtgtccttaaatttgatggcaataaacagtggaaggtta

SEQ ID NO: 42157 - DNA, 4503 bp, Oryza sativa
  unsure (1)..(4503): unsure at all n locations
nnnnnnnnnnnnnnnnnnnnnnnnnnnnnnnnnnnnnnnnnnnnnnaggaacaaagggcgtgaacttacactcttcttccgtggtagagacttatacctgaaagggtggagaagtgataggtttggtctgtttgctgcccaccctgataggtttgataagaagaattgcttcatacaagacaaagcttgcaaacacctgaacatcgaggataattatcatcagcttgttccaggaggaagaatcgggaaagtcagagtgggaccccttgcaatgctagactattttgaagtccttcacaaatgcaatggaatagtgacaacagatgttctgggggctgtggctggatttgctgttaacttcgcagaaccaatacgccaggaagatgtcttggaggatatcttagagtcgtttgttcattttgatgtggctatgctggatagcagaagggcactatccttggacgtaaggaaatacgaccactactcaagggagtttctaactggtgttgattgcttattgcacggtagaccaatgccagagattttgaagcgtgaggaagttacagtcaagtcactccatgagttgtggtgcagaatcaaagttccgctgagagactcttataatgatggtgcattttatcatgatgataaagttggcatacccgtctggtctcccccctaccctgatgggaataattgggaggaggaggaagatgaagaggaagaagaggaagagggagataaagaggaagaggctgaggaagaagaggaagaggaagaagaggaagaggctgaggaagatgcaaaccaccgtgatctaaaattcacaagccaacaggacttcttttcagttgggatgaaggctaatgaaatcaacacctcttgtctctgtcgtcctttctctgcagttgcctcaggtgggatgaggccccttgttgtccctccaagtcagggtggggaagtccagagccggtttctgagcaggaggccacagtggttctccagattcattaatggaccaagggctgcgtgttttttgaggaggctactaaaatagcgaccacggctggtggagcgggcttcttgattcttttgtgtctgtctgaaattttgatatgtctgaaatgtatctcttttgctttgtttagttgcttcctgcttacaaacatgtaaaatttctctaaaggagaagttgtccagaagtttcatttgcatcatgctcttttctgccttccaaacatgagcaaactccattaggatacttggctttgtcttgagtacatcatggatcatgaagcacatttatgctaagtgagattttaattggtcggaattttgctcggaatgtcctaaactacaaatttctgagcccaggggagacggatccctgataaacgtttggagcgtgcctttttaacatctgacaggatacaggatgaggatagcatggatgagggagatcaaaactgcacaactcaggttataacaactgaaaacagtcagggaaccaacaagttctcacgcttgacttgtgttatcatctgacaacttatctatgcatgttagttgtatcataaatatgtattatccattgaacttaacttatcctacgtgaccttgaatttcctttttaaaaagaaatcatgtgtgtgctatgcctattgtttgttctctgcaatctctgccattttctgactgtcacctatattcttcttggttttgcagtttaactgttgaaggcagtattttggtgcatacatatgttaaagtctgtgatgctttagcttatgcttcgcaaaatctttgatactgccataatgccattgatttttctgtgctggtatctctgatttatcatgtcttcccagccaacccgcaccgaagcgcagggtgcacacctgcaagtataattgttagcaatagtgtcaattcacttcagtaaataatcaagcaatttctaatcaatctagcatgtaatactatactctctccagccataaaagaagatcaattttgactattcaaagtccacaagacacaaatttgaacgctagattcttcctcataagtctgaaaacaggttaggtaagtgcaatactgttattcaagcatttgctgtaataaacttggatatataatttcatatgcgaaatatacattctaattctaaataatagacaaattttgctacgggacattcaaaaaacacgtaattagctgggagacatcacaagaaggcatatctgttataggacaacgcaaaaaactggtaattagctgcttgacacccgtgggattattttattttattttaacataatgactattacgtgaaatcaaccacaaactatttcttctttgctatttacaacttctacagatatgttaggtgctaataataagttctcttaaactaacatttggcatagcgttctgatttttttagtatggtcgtgttactcgtgtaaccatgtactgttaggactgtaaatatcacaggctgaaaacacaaaaggccattaatacaagaaaagcatatgccaaaacgaggaaaaagttcactttagatcccttatgttatcattgagtttcaaaaacatcctgaaccacggatctcgtgtgcgctagttttgtaagttaggggatgcgttgtgtccggttttgtggttcagggatgtttttaaactcgacgacaagatgagagacccaatgtgaacttttttttcccaaaacgatgatcatgtgggcccatgggccgttgtactttgctcccacggcccagggcatcacggtctactaccatcatcaatggcgggaaagcatgggagaaatggagggaaaacgagctcccattccccacccagaggccgccgccgccaccgccgccgccgccgcagagcggagctgacgatggcgaagcgcaaggcaccgtccggcccctcctcctcgccgtctcccgccgccgctggcgccgacgcgtccccgcccgtcgaccccgtcagttcacctctccctcgaatctcacgctagttttgatttctcttccttttgttgaggtttcgtattctagctcgcagggtggatccgccggcgggaggaatcgcaagggcgcagcggcggcggccaagcggaagcctaggaagccgcaggtttgcgtcctcccaaatcccaatcgcagcaaatccttgcatcctgctctcttttttgattcgtttgaggctgtaattttgccactgaatgtgtggttactgttctgcccccaaatacaacattggcctgatgcaataattctgtcacttttgcgtaggttcacgagaaaaattacgcgcatgtgtactatggatgtagaaatgttttatatgatgggaatgatttctactatggacatagatatacagaagaatttcgtaaggtggaggcacatgatttgtatggatgtccacacttgattgccgagctaccaccacaaccacggttaatgtcattgctggatttacagctctggattatcaagttgtttagactccatccagaaacacaagacctctcaattaagggcttcttcgaagaagaagacagttggcagtacttaggttcagcgggctggaagacctatgattttctatctgataaaagttggcagtcctttgtcaagaaagtaaagggtagaaaggggatggaatttttcaagttgtatgtggactcctctgaaatcaagcactacgacagtttgctaaaagcaacaaatgatgattattgtcagtcggcaactgtcttgttgcccgagcaagatgatctgacatggtattttccttgggatcacatttcccgacgcctcacggaagacctggcaatgacaactacacagattgtagctcatcttgctcacaactatgacaggcaccttagctatgctggggcatggagagcaaagcagaaggctttggagatacgatttggtacattttatgcttcacacaactatgtcccgaggttactcaaggaaagattttacataaataaccctttcagttttgtggacatcaaggatacagaggttgcaggctgtaaagatttccgagtcctccaccgtatattctgggcatttgcacagtgcacgcaggcctttctgcactgtcgtcctgtgatttgtgttaagggaatgccgctatgtgggaaatatgaaggggttctgttaactgctctagcatttgatgctaatggttaccccattccagtagcatttgctgtcatcgagggtgagagcaaagaaagctggctatggtttcttaggaatgtgaaacatgctgttgtgaaggagcgatctcatatctgcatcatacatgattgcaaaagggcattgttcaatgctatagaagatctaaggaataatccacaagaagcacatccatggaaggatgtacaaagccgctggtgcatccaacaccttgctgaaaacctgttcgcccattttgctgacaaaaagctgatgatgctgttcaa

SEQ ID NO: 42158 - DNA, 10864 bp, Oryza sativa
attcctgcagcccgtggaggtggcatttgaacgtgtgacagagtatttcaataacagaagtgctgctgcaaacaaagcaacgggcaacccttccatgggcttccctgaatgtgtccaggatgagatgaatgcaaaagtgcaaaaagcacagacgtatcacgtgacccgcatgaacactgcggatacaaatgttttctccaacgaagcgcatcaaaggtttaaggttcagtcaagacagaagggtgtgattgttcatctgatatcgaaacgtatccataagaatcacaaaaggaacatagcgtgtcaaagcgaaatcagaagaatcgctcgatgttcatgcaacaaagcaaggctgcttcacaagccctgctctcatgtcattgccgtctgctgtcaggttggagtcagcattgcctcatacatgtcccccttctacagcctgtcctatctagtcaaaacttggagtggaaaatcagatgcatccaaccttgttgaccggaattttgctcggaatgtcctaaactacaaatttctgtgcccaggggagacgcaaacatggatccctgataaacgtttggagcgtggccttcctgcctttttaacatcagacaggatacatgatgaggagagcatggatgagggagatcaaaactgcacaactcaggttataacaactgaaaacagtcagggaaccaacaagttctcaggagaaactagtgatgcttgacttgtgttatcatccgacaacttatctatgcatgttagttgtatcataaatatgtactatccattgaacttaacttatcctacgtgacctttaatttcctttttaaaaagaaatcatgtgtgtgctatgcctattgtttgttctctgcaatctctaccattttctgactgtcaccgatattcttcttggctttgcagttaaactgttaaaggcagtattttggtgcatacatatgtacgggataatttactatttgccactctgttaaagtctgtgatgctttagcttatgcttcgaaaaatctttgatactgccattgatttttctgtgccaacccgcaccgaagcgcagggtgcacacctggaagtataatgttagcaatagtgttaattcaagcaatttctaatcaatctagcatgtaatactatactctctccagccataaaagaagatcgattttgactattcaaagtccacaagacacaaatttgaacgctagattctccctcataagtctgaaaataggttaggtaagtgcaatgccgttattcaagcatttgctgtaataaacttggatacataatttcatatgcgaaatatacattctaaataataagtataataaagttaacattatagatctagtgagatcaaagatgtgccgttgatttttatctctttgagcgtgtgttagggccatattcatgggtgtgtaaatgtgatgttgcatggcccactctgttacagaaacagaggtatcactcgtccagaaagcaaagctgaccaagtcacctttactgagattaacgcaaaatcagtctttatttcttgagtatcatagccatggattttctccttgaaggaaacataatgctggtcgaaactggatggaaacgcgcccacttcgaacttcaaatctatgaaagaatccctcgttacagcaaccaccgacctctttaaatcacgtgactcactgatgacaccatcaaagagacggatttccttatccaagtcactggttaaacaaccgagcaacaaattgaaactgctttgcacttctgatataagaatctctacggtggcctcagctgaacaattaaaacgtgataaagttatgtcaactgcaccgtaatcgccaggaatgcaaattgtttctggccgattccataggcctccagagcctatcattgatgcaccatcaatcagctgtaggtcatctttttcttgttcacctgtcttgatcctcatgtcatattcaattagagcatagtccatcatgtctattcctcggttagggccttccatgttgatgagcgaaccctacaaaattattatatttagttgctcttcttataaaagtaagaaatatctaaaggtggatgcttccttatgttgtttcacttgtaacagcatttacttgaaaggtccttaaagttggagcgtggtgtcacttaggtccacgatcttgtaaaatcaacattaagatccatgaacttgtttaagtgaatcattgcagtccaaaaacacgtctgaccgggttgaccgtcctacgtggcagtctagcgtggctacatgtttgcaattaggcccctccacgcccgatccacagccttcatggtgttggagacgcggttcttgccgatgagcgacatgacggcctcccgcgccttggtgagcacctgcgtgagcgcctcccgaccttcgccatcatgttgcccggcgccgttgccgccttcggtgggtgtttgttgcagcagcagcggcggaggggggacaggggcagatgcactggggaaggagaagcaacacaagccggtgctcaagaacaccatcgccggcggcgaccacagcgggaacaatgacggcggaggtggcagggagaaacagcggcgaccgcgctggcgtgagcaacaacagcaacagcagcgaggaggatgaacgcgatgtggcggcgcagaggatgggtgatgtggactagcgcaggtaccaagaggacatcgaggacaaaaccatcgccatggattccgatcctgaggttcatatcgcgccgagtaagctcttgctccgttgatctctagctttgcatgtgccgccgctgacggtgttagatttgaaacttttttggttgtttgcgtgtgccgccgctgacggtgtcaggtttgacatggcaaggaccctagcggtgcaggagatggagcagtggagggcgacggcgcaacgtgtcaaggtgtcggctcggtgacctcggcggccccgtcttggacgtctcggcggcaccacactccacgatgcgtgtgctgcgggaaggcgaggacatcggcacgacgcctgtcgtcgactctttcgagtggaaggatgcggccacgtacacaatgcctgaaggcagcgctgccgcctgtcgtgtccggcgtgacgtacaccgacaagatcaagttggcagcgacatgcaccacggagagtacagcaagaagctagccaccacaatgtacgagaaggtcgccggagtcgggaccgtcgtggactcgtggctggcaaggtgcagcaagtgacgcagtccgctggcaccgtgatctcaggcatcagcggcacctcatagtcacagggtaccgcgcaggactcggacgcctccaccacccttgcctccggcgagccagcgaccgggcagcaacaggacaagggggcgacggtcaccggctaaatcgccgacatgctccgtcggggcgatgaggaccgcgtgctcagcgaggcgatcttcggcatagtgcagtggcggaaggaggtcgtggcacagcgcgtgccggcggtggcggcagcggtgccgggcgaaacgatgatgaagatccgggaggcactcgcataggtgctcgctaaggtgcgggaggccgttacgtcggtcatcggcaagaaccacatctccgacaccgtgaaggccgtggatcgggcgtggagggcctaattgcaaatatggagccacgctggactgccacgtaggacggtcaacccagtcagacgtgttttgtactgctatgattcacttaaacaagttcatggaccttaatatcgattttacaagatcatggacctaagtgacaccacgctccaactttaaggaccggtggtgtattttactctttttacaactaccaagatcttcatcatgtatcaaacaaaagaaaaaaaaattatgtagggtactaagcaacaacaaagtgtccaaaactatttaacatgatttttctttggaatacatgtgttccttagtttcataatttaaacctgttctcatagtaaatcatcatttcataatatagagtacactccctatgtaaggtgcgttttggaaggagaaattcttgaaaagtagaattttgacctttaatttctctatcaatatatcaccaattgcaataaaattaacatcttaaaagtaattcgagtaccaataatttgacgatttttgccaaaactcatgaagtatgaattttccaaatcaaaatacacaatgatatttctagataagtcggatgtgtacctgctccacaatgatgggatcatccctgctacagttgacaatataattaagcaacggatctagatcatcccgcacagctatgtatccatacaactctactgaaccaccatccagtgtaattttagccaactccaatgataaaatttgcagcatgttgcaatgaacatgtgacatgcaagttccattactgcgaatgacacaatttgtgggattcgaaaacctcattgcctccaaccgagcttcaaaaaaagtaaagtcataatgtaagtttgtgaccggaaattaatacagtgaacaaacacttgacatttgaaaagtacatgtgatatttgatgattatatggccttattggatttttttttccttttcatctacaaagtagaaacaacctatgttctttttactaggagagcaacatctatcctagtatcaactacaagaaaaaaaaaactcaagggcagactacctcttcagaaagccaggtatattctttcctgtaccagccttttacctctacagaaaaccacgtgttttgggaagtggtctatattttggaaactggcaacccgctcctcatattaaacaggggcatttgaatgtttggttggccccttgaacacctagtagtcctttaggttatatatagtatgtgaactgcctgagtactttctattattgcttgttgttgctccctgcatgcttggaaaacttgtactattactgacagtttgtggctgcatgtatggagaatttaaacctaatggcaattacaacagtgtggatgcgatatttagattattatttgcacttatagttgtcattttcttgtgtattctgctattgaaatacatgctcaaaggctgtgtgatcaccgtgttgcaaagttcagggataaagtactttggacatttatgtaattaaatggcatggaataaggtcctagtccatgtcatcagaactctgcatgcaacctcagtccctcccatcaggctgtggcgcagattgctatgtatgcaaatggtgctaagctgaagggccagtaaaagtaaagtacaaggcttggggtggaagtgttactctcatccacgtttaaggacctccagtacaattatctcatagctgaaaagagtgtaaggcgggtaaaattatggcagtgctgcatagcaccacatatacaatgatctctaggatcgcaataaaatatttatagatatggaaagagattcgttatgttcaaggaaacaaattatctctaataaaaaataatatagcaaataaagatagagaaaagatagcttactctcattacggtctgcaatatgaaactcccttttccacggtgtgtccatgatgtccctatatatagagccatcacggtgtctactttttggaagtatgttgttcacagtatattcttcaggatcaagaacttcgtcctcctcaacatgttcctccgtttcactccttcgatcatcctcatcacagccatcctgcttcgcactttgccccagtacatcgtatttgatgtatgaaacctctgaggacgccgcatctctattacttttctcatctccagctctagcctccaagattgtgcccctggtgtcaatggttttcataccttgagtgatcgcagtatgcttcttttcctgggatggaagtcgcctgtatgactcgtcgccttttactcgactgatggtggtcatgttccgaggttcccaaggaaatctatcattaattaagagaatgaaaaaccaatatcaacaactaaaataaataagacggtaccatcagtcaggattgagatcatctaaccctgaaatcgataatcgatttctaaattttttttctcgatctcctttgtctttgtttcgaattagtttaaagaaacttattttccacaactaccttcaaacaaatgaaaacaaaacccaaagttttttttttttgcgaggaaaacaaaacccaaagttgatcgcagatccaaaaactgtggcaaaagacgcaaactttagcatcagaacaaggaaaaaaaacacatgcccaaaaaatctgtctatgaaaatcatgccaaaactgtagtaataaccaagtaaaggcgcagactttagcatcgatcagcacaagaaaacacaccgggaaacacgacggacgacaggtcctcctcgagcaagcaatggtgaccaccagcaccagctagccgctgcagatgccatgagagagggagaagagatgaggcggtgcatcggggcaggagatcgggcggcggcgttagagcgtcggagcagacgcggaaagcggcggagaattcgcatctgggcggcggcgggggttagggggaatagccgtgctgtggctgcgtgggggatttctgtcatcatcagaaacgggcatcatgtggatggacataattggagaaatttcattatttgacatccaattcgcaggcctttcagggcaagccactcaatacacattcctttcagattttgtcactgcgatagcgaattcctttattccgtgccactccgtcgccgatccgtccgtccgtccccaacgccagcttttccgtcgtcttctccacctcgtcacgctcgtcaccggcgccggcgtgggctgcgctctagaggggctcgagctcagattccggtgtggatgtcaggaaccagtcgtcttgtaatctcgcaaagcagcagccgatcgaaacgggcgagccgagacgcacgaggcggggccagccgcagacgtcgcggccgccctccacaccgcagaatcgttgggcaactcggagaagaaatttccagcgtcttccacctcgacgtagccggcgagcggccaccttcgcgaacccgggccacatcgggaacgaaggccatatctaatcccgcagacgtgcgacctcagcaccaggcagaactgcagagctaatctcttccatgccataatcagcaaaaaattgttaatcttcccaaacaaatgcattgagaaaactgacagaggaatctactgttttcattgataaactaccaagcgtgctcctcagaagtcagaacgaagaagaaagaaatcacattacgcaactaattgatgggagagaacgaagaaactagggaagaaattagcgagctgcaattaacacacaagctatatctatgcacaatcagttgctgctgcttcgcaagattagaccccgcgccgtctcgcgcctcgtgtgttgatgtgatgttttgtgtggggggtgaaatgtgcgtgctctgaacacgcaggctgacggcgccgccaccgccgcggggaagaggaagggcgccccggtggccgccgccgccgccgccacggcgccgccgaaggctaagaagcagcaggtctgtgccgcgcacattccgttcctttgaatctcccttgcttgctcgatctcgttttggtgctggatcttggagcaatgggaggtcactagtggtattttgcttcgcaagcgtcgagtttaggatagattacaatctgccaatctgggccttgcttaggtacgaatactgaagcaatgtgctgttttttttttattattagataggtgggggcaaaatctgtatccatataaaatgttcttggtatttggtgaggaacaagtatttgatttcatttatttttagattgttacagatttgcctgaatctaatattgatcacttcgctgtaagatttgtagacttttctaagacctgatgtctgatgtagcccccaaatatcaaactttgatgtctgatatttgtggtaagggacaaatgtttggtttcatttatttttgggttgatacagatttacccccaaccttattgatcactttgctgtaaaatttgcaaactttaatatagcccctaaattcaacactgatttgatacatggaaatctcattgtttggtgtaggattttggaacaaaccaggcttacgtgtactatgggctacgagaggacagatatgggctatgtgagagagagtttgaattcatgaaagggtctgatttgaggctatgtgaacgggtaatcggtgagctcccacagcctcgatcgatgtcattggtggatctgcagtgctgggtcatcaagttgcttcgactccatccagaaatacaagatcttcaaatcaaagggttcttctcagaaggcttgccccttgagtttcgtccggagtggttttataaaggtgactgggagacacaccatatgcataatgatgattcatgggcttcctatgtcaagaaagtaaagagaagatatggtatgtcaatgttcgtgctctgtgtggattgctctgaaatcaagcactacagaagtttggtcaaagctgggtatggtgtttacgctcaagtggggaaggttgcggatcatgaatgcatgcctacggaggttttgcctgggcaaaaaagtctgtcatctaaatttcctgctcagtatctctcctatcgccttaaggatgagcataacatgtcaatgacagctgaagaaattgtaccttttattgctgacagatatggcgacaagatcagtctccctgaggcatggaggataaagatgaaggctttggagattctatttggtaccttctatgattcatacaactctgtaccaaggttacttaaggacataggatataaaaactatggcaattatgtgaacatcaaggacacagaggttgtaggctgtaaaagtttccgagtcctcgatcgtatattttggtcacctgcaccgtgcgtactggcctttacatactgtcgtcctgtgctttgcatcaagggcacttcactatgtgggaaataccaaccacttctgttaactgctctagcattagatgctaatgataacttgattccagtagcatttgccatcattgaaggtgagagcaaggagagctggctgtggtttcttaggaatgtgaagcaatcagttgtgaaagagcgatctggtatctgcattatacatgactacaaaagggagttgcttgatgctatagaggacctccagaataaccctcaagaacaagaaccacacacatggagagacatacaaagcaggtggtgcatcgaacaccttactgaaaacttatctgcacattttggtggcaagaagtcggcggtgctgttcaataaactctgtcagcagagccaaccaagtaagtttactgatatctggaaggacctagatgatttgacactcaggtatacgactgagaatgactctgttgctagtgaggaaatggaacaggagtcagtcgagcatgatgaggcagaacttgaatcacaaagcccatcccaccaacttgattcagcggatgatgaggaggaagtaaatcagggcggtgacagcaagagcaagattacaaggtttactgagtggatccgtctgaaaccattggagaagtggtcgctgctgcatgacacagatggagctaggtatggcatcatgggcattaatatagctgatatatatgaaggtaatcatgtgttgaaggggataaagtgccttcctctcaacgcaatagtggaggttacacaccagcgcatggcagaatacttcaaggaaagaagtgctgcagcgaagaaagcaattggcaatccttcaatgaactttcctgaatgtgtccaggatgccatgaatgccaaaatgcaaaaggcgcagattcatagtgtgacctgcatggaaatcaaggagaacaaatattttcccggggaagaggttcaaaagtttaaggttcagtcaaatcagaagaaggttgttgttcaattaacatcggagtatacccgcatcagtagggatcatgcacgcgagctcacgaaacgcgctgaatgttcctgcaacaagtcaaagctgcttcataagccctgttctcatgtcattgccgtctgttgtcagattggagttaccactgctgattacatgtccccgtactacaccctgccctatctggataacacttggagtggaaattgtgatgtacccaaattctcaccagactacaaaatcatcatgccatttgacaaaccaacttggatccctgacaaaaagctggagtgtggtctttctgtttttagaacatcagatcgcgtgcagtctgtcatggatgaggaagagcaacagagtagcagcacttagagtagatcagtttcagacaattcagggcagcaaaaagcacctagaagaacctagtcaagcttgaacctgtgttattgtctgttggcttaaccatgttttgcgttagacattaagttatggtatgcaaaacctgtgtttctattacttttgtagtgcttatgtgctcccttgacaactgatgttttcagatcttttaaggcaatatggttagtggtctcatggatatttcaaactgtgggcatgattatgttctaaatcaggttagttttgctatcctatactatacccttgctctcttttccagttggttacacttttgatatttgaataactgttataggattacattttttcatgccctgatatgcatgaatgggttgatgccaaattatgtcgaaaggtatcatttctaggatgatcattataatgaatggcatgcatgctctctgacaaatcacatc

SEQ ID NO: 42159 - DNA, 20624 bp, Oryza sativa
acttgtctgaatcacgccctggtgatgtcggtgatggtgatacgaaatccgacgttcccgatgcatccacgtggtcagcgtttcaccgacacacgctgctatactattccttaatcattttctggtctcttcctctgttgtttcagtcgtcttcctcgtgttgctcatggggaatataggagtattatcatatgatctgaaattctgatttctgaacacatatgcatcgcgatttgaacttgtccttccatctgtttctctttggaaacaaatacgtcacgaatttgcatgataagctgttggattaaacgataaataattgcaaagtcgctgtatgcatgatctttcagaattctttctctgacttaaccaatcataatcaagcaactactctaaagttgtaacggcaacgttcgctcgtcgagtcctctgctgtgcccagaggaataaagaaaaaaagaattgtccattaagaagctgaccattcaaagaaaaactttcatgattggaactcacttggggccatgaagaacagttcattgcgatttgcaaaggtgatttggtcatcctttcctggcactcaaaacttgaggaattaaaaaaaagaattaatcaatcagctcgttacaaaacaaacatgaagaagcaattaacccaatgttcagatcactgcaggcgtgtcggttggatcgatcgcaaccgacacgatgatacatcgagacacgaccatcagattaaacgaaaggattaattactgcaagtgctgaagctgttcttgcttgtgtgttttgcacgtcgactaactaacggcctctcacgccatcgcctactaagctagcgtgtatgcttccaacaactatatacttcgatccctctgtccttaaatatttgacgccgttaacttttttaaacatgtttaatcgttcgtcttatttaaaaattaaataattattaattttttttctatcatttattcaatgttaagtatacttttatgtatacatgcatacagttttatatattttacaaaagtttttcaataggacgaacgatcaattatgtttaaaaaagtcaacagcgtcaaatatttagagagtatttcatttgcaaccaaccaccggcgagtcggcgacgagtggaattatcatggccatgcaggacgacgacgacgacgaccagcacatgcacagcatgtctcgctggcgcgcggcgacggcggcggccgggagagaacgtgcgtggtgacccaaaccttgacgcgcagaacacaagctgtacactaccacttctctaattctttaagtacaaaccaacacgtagcaccacctacctaagctttagcttcctctcacattccactcctcacatatatatatataccacattgttgtcatggcacggctcctactccaatcaatcacaaccaacgaattagaatctaatcaccctgtcccattaaccaaattaacatcgatcgatcattagtacaaactaattaatcaatcaattagttagagatcaagttattagtgtccaagtatagcttaggaaggtaatgggaaagagagacacgccggcgaggtcctcctaagttaggaccttggaccgtccctcctccatcctcacggctataccaactttatcctcgccccctccccaccacccctctctcccctcccctctcaaacaccaccgccaccgccatggtcacgcccttcccctcctcctagcaccacctctccccttcccgcgctacgcgggacgaggaccagggatggctccccccaccgccgtctccgcctccaccgccggcctgatctggtccttgtcgccctcgctctcgctcgtcgtcaccacctcggtggcgcttctgctcgtgctcggcggtgtgtccgggatccgcgtcaacgtcatccggctcccgtcggcgtcgccgttcccggcgttccgggaggcgccggcgttcaggaatggcgacgggtgcccgccggcgagggggtcggcggcggcggagggggggcgggtggacgtggccatgacgctcgacgccaactacctgaggggcaccatggccgccgtgttctccatcctgcagcacacggcgtgcccggagagcgtcgcgttccacttcctcgccgcgcgctccgacccggacgccggcgacctcgccgccgccatccgcgccaccttcccctacctcggcgccgccgtcagcgtctaccgcttcgacccgtcgcgcgtccgcggccgcatctcccgctcggtgcgccgcgcgctcgaccagccgctcaactacgcgcgcgtctacctcgccgacacgctccccgccggcgtgcgccgcgtcctctacctcgactccgacgtcgtcgtcgtcgacgacgtgcggaagctctggtcggtggacctcgccgggcacgtggtggcggcgccggagtactgccacgccaacttcaccaagtacttcaccgacgcgttctggtcggacggcgagctcagcggcgccgcgttccgacgcggccgccgccggccgccgtgctacttcaacaccggcgtgatggtgatggacatggggcggtggcgcgacggcgggtacacgcggcgggtggaggagtggatggcggtgcagaagcggaggcggatctaccacctcggctcgctgccgccgttcctgctggtgctcgccggcgacatcaaggcggtggatcaccggtggaaccagcacgggctcggcggcgacaacgcggaggggaaatgccggagcctgcacccgggcccggtcagcctcctccattggagtggcaaggggaagccatggctgcgcctcgactcgcggaagccctgcgccgtcgactacctctgggcgccgtacgacctctacaaggccgccgtacccgcgctcgaggagtgagctagctagctagctcgccgccggcgagccgaggcggcggcgtgattgcattgcatgcattcgagggcagacatacgagagaagaggagagagggagagggagaggaggtgtgtacacgtacgtacgcacgtgcgtgcgtgcatgcatgcatgcatgtgtccatacgtgcaaaacacaaaaggggcaaaaaaaaaaaaagttgtgacgtcatgcaaaacggcacaaataagattaattaggactggaagtggtgaagaaatacatgccaagaggatcaatggaaggaaggcgctccgtctcgtagaaaaactaatcctaattacgaatctaaatacatatgtatctaggtttataactaggattgacttttttttacagagtagtacatatgtggatgcatgtgccgatctctttttctttcttcctcttgttttgggttccttgaaaaattttctaccgttgaatttgattcatcatggtgacgatgatgtacataggtgttttgattggagtacgatgtgtaaaaaattagggtggtgagatcagaagtgggtggtgcactttgcaaatgtgtatgtactatatgctttgatgttgatatatcatacaagaacacacacattcaggggggcaaacatcggtccatagctttattttccgttcatccatttgatcacataaattgatataaagagtaaaatacattatcggtccttaaagttgaaggtggtgtcacttcgatccatgatgttgtaaaatcaacattaaggtccatgaacttgtttaagtgaatcattgcggtccaaaacagaccaggttgaccgtcctatatggctgttcagcgtggccgcatatttgctattaggcccttccactttcgcactaccggtttggttggcagaacaatcggggtgcgacaaatatgggggcagcggtggggacaaggggcatgtaaatactatccatcctaggtcggatgcaacgctgatgactggtgagaaggcaggatccaacgccggcgcccgagtgcagctcggcatccatcactctggcgccaaaggagcgtaatggaggccgcgcccatctcttcagctcaacaacgcccaacgacttggtgggcaggcaagcggaatccgcggcatgaactcaccgcccatggccaagcctccaagcttgccgcttcccaatctgtcgtcaccgggaacaggagagaccctcgcggatcttggggccccacgccctctccggagccatccctccaccgtcgccggatagaggggcaccaccagggagaaccatgcttcatcgacggccagatccaccggtcacccttcccgctggtcgtcggcgctagatccaccacgtcactagatccgtgccacgacgctttgccgccagagtgatggatgccgagctccactcgggcgctggcgttggatccggccttctcactagtcatcagcgccgcatccgacctaggatggatagtattcacatgccccttgtccccaccgctgcccccatatttgtcgcaccccgattgttctgccaaccaaaccggtagtgcgaaagtggaagggcctaattaaaaatatgtggccacgctggatagccacatatgacagtcaacccagtcaaacatgttttggactgcaatgattcacttaaataagttcatggatcttaatattgattttacaagatcatggacctaagtgacacaacgctccaactttaaggaccaatggtgtactttactcattgaaatatatgttgaggcatgtgcatatcagcatgaacaaacaatgttgctcgcggcttttgcatctgacgggccggggctaggtgtggtggcaaaggaagtaagttcactttgactcccttcactagtggtcgaatataattcgtattccactatccctgaaccacaataccgaatattttgaccccttcctcccccaactattaaaaccgatgcaatttgactcccttaacggttttggagagcagtttcgctgatgtggcgcctacatggcagtgttcactttgtcttcatccaacgtggcattgacgtgacatttatatgacaatacaactaaaagaaatgtgggacccatttgtcatttacacaaaaatattatgggacccactgacatgtggggcccaaagtcatcctcttcttcccttcttcttcctccctctttctctcccttctctttctcttcccctttctctcccccttcaccgtccgcgggaggttgccgtgtagggagagcaggagcggcagcggcgaaaggggtcggagttcaaagtgaacttattccggtggcaaatgctcgcggtcccgcgtttcgtgggccacgacctaggcgcaggtgagccaaaatggctaattttgctctagaataagttcactttgactcccttaactagtggtcgaatcttattcatatccttaaaccacaatatcggatatttcgaccctccaaactattaaaaccggtgcaagttgactccctcggcggttttggagggcggtttcgttgacgtgacgtctacgtggcgatgttgactcggtcttcattccacgtggagttgacgtggcgcttatgtgtattagaattaaagacaatatgagcggaccccatttgtcattcacacaaataatgtgggacccacatttcatcctatttccttcattcttctccctctctctcccttatctcgctagatcggatcggcgggcggttcggcggcgggcgagcgctgtgacggcgacgtgtgggcaagggctgaagcggcggcggtttcggcccgcaaggccacatgtggcatttcccctctccttctcttcacgcgtcctcatacgatggtttccaccttcttcgatctggaagcgtggttcaaggaccacagtgccacaatgctcttcgagaaggcgcacgtgatgtccccgtcgagcttaaccaaaagtggcgcatcatacaaccatgcgatgaatgtcgcatgcgtggcagacaacaccttcatcatggacttagtgctgaattcgaaagaggattttttaccaatgtggatcaacggggtagcattttgaaattcatcattcagttgtagagatttggttcggtttcctcctattctcccgactctaattctataagctggatagagatacaggaggactaccaacctatatatgtgcacgcgctatctggcaatagattacttgtgtcgagtttaatccgctttacaatttggcatttccattatcaattaaatatagccatctaaaagaggatgagagatttttttctcatatgtcgaacgaagaggtgagggcaactatagtggaaccaagcgaggggtagtgaaggaatttggcatttccattatcaattaaatatagctatctaagagaggatgagagattttttttctcatatatcgagcgaagaggtgagggggcagctatagtggaaccaagcgaggggtagtgaaggcagtggtgcagcagaggctgttgctgccgcttagcatgatagtagttcagttgattttagtggaaatgttggtactgtcgaagataacgctcaatgacgggatgagcccgttcgttattattgtgtaccgcaacctgatcgccgctgccgctaccgtgccacttgtgttcatatttgagaggtactagattaatgacctatatctttcatttttaggtgttttcctttacatcttcatgtttataattttttttctatgttttttctgttacagggatatgtggaaaaagtgaactgggcaattgggggctggctttttataaactaggtgaaaccctgcgcgttgatgcagagtttagtatgataacaataagtaaaaataatatgtgtgatagctagacaacataagattatgtaagttaatgtggtttatgataatttaaatttaaatagtatatagaatgatgattcaaatgtaaaagtaaggtgatatgactttatgaaagaagaaaagtattgagatagtttgaaccgtagattaatcatctaaaggctaaaaataattgaggtgatatggattaatgagagaagagaaagagagatataatttggactatagattaatcatttaagcactaaaaacaattaatgtgatatggcttaatgagagaagagaaataacattaactaagtgatgatgaactatataggtacatagcatattataaaaaaaaatgaagatatatattaaaatataatgtgaattatgtggaattatgatttaacatgtttggattttaaatgctttaaaatttaataaattataaataacatgtttgcatgttgtttaaatttaatgattattagtggatgatgatgtggtatcttgttaatgaatgatgatgtggcatctttgcatgttaaactttagaaattagtgggttataactttatagtaagagaggatgctgtatttgggtgaggtctcccactctacctttagatttggacattttgtagccgtactactttttattccttagtgtcatgggcatggaccatgcttttattccgcatggaccatgcccatgtagcagtttgcatgtcagatcgatgttagtcataatgccaatatattttttttggtctattgagtatatctatattccatgactctagaagaacatagtaaaccacaggtaccaaagatctttaagataacatattctaatcagtggcgaagccaggatttgggtatagggggtgctggccaggagacgtaagaactcaccagcgcctcggtagataatatagcgtggatcttggtgtataaaattgaacttatttttagaatggaggatgtatgtccgaatatatgttaatatagaataaaaagaaccatttttaaagtcactaaatagcaccaactttactcaatacagaatgacacacgacatcatttctattcatcctttttaattttggagacttgcaaccacatcgcttagttacgttaatagacttgcaaccacatcgtttaattacgttaattaacttaggtaatcacgtaaagctaaaacctattggacagctaggtaggtataggctcaacttgcaacaaattaatgagctaattttatggattagatggctaatcatccgggggtggggtttgcagcgcatggggatgggggggtgccaggctcaccccggcaccccctgtggcttcgccactgattctaatcctaacaactataacgcaaggatccaaatcattttttttgacaaacaaagaaataatgtgaacatatgacagttcttgggcagtaaaagatagaaagtgctagagacttggtgtagtgaacactttactgaaaaggcttgaatttaaccaccacaatggaactaagaaattttacaacttcaaattgattcaagctttgtaataatggcatataaacaaggttgccctaatttaggtttattgtatactattaagtttgattacatggcctaagtactaaaagttactcagtaatctctaatttaggtttattgtatactattaagtttgattacttggcctcagtactaaaagttactcagtagtcaattcacaagcgtgttgacgtatttcaggcatatagcccacttactatagacaacttacatggaagggcggtagttagacctaagttatagctaagctacaaaataataaaaaagacacctcttggcaactctggtgcttatctttgtgataaactagtggtaagatagtatgccgttaaaaatctcagctttgcatcatgtacacagtatttcagctgatataactttcctgaaatacaaagcactcacaaattcaatatggcatacatgagaatttagagaatttaccatcaaattcatgtgcctcaactttttttaccacccaatccgcgtgccctctgtaatatatcattatgactgctaattcgtctattttgtaccactttctctatttttcatgtgttttttaattcttaattccatttgtactccctccgtcaaaaaaaacaacctaaacacatcctagtaccatgaatctggacatgtgacacatcatagtaccatgaatgtagtactagtatgtccagatttattgtcatatcgtagtacgatgttgagttttctcgacggagggagtatattttttacaggtttgtgggcatttttctctgggcccacctgtcagaaccaaaagagatatttctctttggatcgatcggatccctccaggcaggcgcaccaccccgccgccgagcgccgccgctgccactggactgtgctggccaccccagctcaccgcccccaccgccgagcgccggcccaccaccccgccgccgagtgccaccaccgccccaggtcaacgcccccacagccgaatggcaggtcaagttcctgagtcctgacgaacgaagagagagttgggaggccctggctgagaccaacaccaccagatttcaccagagttgggaggtcctgactgagagttgggcggagatgtccttcttcttccgggcggcgtcgcggccggcgcgcccgtcgccgcaggagctcgtccgctccatcaaggagtccctcctcgccctcgacaccaggaccggcgccaaggtactctccccgcatcctccctccctcgcgagcttctttccttagtccgcacatgcatgagatcttggttgattagtgctcgaggtgtcgcttgctttaaccgtagcttgtgtgttgagattgagtgtttatctgtctggaactctggatcttagtagatgttagtgcctgaggtcgttggtagtgcaagatgtgctttattttggtcggaattcgtcctacctacagtgtagcaaacccggaatgcaatgtaatccgtgttggtagaaccgtgggattagttttttgggtttaaatcttcaccgatactgacctttggatgctatggcctgtgctgagattgtgcttaccattggagtgctcatttttacccccaatttagtggcgacgaaggcgtcaatgttagggtgattcaagcttatctatgatggagtttggttgtacttcacaaggaaataggcaaaatagcgcaataaattgttggttcataatgtgaaacaagaataatgcctgataatttttcaaaataaatttgcttgagcaggtctaatgaagattcagggcatgtacttagctcaagtcactgatattgattcgggaaaaggggctcttgttttatttattcgctgcagggactaacttggtactacttgggatctttgagcaactggtttccgtgtatcacaaagagtttcaagagtcacattacttgtaaaatatgctttcttgttgagagattctttttaacagtgttgatataccagtatattgcatatggcacttgcatctggagcctactcataagcaatggcatatttgttcctttgttttactgttctagttgttttatgctcttctttatacacagaacacgattctacagtcccactggttatctcacgtagtatttgttttctaattaggctcttgaagatgttgagaaaaatgtatctactttgaggcagacactttctggcgatggagaagttgaaccaaatcaggaacaggttctacagatagcccttgaaatttgcaaggaggatgtcctttcgctctttgttcagaatatgccttccttgggttgggaggtatggtttcatcagttgaatttgatatccctttctgttcaagcttactcgacttattagttgagttctatattgcagggtagaaaggaccttgcccactgctggagcattttgttgaggcagaaggttgatgaagcctattgctgcgtgcagtatattgaaaatcattttgatcttctagatttccttgtagtttggtaaggcccatatgctcaagtttttttatggaaaacaatcaatatttagcacatgctaattcgtttattggtagtaatgcagatataacaccatccaaaaaaatgtctatttgctgcaacaaaaaattccttctttttcccctttcctcgtggtcccatcattcacgtcaatttattgccgtcagtcctcacctataactacaatattaattgtatttatttatgactatgtctactattatgtcattgaatattttcctggaagctgattgattctcttgcatcagctacaagaacttggaagttgcattgaactgtgggaatatgttgcgagaatgcataaaatatcctacacttgcaaagtaagtcttcataaattttgtttcctttgcataagtattagggatttaattgagccttgtttttgttgcctgctaacatacggtatccaatgggtatgccttgaagaaattctgtggttgtataaacagaaacagtgaatcaatttagcaatttgcataccatggcagttaccatactacttgctagttcccctcccctgttgattgcttactaaattgatatggttaatttacaagcattatgaagtaccctttactcctttcagttttacattctggaatgtatcaatgaacaacttgggtttgttatcagctatgagatcagttaactaaaccatgctagaaaatataccaataataccatttagttaataataaatcaattaattgtacatgcattgaatatttgattttgtagctctctttcagatatatattggagtcaagtagcttcgagttgtttttccagtatgttgaattatcgaactttgatattgcttctgatgctctgaacaccttcaaggtaaacccagttttattataacttggtattttatgcttcggttcttcaaaattgatgtttgttcttgacaagattcttgcaggatttgctcaccaaacatgaagccgcagtttctgagtttctgtgctcccattatgaacaggttagctggagtgttatcttttgtgaaatgtgtttatttatgatgtcctcacccttttccctgccttgttggcaccatcatttattcatttgtacatgacaatttttggaatcatgcaacttgtctatattgctatatcttttaatactgatagataccatgtgttcatttgcagttctttgagctctacacaagacttctaacttcaactaattatgttacaagaagacaatcagtgaaggttggactaatttggattaatatattcaatttattattgcgcatcaaaagaggaaatctaaaagtattgtgcttcatttcagtttctttcagagtttttgttagaggccccaaatgctcaaataatgaagcggtacattgtggaagtcagttatttaaatatcatgattggcctgctgaaggtatttgattagtagttatatgcttccttttttttacattcagaagtcactaatgtagtaattacccatttttgctttcacagcttttctttccttccttttttttttcttttttgacaattctggatattagtgctaccagtatgagaatcgagaaatcctgctttcttactgtattgtcaaccaaaggatttcctaggttagaattataaacctgtaactattcttaggtctaccagagcccctaggtccagagctaaatgggtttctatttgttgctaagttacatgtcatcatcatttgcagtttagctgataaagatcgaacacttgaatgccatattggtcataaagtggtaattggttgagcaaccacattgcttttccagtatatgaaaatagtacaactagtcaacactcctgaggagaacagggtttaaagttttgtgttgaggcaatagatccatggctagaacacagttaccgatgacttcctttgcttcatggtaatcagtttttcatggctctgcacatcctatctttatggctcaactaaagtgaagcttttgtaggatacaagcaaaaatatcaggatatgtgccttccacattttcaaggtaatttttatccttaatcttttgacctttgtattcggctagctataactaaccatctaatgccaaataaatcaataccagttgtcaattatcacataatcaccatttgaaattgcttgcttgacccttcagtggctataagttataacctccatggagttttgtatttcttctgatataactttccaacggaaatttcctttgttgctgatcctgtaaacatttcgttgaatagttcgaaatctattccatttggcacttgatgtggttattgttatagtgctatctcatctaatcaagtcgtttttgttcttgatcacatgttgtttgatttgtgaaattttctgttgaacttgatattgttagtccattgtaataggataagcacctctctttcaccattttttggggtttcactttcactgcatgtaagcaggtatttgttgccaatccaaacaagcctcgtgatattattcaagttttggtagacaatcacagagaactgttgaagctactaagcaatcttcccacaagcaaaggtagtttttactctcaacttccagcctgatgccagaaatggaatagagtaaccaagcattatgagttataattgcatctgggtgtttaaggaagatttcttgttaaattgttgagagatgcaagttgtggcactactaattgcgctccttttaataggtgaagacgagcaacttgaagaggagagagatttaatcatcaaggaaatcgagaagcttgtgcattcatcggtatagaccctcaagaaattcaaatccatccgttcaagtttcgctggtcaagaaatgtgatccctttcttcccttcttgtttttaagacctgtgtaatgtgatccctgtatagagggtgtttatcatagggaaatagtttgaccaagaagtatgttggtcacaagaacactttaccattgctgtgtgcatttccattgtgaaaatttttggaacaactggtgggcacatgttcgaattatgaatgacagctgatgtcaaacatatctttgttcataattgaaatgaaatatttcgagatctgtgacagcagctatcgaattatgaacggcagctgatgccagacatatctcctattcagaaactgaaacgaaatattccaagatctgtaacaacagctatcggttgaaacttgttacgtatgggtatgcttctatacatattattttttcagttgacatttgacaacattatatatatgtggtatatatatgtatatatgataatttacagaaggaattaattgaatccgattaacatggagggtgttcttgagtagtgtgctaagctgcggctgacgtcagcggccggaagatcaccggcgcgccgaactgcgggctgagtatcatgagcaccctgggcgcgtgcacgtacgccggcgatagccggaactcgaagcgccgcaggacgacggcgagcgccaccttggcctccatgagcgccatgttctggccgatgcacacccgcgcgccgccgccgaacggcatgaacgccatcgggtggcggcgccggccgccgtcgtcgtcggcggcgaacctcgccgggttgaactccgcggcgtcgtcgccccacgccgccgcgtcgtggtggacggccatgatcgggatcatcacctccgtccccgccggcaccacgcacccgcccagctccacgtcctccttcgccgtccgtatcatcgccaccgccggcgggtacagcctcagcgtctcgttcaagatcatcccgagctgcaaggagaagacgacgaccaagaattcatggatcgttgcaatgtaatccctctctcgttttgatttttaatccaattattttaaagtttgactaagcttatagaaaaatatatcaatattttcaacataaaaccaacatatcatcaaaatatatttaatgttacgtttaatgaaactaatttagtgacataagtatttctaaattttgtatataaactcaatcaaacttaaataagtttgactagaaaaaataatcaaaacaccttactccttacgttccattttataagtcgtttgacatttttttctacacaaatttctttgaatttgatcaagtttatagaaaagtatagtaatattttcaatacaaaataaacatattatcaaaatatatgtgatgttatatttaatgaaactaatttaatattttaaatgttattaaatttttctataattttaattaaacttaataaagtttgactaaaaaaatcaaataatttataatatgaaacggatggagtatatctgaacattcgacatcgtgtgacgcaagaattacatacggttttgagcttggggaggtggtccttggtggggaggtcgccacggccgcagacggcgacgacctcgcggcgggcacgttcctgccactccgggtgcatggcgagcgcgacggtggtccaggtgaggaggttggacagcgtctccttcccggcgaagaagaagttcttgctctcctcgatgatctcgcccgccgtcatcgccggcgccatgaagctcatgaactccctcatgccgccgccgccatcgccgccatcatcggcgtcgtcgccatggctgctgctgcagctctgcaggccggtgacgaacttggcgaggtggctcctgatctccctgtcgagctgccacacgcggcggttcttcctcgtggggaggaacctgtacccggggatgtacaccttgctgtgcgcctcggtggcgtagccggcgagctcgtcctggagccggaacacggcggcgccgtcgtcgtagttccggcggccgaacgcggcgaacgtgatggcctcctgcggcacgcgctggaaccactcggcgacgtcgacctccgcctcgccggcgccgccggcgcgcgcgcgctccgccagctcgtcgagcatgcgggtgacggtgccggcgacgaacggcgcgatcatcctgaggttctcggtgtggaacgccggcgtgagcacccggcggcggcgcgcccaccgctcgccgtggaggttgctgaggccgtagccctcgaactggcagatcatcgggtgcgcctcgtaccggtcgaagtgatccgcccgcgtcaggagcacctcccggatcagctccggctcgctcaccaccaacctcggcgtccgcccaaaccaaatcaaatgcatcggacctgttggtaaatttcaaattattcaaaaatttaccaccaagagataatcagaaattttcttgagcctcgacgaagcaaatgttatatctagctagcctgctatccaccggctttatcaaatgttagtaataaagtggggtcggaacactttttaggctcctttgaaacataggaattttacaagaatacgttcgattctaaggaaaattctcgtaaaatccattcattccaaaggggtccttcctattgtcattttgccatatcagctcagtggcagtggaaataaataagggtgcatttggacttgattttccgaccgtccgatgagaattggacggtagagattgacactggaaagaaactatatgtgcatgtgtatgtaggtggtcaactttgacagattcaaagaacacgcagccagcatcaatgtgatgctcatgatctattgagttgtaaacaaattgccaaaacaaaccgtcactggaactgacagacgacgattaacttcatcatttcttaactgaccgaccgatcaacaataagattcctcacttggattaaacgcgggtgcatgcctgtaggtagctaacttcgagcatattatactccacaaaccgttgaaaaagagggaattatcatcggctgccgtgacaattaatgagataaactaatcggagcatagcagaaagcaaaccagatcatgaactgaaatgctctggcaatgtgcaggagatgctagctgctgttgatatagtcatatgcaagtatgcatcagctgcaaggaggactcattgctaagcaagcctgcatgtgggtagtgtgtcctctgaaattctgaactgccggatggatctgcatggatgtgagctaagccaagctaaggtaagctagctaattaagctcttgtttatttaattaattactcactcacatgatcattaacctacattgacagcctgttggaaagatccatggatggatggatgaatcatgcattgtgatcagtgatgacaacatcaccaagtttgacttgggaggctggctagctatacttccttcgcttctgaatataagcatttgaaggttgtttagtggattaagagggcaaaatccttcttagtcacttcattgatcaaattttgaattacttggattcccctcctaagcactcgatctcaatgggctgaaaatgattgaattacgtccgtgtcccaaaattatttgtattatatacaacatttgaattcttgaaatttttatatttgatattacggagagagaatagctagctgcagcattttttttttttggttatcaaagagcaagtagtagtggagaggaggcatgcagtgctagtacacctagctagtactactagctactacccacacccagcaaaagtgaaatatgaaacgaaatgaagctctcatctccacctaatcaaccataatttaaccttttgcatccttgtttctacttgcaaaagcatggaaccttgtccccttcctaattccctccgcgttcacgcgtgatagcctacgcgtatactcatatatatactactccctccgtttcaaaatgtttgacatcgttgactttagcacatgtttgaccgttcgtcttattaaaaaaattaagtaattattaattcttttcctatcatttgattcattgttaaatatatttctatgtagacatataatttttcatatttcacaaaagtttttgaataagacgaacggttaaatatgtgctaaaaagtcaacggtgtcaaacattttgaaacggagggagtctatatataagtatacatatccatcaaatgccccaagttggttaatttcttcttattttttcgtgtgaaagtgttgccaatttcatatgtaaaaatatgattcgtgtgaaaatcgaaacaaaaatgagaaacaaaatcaccaatttgaaatttcaaagttatagtaagtatgcatgcacatcgatcaataagagtgaaattaaattggagagtggaactagagagagaaattttttttgaatgaaatggagattaattaattagagggtgatcgatcgaggtggtgttgattgattaccgtagagcttcctccaatggtggtagaaggggaggacgcgggggaggatgtcgtgggaggtgggtggctccatggggcgggaggcggcgtccaccatgaggcggacgagctcgatcgagctccccacgaagaaccggtaccccggcccccgcaccccctgcgccgcgaagtgccgctccacccgccgcggccgccaccacagcgcctccgccgccctcgccgccgccgcgtacaccgccacccacgccgccgccgccgccacggccacggccgccgcgccgctccagctccacgtccacgcccacgacgaccacatggcgcgctagctacggcggcgcgcgctcctcctccctgctgctgttgttgatgatgatgatgctgctgctacggcggcggcggcggcggcggcgaggcggcatatgtgtagacgcgtcgtgccgtttcctgcaggtttatatatacgtgctagctgcggttgggagggagagaatttgagagggatttgatgattgaaatttaatttttgatgctgttgatgacgtcataaacgtgtgtggttatacttccaggtatgcatggtttgatgcagaaggaactgatcatatataactcttggattagctggtgcatggaaattgccattgagtttgttattattccattcattttataattattttatattataagtcgttttaatttttttcaaacttatttaagtttgatcaaatttataaaaaaaattaacaacatctgcaatccgaaatgaatttcattcaaattaaccgttcatataatatgttcattttgtgtaaaaaaatattgttaaatttttaaaccagtaaaaaatcaaaacgatttgtagtatgagacggagggagtatttattatattggtttactgtgattgtcgaactgtgattgtcgaactaactgaggtcaatgcttaatgcttccttattaccagtgctactacactttaaagaaattcttacgaaaacttttacaaacaaaaagtctcaacagtttggtttagctagttataggaaatctagatttttgttcacgtacatgccacatcagctggttataaaagttttgtcaaagaaatgtatgtgttgatttttccttcttcctaagaggtagaagggtttctactgcatcagtaacaagtgtactagttacccagtagcattactgcttgtgtcaacacaaaccatatattgatggatgtatggacattttgaaagacctgtacatcaaaaggatcaaatgaatacaattgcacatcgttttgtaatctttaaaaaaaaacaaacatgtttttataccatcgatcatgggaactcggtatagactttaaaaagctatgttccatatcaaagagaatgtgtactgtctcatcccaagataaatttattttcaccccctgccacatataccaatacaaaacttaaaaagacaataataaaatcagcccacccgagtttaaatcttagatttgatacgagtgcttgtatttatggctaattattctttcagtgctaggcaacgtacccgtcgacagcgaggtgcccatgattcgtcaatctcaatctcaagatatacaaatccagttttccccggaggtgctcatacagataagtcgtgcgtatttgtgtttatagaagtgggtatgcgcgcatcatgtacacatgcatttgtactatgtttccaaaaaaatcacaatgcaattatttttctctttatttatttctaatgtaattatttcgtatttttacaaattctgatgtaattgcttaaaaacaaaactattttgggataaacggaaagggaaaaatgatcaaacggagtgagtataatttaatagcaaaccgccactttcatccttcgaaacaatgtgatatgtttcgttcaaacagtacacgcatatgcgagttcggtggtgtgaccgagtttaacaacaaaaacacggagcacgacatggtacactcccaaaaaacatccccaaactattaactgcaaataataaatccccaaagtacaaaaacatggtcgacagacacttcataacccccctctcacaatccttccaaagtaaactagattaaggagcctatcacctccaaaaccaaaacgaaactaactttttattttttgttaatgcattttggggttgtggaggggtggcgcaagttgacgagggtggtgctagctacgcatttgtttcttgttctcttgctgtccccccggaaaagcatggcgagaggttgcagcggtcgggctcctgtcgcacccaagtgcgtacagtctgttcctcacaacctgtccctcctattcttttttttcttgtgtgttaactactgcgatctaaaataagttcattttcacccatctcgtacatatcaatgcagaactaaaa

SEQ ID NO: 42160 - DNA, 1421 bp, Oryza sativa
aaacttgaatgggttataaattatgtagtatatgctagctggttactcctaacactaacactatgtatactactacttcacaattaagtatactaccaattcagatcctgtacagtactgcaagctgacatgtgcactgagagtctgtggggcccatatgtcagtgagtggtactacatatagaggaccctcactcgcatactactatttactatactactgctactcctaacactaagctagcctttgcatcacatggtaaattagtgctactttgtttacacaatcacttgtatatttgccattgtcaaaaccttcgaatgtttcccccgcaaaagagagacttgtttaaatgcttgatgaatgtgtggtattttagaggttcttggattgggttttgttgatctttgaggtgaacaaattcttatgatttgaaaggatttcaatattaattatcatgtgcaaaatttcttgcactttgaggtgaaaacattattatggtttggaaggattttaaaattaattatcgtgtgcaaatgatgcctgactcctgataaaatgtttttgtgatttttttttactttgtaagttttaacccatttgtgtttgtgtagaaatgtcatttggcaaattatatgctgaagagagtatactaatgctcacgccaaacagagggattatattctacacagacgctttcgccacaagcacaatttactattctgtcaaggcttgatagctgggtttgtcactctcctcaccaatcaccataaatcgatttggtttcctattaacaccagatcctcgtgaagttttgtttatttttctttcttccgaatgaaagctctacgaaagcagtttagtttatcttgcttcactaattttaagctttctgatttgattctctgtagtataattattttctcaacaaatcccctaacatacgaatacttaaaaaaaacaaatccttaaaccttataaaattcctcctgaatattgttgtcagaaaaagctcacgaataccatgaagttatataaaatccgaaacttcaaaatcgagtacgtcaaatcaaataaaaacagggtttacctacaaaacgccagcgtacaaaacgacctgaaaagtcactctctcagaagtcgtcgctgtgttcatcgatcgatcatcacttgggcgttgagtaaccgatcgtttcgtcagacgaagagaaaaaatcagaagcaaaagaaagaaaaagaaatgattttaatttgtgcagctcaaagtcgttgtgaacaaaactgtcatatacaggacacccctgacacactagtctttaattaactaataacagaggagtctgctcatgaaatattctgcaggtgtttatgttaatcttgaggggccaataatcaactgcacaagggggaagctgaagtgc

SEQ ID NO: 42161 - DNA, 1361 bp, Oryza sativa
caatctgatgacagtgaaaaaaaaaaaagagccattctgaaggggaacatgcccagctacctccctaacaaaagtgtagagaaaagagtgcctatttcctctgctgataaataaactaccatcatgtatataggtgcctggagatcttgttagacattgttagacaggaggaatacaggatggtagggcaaaagaattattgagaccactgtgcataacaaaagccactgttcagcttggtatgtgcttgccaagagatttttacaatgtaattcttccacatacacgccagtatgctccagggtgaaaaagggatctttcaaacacccatatatctttcacaagcacctataagaatatttgcacacgccaaaacatcatgagtcaccatgttgaaacaattgattaggctgtcataaggtgtgaaactacaactgcttttgaatgatataaacaactgcttcttataatgtaacgagttactgatggtctagtctctccatttatttgctctacagtttcgtaatcttttcataacatgtaagatagatatacatccccatgatggatcatgcagaggaatacacaagattaaaattctatgttgtctccctgtgctcttttgtggaatttacagaacaataagaatccctgatgctcaatcactagagtccagacaataatcagctgttaaatttccagcatattgtcgcaaactagatactaacagattatttccaatgtatcattgtgaactaatatttgaagtcagttatatgcttggtgttttttttaaaaaaaaaaaagcctgaacaaaactagtcccacttgtttcattgtttgaacattagaacttcagatagtcacccatattttacttacctcttttgacttatctccagacacgacctcaccttttgtattataggcttcaaatttctacagaaatacaattaagaaactgtcatgcgatgaacatacagtactgcacaagacaataggatgcagtgctcctcagaaccactaaaccatctattcatgatcattgcacaaaataataggaaacagagaccaaccaaatacagggaataacttagtcaaggcattaaaactatctttgaaaagtagacattttgaagtttatacttcaggtgcttatgagcaatgcatattctgaacatctccaaattgtgtagacatgaaagctctaaagaaaactaagaggggcatgcccacctaatggtgcaagcagtcagaggatgaatacgagcacatgtggggactttcaagaggtagcttaatgctatccaacttaaacataatacttggtacagtattagataatagagggctgcaggaat

SEQ ID NO: 42162 - DNA, 8998 bp, Oryza sativa
aataaatagcatgcctccaaaagtttgtctaacatccactcacagtaaggtgaaaacttaccgaatgcattctctctgtcaatattttacggagagatgatgtgtctccatgtgccatcagtgtgttaacctgaatgagaaagaagggtctcattgtttgccctatggcttataagccgttgccaaattttgaattttaaaacttgtttttgaagttgattttgatgctttttcaacatttgcttttaagccacaaataacacatatataaaaggtttacccataaatctttttttaatcactaatcagccgtgagtaaccgatggggaaaatatgtagtagttggcacttaaatttgcatttgacatatagacagtattctttataaggagaacacaatcaaaattctatgttacatacaaattgcaaggtcgcactacaagtcatgtatgctatgcactgaagaactcggagatcaattcaagccagaagataactcaggaaaagaaaaaaagaatgctgctcagtgactattgctatttctcaagaaaaggaaaagaggtagaaaattcaccagcctgttactactccctctgtccagaaatataagggagtctagagtttgaaatttgtccataatataaggacatccccacctacttacttataccaaccaatcaaagctatccctcacctcaacttaatctctccaaaaaaaaaaactccagatgtgcttatattctttgatggagggagtatgtcaacctttagtagcaacaaagtggcataaccataaagatcgcaaatcagtaatttggaccatttatctactgaacacttatgaaaactatactagttattggtctaggcctgtgcctaggaaacacgattgtcaagagaggtatgccaaaccttcactggtaacagtatacctgataacaccattaaaaatgatattatcttgtaataatattgaacactacaaaattctacaattaaaatcaccaaacgaatataggtactgagaaaacattaaataaatcagtcggtactaggtacagctcttatcttccattatcagatcatgatatctgcatggaaacctgaaacctatgtaagtgtaatcaaaatgcttagattattctacttgtatatttggtttcctaagagataaaggaaatgtacctccttgtatatcttgaatgcttgatcatagaattcctttttggtatagcctgttttctttctcaatcttgacacagcatatgcattcttcatctgtcagtataacaaccaactaatcagctcacaattcgtgaaaataaaaatatcacaaaggaaaattgcagggtatctcagatcaaatacattaaggtattgcagcggtagcaaataaattccaaaagttatcgttgaatgttgataggatagaaagtaagaaaataaataatgcaaataaaagacagtactccaaaatgtgtactcatatatgcagcattgcactgttataacatggcaactcaagaacagcaataataaagaaactctgttgccaagcatcatgaacctaaataaaaaggaaaacataaaaaaaactacagtaggtttctgttaaatatctcagtttgtgtcatttcatgtaaacaatcattgttctagctggtaaataatcatgtacaaccaggtatgaccagattggttgtgtcaatggtggcacacaggtgcctatggataaggatcgaaaaaaagtaatgtgtgatcaaggaaaaagagggaggccttttaaatttctaatctagaattcaattgactaatcaaagaagtagtcacaggttgtaagaaggaaataagagatgaaaagcagttttctagacaaaagagtcagtacctccagaataacgtcctcctttgttcttctccagccacttggtgtaaaccatctaattcacaataagccaaggttatgatgatgaagaccttttatcatgcgataggacagttttatttaaaggatatttattcctctagcacacatataagttttgatatcaatgcgccacttaacagtatttaacttttgtaggatcagatagagagaatcagcataaccaaacatgagaaataaaatgcttgaaatgtctctgcatcattcagctcatctaagtttgtttagccaaggcagcagatattagggtagcagacggtgaaagcatatctcatgattttgcattctcaaggggctccatcacttatttattagttagttagctccacacttaagtgtgctcttggtgaacttagttttctgtcttaactgaaaatatatgattttccccatccattttcagaaactaaaatggcaatgccacagccgtgctgtaggaaaaaaaatacagtaaggaagaaagaaaaaggttacacttctcagtagtaagtttatcgtccatgaaggggaatggcaaaaacactgcactgaactgtaatgttcattcccaagtgctgcactctggaatagcatgtcatttgtaccttttagtgttgagcttaaagctactcactctaacaattctgtcctggaaactagcagatgggtcagtgtttggaaagggaagagaactgattaccatgtacagattgatttacgtacgtattgattcacgtgacaaagcataaaggtcaaaatatagaatgtaatttcaccttttccagaaggggattggttcccgaatgctgtatggctcatatacaaaaccagggctcatcatgacaaccttcataccgacctatacagagaaaaaaaaacaagataaaaagaacacaacttcaacaattatatgaaatcccttaagctaaccaaatcacaccagaaaaccagattcgtcctcgcaccttgcgggcaccaagtggcaccttcgatgatgtttgcgacggtgtcggtgccttcgataatgatggcggctctgcctgtgctgctgtcgacattgatcttgtatgatttatttggaatagtagctccagaacctgcagcacatgcaaatttacagcacaaaatcacataacaccttattggcagcaaattgtacatcatccccaactcgataatgactcaaaccttcacagtatagacaggcgaccgccccctgtaaccaatcacgccaccggcattgtacggcgagcttgcaaaacctaatggcacgaaaaatgattgaaatggagcccaaattaaaccgggaaagaaaaacaagcgctgggttgctcacctcttgcgcgtgtattcgcgtggatcagcgcgaacgagtgggcaaccgaggcatggtgatccctgaaacggaaacagcaaagaggaagtaagagaatatccgattcgagccgcggggaacgagatctattccgaagtgggagcattacgtaagcggcggcggaggaggatggaggaggtggagagggcggcggaggcgtccggtgacagcgtgcccgaggcgagccagagccatcgccggcggatcgtctcggcgccggcgacgacgggagaagaagcggcgcgccggcgtggaagtggaactaaccaaggcggcggcggcggcggcggcgacgagggttttagggagagactcaatccaagccgttgatagaaaaggagcggctgttcttgctttgatcttctcctccgagttcttttgttagagggcctgttaatctatttagaatggcaaatggtaaaatttttggtggtaaaagatttggtatagagttggtgcttagatgtatcattttatcattttagcactagagagagcgcatggtccccaaacactttttggcaaaaattactaccctagactagcaaataacaaatactaaattaaaaacttttgctactagtgtttagatccaaaatagcaaaacttttactattttagaggatctaaacagacccatagttgccaagagcttcgtcggagcctaataaaccaaactaaaagtcgaaatttgattttttgcaaataaaaaacttaaaaaaatttacgttgtttttgcttggatcttcacctcggagttctaacaatgttagagttgcctattcaacttcctcgatttcgagaaaattaccataatcggagttaggtttcgtcaatatgctatcctgaaattaggattcactataataccactctcaaattgtgacagtatgttagaatgtattttctctcatttcttccaaattaaatgaactctaccctgatttccttggtgagctgaccaagatacccttgctcaatcccgtgttgtctcaccgctgccacgagtcatggctggtgctatggtgcataactgcatccgtgtccatcgccggcagttgcgctaattccattcgaaaattacatcacctgacacacctagcatcattacatcagcgctctcaacacaacatctatagaacaaaaaaacacaatcaaattgattagcttgttcatgtgactgcgacaaagatgtttcggtggctggtgggacagtggcagtgccaggaatggaccagcgagcctacctctacactcatgctcaccgccgctgttcctcctcatgtttgtgtacgcatcattgctgattcgtcgtcgaccaccgaatgaaccagcatgacctcagcggggaaaagcaccacgacctgcacgtcgccctgcttcattgcatctaatgacgacgacgatgccgcagccacaagcaccacctaacgctagcatggtggtgcagcccgttgtcctcctatgtagatctaacgagcgtatggagttggggatggccatggctgccctactgcgtcatccctagcttgtcgaggtggaccagctgacaacgacagggcgtaccagtggtaaggtcgacgacaacggtcgtaggagagcgccacaaaggaggctgcggctttggcagcacgccggtcgatgagatcgttagtgacaattatgtaactttggcatgagaaaaagaacatacggaactaagggcattttagtcccttcaatgtgtagaaagtgcaaaaaaataagtaaatgagagaaaatgtactctagcatattgtcattatttgagagtggtgttatagcgaatcccaatttaaaaatagcaatttagcggagcccatctccgagaatggcataatgtcaattttctcatataacttgtttgaattacgttagatacaaaatcgcacgtgcggttacaaggcaaggaatccattcccaagccgaccgatgcaagcgtgtgcaactcaatcaatccaaaacacgtcccttgtcattcttcctcgcaccgcaacacaagcccaccaacaccaagcaaaccaacgcaccaccttcccctcctcctcctcctccgatccgatccgatccaaatcgccatggatttcttcaagtccatcctcgccgagcccgagcccggcccgtcctccccgccgccgccgccggagacggagacggagcaggagcacgccggatccacgtcgaccccacccactgacgacgacgtcggcggcggcgggggtgggggtgggggcgggggatggggcttcggcgggctgctcaagacgctcacctcccagtcggagaccgtgctcgaggcctaccgccgcgacctcgccgagttcggcaccggcctgcgccgcgagaccgaggcgctccgcgacgccgcggcccgcgccgcgcgggacctcccggcgcacgcccacgcgctcgacggcctcgccgacatcgtcgcgcagggcaaggacgccatcgcgcaggtcgccgccgccgccgccgcagcccccgccaccgggcactcggacggcggcggcggcgaatccgagcccagctccgcctcggggcaggtccggtacagccgcttcgaagcgcagctccgcgcgctccagtcggatccggccacgttcacctccgatcctgaggactccgatgacttcgcggcgtggagggtagggtttagcgtggatgagaggagtggggagatcgaggcgttgtgctacgagagcgatgcgttggaagggatggtggagaagctcgtgccgggcacggtggagagcgaggtgttctgggcgaggtacttctaccgtgttcataggttgaagcagcaggaggatgctagagcaaagctcgtgaagcgggttttcgcggcggaggaggacgaggaggatttgagctgggaggtggatgatgaggatgaggaagaacaacaaagagcggaagcgaatgaggaaggatcaaagcaagaaccgatcgaagaagatgtcgaacgtgtagcgggggataaggaaagcgagaggattgtggaagaaaaggaagttgaggcagtggaagaatcacgcggtttggagaaggaacagcagaatgccgatgcaccgcaaccggaggttttcggcagctctatggtggtggtggacaagagggagaaggaagaggcatccgtttcgaacattgaagaatcaagtgacaagaaagctgtcactgaagaaccacgttcaagcacaggagatgatgcggtgaaagacggagcaaagcatgagacaagcgactcaagcaaggatagtgactactccatggtgtctaggcagcgaacaacgaccgaggaagaggatcttgagtgggatgagattgaggatcttggggagcatgaagagaagagagggagcaataatgactcaagctctgctttaaaggaggaattgcggaagaggctcagtgttgctgaagatgatgaggatttgagctgggatatcgaggatgattgatgatgataaggctgaaaaaacaacgtgccaacctggtatgaagtgttgattgtatctctatacttttttgccaattacttgtgcaagatactgaaatgtggccaataaaattggtttagctgtgctgattatgttatggatacgtttgtaaactaaacttggtgttatcaaatggcaattggctatgcgtcaattcgttgatgtctttatatcactgtaaatatttttgttttatttgactatgtgttgttcagttaaaatacgtaggctgcactagaatttggaatagcatttggacgatttgttcccacacaacctttgaatcaggacatactgaataaagttatgactgcaaaatcgacatcacccctcagtgatgtaggtttcattcattagtgatcaagctctcaccaagattccaatagtagcagatagtggacataggatacaaggctgatatttatagtccattttttactcttttggatatgtgcattttgccatttctgcacatggggacgctggtgccagtgggcaccaaaaacacatttgttctgaattctgtgttcttgcttctttcacaacttagactggtacaatgcgaccattatatgtaaattgtaagttttacagttctctatgtaagatatttctatatcaattttacttgctagttgtatgatacactaaaaaactatatcaagtagagaatagtcatctgttactgctattacgttttccaacagttgtccattattcagtgccttgtaacagggtaatattcattcagcacatgccttatacatgtcatggcaaaacgctgatgaagcttatgcatcatactagcatataaagcagtatgagttctttctgtattgaatttggaatgtagggaagcaaaatgtacagaaatttgcctgtcattcctgtatgatacaatatcggcatatggctgtttccagacccaagatgtatgtaactacagagcaaacaaaatttcaattaccatggtttttaccaacaaaatggcttagctccagttattgtgcctgtttgcctagctccggtttgggtatcaacagcagcctttttctttagaactttttctcttttttttttggagaactttcatttgggaagatgctggtacagctatgctgcccttctgattcgctgaatttctgtcaacctcaaatcttctgaatcctaacctgcttaattcataatctgttcattgttcaagctgcctcacaagttataatggtcttgtttggggggagctttttctaaaatctccagttccctaaacagttcaaatcttctcacctagattcttatattctaagaatctgtagttatataatctaggacatgaattagaaaccagaagccgagaaacatagtttttttttatactactcagaattttaaaactctcccaaacaaaaccaatatatgatcatgtggcagcaagcagctgcacactttatcctgggtcgaacaaggcaagagcaatatcctgggccaaaatttacccaatataacggcccatttacgacattcccagcccagtccggcccgcccgagagcgtccacaaaagccgctgccgggtcgcctccttcccttcctcctccgtcaggtcaaccatctcttcgcagatccacctgctccgccgccgccgccgccgccggcctcctccgacccgcgcgtctcagccgtcgaggtacgcgtcgtcccctcctctccctctgcgcgcctctctcggttgttctcggaatccgtggctcgggtagatgggatggaaggattcgtgtcccttggtggccatgttgacttggggggagggattcgtccgtatcgcgctcgattgttcgcgggattcgtggctcggtggatgggaggattcatgccgtgttgcgacgttgggcgagggattcgtccttatggctaggatccagctgatgcgggatgcgcccaagtttcgtgtcttgacgtgaactctttgctcggccgcgctttagggatgatatggtatgcttggtgtctaggtgatttccgttgtttgattaaaatttgctagatgtggggttttatatggcttggtatatcttggaatttggtatccctgagtgaattcacatgcatttcatggtttattgggtctgcttcggtgtgatgaatacatgcttaattgaacatgaaatagcgctctcattgat

SEQ ID NO: 42163 - DNA, 11734 bp, Oryza sativa
cagatcagtacgggagtttaaatccaattatgatgtttatggctagcaaattcaatagttcaatgattatataaaattgttcatggagattaatattctctctgaggaagtgaggatttgcttgagtgaaattattgtgttgatatgatcaagttgtcttagctccttgtgtcataatgcaggatgacagaggcaccatttgtgccacgtgagaagctgtttaagcaacagcaatattttcagaatttaaccaagcacacctacctgaaggggcgttacgatgtgatcacatctgttgccattccccttgcgctggctggcaccagcttgttcatgattgtaagttgaaagtttcaatttgttgcctatgctactctgttcttgttcctgtagtcttgttcagtcaataacttatttgctgttttataaacagggccgtggagtttacaacatgtcccacggtattgggaaaaaagagtaggcggttcagtatctcaacttggcatggaagtggtaccatccaggctacattgtctttggttgcaaaataatactgtcaatctgagcacattttggttcgctttgttgttatttgtttatatctgatgtcagcaaattgatgctaacttatcagaaatgtgagaacattggcatcgttgcatttccccatttaattgcatgttcctgctttgtgttttcttttgattggtgatggctacatgtactcgttgcttcactatggtgacatggtgttttctgatttcaccattcgcatggcgtacaaatggtgagaactgagaagccttaagatcctgaatggttgcgagtattatttttgcgataccatgatggttgtgagagttggcatcttgctgagattttcttgcgtggagatatactttgacacaccgtagcaataaactcctgacgcgtatgttccaatctggttggtttcttgggcatcttaatttcggttcggatgttattggttagttcgctaacaaacgaaacgatgcggcttggtttccgaagttaaatcttgcaacgcgaaacatctcagaatgtagaacggtttgacatgcattttggtgggttagtgatttgtactcattacgggtaggccatactagcttaaagggcatgttattgatacggaatgcacatgagcggaacgaaaggaatgagccaacgaggaatcatgttcccaggaatatttgcatcattaaaaatgagaaccctaaacacccgttaatagcccgcagaataaaagatttcgttagccaaatgtagatggataagtccaattaacaacgctaaactatactccctccgtcccataatataagagattttgagtttttacttgcaacgtttgattactcgtcttattcatttttttttttgcaaatataaaaaacgaaaagttgtgcttaaagtactgtagataatacataatttcaaaaaaattgaataagagagtgatcaaacgttgtaaacaaaaactgaaaatcccttatattatgggacggagggagtactgaattcccttatattatgggacggagggagtacttaattagtatttgaagatcttcactttctccaatattgcttcagctagggataaaaatggttcggatagtttccgttcgtccggaccatttttcggattcggataatttcggtcggaactatccgaaaattctcggattcggaaacgaattcgaatttttttctcggaaacgaaaatgaatacagtaagggtactatccgtcggaatcggaaaacggtcggaaactatctggaatttttgcatacattgataaaattttagaaaaaacacgtatatatacataactttttcatacggaatcagatgaagataaactttatatcaacattgtagagctcgatgagatctacaactttcttattgactattttattatttgagatcatttaagggtctaaatatttattataatataccatattaatttttataaaatctcagatctacaattcaaacgacatctgatggagatgtgttctatatcaaagttgtagagctcaacgggatctaccactttgtagtttataacatttgtatttgaaagcatttaaagcataaaacaaatattgcaagtttcgaagatgtgaagtaaaataaataacatctccaatttatacaatggcaagtaagttatacatctagtaaaaggtcttgagaatagaaaatgataatcatatttgcatatggatctcttagaggaacaaccatgaaaatcgattttcacatacggttgtgagacagtctacaaaattgacgatataaatgttagagatgttgaactaaaataataagtgatatctcttccttgatcaagaaactcaatttgaggggttttttatataccggtaaatattcgctaccgtattcgttccgtctcgtattcgctccgtatctgtattcgataatattcgatttcatttccgtatccgagttttcgattccgattccgaaaaaaatatgaaaacgaatatgttaaagctagtttccgtccgtttccgatccgtttcaatccctagcttcagctaataccggagagattgcccacctggaacaaaaagagaaggtgaaatgcgacactggattagcatcattttgacaaagaaaaatactgcagctcaactcaaaacaaataactgaaactacaaattatcaagggacagtatttccgtattatgctagatatcactctaggggcaagaaatgccaaaaggagcaagagtttaatctaaaattctcaaagacaagatcatagtcaagttatcgatgaaaaacagtcaactttattagtaattggtaatggggacatggtggttctgatctctatttatatgctttaattaccctcaattactaacttagcaagtactcatgggtggctagcagcctaacatgctagtgcacatatactatttaagactaagtatagcatgaaaatcttaagataagttatccaagagtagtgaagtagaaaggttagtatttgcatcaaatgctttcctttactgtcccaccccctcatcattcttagaatgaagtgagctgcaatcatgaaatttatgagggatttgtggatcgcgtaacataccgttgagcatttggactatgtagtccctcttatagatttctgggagtgctaaaaacatctccatttggtttggttcctttgcgaaaatacttgctgcgaagaccacctcgcttccagtaaggccaagcttttgaatttcagctatagctgtcactttggccttttgttggggttcctcgcacatcttcttctcttgtgtatgatcggtaccacattccatcactgctgctaccatgcttccatggtgagtgatattctgaaaacgatcatgtgcgtctttgaaccgttcgatggctgatgctgcgctgctgacactctgcacagcaccctggaagtgatcatgtgcatccctgaacatctccattgccgtggccatcgcattggcatgctgaacaacattttggaagtgattgtgcacatccttgaacaactccattgctgtcaccatggtgctgacatgttgaatggaactctgaaagtggctatgcacatccttaagcatccttggagaaggaaagtttgattcagtcctactccttttcgtgccattactatgtttcttttgcctcttacagcttgatgccacatccaaggagcgaccagatggccctgcggattccctatccttgtccccatcctcatctccgacctcgtctgtgttttcattctccatgtcagcaaccacttcatcggacaattcctcctcctctctgcctgttctgtccttgccatatattacatcaaatgtatcaaaatatggaaatgggataccatacaaactcttggctctaggatgatcctgcagaaaataaacaagtcgtaacaaaaacacattatgataaaaacaaatgtacaaaaatacttagaatggcttactttgcaatgagcatcatataactctttttcacactgaatcatcttccgcatgccgtcccacgagaacctgggcaacgctaacatatctttgatcgcataatacttcctcttcagcacttttaaccgagaatcgacatgaggactggatctaataccacggcctggcagcctttgcgcaagaatgttctctatcccttgagaataacagttcttgaatccccctccttcgaccttaaatctaggatcaagagaaacctcgcacaatgctttgacaagctcctcatcttcatcggctgtccatttccttttgttcctgcctctgccacgcacaactttggagcactgagtttgactcatccctagaacaaaatcataatcagcttagggtgcatataaaaaggagttgcttattaacatataataattaatattatctgaaaagaattgaaaaatagattaacatgattttttttaataaacacattatttagtagttcgggaagtttgcgcgcgaaaaacaagcgaacagaggttggtaactttgaacattagaacacagccttacatgtacagaacagttcatacaagctagggttttacaacaacgtagtatatcactccattatccatgtccataggaggagttcgacggctagccgatgagagaagaagtcatcgaggcggcggcagtactggaggcgtgttcgtcggagagggcgaggcgaacggcgggggagatgtcaaagccagccgctgcggccatcggcgaggggagaggaggaggaggaggaagggaataatacctcacgtcacgagaggcagcggcggcggcggcggcggccggagagaggcggctccgggacggacggcgggagcaaaagcggcggaggggagatgggattgggatttgggaatggtaggaaccggattagggatttagggttgctggttggtgtgggtgtaggagtgggactgggactgggatgggagggaggcaggccggtaattggattcctcatctcgttgggctttgtcgcttggacatctgtgatccaataccactggattcgggttagggtctttaggactaggatttcctaagcattttccatcagaagggaaacgatgggcacatcccggtaatcactatcgagataatcgttttttatctgtattatcatagtatcgaatactatgatcggaatactatcagattttataaaatacatatttttatataaaatatatatttcctcattccctaaatgtttgacgccgttgatttttcaaaacatgtttgaccgttcgtcttattcaaaaaatttatgaaatgtgtaaaactatatgtatacataaaagtatatttaacaataaatcaaatgataggaaaagaattaataattacttaaattttttaataagacgaacggtcaaacatttttaaaaaagtcaacggcgtcaaacttttgggatggagggagtaatatactgtattatatatattaaaacatataatattgattttgatatatttaattggtttttaatgtaaacatgagcatatttattcatattattttcaatccatcttattttaaataatattttgtaggatagtagagatcgtagaattgggatactacctaagattttatatagaatcgtgtgaaaatgaataataagatcgagatgctatgaaaaataagatactatgtgtgattttggcttgatagtatcgtagcattataagatactagggcatggatcgggataattacaatcttgctctagactctagagattgtttggcaatcacaatagaaatttaaattttgaaactttattttaagttggttttggagtatttttattgtagtttattctgtagcattggtttttagaccgtgatcaataatttaaaagttttacactaattattttttttgttgctttgttcatttatctacggtttaccagcgatagctcgaccgatcagacattggcctcttccaagacaaaagttttagggtaattctatggaaagttgactattattaaaattccataaaatcctacacttgtaagagcaagtttaatagtatagccaactactaactccaaatcatttatagccaattcatataatagttaattactacactattaatatctggtcccacatgtcattcacgtattatgtctccgagtccgtgctgtatctggctacagatctataacccgctgctcttctctctcttcttttatccttttaaaatatgtttatagttggcttatagtatgctattgtagctgctctaatattgtagatcaagtaaaggatagcttataattaatctcttgcaaacctgaaaacacactacgccatgtcacagaattgcccacagatgtgtgtgggtaaaaatagagaatcaacatctaaccatctgtcggtaaaggtttgtgacataccatctgtaggcagttctacggtacaggacagatcgggaactctacggatttttggggacaaactatatgtcgctgattgttaatctcgtgtcaaactatctgtcggcatagactcatctgttggatcacaatcaaacaacccataatcattctcgcaataaatatataaatgttcatcacctagaccctagatcaagtcggtaagggccttttccgatagataagatgacgtggaaggtgacctctgccgacagatgttctgtggggggtggtgttctgtgggggtgggggagggttaggacatggtgtagtgataaattggcacttgtatttaacttcttttttttttgaaaaataaatatgatagttgaggtaactataggttggttcgccatcataccttcttcaaataactgaagtacacatgatggagtgactgaaggcatcacagtttttgtttcacatgaaagcaggcctcacaaaataggcttgtttgaaacgcacagagcactatcatcgaaatttttaaataaacaattaaagttccctgggaacaggaaattaatgttttccaagcatgggaaagtagagagaagaaagaaagataaaagtaagagaggagaagaaagaggagaggacattgacatgtggggctcacacactaactcagtcggttggactatgtcaacgagccacgcttagggaaaaccatcctcaaaatagccgaagcagtcatttacaccggttttacggttgaggggtcgatataccctgtttgcaattgagttgagggataaaaatcagattgaacacataatttcgagggagtcgaattggactttttccaacggctgaccactgtgcctcttcgagtgaagaatcctgaaaagcagcccatgggctcatgagaaaacagagcctacggacagcccatggggattcctctaaaatatcctgtcctccagaccttgaatccatcaatccctaagttccgcgccgccaaccccattctccagcgcacctcaggtaatcaattaataattgacctttcctatctgttgtatacattttactaacatactgtagagtataatgccttgtttgtttttgaagctgacaatcgaatcaacgatgggcctctcgcgtcggttcctgaatctaatcgtggacaaccgcttcccaggcgctgtatcgctgctctcgatcgacttgaggcgccacaagctgttcaacacaacaacacctgctgatctgccattgatcaacagatctgtatctgaatcagaacggccgccatgtgtagccaatgctaacaatcatcagaagaagaggaagaagaagacagtaaagatgaggatgcttcatcttcccgcgccaaccatcgaccttgaagcctcatctaggggctatagctggaacatcaagtgctcaccgctcacagatcgcaagctgctctgcacggacaactatggccgccatgtcctcttcaactccgaggcgcgccaagtggaggacttgcccttcctcaacgagcccaagaattcgaccttctccatcttcatccctggtgcggctactgacaccaatggctgtgacgacaatggtggtggcggcagcagcatctacatcatggagcgttgtcccagccatgaacaagaacagcggttgctgagcggtcaatttgaggcatttgtccatggaaggcacaacacctggtacaaccaactactgccttcaccgccattcatctacgaccccaagtacaagcgacccaagatcagctcatatgcagtgcttgttgacgactgtggcagatcacacatctgcatttcagtggatcatgttggcacctaatgcttggacacagtgaaacacacctggatcagagttggggattggacactacccttcacaggcaaggttgagcatgtgccagagctgaagttgtggtttggcatttgcaccaatgactggaaattgggagctattgacctctccactattatctccacagccaccatggaggacttccagccacagctagtaggcacttggaaggagcttgaggcacctcaacactggagtgagatgcgttgtcctcagcttgccaacctgggctcaggcaggttctgcatcgcaaggttcttccacacttggactactcccatggaaccgaactcatttggttatgattcaattaaggtgcactctttttctgattttgattctgattctgattcaattgagtttgaggagcactcttttactgtcttgaccggtacggatgtagtgccgtgcgtccatgatggcaatgggactggcaatggcaattacgccaatggcagcaatgggaaagtggaactccgaatgatcaagcacaactcgaaaagccacatatcttatggcatagatggtacaattaggctagtgttctgaataacgtactttggtttgcttccagacccatgtattatcttattatccatcattgtcgtctgaatagttaggggactttgttctatatgagacaatttggtggtatcactttatcctatgcattttcattacgaatttgtagtatttgtgcaactattgtatttagatcagcttgtccagttccttgtatttgtttggaaaacaaataacagtgatcacataatgctatgaattggcttagtgatctggcatgtttttttttttcaatcaagggttagttgatgaaggatccgtgaagtggtctggacataaagcttgtctagatccatcatactacggtgtacggcgtgtcagcgtgtggctgcatggcggcattcccttctcgtattattattattatatgactctcacgatctcagcctttgaggcaccccggccctctcatcttcactattcctagttcttcaaatttctttgtggttccttctcttctagttttaaatataacctctaggtttcttgaccaccatataatctgttcaacttctaattgatgaaaatacacatgatgatgggagtggctgaaggcattaccatttctttttgttccagacgaaaacatggcttcattgaaatttcacaataaacaattcaattgccctggaaactctgaaattatgtgttccaagcaggggccaaactgagtacacaagaaccattccattcataagaaaaaagaaaaaacaagttcatacccctaataggcaggatacactgggcacaaagaaatattaacatccatgttactaacaagtaagcgtgctgtgaaaaccaatgcacatttacacaagacattctggacgcgattgtacactacaggcaagaacagcaatcgacatgatggccagaaagtatatcctattatgagtttttacctgcgttgcttcggcgcaatactgcagatcaaatgtcatactccttccatcccgaaagaactcaacctaggaggggtcacatcccctcttggattctgtccagattcgttgtactaggaggggtcatcccctcggttgagtttttctggacagagggagtacgcaggtgacacacattccaagaatcaggtgacagcagtccacattccaagaatcaagtggatctgaaagatgcggtaccagattttgcatcgaagtgctgtcaatggcggaaagttctcacagcttggtcaattcttctccggcaaagtggacaattcgtcaaatgagaagagcagttcatacagcagcacatgtggccacacctgcacggtgtttgatttacatattcattcataaatttttgaggtgacagtttaatgagaacaaaagttgcataaagagatgtatcgatcacaaagatgacaatgggggtgattcagaaacaaaatcaaaattttgtaccaatcagagctcaaaatgtaatgataaggtaactactcttcaattcaaatatttgatcagattccaacaaaaaatgtaatgcatagtctatagtaatgtttaaagagttattttattattcagcaatatatagacagttctcattgctaagaggctaagagtaaagctatatgatggaatgcaaaatataagatacttacggcacaaaaacagcattatattcctgttcaaggcatatgacacatatgtccaagaccaattgatcctttttattgttagaatctacatctgatgtaccattgccccctgtacaaaataaaactgatgttataagacatgaacaagttatgataaaatagcctaaccaattgataagaaaaatgaaaaatcaccttcagcttctctagcttgtctttgtgcagcagcagcatgaaccctgtatggaaaaaataatgcattgtaacaacattttcagtatcttgcattagcaaaatcgtcaatggttacaaaacatatcctagtgtccatctgtatgctacaatgttagtttgtgattttcacccccgatataaaattactcccagggtaaaacttttttcaagacagcatctccaatgtcttccatttcagttttgtcctaatgatatatattagctgctggaagcacatgcaggttccacaatttaaaagatacagagatcacaatgctattgaacattacaagatgttccaaagcatctcattctgaccatgtctagcaaagtgagcaaaccactgaagaatgtaaatgggagtaacatgtccgtctaaatccaaataagtggttggttagcacacacctcttctgtaattcatgtcgtcgttttctttcgagaaaatgctgtagtgcacgctttgcaagaagaaagacaccaaatgctgcaaatcccatggaagcaagctggtataacctgttgtagtaaaacacactattagcctcaagaagcctaaaaagagagagaatattctactgcatcttcatacttggcccatttcccaagattcatgataagttgatcgatgcttttcggggatacataaaatggtcctttgtgtggtcgctgaattcgaatagttccaacatcatctttaatggcctattcatacaacataagaatcaaaaacgaaagcaagacttagccatgtaaaggaaaatagggcaccaacacaaggcattgcagacgaattaaagctatgaattacctcaccaacaacagtcaatgaagttccagttggaagaaccctttcagttctcttgactccaagcatctacaagcattatttcttaaacatgaataatactactacaagcattta

SEQ ID NO: 42164 - DNA, 18093 bp, Oryza sativa
attatattaaagtagtattgagcatctaagaacctaatatgcaatttatgatactaaaagagctctaaatagtatgttaaaagaatcaagctcctttcctttattttcttgagaagccatttgtgctcaatattaaaaaaactcttttgctaccttaaaattgggttcatcagctttttaacaaataatctagatgatgaggtcttgtcattaggtttacatggaggagctcgatgtaggtagggttaggctatggggctgacaaacaaggtttatacacagaacaagctatatcagcaagattattacagaagtccagacatccatatgacattagatggttcatctactataaatccaagattgaataaatcagctgatatacagtcaccaagattggacacataatggcactgtttgatatcgagactaaactgaattacttgtttcaatagaaccaaagaaaattagtatataacaactacagcagttaattaccaggtaccatggaacttctttgctaacagaaagcatcacagcggaatcttgaatccatgatccagcatcgttgtgctttaggaagtgttgttctgcctaccagaggaaaatggttaagtaaaattgctaggatatgcttgccacaaaactaaaagaaaaggaaaccgtagaaatggaaccaatagataccgtttcctctactattacacctctcatgccactttgttggcagataagtggtgtatctgaaccaacccgtccagagactgccactacaagtggcaggaccttacttgcagtgtccaatatagcagctgttgaagacaatacagataggtcaaaacaaaactgacaaaaaggtagtattatgtatgtacctaattggacaaaattacaaaaacttcatttataaaaaaaaaaacagattgacacactacaataaagttataaattcttgtagtatcttaatgctggacttcaattaccacaacaactctcaggttttgaacgcgtgctacaagaacaaattgtgcttctctggagaaagtggtgacacagaggtctactgcttcatcactgaatctagatggacctgaaatattctcctaacactttatctcatgcatcactaggattgaattagctcgaagcataaaaatttccccaaaagccacgtacacggtacattaacctcaatacaataaattaacaaaaccgcagagtaatagaattactgcagaatccagctaattaagcacgtatttagcagacacccaacaaaacatcaaaccaaaccaaaccctcgctcgctcgctcacccaaatccttcgtgcttccggccctcgccaccgatcgcagcacctccgcatccctgagcaacaaatccccggtcagaaccaccaaaatccccccaaaaaatcgcccaaaaaaatgccgccctgcaaaaatcccgcacctgccgctgctcctcccgaggagatacagcgccgcggcgctgaggcagcacccgactccgccccatgggatcaacatctcgcaaggaatcgccaggcgagcaccgaatccggggggggggggagatcagtgaggaggaggacgacgaggagatgaagccgtgaaattttatttttattttcccccctttttcgcggcgagggaagaggaggaggcggcggggagggggaccgggaggcaagcaaagaacaggatacgaggagtgcaccggcctcggtgggggtgggcctcacatgtcagtgagtacattccctgacatgcgggccccgcagggatatgccacggcccctattagatactggcccagaagcgcttttagtaagacttggccctagggcctgtttgagggagcagcaggagctacaacaaagcttcccaaactatccgatttccatgtagagaatgtatatggagaattcagaaaataaactataatttaaaagctgagacttctagtttttctagtttttcgctagctgtttcttagaaccttaagctaccaaaatggagtatgaccttagttagttttggtagtcagccacagttactcttataatcaaaaacttgcttaaatatttttcttaagattctaaaaaactattgttgtgaaatccataaaataaactaaaattgaaaagttagaagattttaaaaaactactgtatctactaatcggttgtttctcgtaatcttaaccttcggcataggtagggcgagctcctctcgcttacatgtggggcctggtcaacctcggtggttcgaacgctgcaagtgggacccacctagggttttaagaggaggagattctcgtcggcggcggcggcgggcaaaggttagccatggagaaggcgaagctctcgtcggcgctcttcgccggcacgcacttcgaccgcaagcgcttcgccggcgacttcgcccggttccggcaaggcccgcctgccccagacgtggcctccgccgccgcgccgtcgccggagaagaagcggaagcgccagagcaaggccaaggcgaagaagagcaagaagaggcgggcggaaggcgccgactctgcttccggtgagttcttcttctcaagaggttgttgctttttgggagtgtaatctgactctgactactctgtcgagtgttgtacgctttgcagatgctgtggaagggttcagtgtgttcaagggattggcagcaaagaaggatgaggacgattcggagaagaaggtcgagactggtaagagtgaggactcggaggttgtaaggcggaggaaggaagtcgagagagaaatcgaggtaatggcgttttgcaaatccgttgagctagctgtgtctctctttcgcaaaattgtgcttatgtaaaatatttgaaaaaaatgtttatcatccagcaactatcttggattagaaataatggcagaaattaacatttcggtgtgttcggtttgcatgtgttggattggtttgcagagagcggcaatactacggaagaagtttgatattcacatttcaggacaaaatgttccagcaccgctagagaactttgaagaactggtttcaaggttagtatctgaataattcaaagagttcagacatactaaattctttattataggtgctgctacatattaacttcaacacatcatggtaccgtctgaggtggattttaacctacctgattttgtgcactaggtatggttgcgactcatatttggttggaaacttgtcaaaacttggatttcaagaacctacacctatccaaaggcaggccattccaattcttctatccgtaagtcattttgactctgtttggatatttttccccctagtgattgaaaattttagttttttagggtcatatatctgaaattgctttgtttcaggggagagagtgctttgcctgtgcacctacaggttctggcaagactttggctttcttgttcccaatccttatgaaaatcaaggtatttatctttgtgatattgttttatgctgtttgtatgtgttgtacttgtacattctttttaagccatgttgttatagccaggatctaaagagggtgttaaagctgtgattctttgcccaacaagggaattggcagcacaaaccacaagagagtgcaagaagttagcaaaaggaagaaagttttatattaaactaatgacaaaagatctatcaaaatctgggaatttcaaggatatgcattgtgacatcctgatctccaccccacttcgtctggaccacgctgtacaaaaaagagaccttgatttaagtaggtctgtgatcataccttcattattttgatttgcacactactacctgttagaagctaaacttgatacattatgaactctgtctaatggtttatcatgagtttcaaccttggaatcccgatttctaacatttttgttggaaagcgaatgcatgcataccaatccggataataatggtatttagtaatgaagtgatggtttacctgctagaagctacacttggtacattatgactctgtctagtggattatcatgattttcaaccttggaattccatattctaacgtttttattggaaagtgaatgcacgtatttagtcatgaatgttagctttttagtggaaggtaaaattccttcactatattaccctgaaaacaatcttaagtgtttattcatctcaaaaaatactatagagcctgtgccttgttaattcccaccaatttacttacgaaatggaaatttaattagatcaattcaaccgtcccttagtggcatcacaactatatgtctgcatgccatttataaaggaatgacaggttgcaattttcgccattgtttttctttttattcgtgggcacccagttcgatttaacagtaacatatgctgtctttcagagtggaataccttgtcttggatgaatctgataaactttttgagcttggatttgttgaagtgattgattcagttgtcaaagcctgctcgaatccttcaataattcgatctctgtttagtgccacattgcctgattcaatagaaacgcttgcacgcacgataatgcacgatgctgttcgagtcatcgtgggaagaaagtaagtattgctttcacagtgtgtactgcgaaaactattttttcagggttatttttgtcattaattcttcacatacaggaattcagcctcttcactgattaagcaaaagttgattttcgctggaactgagaaggggaagttgctagctcttcgccaaagctttgcagaagtaagccatgatccttctctgatggttttctcctagtttccatcttgctgtttccgagagctgattaaacaatttcaactgtagtctctcaatcctccagtattgatctttgttcaaagcaaagagagggcaaaagaactttacaaagaactggcatttgatgacgtaagagctgatgtaattcatgcggaccttgatgaggagcaggtatcacttaatatcatttttagttgctaataaatgtttgtggtagttttgttttcactgctacacttggctcaatttctatctcctcactgaagcgtcaagatgctgttgacaacttgagagccggaaagacttgggtactgatagctaccgaagtcattgcccggggaatggatttcaaaggtgttaactgcgttatcaactatgattttccagagtcagcttctgcctatattcaccgaataggtaagtatctggctttgacaggctacacgcacccgtctgtgcatttttgtgaatgatgtcttgtacataagcatctgcgtggaaggcctgagttctgatgggcatttgattggttggatactgattatatggtcctcttttcaaatttatattattgttattttgcctgttaggcttgtttaaatttacattccagtctgataatgtagccagatatatcatatacctctattgatcagtttagttcagtttcatgtatatgcaattttttctctcttatgaaagacctggcatcatgtttttcttccgccatctcatgattcatgaactaactagggaaaaaaaaaactcctttcttgttatataggacgatctggaagagcaggtagatcaggggaggccatcacattcttcaccgaggaggataagccattcttgcggaacatcgcaaatgtgctgatatcttcaggctgcgaggttccttcttggataaaggcattgcctaaactcaagcgcaagaagcacagggtgaaccgggatcccatctccacattaccagacgaagattgagtttccctgtaacgtttctagatgaagattgagtttccctgtaacgtttctagatggcaccttggcttcagttttcctgtttgaatgccagaaactgctgcctctattagttttgttgactgaagcctgagatgagaatacacttgccttttgttatttacagttttgactgatcaattgaatagattatttctgaatttacaattagattcatcgcatatcccaacatacaaccaatcacaggcatttaccattttcagtctgtcctgtggtcatttgttaactgtcttgcagagcctgcatgatctccatggcatcatctacaagtgaggccagagttgagctgtgcctgctcagcccaatgctgccagagaacatgttgaagctctcgagctcggacgtcgacctgacgacgctcctgagctccttctccagctccatgctcctgaagaaggggacgagctcggcgtcgcctctcatcatggcgatggcgagctcgatgacgaaccttctcatcctcggaaccttcaccctgggtgtcctgtgctctttcagaatctccactagcctccctgcaatgtctgtatctggtacacctgcctttccaaagatttccttgtgaaattcaggtgttgcaagccttgtaatctgtattgccaatcctatagacacctcaagcaagctgctcttctcaaccataattgctttgaacacctgtgaaatcatgtagcagacatcattcatcaaatcatagcaacgatgtctactgaagaatgaaataagtgatcttgttctagagaatctattctatgcccttgagtttactctagttaaatgttttttattggtttctttgatttgtttcaaaagaacatcaacacaggaattctctcatggttgcagtgacatgagtagcacttcatggttctgagttcaagtctctataggagcgaatttcagtttgggttatttgagggctaaattccctgtttgataggttaagttcccaattaaaaaggctatatatatccggttggatgtagaggctacggccttgtttagttctaaattttttcttcaaactttcaacttttccatcacatcaaaactttcctacacacataaacttccaacttttccatcacattgtttcaatttcaaccaaacttccaattttagcgtgaactaaactcagcctaggtaaaaattacccttctctaaaaaaaaagaattctcatccttttttggttggtttttgagaactttctattgggacagctaagttccctattaaaaaggctatatatatctggttagatgtagaggctaggtaaaaattacccttctaaaaaaagaattctctcatattttttggttggtttttgagaacttactattgggacagctgcagtgaggctgctgagctgcaagaagtggtcgctcctgctgtacctgcacaggttcagtaggattctggatgacgtgatctgcagcccggggtggtgcagcgtcatcaccagcctctcgacgacggcggcttcccggagtatccggtcgcagttggcggcgctctcgagggcgagcagcgccaccacctcgccggcctgcagcctgatgtgcgccgccccctgcgccgcgtaggcgaccgccggagccgactccggcgagccggcgaacatgtccagcagatgcgcgatcatgtcgcccgtgcagccgatcttctccttggcgtcgccgtcgatggcgaggtcggcgaggacgccgatcgccgtcagctgcatcttgccgtggcgctcgccgccgtgctggagcaccttgcggatgttgccgaggacgaacacgttgtcggagatctccctcctgatcgcctcgccggtgtgccccggcgtgctcgagaggttcttcaccacctgcagcgaccggagcaccgtcttcgccggcaggctcccctcgccgccggcgcagatctgcagcgccgccctgctcgtccgggtgaagtgtatgatcctggagaggacaccccttgtgctcgagatcttcgccgcgttgccgtgctcgcgcgccagcttcttcatgatgtggagccccatctcgttcatggcgaggtcgccggcggcggcgtcggtggtgggggtctcgagtaaggtggagatggactcgatggcgccggggatggtggcgacgcggatgaggttgcggcgcttgccggcgaggcggaggacgacctcggcggcgagcgacctgacgcggcgcttgctggggctcttccagctcaccatctccaccagccgctcgacggtggccgccgacgtgccgatcttgcgcaccgcccgcctcgccgagtcgcggttggcgatggagccccggaggatgtgcgcgccgatgagctgctcgtcgccggagtccgatgagaggagctcgacggcgaaggagacgaggtccatccgcgtggcgtcgaggatgccgccctcgaccgacctcgagaaggcgcggtagaagaaccgcttgatcggcaccacgccggcgtcgccgaggtcgcactcgccgctcaccgcctcgaccaggcgccgatagctgagcacccactcccagtacgcgcgctccaccaggaagatcaccgcctccgacagcgcgagcacgtagaacagcatcagcgcgtagtacgcgttcttgttgccgccgccgccattgtcgccggcgaagcggagcgtggcgaggcgcagcagcgacagcgcgacgcacgccgacgccgagaggagctggagccagtagaggacgtagctcacgttcctcgcctcgacgagccagccgccgagggggaggaggtggatgggcgaggccgccgccgccgccttgtgcggcggcggcgggtcgtcgtcgtcgtctccggcggcggcggcggcggcgtccgggaggtgcatcggctgctcctgcagatcgagctcgttgctccggctgaacaccctcgtcccctcgacgaggaggatggcggtgacgagccagaagtcccgggcgtcgaggtcggcggcgaacccgccgaggatgaccaccgtcgcccacacgaagcagacggcgccgacgtgcgacgcggccttctcgagcaccgcgacgtggagcgcgaacgccgtcaccttgcgctccggcaccacgtcgtcgacgccgccgccgtcgtcggaggcggtggcggcgtgcatggacgagacctggtgctccaccggccgccgctgcggctcgtacgacgacgccgtcgagtcgccggtgtgcgttctccggtgcctcgccgtcgccgtcgccgtcggcggcggcaacggcggcggctgcactagtatttgcatgggaatgtccacgccgccggcgccggcgccgccgccatgatcagccgtagtgtcgatggccattagccttgtattcccgagtgcgtgcacaagtgcacttggggtttaatttccatggttttttgcatggtgatgttataaggttggagctgattgggcgggaggctaatttttcatctaaattaattttgctggatcttgtgtgaaagcaatcagaagagaaagatgaaatgagattcgtgtggcttcaacgtgcaagaaacaaagtttcatcaagttcagatacacgctcgagtagattacaagttgtttattgcattcctgcgcaatgcaatggagcaaaagctgtgtttaccttgccggttttcaagttgtttaacctgcaggttacatcatcttgtgtcatgtaatgttgagacttgctgaacttctcatgttacagtgcagtagccaagacatgtttgattttgattgttggaaggattattggtgagaattatctataatcaaatatttattaataaaaataataaatagagcaaatagtccataatccatttcaataatcagtaaataaaatctttatagacaacctttcaccgtttcacgcaacagtcattttcagaggtttacataccattgccaactctataactgcttctcgtacactcagattgcatctcaatcaacttgtttttaatctccaaattaagaggatcctcttcattcaaccattctcttagactagatcacataacatttctcggattttatatatacatgttacttgatcatgggtacgtcaagcaatcctatgtctgagtcaacaggcaaaatgacttcatttgataaatccagaagccaaaacaatcatccgggttgcttatctgaacactgccgggtagctgaagacctacgggttcaggctttatacatgcagaattcagtgtattctttaagcagaaaccgtacccgtagcttcaggaatggaagagtacatttcgtgccgcgcaacgaggaaatcattctccggccgtacggtgttccacgcccggtaggccggcggcgccgccgcaaccaatgaccaatcaccaaatccaacacctctggagtttggagtttactctgcatccaaacaaacaaattcaattgaatttcagtgcatcgaattctactgagaaaccggcagcaattacaataaaaaggtaactcttgtactacacatcactcctcatggttcatggactttggcaatttagcaccacttgacaataagtaataacatgatggtatattttacctcttccgtttgttttttttctgtaatgcgtacaactcttaggtagatagagaggaagatgccatcagctgtgacattttcctagaagatgaacattggcatgtcagtcaagaaaactatgctccagctctatcgggagaataatacaaataaagggaacttcgcatgcgtagtaatcgaagttgctgctgactcatcattggattaaccggtgctctcgtgtcagctgtctcctgattgcctacaaccctgccccttcaggaggtatactttagaaagtgcatcagtattcttcgtagcatatacagaattccagatagatacatcaaagaacctgaactgattcatgagtatgtcgacacaaacagagaatgtactggtagatgtagcagagagagttgcccaacctgaggcgagctggcatagcgcgatgccagaagagcagctgaattgctttgttcaagttgttgcctccgttgagagggtgggcaacgccctcggcacactggcgttcacctgggccaccgttgtcctccttggaggatacccaactagtatcacctgtgtggactttgcgtacgccacagcattgttcttcttagaagctgcaaggtatgcatcaatgatcagtcacatgtgataatgttagtcacaaacctgtgtactcatgttatcactacacttagcattcgtaagaccatgatcagattatctagtacttagcaatttatcaagtccaaaaggattgttgttcatttggttgatatatcatcctgtttttctcggtttccatgtgatgcaccgtgcatattttcaggatgttctgccccaacagatcagagtaccaacttttcttcaggactcgcggagctttgagacctttctcatggaatagagtgattgtggtgatatgtttgaataatgttggtttattcctcccaagcaccaaaagtaaagaattgtcggtttccatattgatgcttgttgctgccaccttgcctttcccaggagttcacaaacttaaaggtggtccattacgcaatgctatatcactattgagccccttggttgtaatggtgctgttgatcccctgtctatggtgcaaagatacaacaccagcaccaaaatggcatttgctactcctagctagggccttttacacactgttactggtcatggtgttgctactaacgatcagcaaattgcagtttccaagcatcgtcagactagttcataggcttgtcatccacaaatcattatcctgccaccaagtcagtttgttttcttgcatgtaccttgcagcagtgcccttggtgttcttttctccatttttgttagtaatgatggtattcgctctgttgacagcaatgtgtggcagtttacagattccagctgcagtcatgcgcatcgttattggatcgatctgccttttgcaccaagattattatggcaaaggtggccatgcaaataattctgacaagacaaacctcaagccaacacttaggctgcgttcgttgggtggagaaagagagagagtttgtttggttttccgcgcgcacgcttcccaaactactaaacggtgcgttttttacaaaaaatttctatagaaaagttgctttaaaaaatcatattaatctatttttaaaatttaaaatagttaatactcaattaatcatgagctaatggctcacctcgttttgcgtatcttcccaatctcctcaatccccttctcctcaaacactcccttaatgtcttctatggaatggtgctcggtcaagggatactatacattgtggctcgcataatggagtttttctcattctttcctcggagatcattgccccgtcgtggtgggttcaggggtcagcagggagtcaaatctcttgatatgtactacacacatgcatttgagaaatgtatgaacgctagcatccttgctccaaagaagttgaacctcaccaattttgccatggaatccctcgaatcagactcaaggaagaagcagctgtgcggggttcgaattctgtatagccttgtgaacagagagccctatgacaaacaagtcctgtcaaaagtcacaactccatgaagacggtcaccacactgatccaaatgctgggatggactaaccaagaagacaatcaaattagattgcttgccgcgaagattacagctgagcttgctagaggtctccagattgtcacaatccctggtgcaatgaactccatatcatcacttctggacaaccagaacaaacagcagatacaggaactcataattcagaaagacagtggtggtgaggagaattgctggatactcaaactttggcatcagatgactaaaaagtggtccattctagaggaggagcagtggacagaaactgatgttttcctggtacttggccttgtaactcttgagaggctagctacatatgatattgtcaactgcatggagatcagcagatcaatggacctcatcccaaagatcacagagttcacgagtaacaacagtgagagaatatgtgtcaatgagacaagtcagaaaatactgattgatttgtcattgaaggtgctgagaagactggcaagcattggtggggaaactggtataacattgaggcacaagatatcagaagatcccttcctacttggcaaccttgctgagattttggaggatagcaagagcagtcaggaactgaggaagttgacaatagatatccttataaaacttgccatggatgagactacaaagagagagattgggagcatccaggtgattgttcagatgttgatgtttgcattcactgcgcaagatgatctgccaggtgcatattctgactgctcgatgacaatgaaagcaggacaagcattgtcaatgctaacactagaaagtgcagacaactgctcagctatcatgaaggaacctgggcatagattctttaaggatgtggcaagaatgctagtgcatgacaacaggtacatacatgttgcagcaaatgtactgcaaaacctgtgcaaacactctagagttgagctaggagattcagttttggtggaactttccagtgtcctactagaggtgagatctccacctatgtatgataatatttggcatattttttttaaaaaaaaacaatgagaagcacaggagggctttggccccattctaaactacaactttctcgtcttccgttagcacgcttcccaaattgttaaacggtgtgtcttttgtacaagatttctatataaaagtttcttaaataaattaaataaatccaattttcaagcttgcaataattaatacttgactaatcatgcgttattgacttgtctcgattcgcatgccgcaaaaaaaggttgtcccaaacatattttgtatgaagaaggggctgagaaaccaaaattttagcttcttatttaggatatctgttttcaccagatatttgattctagagtctaacttacatgatgctgcgttataccgtctacaggtgttgggacaagtaatggatgcagagggaaaagaactcgaggtccttgttggcctcagttcacaaatatgcagggttagtcctaaaagcttttcaaaagcgctagaacagggtcagaaggaggcaagattcgtggagaagctaatcaatggactaaatgcgaatatgaaacccaatccacagtttccaggaatcagaagtgtgatagttgagcagtgtatatacatgatggagctgagctctcgttatgcaacatatttcagaaatcatgaattgatggaagcattaataagggtggagaagacaccatcaagggctgaaaaatacaggcttttcttgggcaacacagggctcattgagcacagagtgaatctgtcctctcttgtggagagggcaaaacagttgatggccgtgcattcaactcaacagccttgagaatccaattagattttcgatcatatttaccactagcctttggatcatcctggtccactaggatatctttgtaattcaaaatactgattggcccagaaaacactggtgctaagctctggctaataatttatctgtacagtttaaacttgatcctttttaaaaaaggactatagagaaataaacaaaacaaacaaatgcacataaagattcttaggcgcaaaaaggaaaaaaaaatcaaaattgcatgtttatttgacatacatcgagttcaatattcaacatttgttttattccccaatcaaagtgatcatgtcaattgaactgttaagcaactatcccaaatggtgtactgataaatactctatgattcctaacctattttgttttcttggactaaatatcaaataaggcaagtttggcataaatgatcctgtaaataagtgatgaataagagaatattctgacattaacacggatgggtctgttttttctaatggtcaggccgttgccgacgttttatataaaagaagaaagtgtctcattttaagaaaaaaaaacatgacaaaaccttacaatgcacggtaaattaggggaaactgcacgaaaaccacaactcaccaccaactaacctaatcagccatggcagcgaaaataggagttacagtaccactagcaccacacagttctgatgttcgaagtaaatcctgaagtataccgtatatattcagcagaaaaactcaacagtttctgtcgcgagcatgggggacggttcttgttgactatagaagaacggatatggcttatctggtccctgcagctagtatagcaagttcaatttgagcaggagtgagtgggtctgtgagtgcttccgtcactgctcgtatgaacaagaacaacgatggaaggtgaatggctggtgcactcactctatgctccatgtgaatttgtgaaatttgggttttgctgcccgagtggctggggcctagtcgctcgcccccggcagcatctgatcccacttcctcttgtgaaaattttttatattcatcgtgaggtccaagtgtgcggcgcactaggcagcaaattaaattaatcccccaaaataatatactactccctccgtttacaatataagtcattctagcatttctcacattaatattgatgctaatgaatttagacatgtatatttatctagattcattagcatcaatatgaatgtataaaatgctaaaataacttatattctaaaacggagaaattactaatttgcaccgaactagtactagaagagagcaaaagcaccgcttaaacggttgaaccctagctaatattcgggtgcctttcacacacccccttaaacaaaatcgccaaaaatgcttttcatgatgtatgaggaaacctaagatttcgaggttgggaaaaaccaaatccgcaggagcggacggggaatcgagacctaatctcccccgcggatctaggccccaagcatttgggcgcggcgcggcaaaattaataccgaatcgaatcgaattttttttcgatcgaaaccgcgatcgagaggaaaaaaaaaaggaatgcatcggaggaacacggaagggaagcaatcgactcaccgtgctccttgcagaggccagagcgggggctctgcgacctgcgagcggtcacatcgcagagatcatggagacacagtgaaactaaaggcagcccgtctctctcacagtctcactctttagcaaattttaccaaaacgtccatgtgctctgcagaaaaaaaaatggaattttccttctctcctttttttttcaagtggtttgaaattgacctctggcaaaaattaacgagctatataaattttttttgaggaagataatgctttattgatcattttaaaagttggatacaattacgatcagcagctctctagtatataggggagcttgcatatgccacgcacgcaatgagctatataattttttttatttgttttctagcatgtcttttataaacttgtaatggtgcaatgagtatttgcacatatattcactctcctatttttttttgttttaaatatttgtcacttgtaactaattacaatactttgaacactgatgttacaatactttgaacactgataaattttaagtagttaaatcatgatatatacttaattaatggagtacttcaaattttatatgttttcttcgaaggtcaaaatgatcaaaaaatagtatatagactatttggagacagagggagaattgctttagagttttattaaagaaagaaaaatgatacttgctaacttatagaaaaacttcttcaacccttaccgttaggcacacaaacaatatgtcatgactctctgaaaggcctagttaagcaacaaaatacatcatgcgatattgatacatatagtaattgctgtcgataaaagaaaactcatgtatgctcgagaacacgagtcagctatcaaactctgtcaaaagcgtaactttttgaagctagtcctactgctgttgaagatgcagaggactaagaacatccccagcagttccggcatcccatcttccatccagaaaatggcgtatggggggagaaaatccggctccaacggatacgccatctgggcctccatagatggtacatgcgctattcttggcgtttctctctcctcacgccatcctgcaaccaccgctcccatccgttctactgccctcatccgaatcgagatcgaggcagagggtgaagcagtgaaggtagatcgaggagagaggatgaggcaaatcttcgtcggccgctcccgccgtcgaccaccttcggccgcgccgcccttctgctcccaccgccagtctgcccagccgtcggcgagccgctcgcgccgcgccctccgctccgctcccaccggcggtcggcggcggcgagccgctcgtgccacccctccgctcctccgcccttcgctcgcgtctctcgatctctctggagtgacagagagatcgtgtgaaagagaagataatgatgaaaaaagaaaaaaagaaaaataatattaattgatagtagttgaaagatactattaaaatataggaggatgtgatatagatgatgtaatatagatgatttgttagagtggagagaaatatgaaagaggaatcttttttggataaccatctatatagccatatgaaagatcaaatttggacgagctgctggggatgctataaggtgatacaaaatatgaatttccacgctgcctttgcacccctagtagtattattgaggactaagaagactacttgtgttctttagtatggattgggatcgaatcactcgcatacgaaaaacagagtgatatattatagcacataattaattaaatattagttaaaaacttatataatgaatttatatgattttaaagcaactttttatatattctttttaagaaagcacaccatttaaccctttgataaacacatacggaaaagtaagtgagtgaagattgagaaacttaactacagacacatcctatgtttaggaagaaacgtggagtagggcacatggtgtctattttcttgaaaaaaagagagggggcccatcctcaatccttaccaacgaaggggcaaatagtcaaattccccccagctaagctgcgcagcctcccttcctgcctgcgcctgcgctaccgtagtcggcctccctctgactcttttgctcccccctccctagtttaccctagtcgatctccccccccccccttccccctc

SEQ ID NO: 42165 - DNA, 3962 bp, Oryza sativa
catccccccccacccccacccgtgccatagggttggctgctcctgctcctactgtacacagcttgattgatcctttttggtgggtgtggatgttgggggtagcatgccgctgacctgctcggggagatgcagaggtacgcgggtgccggtaacaacagtgggtttagtggcggcggtggcgcgggtggaggcggtagagacagctcgaggttggatgggtcgccctactccgccaacaattatcccctgagctcgaggtgacgcgctatcgctccatttctttttttttccctccatccaacatgatttcttgttttaagccatgtaaacaataagatgccctagtatgctcttatttagttggaatcttccaagttgtaattgatatgatgcgtgtacattttggatgctacagtaatggcatttcttcgaatcataacgattccgtactgttttatgacttgcgttacttgcatgaagtaactgccgtaatcaaactcaccacatgttctacgtataatttcccagctattatcagaatgacttgataaccttgacacaaactgttattgaaccacaagcaatcaacatgtatagaatgttgttctgaccaaaggaaattttttttagtaaatattttctttaactgatgttgctgatatttgtatggttacgacaatactttctctagaaattagataaattccgtcaggctgttcatttattagttaaagaacaagctaatccgtcacgtatagtgattgaatatatattaccatgccatgaatatcaacaagaccatcatcagttcagttttattgaatatagctcatcgcgataaatccctccatcctagttgtatttcgtataaccatctgattatgtagaacatacagattaataggcgtatatatatgacatcatgctttggaaatcagaatgccatagataatcaagtttgtatcattagtatgatattgcaccacttcaatctttgtggtatggttagagaaggagcagtcattttctctttgatatgtgatcgaatgaagtagtgaaagaggttatttactactgcctcaaatcttatacttgtcatgcatatgctttgccatgtttaaaataaaatatgtcataatattgctaaaatatgtaaatgcattttttctgtcatgaaacatgttgtttacctttgatctatatggaatactcaccttaatttatttataactggcaattcatttatattcgactgttgtgtaatattaaggaattcaacgggtaatatataaaaactgcagcgggagtaagtggggtggcagattcactcagcaccatcactccattcttttaaaaagagtagtttatttttcgccgggccagcaaaggaatggtggccaaatttattaagagcagagaggaaaatggttggtttacataacaacaagattgttggatgctacttaaccgctgcagccaaacatacctgacaaaatcaaagtgcaacattaggaagccaagatagagggataagataacagctttgctgcacgccacacccatagctcctccatgattgtctcgaccctcattggggtggatcaaacctcaaccctcacaaataattgaacatggaataaagaatatctgctctgtcaattcttcacctctattgcttgtccaatatcggaagtaatatttgatgaagagtacaacgaacttgctactgtcacaatcactttcttagtatcgattttctgtcaacagaaatgggggtacctaattcaaaccaaacctgtgcaattttatcatcacaataactgaattttgatatgtttttcttcttcattgttgttttcaggcggcagcagcagctagctccttacaagctaaagtgtgataaagaaccacttaataacaagtacgcatatacttcttaccaaagacagttcactcagggagttaagtgggtgtttattaatctagatgttaatctttcagggattgcatttcctttactttctttgcccttcgttttaactttggctgtgctctttgcgtaaaaaaacacatctgtgttgtccaatagcaagttagcaacaaatagtaaaatactacttctttatcctataagatattacttcacttgatcttaggcagtccaactgtacacgatggctcttttgcaggcttggaccacctgattactatcctcaaacaccaaactgtcctgaagagacattgacaaaagaatatgtacaatctgggtataaggagaccgttgaaggaattgaggtgcgtatggagatgaatgttgtatacaatgtattatgagtttgaatccaattagaaattcattaatgtatctatctgtgctatgcttattgagtttggatatagtccaatcttgtatattgactgattcagttttttcttgggattcataggaagccagagagattgtacttagccagatcccgtacttctgcaagacagatattgttgtaaaatgcaaagaggtgaggaaacttggccaatattttctcagtaagctcgtggcatgatcttattttgccattgtgtttcggaagaaatacgaaaaattctttgcaatagcaaatggattgacagttcatggtaacaaagagacaaattgccactggcaccaaccttatattccaatgttctgtatatcaatttggcatctaggcataatttgttgcctggctggtttactacccatgctatttgattaccttgacttactggagattaatctgatatcctttagttataaagtgtcaccgactattaggactaaatctcagaacttattccatcctgcaaggatagttagtctagtgattattaagtctttatcaacaattgattctggcttgcacagttgtaccagctatcatcaggtgcaaacatttaggcaaaaaagttgctgtagattgtgggttgtgtgtttctgttctcttttaggaaatcttgtttctctcgtaatctcaaatatgtatgttgaagatgtagttctttaaatgttgtaagacaccacaactataaatgcatggatacatttaattaacatggttgattggtagcttcatccttttgtttttattttatgatctgttttgatgtatgatatagagtacttagtataacatttaacaatttcttcattatttgctgaaggcactaaagaagcgcttgagagctataaatgactctcgtgctcagaagagaaaggtagttgtgcaatatttcttgatttggatgtatttacctcctgacatcatatcaaacagaccaactaattttcctgttttagcaggctggccaagtttatggagttcctctttttggatcactgttgataaaacctggagtttatccagagcaaagaccatgtaacgaggacacccgcaggaaatgggccgaggtcgacatacttgcctgttatctgttttcacatgcttttttcaatggaactgttggcataatttatgaactgtcatttaagttttcttgcacttttatcttgagcttgtcgctagttaatacttaacttttctgctctagtttgaatcttctttttttaggaattatgggtttagcatacaatcgattagaaactttattttttgcttggtgttgctttgactttaaactgcttattattgtttgaagtcaagggtcaagtttgtgtgaggcagacctcccttaatgcatcttatcatctcatcggttggaacaatgcaagtcaaataacctaagaaaattgagttattttgtttacagacatcattttctacttctgtgatatcactgctgccatgtatctggctatctgcccattttaactttttgattacatgtgccatcgccatgcaggccctttcccagccaaacaagcgactgcgttcattatctgaacatgttcctcatggttatcg

SEQ ID NO: 42166 - DNA, 756 bp, Oryza sativa
gaaaagcttgaaatgttttgccagtttctacctttatcctttttgctagttacaatgtttaacgctgtgaactgatgctgatggtgtgacaagtagtggtacttgtcttaggctcattaaatgaatcctacagacactttgatattatatcctgtgagcttggtcctcaaattctgaacatttgccatgtttttttgggaaccaattcactagtcttgttggtatgtttaccatgctttgtttcctggacttggagtatgctgtcatctgagaaaattggtagtgcagattacatgcttcaggcttcagcaattaccttcagaatatgctggttgcttcttctcatggacaatgtttaccttgaacttcagcatccattcatatccaacatagggaaagtttgggaaatatcattgtaaatattcatgagttgggacgtgagaatgacatgtgagacctagactcaacgtcaatggcacatccgatggtactctctccaatataagaacttgtctagatttcgtagtgctagaaaatgttccatccagttttaagttcttatattttggaatagagggagtagttttcaactccctgatttttgcaatggtgaatggcaaattggcccatcaaacatacgtgatagctcctagtcacttcaggtgtgtgtctgtatacagtagttctctctttcgatgatgctcacgtgatgggaggtttggaagttggaaccagatccgcgtcccatgtcgggag

SEQ ID NO: 42167 - DNA, 910 bp, Oryza sativa
  unsure (1)..(910): unsure at all n locations
ttgaccactactttctattgcaatatatctttataacctgacgagattataatattatgaaagtatttgacaaaatgaatctaattctaaacacatgattttcttccatccaatctaaatatttaaaagatattgatggtcaaagtttcttaagttcgatttgaaacatgtccaaaaaaacatgttttcaagaccagaggtaatacaaaagaacatgctactttgttgtaaccaaatatacttaattgcagccacaggttcgatcaacatcggtcagtacatcagcaggaggctctgacaatcatcgatctaatcaatggacaaacgatgtcgttgaatatttacaacagcttttggatgaattttgtttaaaagaggtacctccatcttttagagaacagtcatcaccagggcttattgctggggtcacacaagtaaaaatgaaaagcgaagcacccccagctgttggagacatagacgagcctttggtgcacttcaaatggtggtatatggtccgccttattcagtggcatctcgccgaagaattgcttgttccctcggtacttattgaatggttatttaaccaatttcaggtgattttatttccattgactgagtagctcatttatttaatgatgtttaagttatctcttattttctttacttaccagtgatatgcttctaccctttactcaggagagagttgcagttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 42168 - DNA, 12912 bp, Oryza sativa
tggatcccctttttcgaatgtgaactgctacagcggtattccgtgcgcttgcagatttatctgtggtcgtaagaaatatctacatttggtttatttactccttgactatatgtttagtttgttcaactaaccacatagttaggggctacacctattaggtgcatttagtcgatgcacctaagtttacatttaattatttttcagccctctacactcttcagatctggtaaaagtactcgggagaccatagcgaagatgattgaaacacttagctttggagtaatctagttcgagagaagattatctttttgactgtgaaggtctcaggggctactgtgtatattgtgggtaactcctacccacacggcaaggttatctgactaattataagggatagcttagatctatggaatatgtaacggatcataacttgaatattacgtttccttgtatattacggaacggcctaaagtcctggtttgataatagatttaggaaacccttaccgtatttgttaaggtttttgtcgtgtaatcctatccccccaccccggtgctatataaggcaggcaggaggccctctacggcatgatttcacaaccagatcgtcagatcaatactacaccaggtggattcaaatccccaaacaggagtagggtattacctctcattgagagggccagaacctgtctaaatctgttgtctctgcattcatccagttttaggtctcatgcgctaccccctttatattgctgaaatcttgtttcgacactaaagatactgcaattctgagtccgtgaagtagtgcttcatactcaccacattatgggaagctaaaaaatgaatctacaaaacatagctaagtcgttctccagtcggggaaatcaatacaaccccagcacctgtgcctaatattctcttcgacccatcaaaatgcatagtctagtactccaattttcgaaggcgtgtcttactagcacttggtccactcggcaacaaaatctggcaaggcttgaggcttgattgaagtgggtggcttgaatgatatgtccaaagacatcaactccaaagcgcactttgcaatacgactagtcgcctcacgattgtgaagatatctccgagtggaaaagatgtgaacaccatgactaagtgactttgaaagtaaagggccaacttcctaatggtattagaacaccatataacaacttttgtacctgaggatatcttgtcttggaatcggccaaaacttcactaacgaagtagattggtcgttaaactttttgaacatggccctcttcctctcgctcaatgacaagcaccgaactcactacctaagatgttgccgacacgtattgaacgcgctgatgaagcctgaaggggggaggggtgaataggctgtccctgaaaacttaaaaacaaatcgcagcggtaaaattcaaatagacccggaacttcctggtaaggaactccagaacttccggcctaccaggcccggaacttccggtgttcttaggacaggaactttcgggttacagaaggaagatgaaattcaaattttgaaactggagactaagttaatcttcacaagatggtgaacatgtattctaagcagaggatagatcacagaatcatccacagaaacatcatagaaagagacaagagcgatttttttcccgaagttcggatcttgcgatcctactctcctttgaggagctccaaagagctgggtctcgattaaccccttgcctcacttgtgcaaaaaccccagagaaaatccacagccttcaaccccaaatacccctaggcaaatttctagaattgaatgaccaccaagatataactcaacctatttctagaaatccgccacaagtgtgggttgctctagttggaaagcctctagaatctcagcacaagaacttaattaacttacctcgttccctttcggaggagaggagatccttcacaaacttatccgggacatcgacaatatgcaatggattctcacgggcgacacctaactgtcacgcccagaaattcccgagtaggattccaagcagaatgtgcattaaaacccccgtccaggaccggccagggtacacaaacgacaaagttgacatatagatccacgtcttacaaacatcataaagtcttacataaatgcagcggaaaattaaaagataactggagctaagccttgacttggaccgcagcgggatcaccactccacaggcatcctcgacggcacggctaagcctactcctcggagaagccaccatctgacgcatactcaaactctggggtttggggaaaatagagcaagactgagtactacccactgtactcagcaagtcataccggaataggggtatgatgcagggaattatcaagggatagctacagaggttcgtttgcataaagcgagcatttataaacagtagttggaagcagtaaaacaattgtaacaattaatcaatattaatcttccactgtccaacgctacaccatgttgcaacaggcccaaccatccacctagactactcaaattcaatagactagactagggtgaaactaatcatggtgaatctggttgaccgcccataaccgcgggcacggctattcgaatagttttactctgatcagaggtgtacaactgtacccacaagacacagccccacgacacgcttccgtgcaacgacatgccaccacgacataccggatagaggccgtgacaggacccttcgcataaccccctctaaccaagcacaccacacctcaggtttcacccccactcctcgcaaggcagcggacagtcccctctcgtgcctaggtgaatccggaagccgcataggccgtcgcagggcctggatgcgtcagctagaggaaagctacactacaagcccagccgttgcccacgttggcttgtggtaagtacgaggaattcttccagggtttcccacaaaccggtccttaagtgccatgggcgcgactagcaaaaccatccacccacaacccaccatttaacatattttaatgaagcgacaccaggatggtggctctaatccaacatcaacactagaacctgaagtctatacattaatatgatttcccccattgtgtgctagttgaactaagcatggctaagcaatccctagtccaatatctagtcatgttatatcccaagctaacaaaggaacatggaacaaaatagcatggctataatagtaggtaaacatcccacggtaacagtataaaataatgtagtatttgaaagaaaacaatagagcatttgcaatataggatcaacatgttcaagtgacaagcatgacttgccttgctctgctgctggaggaacctcggcgactatttcaaagtacaccggagcgtcgggagagccggaatctaagcggcatacaaagcaaacaatataaactggctataagactactgaaacaaagaacaaaaccctttttaatggattctatgcatttttcttgatttactgagacttgaatgggcttaaagggagctcggatgaatcagatatgaattttagaagattcactgtgtttttactataacagaaaaaatccttaattgatttattgagcaataaataaatcccgggagagagaggggcggtgccgacatgcgggccccacatggcagtggctgcgagcgctggtccaggggaaaaggggcgacgcaccacgtggtgacatgtggcgccgacgtggcacgcacgtggcggcctcgtggcagccacgcgggcggcgggatcggatggccccgatctaccgcctggtagatcggacggcggatgcagctcgcggccggcgcgcacgggcacggctcaagccggcccggcggccatggcgcgcggcggcgaacggccggcggcggaggacggcggtgtcgtggcgacgcgggcggcgatagcgacggctaagcggctaggcggtggcgcggcggctaagcggcacgggagagagggagaaaggggaggaggggcctcaccgacgacgatcgacgatggcgagcgatggagggcgatggcgacggcgagacgagctccgggaccacctaagggatcaaaagggatgagttagagagggagagggaaaccatggatggctagggcggtgaccgaaggcgccggccatggcgaagctcaccggcgcacggcgcgtgcggggttccggcggcggattactacggaggaggggtggatgggacggcccgcacgacggcgaacgcgacgacgtcgacgacgcggctcggcacggcggctagcggcggcggcggcggcggcggcggcggagaggaggtcgatgacggtagggtggtggagtgcacgggagcgggcgattgcaaaacgaaaaagagagaggaaggaacgggggtgctttatatagacacacgagggttgatcgtggccgggagaccgcgatttcgccggaggagtggggagaggtggggaggagaaagaggcgggattcaaaaattgaatcctggccgtgtcgagcgctggcgcgggttggagagagggggagtgggcgcggggacgtgggcgcgagggcgacatgggcgacgtggcccggaagacgtggttgcagggcgcggcggtgccggctggaggtgggagacgggcccgacaggtgggccccacctgttggcgacccggggagagaggaggggggctcgggcggctggctggtccgtgtcctgcggccggcccagcagggagggagagagaagagagaatgggcctgtggcccattcgaaagagaaaaagggaaaaagaaaaagaaaaagaaggaaatgaatttttcccgggattaaatattgcttgtgctcaattttaattggttaaaattatttctggagctctaaaaattccactaaaaatcttgttagcgtatttcgacatgtagaactcaagaaaaaaaattccacatgccaattctgattattatttgcattgatttattagggtttactcttgcttttacaccggtattttcttgagaccatttataacttgaatttaggcttgggaaagaacttcagggtgtgacaaacctacccccccttaaacggaatctcgaccccgagattcggaagagctggtgaagaggtgcagatgggcggcctttaactcatcttccctttcccaggttgcttcttcttctgagtggtggctccactgaaccctgcagaacctagtgaccttgtttctagtccttctttcactagtctcaaggatacaaactggcttctccacataagttagatcttcttggatgtcaatatgctccgaatcggcttgttcttcgggtaccctcaagcacttctttaactgggacatatggaacatgtcatggatgccgatcatgttggatggaagttctagctgataggcgacttctcctcttcgttccaagattttgtatggtcccacgaagcgtggtgtcaacttgcctttcgtctggaaacggtgcactccccggagtggagtaacatggaggtacacataatcccctgcttcaaaagtcgtccttgtgcttggtcttgattacaacattgtccatgtaagcttccacgttgcagctaatatggcttgaaaaacatctctgaatcatgcattgataagttgccccatcgttcttcaaaccaaacggcatagtgatatagaaataagcaccaaatggtgtgataaatgaagtcttcaagcagtcagactctttcaggctatctggtgatatcccgagtagtaaaccaaaaagctgagtagctcgcagccggctattgaatcaactacctagtcaatgtgaggcagcccaaaaggatctttagggcatgacttgttgagatccgtgaaatcaacacacatacgccattttcctgttttcttcagaactagaactgggttggccaaccagtcgggatgaaagacttctttcatgaagcctgctgctaatagcttggtcaattcttccttgattgcatccttcatgtcctgtgcgaattggcggagtcgttgcttggtatgattaccgtattatttaacatttaaggagtgctcaatcacctttctaggaataccaagcatatcagatggtttccacgtaaagaaatctttattagcttgtagaaaggtgatgagtatgctttcatatttacaatcaatctctgtgcctattacagcagttttggtaggatcagatggatcaagggggattttcattgtctttgcatcgccttctccagtcttgggtagcttggtagcaggttcttcaccctcagctgatgttgatgcaactagtcggatctcctaaggagcgagtgctgtctcacaggtttgggccatctcacagctctccttatcgaaggtgatggcttgcttgttgtcgcttcgcagagatatgactccgcgttgtactggcatcttcatcatcatgtaggtgtagtgtgggacagccataaatttagctaacgccgggtgtccaagtatagcgtgataagccgtttcgaaatcagcaacttcaaaactgacgttctctgtacggaagttttcccgagtgctgaaggtaaccggcaaagtaatctggccaagaggtgtggatgacaaccccgggatgactccatgaaagggcgcaatactcggcttcaactcagttcttgggatttgcatctcgtctagagtcttggcgaagaggatgttcagtgcatcgccaccatcaatgagagaacgcttgagcttgattgtcggcccctagttttacaacacaggaaatcggatgcattttgttgaaaccaactccctggatcggtaggttggtacacacatcatacatcacatggtacaacagagtctgcacgattaagtcttacaatacttattgatacacgggttgcccaagtgggtcccgaataggccttatatggccgagtacaataccaaaaagtagagaaggggaaaaaggtgagcgtaagagaagctgcggcggtcctacgtctccacaagcatcgactggggatcactcctatggcgcctcctggggttcactgtcttctgggatgctctcaaacagttccgcagcgtcggtcaggtctaggagggttttcagaaagcaagagtgagtaccaaccgtactcagcaagccactaccacaacatgcatttagtgcactcaggaatacaaggaaggctaggttcatttgcataaagttaatttgcacaactcttttcacaaacctatgacttagcatttttaactaaaaacaacattaggttggagttatcattcaatctacgagggttcatcccctttccccaaagcctcgcttggtccggctttaccctcgcatgcagttttccctattcccatcattatcatgaccttcccgcccatcgggcaaggtcacaccactttccttatctaagcaagattaaaaactatgaggctagtcaagcatagtacaagtcccgatgctcattaaccgcaagcacgtctattcgaatagatttgatttactcacactgtagtggatgtatgcttttaatcctgcactccgcggcttgccaaacacataagtctagtcccaacacatgagacttgccacggcccagtttttcagtcatcctagcgtttcggcacccgctccaaggactattcacccccattgcacccccggcacaaaacaacacctcgagccggcggtgaggagagtcctggcgctcccgatatctcaatgggttaaattacatataggttaggtgcgttttagttttcccgggtaccatacatcacatcccttcaccttaactcacaacatacttcagaaccaccatgacaggggtgccgccccacgaggatttcttagtccaccaggtctatacccactcgagaagtgcagtcatactcttattgtttcctgcccaacttcttgactcagtctttaattgaccagggacggcggctagccatttctaggaccaccaatattctatccatgccgccccagtcgaaaacattttgttccattaggtttttggtttttgcaaagctttttgtgctgcgggtggtgcacatgtctccacccgccttctggcaatcactctcgatgagtgaccaccaccaacacatccatatccaactactatggagtgtataatcgtctatgaataagcaatattaagcaatgtcaataattgaccacgcataaataatagactcaggcaacaaggatataataaaggtaacaatatcaaggatggttcatacacaaatttaggtacgcattttataattagcatgcaactttatttataaacaaaacatttataaaatgggttcaacatgctcaaggaggggagcgtagtgacttgccttgttcagtcagtagttcggcttcgacaaactcgtatccgtcctcacacacgtagcctgatttgatcgggaaacggagaatcacagtctattctaagactagcggaaaaaagaggaaaaacaaataaaatagcagaaaaagaaaatgctaacccaagctcattccgaagggtttgggataagaagaattttagcgaaaggttcttcaaaattcgacttgagatgaacaagtggtggcccctaaaagatttggaaaggaattacaaaccacaggagagacagaggacccacatgtcagcccatgtggtcttttaacagccctaggcccatctgtcagccttgctttagtggcgcagctaaaccggagtgaggtggtgcatgtgggtcccatggattagtattaaatcggtaattagggatgaaaggaatgggtggtccccacctatcggccgctcaggcacctcccccttcttcctccttcctcctcggccttgcgcacgcatgagcggcatcgccactagggctgaaccatgccggcaacgaggggtttggaagatagggcggacagtcagggcgggtcctatgtgtcacatcctgatttttgtttcaggatttataaattatttaataaattattattagaatttatattaaatgttcattaatttacaagtgaagttaaatgtgggaaataaaatttcctaaatataaagcatggatggatttaatttttattaaattctccatgattaattatactctctggaattttctcggatttttcggagctcaattcctaattttaatcatacaaagagcatttcagtaattacccacatattaaattaatcattaaatggtctaattataattttgttaagtactttgagtgtccaagtattttcaggatttttcttggaattatttgagcattggaagtatttttaacaattgaaaggtcatctcattggttaatttatttggaaaagtaaataaaagtcctcttcatcagcttgggccgaattcagcccattccctcccttcctctcagccggctgaaaagtctagtttgcctcccttgcactacagtgctccttcttccagctctggacagagccagagccgtgccgtgcctgttgccgccgatccccttccaaaatccaacctctccgttgctcttatttccgaattggttgcgggaatggaatcctctcaatctcctcttcctagtccccaagaaatccccaaaagtttatatggaaatcctttccaatttcgcggttcaacctttcctttttccggcgaagatctaaactttcccgagtttttcccgtcgttgtgggctcgatcccggcctcccatggctatataaaggaccccctagtcgtcctctactcatcccctcaagtcccgtcttccgccgtcgccggaaacgctctccccacgctctccctctctctccacctccggccgccgctccagccgccattcgccgtcgccccggccgtcgccggtcagcgccaccacctctccgcaaagtcgagctctaccccagccacccgttcttttgcgccgaacccctccagaagtcgccgtcaccgtgaaggccgaaccgttgccatgttttgatctccggcgaagctttgccgtcgactccgtggtcgccggacctcgccgtatccactgtcggcatcgcagcagtgaggagaaacccggcagccacctccgcgaagacgcaagccatcggagcaccgtcgtcaccgtgaagccgatctgttccatcttcagtcgcgccgtttgtcgtcgtccgtcgtcgccctctgtcgccgtcgactccattgggttcgcaggagcaaggtgaagcccggccatcggttatttcttcgccgaagattgctgaaacgtcgccgccatcgctgacccgaccccgtcgccgcctctacctcgctgccggccgtctgccgtcatcttccatcgtcgcgccacccctcagtgagctttcctctctccgatgtcgttcaccggtgtagtttatccatagggtcttgatctaatctaatctatttcgcaggttgctttaatcttttatctcggttataaattatttgtaaattgtttaattaatttagaatagtcttttctttaataggtttaattggaattaaattttgtaaaattcgtaactaattcatatgaagtcagaatgaggctgttcaagtctcataattcatctaaaatcatgatttacatgtttgtttactttatatgtattgtttatttggtttttattagtctttttcctcgttttgcgtgttagcttgtcgtttccgtcgtttcgaaggttcgtgagtgcgtcgggagtgttcagaagattaattgaagaccgattattgcaaggcaagtcacacagatcctaaacacaatcctttgagcatgttgatcctatatttaaattctctatttatttcaactgtgcatttattttcgaatgtcaccgggtggtgtgaacttattcctttcttatggccaatttgcattgcttaccctatttcttgattacctcgggttataatttgactagttggatttatatattggttcaactagatgttagatataattgcttagccatgcttagaaacattagcacactattgggataacttatgactcactattatttaatgatggcttaatgatagttcacgagggtcaatcgtgattggttaattaattaaattggtaattaaaatatgattaatggtgggttatgaggacatggttttgaaggtcgtgctcatagcaattaaggaccggttcgcgagctactgttgtgaaacattaaccatgccaaccacaagccagcgtgggcaacggctttaccttttgtatagcatggttcattgcggagcaccagactgagaagtggcggagataagcccacgggggtcgctgggtaatccatgccttgttttataagggggtgattatgatccaggaatggtgcactgtggtgagttgtgttgtgcagagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgggttgagcaatgtttttcgtgattagtctcacacctctcacaataattattgatgctataactggtaataatttgtttagctcctggtttggagttagatctgtgcagccgggtatggttgttcaggatggttgggcctgtgcagcatgggtgtgctgttcagtgttgattaaaatttctgattaattactccactgttttacttctcttaaatgttttgttaaatgctgcttttgcaaatgagcctatattatgccatcctttggtatccttgtgcacttgcatatttgctgtgtggcttgttgagtatgtcatatgctcattcttgcaataatcaatcaacctcagttgaagaaaaaggattcagaaggagaagacgtttggcttataccccagttgagctgcctgtgggagtggagctgaagccatcgctagaccattattccgctgctgttttcttttcttttgtaagtatgtaatgttattattatgatggatttgtatattaaattgtcagtttgtgtacctcggctgattcctggacgaagattttatgcacaaataagttcggaaattactagtgaatttccgggcgtgacactatggaacctccgccgtgtgtgggtggcggcgtgtgggttatggtgctccgaggcgaccgcaatgcttgggtgcggcggcggcctatgcacacgcatcctggacaccaactcggcgacgatggtggggtgcgtgggtgatggtctgggggtcgggggaggtggtcagggactcgacggagtgtgccgaggttgagaggggatagcggggacgcccggaacgagctcgcaccgttctcacgctcaatgcggcggtggtggaatccggctcgtcgacgataggttgcaagggtggagaggaggtggcggggggatttgtgtgagtttggtggaggttggtggatggttatcccggggtcgggatgaccggtaatgaagagcaggtgactagccacgacagcgcgcatggccgaccggcggcatggcgagggtgccggcgaggggttacattaggtgccaaatgctgaggggtttatcgacgacgcgtggtaagtgtcctctggcacgcttacgtggttcgggacagcttggacggcggtagccgtttggtccgggccacgcatgtcacgaacagagccatggagcgcggcgcgtgcacatgcgtgtcccagtggcacggtcgaaccgacgaccagggaaacgccatgggctcagagggtaaggcgctggggacctaatgtccagccgctacggccagcaaaatggcagccattgagagttgcgggggtggcgtttcacccactagtgg

SEQ ID NO: 42169 - DNA, 835 bp, Oryza sativa
gtgctagtcggtgttcgtcctggttcaagagaggttcgagggtgttcgagcaattagattgcaagttttaggtgattaattagcgttcaatcgttcgtccagttcatagcgcagctccctaccccccccatcttgctcaacctaagcttcggccggaggcgagctgaggcgaagcaagcggagcggcggtagcccaagcgcaaggagtgatagtggagaagaacgagagctagaggagacagagatagagatggattggggcgcatggcgcggagaggtatttatagagcatgggcatgtgccgagcggatgatggcgcattgaatatggcctccgagtgctgggctgtcgccgttgcagaggaatgttggggaggcggtggcaatgggatggcctccctgtgcagcagggcacgtggcggcgaggtgcttgaccgcgcggggacaaagcgacgcgattcacgtgacgccgtcgcccggggtagatgagccgccgtcgccaccaacctacaccggccggttgcgttgcattgatggtcgcggttgccccctctctccgtgccgttgagtggagcaccgagccgggcggtgtctttgccagagctgggtgtcacggcggcggcaagccaagaagagcttggggaagggcaagggcgagcccgccggcgagatgggcgtggtaggcgtcggaagggatggtggggctgggagcgtggcgccatgtgtgaccgcgtggcaaggcgttgcgcggagaaggggatcgagccccgtcctcttgtggtgtcggctcggctcggctgagctagggcttccaagccagcctcaaaaagagggga

SEQ ID NO: 42170 - DNA, 1727 bp, Oryza sativa
tcgtttctgaccgttttcatccctagctgccgatgatgagggagcgatgctcttgatgtctatcggggggagagtggacggagttttcccgacaagccatgccatcatgacgtgatcttgaattagcggcgctaaggcttggtttgtgatagtcttgagatcggagaggtggagaccctgactgccaaatggtgtatgaaccgaggcagagggctgccgagtgcttccctagttgactggactgaagcgggaaggaagacggagtcgtcgatgcccgaaacgaatcctattgcagtagtcggcgaaaaacttgatgtaacccctacttggcgcgccaactatcgaaacaagatttcggcaatactaaaaggggtagcaatcaagctggaaaagtggatgggtcagtagagaaaggtttatacaggttcaggccttgtcgatgagaagtaatactctactcctgtctggggaattattccgccgagtgtattattgatctaacgatctgggagaaaagttctgccgccctaggagtactcggacccctccttatatagggggaggaaccgagatttacaatgtacagcccatattacttacggactaggctaacagatatattacaattgtaactaactaggactacgggatatttccttgatatacaaattaatataattcccgagtccttttctaaacatattctacctgtataagctatcccctatacacagtcggatatacttgccatgtgggtatgtggtacccataatctccacaatttgtgtgcttaaattcctaaaaaaaatattggcaaagaagctgatccttactgttcgtatacgagcagttcctttgttgcaaagcaatgagcagtaaaactttaaatggaatttgaaatcatatgactttcctgcaaaaagttcaatccaaaggaggcttaaaaaatatcgtgaattgagatcacctacagttgctagtatcatcacgtacgaccatcgttggatctctcacatcacacaacagtattgtccattactctctctatcccataaagaagcaacacctagctacgcaatgcaaaattaaataagaggataaaggaccaaaataccccttattaatagcaaactagtattggcggatattgttgacgagaaatccatgctcagccgatggtgccagaactgtgttggtgcgaactaaatcgacgaacacaacggcttggtagatctgcttagctccagtgccggtccaaatcttggtgagatgcgggcgtgccagtcagtttgatcctacaactgacaagatatacaaagagctgatcggctatgttaacgaccaaatttggtaattcaagtatcggagatggaaccgaagcggaatccaagatagagatcgttccggaaacagagcaagagtcagctaaagtctaaatcagccgcgacaagaatcggcagagttcgagtcggataaggttagccgattgagccgattccaacaatgtgactcggtacacgttgtcaggttgagttaatgtgcttcatatggattgccacgcacggattaagtcctgaaaaggcaattgtatctattagttcggatattttatgtaatttccttatagataagtttgggtaaaagtctgccgcaaagacttatggtatcttagagtttgttagagataagagtcatgtccgataaggacattttgtatctcgggtata

SEQ ID NO: 42171 - DNA, 748 bp, Oryza sativa
aagtgcaaccgcagtttaacaacttccaagatcagattaactatgcagcgcaacatgctttgatcaactaatcaggagacctagtcaataccttaacaaacatggtaaagtctgtggttgatggtacaatagctgagcatcaagttgcgggaccagtttatctttcaggaggcatcttcccatattacaaaaacttggtaactggtaaccagaagtttgctaccaatgcaccaccaattcagccgatggcatcagcttcgactccagcaccacctgcgccatcatcggcaccaaggcaaataattaataatcctcgcctcttgtctagcgaacaaccgcaacatgctggtcagaatatcaatcggctgtcccgggagcaaattgcttgaatgtttttgccaactcagccaactggtggaccaattcagcagacgccgccaaggcagcagacagttcagtcgattcaacagcagacaactcagccgatacagcaacagatggtccagctgatgccgactgggttgaggacgcctgataatcggctgacgcatcaaaatgtgactcaggttgtccctgagcatctggtacacattgtacaactagatcaatcggttgcagcctaagttatccctgagcacttagtgcgtaatattcagccgaatttccataattgtcaagggggtaacttcaattatcaatatcagcctccttcgcctcatgctcagtatcaacaaggggctgcaggaat

SEQ ID NO: 42172 - DNA, 750 bp, Oryza sativa
gattctatctatgatcgtaagaaataccaacaagcatttctggcgctgttgctggggaacagttgctgatcattcccaaaccttgctcatcctcgtatcctttttacttttctattctacctttacccctgctatcctagagaagtattcctgtgggtataccaagatcaagaatattctacaaaagacggtcaacagaatgggaataggatggaaggatagattgccagacgcactgtgggcataccggatagcatacaagacacccattggaatgtgcccctacagatagtctacggaaaatcttgctgactccctgtagaacttgagcacagagcatgttgggccatcaggaactggaatatgaactttgaaggagcaggagaatggagaaaaatgcaaattgctaaacttgaagaatggagagagaaggcttaccccaacgcaaagatatataaagaaaggacaaagcactagcatgataaaaggataaagatcaagcaattcaagctaggagacaaaatactgatgttcaactacagggttaagcctcttcggccacggaaaattgggtagtaaatgggaaggacagctcgtcgtaatcgacacctcttcgcacggggcaatcacaccccgcgacgactcaggaaatatattcaaggtaaatgatcaacgcttaaagatttaccttgagccaaatgaaactgtggatgaagaattggatgttattgaattaatcgattattaacc

SEQ ID NO: 42173 - DNA, 999 bp, Oryza sativa
acgacgtgattttcgttgcaatacataggggttattgctaccgaagtctaatttagttacgataggggggcatattgccactaattgcgtagtgttgcgattgtaattttttttgttgcaataagtaggaagtatcgcaacgaataaatctgcgttgtaattagggtgacaatattgccacgctttttgttatcgttgcaatagttatccatgtcgcaacaaatttagagcgttgttataagattcatgtatatagcaacgcgaaactactttgttgcaaatgagtctataggtattgcaacgcaaacctaaatcgttgcgaattagtctataggtattgcaacgcaaacatgaatcgttgcaatcattctttgatattgcaacaatgttgatatttcttacgatccagatagaatccgcaagcgcacggatataccgatgtagcacttcccctacggagtattccaagggtatcaaatccaaaggaacgtgtgtgattatctcttcctccggttcatccaaggaaacaaagctaatgtgggcagaggacagagagaatttcctaatgagaaatattgtctagggaaagcttaactttaatcctaatgcaatacttcaggcactggcaacccgctgctcctagatgtcgctctactatgtacccggactgggaggacttaagtgatctcgagggctgtcaccacctctacacctacctcaacgtactgtggaatatgcagcaattactggataataattacctaaataccacatctaagtaattaatatctactttagtgtttataactcaccaaagcaatcactatattttagttgattataatgaacaataatctcgtatgctatttaggaactaaccaagagataattctcacaagataaatctaaattactcaggaagaatattacattgaattcagagtaataaacagaataaaaaaataggagaagattactgacaactctaggattcttccg

SEQ ID NO: 42174 - DNA, 7594 bp, Oryza sativa
taaatactcaggatgatatttctattaaagcagagtaattaacaagatacaaaaataggaggagattaccgacaactccgggattcctccaattccttctatcttacactctccctattctaatatacaataaaatacactagagcctcttgtaattcagctcatgctttggtttgtgtgaatgagggagaagagaggggtatttatagtgtggaggtaacttgagagagtggagatgcccgcaatattctccatagaatccaaagagcatcttccttctcctcttgccatgtgtccttttgatgacggtttctaccagtattaacgctcgtaactgtcataggatgaggaggacaaccgtcataccgaagttgggctggattgggctagctgctagttcccctggcccacatccttttcaggatgctgacatgtgggccctatttttatgatactccatgatttgactccaaatgattgcacattttatatattgtagctcaaaaccatgtgagtccgttagtgcaaaatatatttccattctttatgctcactctctcccatgtcactctctatcacctgcatacgaatatacaccaacactcgtggaaattgttagaaatacatcctaccactatgttagatgtttcacatttatgattttatacaggtattgacggtgttattttggcacttaacagccgtcaacaaaccccccacacttagctctttactcgtcccgagtaaaggttaaggattaatgaggaataaaatttcccaagatataatacaagtatacaaaatatgttaagccacacatgtacctgtgaacttttgcagtgtcaaacttaccatcttgggcaattgatgaatggaacggtcgtaactcaagtccatcttattcctcctgtcaatctcttagggtttttttatattttcgcaaagtagttgtactcctcaaatgaccttctctcagatcactcatgtgattttatttgtcgatcctcaccaaggcatgtttgccgaattgtccctattctaacaggctatagaggtggagctcggtagggatcaatccaggcatacctgcatcacatatattacaaagccaaaataccggaccaaaggagatagcaagtcatactctctgatcaagaatgtgcatgtgtgtgatatatgtatgggtatgtatgtgtatggttgttttatgggtggaaaatggaaaattgaagacaacaactcctttgatatacctcctcctccaatgttctttcattggaaatatgagagagtgcatggctacctttttttcttcccttttttttttatcatgccccatactttgtatgagcaagattttttttattcatttttttatcaacgctccatacttgtatgagcaagactttatcttttttttttcttttgcatagtcatacctctcttcctctctttttttttctttgaaagaatttcgaagcaagaggcataaatgaggtggagtatttattttgtggataatggataaaataaatgatggatgagagatgctagcttccagtgtagaaatttagcataatgtgtgtatgtcgagtgtgcgtgtaatcttgatcatgaaagtacgaaaagcatctcacatgggtcacaataatttgacaaagctcgatgtaatgtcaagcagcatatatatatatatatatatatatatgcttatatatgctgctatatatatatatatatatatatatatatatatatattacatggcgtctctgacgcgctaggaaatagactcttccctccgtattttccgtttttttctcctcctgccgcacatccctcgtgcactcatccagtagtaaaaaacttacttgcctttttccgcatccacatgcatccatcgtttccccagttttctcgttttagtttcttaagttgcggcattgaccggtcctccccggtttcagtaaaaaaaaaataatttccttcctcctatagtccttacgcatgtatcaattgtccactagaaaaatcactgcttcagtaaaataacttgcttcctgctcgccattcatccatcgctcaaaagtaaaaaaatcactataggatcactatcttctctctctgtttcatccatagtaggagtaatttatttacttgaggtttatttcctcctgctgtttccggattttatgctcctttcaattcgtacccacccatccatccatgcacagtttgactggagtaaaaagtttgtacatggtgctttcctttccttcaactttccatcaatagtaattttttttactagagagtaaacgtaaaagtttactgtagtaaaatttttactgaatccagtccttttataatttagcagtatattttcttccgtttgccatttttattcagctcgagaacagagaaatgtagatggtagtaataacttgtcacatcctgattttcgttttaggatttataaattatttaataaattattattagaatttatattaaatgttcattaatttacaagtgaagttaaatgtgggaaataaaatttcctaaatataaagcatggatgaatttaatttttattaaattctccatggttaattataatctctggaattttctcggatttttcggagctcaactcttaattttaatcatacaaagagcagttcagcaattatttaaatattaaattaatcattaaatgatcttattttaatttttttaagtactttgagtgtccaagtattttcaggattttccctgaaattatttgagcaatggaagtatttttaacaattcaaagatcattttggtgattgatttatttggaaaagtaataaaaatcctcctcctcagcttgggcccttttcggcccattccttcatcccttctctctgtcctcagcccagcctaaagtctaattatactccctctcgctacagtgcttctcctacctccagccggctggacagaggccgtgttcatcccgataccggcgccaatctccgccgaatccggtcgctccgttgcttcccttccaaaattgattgcaaaaacggattcctctctatctcctctatcttatccacaagaaacccccatcaaattcgttatctatctcacgaattttggccgtttttattcgggtgaactcggataaatcctagcttcctacaccaaattcctccgttcccgagccgatctctcccttttccggctataaatagcagtcccaagacctcctcttccgttccctctttttcccgagtttttccctagccctagccgcctccccgcgagctccctctctctccacctccggtcgcctctccagccgccgtgcgccgtcgcctcggccgtcgccggtcagccccgtcacctccctcggcttcgcaagggtgagagctaccccggccgccgttccccttgcgccgaaacctcgccggaagtcaatctcaccatgaaccagtgggttgccgtcatgttccgatctccagccgcgccgttcgttgtcgtctatggtcgcctttggtcgccgtcgcttccattggattcgcagctgcgaggagaagctcgtccacccctccgttgctgctgctcgtcgccgaaacaccgtcgccgccgtggacagtacttcgccgccgtcggccatctccctcgccgtctgtcgtcgcgtaagtggtggtaaaggtcgccttgatctcctctctcacccggtgccctcggtttgcatcattgtaccgtggttcgctggtaaccgccgttcccgtgctcgccggcgtcgatcccgcgtggcagccatgtcatcgctgacatcagcgccatcttggccatcaaaatcaatataaatcctgttatctcttttcaatgacatattagttctttttactatatgtcgtctactaaattcattacaataatttccggaggatgctttagtcttatatctcagatataaattatttgtaaattgtttaattaatttggaatagtcttttctttaataggtttaattagagttaaatcttttaaaattcacaattaatttatatgaaatcagaatgaggccgttcaagtctctaaattcatctaaaatcatgatctacatgtttgtttacattatatgtactgtttatttggtttttattagtctttttcttcgttttgcgtgttagcttgtcgtttccgtcgttgcgaaggttcgtgagtgcgtcggaagtgttaaaaagactaattgaagactaattattgcaaggcaagtcacacagatcccaaacaaccctttgagcatgttgaacccgtttaaagctaatgttttatttcaatttatgcattattttcgaatgtcatcgggtggtgagcctttcccaattaattaatggccgaagatgactttatttttctatgggttataatttgattagctagaaccttatatattggtttggttcagctaaatgctatatatatatatatatatatatatatatatatatatatatatatatatatatatatatgattgcttagccatgcttagaaacattagcttactaatgggatgaatcacactacattattatttatggttatatttaatggtagctcacgatggttaatcgtgttatgataattaaatgataattaaaacttgtcgatggtgggttgtgagcacatggttttgaaggtcgtgctcatggcaattaaggaccggttcgcgagctactattgtgagacattaaccgtgccaaccacaagccagcgtgggcaacggctttaccttttgtatagcatagtttattacggggtgccagactgagaagcggcgagaagtccatgggggtcgctgtggagtccctttgcagtgccgtggtggtacttcggggtatggcaatatgtgtggaatcgtgtcttgtgggtataatggtacatctctggctagagtaaaactattcgaatagccgtgcccgcggtcatgggcgggttgagcaatgtttttcgtgattagtctcatacctctcacaaataattattgatgcaataactggtaataatttgtttagctcctggtttggagttagatctgtacagccgggtatggttgttctggatggttgggcctgagcagcatgggtgtgctgttcagtgttgattaatatttctgattaattactctactggtttactcttaaatctttgctaaatgctgcttttgcaaatgagcctatattatgccatcctttggtatccttgtgcacttgcatatttgctgtgtggcttgttgagtatgtcatatgctcaccttgcaataatcatcaaacctcagttgaaaaaaaaggatccagaagtagaagacgtttggcttataccccagttgagctgcctgtgggagtggagctgaagccattgctaaaccgttaattccgctgctgttttcttttcttttgtaagtatgtaacgttattattattatgatggatttgaatattaaattgtcagtttgtgtacctcggctgattcctggacgaggattttatgcacaaattagttcggaaattataagtgaatttctgggcgtgacataacttatttggtaaaaatctctccaaagttagtaaaatttttactcccatatagttctcacattaattcttctacttgcatatattttgcgagttgtcatagtaatatttttactcggatatattttcctcgtagtaatatttttactcgtatgttctcatagtaatatttttactcatgtcctcatagtaataattttactcatgtattttactacatgttctcttttactcccatgaattctcatttgttgcttcatttatcttagaataatatgtgaaatagcaatatgttaccgttcgttttgttaccttgaaccatgaaaatttgattatgagtaaataatacaaacattgtagaagtcactatgcgggtgaaaaaatattacacatcaagctagcccacaaaaacaagaaatatgttcttctaggagtgaggaagaacagctggcccagcattggatagccggcgatagtaagcatctatcctggcttgcttcaccacgtgacgacgtggtcggccttgacgccgtgcgtcccaggctcctagtccacacatcggttgacccatcaccatcgcacatcaccagccatgcgccatagatctgacctcactagtacagatccttccatctgtgacggcccataacaagactggaatttgcgggccgtcataaggaagtaatctcaatcgggccgaagtttcgcccgattgagatatggtcgcacagccatggtatatcggcataaaactaaagcccgtcacggatgacacttatctgtgacgggctatagttgaggcccgattgagatgagggttccatatctcaatcgggcctaaaagaaacccgtcacagatgagggtcatttctgacgggctccaactagaggccagattgagataagtttattgtccgtcacagatgacactcttttttgacggccttttattaaggcccgatagagattacttgtatgcccgtcacggttgattgttttagggccattacagatatttgttgcacagtataaataccccccaccacctagtgtaactgtatcccactgttcactattttggtgggaggctgttgggggcgattttttgtcctttttccaaggaaaacagaaattaaattctcaaaagtgatcaaaatggatcaatcaagtgagtaatataaatcattaattgagcaattttatcacgtcttacttttgcaatactgatcttataatatgtgcctctaatttattttttttattttgtaccaattgatcgaagttggatgtatgccaaaaatttgaaacgtcattctacggagtaccgaaagagcgtaataaaatttatgaacgccgtggaggaggatcggataagaagaaacagtaattacatgtgttgtccatgtgcagattgcaagaacgagaatatgtttgatagcggagaggacgtacacggtcatctgatacaacgaggattcatagagggccatacatgttgggtgaagcatggagagcaagaattaggaagtggagcagcagcagacagaagtggtgcgcataatcaggaagatgaaaatgagcatgaaatgtttataccttctccattgggcggtgaaatggttgatgtggatcacgatctgctgcaagacatgttacgtgacgttgaggacccagcccagaatgagagagatggaatgaaattcagcaggttggtaagtgattccgagacgcctttgtacgttggatgcaaagcaaaacacactaagttgtcagttaccttggacctaatgaagctgaaggcaagtagtggatagacagacaagagtttcacagatcttttaggaattttgaaggctatgcttcctgttgagaacacattgcccaagacgatatacgatgcaaagcaggttctgtgtccactggggttagaggtctgtagaattcacgcttgtcccaacgactgcatattgtaccacaagcaatatgcggactggatg

SEQ ID NO: 42175 - DNA, 6393 bp, Oryza sativa
aaaaaatgtctggtcagatattagcagtaatatttgtatcatcaatcactaaggatacatcttctccagactctcaagaagcatgacataactattcaattcattaccaattctctatgattttaaaatgtattatgaacagagcatgtacacatattaaaaaatgcagacaatatgaatgtcttacctcctgtgtcaatggttgtttactctgctccgacatcactttttgaatctccttcaccaattcatccttgagataggctttaagttattcctgattttcgtgttccttgcaagttcatcctttaatatctgaacctcacgagcttgttcttcaactatctcatgaagttggtgttttgtttgtttctcaaaatatccgtgtccacgtttctatgttgattttgttcctgttgtttccttgtatgtgttctggaaaacatcgtcttcttgacccccaaatgtgacacttcttgatccttcatcacccgcctcatctgaatctgtcatagccaacttccttgttgtattattctgatgcaaagaaaaaaaatgtaagacatcgatttaggtaatgttgcgactcaaataatatcttgttatgtgcttgaaattacaactcatgtaaatactttcagacatcttatttgaccattttccgtgcctcgtgtgagtagacttccaaagttccagaacacctggctcagcaccagtttcttcatctctctacgaatgaaatattttgcatcattagtattcatttgattattattttgttagttcatctgaatgtaaaacatattcacctgttcccaactacactgagagaatggtttggaacccataagatgcatggttttcatttgttgcctattcgtagagttctgggtgctgaccttctgcacagataagacacgcaacgttcagcaattagcaagtacaatatgcacaaacgcttgtgttattaattgtacaaaaaagtgcctcaccttaaattttttggatccaaagtacatgatcagtcttgaggcttatttttcattctgtcttcataactgtcatatgccctgtacgtagcactaaaagtggatcaccatcctttgtatcgttctttggcaatcttccataccatctgcctagaatcatcattctgcgggatgtcccatgaattatgttggaaacattacattcaattacattgagaacataggtgcaaattgaaaaattcatttgcataacagatagaaaagaataaagatgtggcatatacataccattacacaatctgcaattgaattcttgacatcttgcttcacatctttccactttctaacaccaattagtggagtccttaaccttgtgtacattaccacttcatccacaaatgtacgcctattgtctccacatggaccacccagttttgctgaaaattcaactttaagtttacgagaagatgacttcaacctcttggtaccatggccaacttgcttgccatctacttacaatcacgtgagaaaagttcatacaaaggattaagtgttgattcaattgcagcaatgaaagtaaaaatttaaagaaatatgaactgaatataaccttgtgtatgctttgttattttcctagcatgagatggccattctatttctggcatgtcactgctgccattgatctcgacaccatctgatgtattcttattattggtaatataagctttgtaagccactgccaaaaaatgtacacatgtgcgctttgtagattataaaaagtaattagaaataataagtactccaaagggaaaaatacatactaatttgtttcagaagcccttgatcccttaaccattcagtgtaagttttaatggtttcgtccctgtaatcatcgtatagatctgcgagataccaacaaaattatgtaagtaaataatacaggtacagatatgcacaacttgctactgcaatacaactagcatatataccatgaacagtttcatcatcctcttggattgatgcaagccattctttgtatgcatcaacctcatcatcatcatcattatcatcgtcacactcttgctcccttggtcactttagaggtgtaatgttgacatgtcgttcttttacttgttgtgtagccagtactaacctgactttcttttctgaagctacgtccctaatcatgcattctgcatctcttctgtaatcaattgcctcaaggcttgctatatcatttccacatctcttcttgtagtacaagtagtcgcgcaagccaaaccctagctactcttatcaaagattcaaatcatatgttacccttgtcaacattggctttgacccagcgctctttggaccccttgcagttgatccatacctcccatatctcacctgtcaacttgatgctatttgtgtggaaaacaaccattatgataatatagtaggaatatcaaacattgatttacatgaaaaaaatatattcagtacacttctagtattcttatatagtaacataaacaaacgagaaaaaacaactctgttttataacatcaaaaaatgaaaatgtcaattaggcgcaaaatgcagccctctgtattatcaaatttgctgacctcatttagtacacactagggcaatgtttggcaaatgagaaagggaaataatttcacacccatctttaaatcctaactatacattctcaatcttcaatttaatcctaacccatcattgattttcccaatcccaatccaatcccatatatcccattatctaatcacaccctaggttaatatgaacatacgaagatgagcacatgaaagatgcgcactagttggaaaaaatactcacctttggcttaacgggtcattcaaatcctcttcttcaaaaacgacgtcggcatcctcgactattgccgtacgaccaagtatacagagacggtccacaggtcaacggaagcataccccgtgtgccaaccgaggcgagtggccgacaaacggactccactagacaccatgcgggctgcacacgtggaaacaacgcggctaccgagcgaacaaacaaccacggtcaccacacgcacccacaaacgactaccgacaccggtacacgggtaccggggtcgacaaacacacaacgggcatggggcgacatcgaaaggacgagaacagggcagcgagaggatggatccttaccaccacgcgatgaggcatgggaacgacgatgatgaacggcgcggcggagacggatgggaacgacggagacgaacggacgacacttcggcggcgatccttggatgaaggcaggacgaggccgacgcagggcttgatgacacggagccgatgacgaagacaacgccgaggctgcagcagacttgacgaaacgcgggcgacgaacgaacgcggcttgacgaagggacgaacgccacgacgaccaagaacgatggcaggacgacaaccggaactggcgaggaggcgacgagggcagctggcagcagctgcacggatgcgaggatgacgcggaacacgccgctgcgatgacgacgatggaggcggcaccgcgggatgacgagccggcaaggatgaacggtgaagacgatgacggacaccggcggtggggttcggatggaggggaggtgatgccgaggacgacgctcgctgctgcgatgccactgttgcctgcggggatgcacttctggaggtctccgagggaaacggagagcaggccggggaaggggaggcgactgtgacgccgggggaggcgacggcacggccggccggcgtgctgacgcggtggcaggggcggctggagttggccggcggcgtaggagagagaggaggtcggcgacggtgtggctagggagctcgggaaggtggaaaaccgaaggaaagggggactagggctccgttttataggcaatggaggggagtgccgaccacaggaggggacgggaacgacgccggagaacgtggccagcggcatcaatggcggtcaaagaagagggattaaatcctagtgattgggggcgggattaaaaggggaaagttgggggaaataatgaggaagggatggggattctgtttttgcaatttatttggccggaacttgcgcagtggagcgggatcgaaggatggcggcgctagggttcaggagagggacagagaggagcggccggctggaggttgaagacgaccgggtgggtggacccaccggtcaggcgcgaggcgcgcacgtgcgccgcgcgtgcagaggggcgcgaggggaggagggaggcggcctggggtggctggtcggctgggccggcacagggcaggggtggcccaagcggaagaggagggaagaggtggaccgggaggaggaggggaggcctgggagaaagaggggatgaaaaagagagggggggaagagagacttcggccgcgggccgagggagagaggaaaggaactttgggacggacttggcccaaaggaaaaggaggattatgtttagtttcctttttaataaactttcttaattgttgttgttgcttaataattgttcttgttgcacacaagcaaagctacaaccttataaagaagcaataacaatacataaaaagaaagcacacggttctttaggttataagaaacattaggagacttgaatgggtcaattcagggttcgtatgatcaagatatgatcatccgaagtttaatgctgttattgcaggggcgtgagcagtagggcaaggacaaggcgagtacatacactccgtgcacgacgccatctgcgggactgcccaaagccgtctcttttcgggtgccttcccagctagcgagcaagcgaccagctgcatccggagcttctgcggcaccaaaaccatctccaccatgataagcagagtcaggtaaaaattcttcgcaggtacccgccaagagtgcctcatctgttgcctcgacgggacgcattcagtgccaccgttgccaagggtttgggcatgtgtagaaagattgccctagtcaacaggcatatgttgctacagaagatggctacatcaccacctccaacgtggaagaggaagaggaagaaggagaagttgaggatgaggacggcgaagtctttggtcgtgatgacacaacggcctataggaccatcattgtaaagcgggtgctcagcacgcaggtacagcagcctgagaggttgcaacgccataatttgttccagattttcttcatcatcaacaaccgtcgtgcacgtgtgatcattgatggaggtagctgcaacaacttggtgagttctgatttggtcaagaagcttggcttgaccgcacgtacacatccacatccttaccatattcagtggttaaacgtttccggaagagcaaaggtaacacaggtttgcagggtttcgttttctattggctcatatgcatattctgttgattgtgatgtggttccaatgcaagcttgttcacttttgttgagtcgtccttgggaacatgataattatgctacacacaatggtaggagtaataaatacacttttgtgcataatgaaaagaaaattacttcgctacctttgacccctgctgaaattgtagaagctgataaagagcgagttgctagtttgaaacttgatgaatctgaaaatcagcaagttgttaaatctgtttttccacctaaaacggataagctttcacctagctctaaggttgagggaattaagttgaagggtggtgttatgcttgcaacaaaatgtgacattgctgaaatttcagatgatgatatttgctattccttgatatgcaaacaagccttggtatctctagatgatattggtagttcgatacctcctgttgttactaaccttttgcaggagtatgaggatgtttttccagctgagatacccccgggattgccacctatgagagggatagagcgtcaaattgatttgattccaggagcatcattgccaaaccgtgctgcttatcgaaccaacccaaaggagactaaggaaattcagcggcaagttcaagatcttttggaccgcgggtatgtacgtcaaagccttagtccttgtgcaattcctgtaattttggttcctaggaaagatggttcttggcgaatgtgtgttgattgtagagccattaataatattattattcgatatcgtcatcctatttgaatgtgtgttgaattattccacgtatgataaggaattgtatgctcttgtacgttctttagagacgtggcgtcattatttgtggcctaaagaatttgttattcactccgatcatgaatcgcttaaatatcttcgctcacaaaataatttcaatcgtagacatgctaaatgggttgaatttattgaatcttttccttatgttatcaaacataagaaagggaaagataatgtgattgcagatgcttt

SEQ ID NO: 42176 - DNA, 1457 bp, Oryza sativa
aaaagtgatgatgttgttcatattgctgatctgtttttccatgagattgttcgcttacatggtatggcttctactattgttttagatcgtgatgcaaaattcttaagtcattttttccgcacaccatggaacaagttgggtacaaagctattgttttctacaacatgtcacccacaaacagatggacaaacagaggtagtcaaccgtactttgggtaccatgttgagggctattttgaagaaaaaattgaagatgtcggaagaatgtttgcctcatgtggagtttgcgtacaatcgggcaacacgttctactaccaaggtaagtccttttcagatagtgtatggtttcaaccctcgtgctcctattgatatcttgcctttacctactagtgagagggttcataatgatgcaaaggcacgtgctgaatttattttgaaaatgcatgagacaaccaagcacacaattgaaaagatgactgaaaagcatagaattgctggtagtaaagataggcaagaagttaagcttgaaccgagtgatttagtttggttgcatttgagaaaggatagatttccagaattgagaaagtctaagttgatgcctcatgctgatggtcctttcaaaattattgagaagattaatgataatgcatataaacttgagttgcctcccgagtttggggttagtcccacgtttaacatttcagatttgaagccatacttgggagaagaggatgagcttgagtccaagacgacttcaattcaagagggggaggatgatgcggacatcactacctcagatacacacaacaatcctccaacggtcattcaagtaccgataacaagagctcatgcgcgataattgaatttagaggtgagctcattcctatgttcttctttgtatgaattcgagagtagattgctacctaatgattatattgtgattagaaacaatggaggagacaaggagacacttggagaaggacttagagccatggaggatcatcgaggacgtccaagttaaagtggaggcccaaaccaagccgacctcgagtgtaattcagagtccaggaccagtctgcactaaaacgggcgcccaggtcgcatacatgctcggattggggcattctttatatggatggaaagctaagaagataacctttccaatggttttcgtcccacatccaaattatatccaagtcaatgggaatcgaccgaacaatttgacgtccagaatatgtcacggtgctgcgtcaccgtatttgggcctttgggccgtgtatcgtgttagaacccattagggttgcgtcgagagggggttgcacgaccctaaactctatatatcagtatccgccgccatctttaggtttttgggttttgcttagattattctgtcgagaacagtttcgccgctagatcggtttgtaagaccccaactcgtgagtttaatcattcatctgc

SEQ ID NO: 42177 - DNA, 1165 bp, Oryza sativa
taaagaatcctcatagttccgtccgattagtttcacttccttgtgcaagaaccataaccgccttagggtcctcatctctatcatgtttagaaggttggttgtggatgcttttatttatcataaatattgcaaatcttgtatgtgtctgtggcactaatcttgcagcgagatgtctccatggtcgagcttgtgaccataaacaaagcaatgccgggagatatcccggattatcttggtaacttttctttccaataaaagtaagaatcagtttttaggatattatgcaccttcgggtattcttagtcagtaaccatttcaggctgagattaagaatgagggacgtacgatgcctaagaacataggaactacatcaactgctcattttggtgatccttggtgttggtacacaccttataaagatcccagtctcacacacttgatttttgacgtctcataacgcaaaagtccaagtgtgggggaggaatgtcgacgagcttgcatgacaagttccatcaaccaaggccaccttgtttgcagttggcgttagtcttaccttgcagataaaaaaagaaaaaaaagaagaaaaaaagaaaaaaagagagacagaagataaaaaaaagaaatgaaagatgggacaagaggaagagagcaagagggctgacgggctacatctagttcaaagaccgcattatgtgcgagtttttaaaataggccatacacctcgctagtagcgatcatgctacctcgctacaccaagcccctctcttgagctcatgtgccaccttggcttagccttcatccactcctagttgtgcacaacctctcgctcctgcaacacctacacacatacaagcaagaggagatgccctcttctttcctaggtgtttgctgctacactctagttggcacttgcatctttgcctaagaagagatgcatcctacgtctctacaaaattttgccaacggaacacgccttcaaggcacaaggttcttgcacccgagatgtgggcataaccgaaccacttgcttgagttggtgtggtcaaagtaccttccttcgccacaacccacatcaagacggaggagagattgacaatcacatgtgaccatgccaccgcttagagatttcaacatatacatcatgctggcggtaagtgcactcaggt

SEQ ID NO: 42178 - DNA, 2010 bp, Oryza sativa
acaaggtacaaaacaagtgtgggggaatcatttccgaacatccgacgcgcaacagcatcaactcaacatgacaacatgatgaacaccaacccacggctgcgcacaaaattcagcagccagaacagagtcctggctgggtcggttgaaccaagtgttcgcccaacccttgcttggtccgattctgtcatccttcgccgtgtggtcaggtttgcgcgtctcctcccttatcctccactatttgtgagttaaacttggcagaaaaattgaatacaaatttagtttgactccaaatgaaaattgaaaacattaactctcaacaaatagaattttcctatgattgatcatgtatactttttattctttgctaacacttgtcacttgtgaacaaacatctatcatagggaaccttgctcatctaagtaattgatgtatgtgatatggttatgacgaaagaaattcctgtccaactgtcatgatacttgggattttgttttgtgaaattaaaactttttcgagcaatactcctcagtgactatataattacctaccaaggccatgtataattatcattgcagaaacctttatatatatgtatatatacatatatgtatatatatatatatatgaatatatgtatatatatatatatacatatatatatatatacatatattcatatatatatatacatatatatatatatatatatatatatatatatatatatatatatatatatatacatacatacatactagcaatagtgcccgtgcgttgcaacgggaaaaacactgtttgatagtgacaccttgaaaaccttaaatcggtaaaaatcaagtctaatttgatatattaacaaataggtagaaccgagtctaatttgatgaattagcgtagaatttatgatttagttttagatttatttttcgagcctacttaggagcttatccgacggattttgattttaaaaatctaagtcacattgtttgatcaaatttgctttcgacccaggtcttcctagtcggcccaaacttgggctggcccatcttcggcgagctaattcaatttgacatcccgcaagccgagcagctgagcgcggcccacatatgcggggacggtccgatgcacttcgacggcccatttggcacagtgtaatcagcggcggcggcggcggttttttaagtagtatttttttcgattcggatctatagtttttttcaccacttaggggaaaaagacttttgttgttgttgtttttctttattttattttttgtgtggcttttctttttctttttatgcactttctgccttcattctcccttttattatttttttaacaaaaacgacctcaagtaccttattgcaagattatagggactcaaatgtaaatataaaaattacatggactcaaatgcaaaagtacaaaccaaaaaattaaaatcatataaaatggaatgctctcgaccgtaggttccgtttttgcaaatatatcttcaattcgacacatcaatttttcaccaatgtagagtcagactttttttttcttttttgaaagggaagtcggacttttttttcttttctaaaagggaatcggatataggtgtcggacttttttattttattttttcgctattatttttttttgacggacgaaggaagcatctctcattttgacttttattgttgttgtttttctttattttattttttgtgcggcttttcttttttctttttatgcacctttctgcatttgttctctctcttttattatttttttaacaaaaacgacctcaagtaccttattacaagattttagggacacaaatgtaaatataaaaattgcagggactcaaatgcaaaagtacaaactcaaaatttaaaattatataaaaatggaatgctctctgtaggtttcgtttttgcaaacagatcttcaattcggcaatcaatttttttcaccaatatagagtcggactttttttcttttctaaaaggggctgcaggaatt

SEQ ID NO: 42179 - DNA, 8532 bp, Oryza sativa
gatatgattgcagatgtgatgaggaagcagtttgggcttaagccgaaggatactggaaacttgtatcggcatccataccttgagtggtttgagagggttccattacctaaccgatacaaagttccagatttttcaaaattcttaggacaagacaatgtctcaacttatgaacatgtcagccgattcttggctcaatgtggtgaggcatcggctattgacgctttaagggttaggttgtttcctttgtccttgtccggatcggcatttacttggttttcttctttgccctacaaatctgtcaatagctgggccgatttggagaaacagtttcacagttatttttacagtggaatccatgagatgaaactatctgacttgacagcaatcagacaaaggcatgataaacctatgcaggattacattcagagattcagacagataaggaataggtgctacagtttggctttgaccgattcttagctagccgatctggcttttcagggtctgatagctccgatcaaggagaaattttcatctcaggagttcgaaagcttatctcatcttgcacagaaggtaaccctgcatgaacaaatgtttgcagaggctaagaagaatatcaaaaagatcaaccacgtgtacccttacatgtatggttccgatgaagaggatgattccgaagtagcagtagtcgagtgggtcaggagcaagaaggttgtgccattgtcacgactggaattaacccaataggcattccatacatgcgtgtattattccttgtcccaggaggcaaggtacaccaaatgttgatacaattcagagtttaacaagcggaagcgtaaatagttaatttattacatgggcgacgaaggcccagcacacacgaagataaacgaaaaacagctgaagactagggcgacgaccacagacacttgacggcaggcacgagctagacactaaagccttcatcctccaggaactcctcttctgggttggggaaaaaattgagcaagattgagtacaaccaccgtactcagcaagacacacccacgaatgcagaataaatgcaaaggagtacaaggcggttataataaaggggttagggtttgcagtaaacagcattaacaagacttttagttgctcagggtcattttgtaaagacgatcctagagctacacagtgttattaatcaaggccgtgaacccgcacaaacctgccttaacccaagacctacgatgattcagactaaactggcaaccagacctgggtcccagctcatcccaagccaaccctggccaaccattccacattttagttgttaaccatgttttaagaaataaaccactaacttgggtacattgctaggctttgatgtgcactagggttcccgatcttccgaaaggttctgataaacaaatatttgggcggagtcgcgacacaaatcgatccggcttcatgaacgcgcacgctcttgagccccgcaatcgcagcaccacgtctcctctggttatcacccgtgtcgaaacgcggatgacctcgccgagaaggctaatccctgtttgccaattgaagaatacaaacaagaatgagatagaaaacaaccaaaattgcagatgaatgattaagctcacaagttggggtcttacaaaccgatctagcggcgaaactgttctcgatagaataatctaagaaaaacccaaaaacctaaagatggcggcgggtactgatacatagagtttagggtcgtgcaaaccgctctcgatgcaaccctaatggagaacccaacacgatacacggcccaaaggcccaaatacggtgacgcaacaccgggatagattctagacatcaacttgttctgtcgattcccattgactcggaaagaatttggacgtgggaccaaaaccattggaaatgcgatcttcttagctttccatccatataaagaatgccccaatccgagcacgtatgcgacctgggcgcccattttagtgtagactggttctagactccgaattgcacccgaggtcgacttggtttgggcctccaccttgacttggacatcctcgaggatcctccatggctctaagtccttctccaagtgtctccttgtcccctccattgtacctaatcacaatataatcattaggtagcaatctattctcgaattcatacaaagaagaacataggaatgagctcacctctaaattcaattgtcgcgcacgagctcttgttatcggtccttgaatgaccgttggaggattgttgtttgtatccgaagtagtgatgtccgcattaggcttgcccataaccgagggcgcggctattcggatagattatactctgatcagagatgtacatctttaccgacaagacacgtcttcctcatgtgtaaccgtgcgccacataccaccacggcatgcggacggaagacgtgacatagttcccaacccatcctagccataaacaagagtaccgacccaaccctggctacggccggaattcctgagacaggtaacctaggttgagcccctagcagcaggacaccggccctgtgccatgacatctcgactaccgggccacggctcgtgtagccttcatttgtcctagaggtgtccatcgagccccgacttcgtccatccctatccgtgtacttttgcccatgaccagactgagccacaaactaagccttacccactagacatgtggaagtatggtagtgctttgcaacagaggcccaaagaccggtccttatagtggccgaggtgctactatcaaaaccatgcacctcgagcccagtctaaaactattttgggggttttgaatggaggagaaggggtatgtccattttcacataagccaaccattccataatatccaaatgatatgtgcatttccaaagtctaaagtaataaaaccacctaatattgcctaatttatcagcgaagcatctacctaaattcatactagtggaaccatgaatagagtacccactagttggggttttgtttatcctagggtgaacaaggtaataataacaatagcaataataatgaggtcataacaaaggtaaataagcatggctaaataaaacagtgataacgcgggaatttaaataaagcgataatggaataatttaaaccaaaataattttataaactgggattcagtatgctcaaggatgatgtgacttgccttgctcgcttcccaaacgtcggcttcaacctccacgtagagcggatcttctgaagctgcagcgtctacacgaacaacggaaaggaaaaaggcttttactcaaataaactccatataaaaaacagaaacaaaccataaaaatgggtccttgacttcttaaggaaaaattagagacttgaacggtccaagtccgagttcaaacgaccaagttatggccacttgaagtttatatgctctttaagtgaatatttgcgaattgcttcatttaaaattttagttaaaacaatttattgtgtgagctgaggggagggggcgcgcgggctgggtccaagggagtggtgggccccatgcggcagcccctcggtccacggtggaccgggtgcacccgcgggctcaccagccggcgccgtgggccccactcgtcagccgcacctaagggcacgggtggctgacggctgggccccatgcggcggccacacggcgcgcccggaggcagccacgtcggcgtggccggcgggaggcggcggtccacggctcacctcggtcgacgacggcgacggaggaggcggtcggtggcggagggagacggtggcgcggctcgggttgacgaggacggaggtgttccggcggtcggcgagctcggctaggcggtggacggggtcggcggcggtgcggtgaagccggaggagacgacgtcgaggcgggggacggtcctggcgagcggctaggcccggccgaaggtcgacggcgacggcagagagagaggacaacggcgtgggcgttaatccgacggggaggaggggcggcaaatggcggaaacggactagggaggtacggggagggtttatatagggttgggagtgagagagggcagctagagggtaaggaaaccagcgtgggggtcccggtaggcatcaatggcaccggcgagatttgcgggagcaaatctggccgtttgaatgcgggagggggaggggaaaatgggggggaaagggagagggaatcacggggaacatttcccccctcttaattgcacgcgggaacagtcggggcggcggatttggcggcggtggcgctaggcgcaggcggagagagcggcgggaggaagggatgacgggtgggccccacccgttagcgagggtggcgggcaggcggaatttggccgagagagagagggaggggatttttagggttttctttttatgaaaccttttcgactttgtttatttattgataattattatttgtgctgtgaaaattctactaaaatttatttacacattttaggcttttaggaaatgtacaaaaatcctccaagccttatttgacttttaactttgcacattttaattttggaggctttcacttggattttaattattctaggcataattttaatgatatatttttagggttgtattgggacgtgataaacctaccccccttaaaaggaatctcgaccccgagattcggaagaactggcaaagaggttgggatgggctgccttcagcttgtcttcatgctcccaagtagattcttcctcggcgtggttgctccactggagcttgcaaaaacggattacccgattccttgtcctgcgctccattgtgtccagaatcttcactagcttgtccacgtaggtcaagtcttcacgaacatcaatctgctctgaatcggcctgctcggacggcactcgaagacatttcttgagctgcgacacgtggaacacatcgtgcacattgcccaaggatgcgggcagctccaactggtaagcaacttcttcgcgtcgagcgatgatacggaaaggtcccacatacctaggtgcaagcttcccttttgtctgaaacctgtgcactccccgtagcggcgtgacccgaagatacacaaaatcgtccactgtgaactccagatcgcggcgtcggttatctgcataacttttctgccgagactgtgccaactttaggttatcccgaatggttctgactttagcttcagcttctcttaggatatcagtcccgaatacttggctttccccaacttggtcccacaacagtggagtccggcatttgcgtccatacaacgcttcatagggtgccatttgtatgtaggagaactcagcataggggacacttttatcccaggtcttcccaaaatcccgaacacaagtgtggagcatgtcttctaggacctgattcagacgctcggtctgtccatccatctgcgggtgataagcggtgctaaaattcaatcgggtgcccagctcttcttggagcttcttccagaagtgaggtgaattggcttcccctatcagacataattttcttaggaacgccatggagactcacgatcctggcgaagtaaagttgagctaacttgttccctccataggtggtcttcacagggatgaatcgagccaccttggttagtcgatccacgactacccatatagaatcatatccaccttgggtttttggaagtccggtgaagaaatccatcccaatttcatcctatttccattatggtatctgtagaggttggaggagtccggccggtcgttggtgctcagctttgacacgccgacacacatcacaaagggccacgaactctgcgatttccagcttcatactgacccatcaatatttctctttcaagtctaagtacatcttcgtactgccagggtggctggaataaggactttcatgagcttcctgaagtatcaactgtttaagttccttgtcgtccagaatgcatacacgatttccattccataaggttccgtgttcatctttcgtgaagccagcggctttaccctgcttcatattcttaaggatcccgtgcatatccggatcattcttctgggcctcgcgtatttgatcaagcaaggtgggcttggcttccagtgcagccaagaatccatggctaatgacacttaggttcagggcttccaactgttgattaagttctggtggaatgccgcggacgcaaagagaactgcaatagcctttttgactcagcgcgtcggccaccacgttggccttaccagggtgataatggattcccacatcataatctttgatgagctctaaccatcttctctgctgaagattcagatccgactgggtgaagatgtatttcaaactcttatgattggtgtatatttcgcagcgatttccaaagagataatgccgccagatcttcagagaatggaccatagcggccaattccaagtcatgggaaggatagttgccttcatggggtcgtagctggagtgaagcataagctaccacatgaccttcttgcattaacacacaccccaatccttggcccgaagcgtcatagtacaccaggaaatccttgcgattatcaggtaagattaacactggcgaggaaaccaacttttccttgagagtttgaaatgctctctcacactgcggactccacacaaatttttcttccttctttagcaactacgtcatgggcctggcaattttggagaaattctcgatgaacctctgatagtacctaccaaacccaagaaactgcggacctgggtgaccgtcttgggttgcttccaattggttatggctgttactgtttcgggatccacagtaactcctttagcagatatcacatgccctaagaacttgacttcggacaatcagaattcacacttgctgagcttggcatacaactgatgttcccggagctttcccaacaccagacggagatgctgcttatgttcttcctctgactgtgagtacaccagtatgtcgtcaataaagaccacaacgaacttttccaaatactccatgaacaccttgttcattaaattcatgaagaaggtaggagcgttggtcagaccgaacgacatcaccgtgaattcatacagcccgtactgcatggtgaatgcggtcttagggatatcttctgcacagatacgcaactggtgatatccggaacgaagatcaatcttggaaaagacagtggcaccttcaagctgatcgaacaaatcatcaatccggggaagagggtacttgtttttgatagtgacttcattaagagctcggtagtcaacgcacatcctctttgtcttgtctttcttttctacaaaaatcatgggagcacctcagggggaagtgctcggccatatataccccttctctttcaactcttccaactgcttcttgactgcggccaattcatttgttgccacacggtagggtcgcttgtacatgggagcggttcctagagcaagatctatcctgaactcaatctcccgctttgggcggcataccgggttgctcttccggaaacacatcaccgaactcgttggctacgggtatttctgatagtcctagctaatgaagtactgagttgccggtgggagttgggtgcgcaaagaagacagccggttgatcaggcttccggtacacagtgacagtacgtcttgtgcaatccactactacttggaattgggtcaaccaattgatcccgaggatcacatccaagtccttggtgtcaagaaggatcagatccgaggggaaaggaattccctggatctctatagatacggccggactataatactttgttgtcatagcccctccaggggtggtgatgagcagagagctcctaagctttgctacccccagttgatttctccccatgaattgcacagatataaatgagtgggaagctccagagtcaaacaaaatgatagtggggatggaatgaatgaagaacgtaccggcgatgacatctggagttgtcagcacatcttctgtagtaatgtggttcacacgaccccgagtggcatcctttccatcattgttggggtggggaggcgcttggccttgctgacgcctcggcttcgggcatttatccgtgaagtgcctaggctcaaaacagtagaagcacagacgcggctgaccttgaacatccctgcgtccttgactaggctgcacggccggtgcagggggacggggtggaaggttccctttctagttctgctgctgctgcggctgtgggacgcaaaccacaaattaaggtcgtggcgcggggcgaggctgctgttgctgctgctgctgtgaggaggatccccctggatagggattggtgtagcggatcctttggttagccccatgttgattacggaaattcgccaagcgacgcttgtgtgactccagttccttgtgcttggtctccaggcggatgctcttgtccaccaggcgctggaaatcagtgtaatccccggtgaccagacgcaccgaaaagtcagggtccattcctaccagaaacttctcctgcttttcttcatcttcacgaacatcctcctgggcgtac

SEQ ID NO: 42180 - DNA, 11888 bp, Oryza sativa
aaggagtctccacgaagcaggtccacgccaaggactgacgaacaagctcaggcctggaggtactcttgcgggcggtgatcttctgactgcaacagacacggcggtgcttggggtggcagacctgtccttaagcaatcttaagctgacacagctgcgcttccacggcgtccaactccttcttcagctagaaattctcctgacgcagctccaggatcttcatgttgttctcgaccaaaccacggcgcaccatatcgatggaaatcgatacgggccgtgtcatacgcctccactatgcacgccaaatgcatgatggtagcgtcatcctccgcgctagcatccctgaaggcggcgtagtcgcgggttcctccatgacgagggtggtagtggtagggcgagtgctgcaactcgtccggatagactggtgaagagtgccgatggcgaggagcacggcgttctgccaagcggcggggaaggagtctccacccgcggtgactgccagcgaattgctctcgggggagctggtgaggatcacagtagtgacctcccaagcggcacggggctgtgcatcgtcaccatcctgctgtgaaagcttcttgccctggtagtccactccatgcggatatccctggacaacgcacatgccccgcagctccaaagcgaagccagtcagatcaagaccacaccggttgaggttgttggccatctataaacaaaggcaaaagaaaaattttagagatcagcttttgatgagaaataaagcagcaagacagagaaagactaaaggattttcgcaaataaggggtggttttttatttcaaaatacgaataaggcttggggtctaaggctcgtcctagggtcaaggaggctctgataccaacttgcacgatcagaattaacccaacaggcattccatacatgcgggtattatccttgtcccaggaggcaaggtacaccaaaagttgatacaattcagagtttaacaagcggaagcgtaaatagttaatttattacatgggcgacgaaggcctagcacacatgaagagaaacgaaaaacaatggaagactagggcgacgaccacaggcacttcacggtaggcacgagctagacaccaaagccttcatcctccaggaactcctcttctggattggggaaaaaaatgagcaagattgagtacaaccaccgtactcaacaagacacccacgaatgcagaataaatgcaaaggagtacaagggggttataataaaggggttagggtttgcagtaaacagcattaacaagacttttagttgcttagggtcattttgtaaagacgatcctagagctacacagtgttattaatcaaggccatgaacacgcacgaatctgccttaacccacggcctacgatgattcagaccgaactggcaacccgacctgggtcccaactcgtcctaggccaacccaggccaaccattccacatttttgttgttaagcaagttttaagaattaaaccactaacatgggtacgttgctaggcttgcccataaccgagggcgcggctattcgaatagattatactctaatcagaggtgtacatctatacccacaagacacgtcttcctcatatgtaaccacgcgccacataccaccacggcatacggacggaagacgtgacatagttcctaacccatcctagccattaacaagagtaccaacccaaccctagctacggctgggattcccgagacaggtaaccaaggttgagaccctagcagtaagacaccggccatgtgccatgacatctcgactacctgggcgcggctcgtgtagccttcatttgtcctagagatgtccatcgagccccgacttcaaccatccctatccgtgtacttttgcccatgacaagactgagacacaaactaagccttacccactagacatgtggaagtacggtagtgctttgcaatagaggcccgaagaccggtccttatagtggccgaggtgctactatcaaaacaatacacctcgagcccagcctaaaaccatttttggggttttgaatggaggagaaggggtgtgtccatttccacataagccaaccattccatattgtccaaatgatatgtgcatttcaaaagtctaaagtaataaaaccacctaatgttgcctaatttatcagcgaagcatctacctaaattcatactagtggaaccatgaatagagtacctattagttggggttttgtttatcctagggtgaacaaggtaataataacattagcaataatgaggaggtcataacaaaggtaaataggcatggctaaataaacagtgataacgcgggaatttaaataaagcaataatgcaataatttaaacctaaataattttataaactgggattcaatatgctcaaggatgatgtgacttgccttgctcgctttcccaaaagtcggcttcaacctccacgtagagcggatcttctgaagctgcagcgtctacacgaccaatgaaatggaaaaaggcttttactctaataaactccatataacaaacaaaaacaaagcacaaaaatgggtccttgacttcttaaggaaaaattagagacttgaacagtccaattccgagtacaaacgaccaagttatggccacttgaagtttattgctctttaagtcaatatttgtgaatttcttcatttaattttttagttaaaacgatttattgcgtcagccgaggggagggggcgcgcaggctgggttcacaggagtggtgggccccacgcggcagcccctcggttcacggtgaaccgggtgcacccgcgggctcaccagccggcgccgtgggccccacgcgtcagccgcacccgagggcacgggcggctgacggcggggccccacgcagtagccacacggcgtgcagggaggcggcgcccgcgtccctatggtcgccggcggcagccataggcatggcggagcggcggccgagagagaggaagggaagggtgaaaggaggcagcggtccacggctcaccccgggcgacgacagcgacggaggaggcgatcggagtggagggagacggtggcgcggctcgggttcgcggggacggcggcgttccggcggtcggcgagctcggcgaggcgatggacggggttggtggtggtgcggcgaagctggaggagatgacgccgaggcgggggacggtcccgggaagcgactaggcccggccgaaagtcgaaggcgacggcggagagagaggacaacggcgcgggcgcgaatccgacaaggaggaggggcggcaaacggcggaaatggacgagggaggtacgaggagggtttatatagggttgggagtgaaagagggcgaccggaggggaaggaaaccggcgcgggggttatggtcggcatcaatggcgccggtgtgatttgcaggagcaaatccggccgtttgaatgtgggagggggaggggaaaatagggggaaagggagagggaatcacggggaacatttcccccctcttaattgcacgccagaacagtcgggggcggcggatttggtggcggcggcgctaggcgcgggcggaaagagcggcgggagcggcgggaggagggggatgacgggtgggccccactcatcagtgagggtggcgggcgggcccgtccgtcagcggcgcgcttgtggggaggaggctttttagggttttctttttataaaaccttttcgactttgtttatttcttgataattattatttgtgctctgaaaattccactaaaatttatttacaccttttcggcttttaggaaatatacaaaaatcctccaagccttatttgacttttaagtttgcacattttaattttggaggctttcacttggattttaattattctaggcataattttaaggatatagttttagcgtcgttttgggacgtgacagccatgcccatgggtgagaagttctgggaaagaggaaagatttgattttgatatcaccatggctgataagattttcgatttgttgctaagaaaaacaaattcaacttcctgctggtcatgtaattccatcggctgaggaactaggtaagaggaggtattgcaggtggcatgattctggttctcacaataccaatgattgcaaagttttcagacagcaggtctaggtggccattgaagggggggagattaagtttgatgattcaaagaagccaatgaaggttgatggtaatcctttccctgttaatatggtgcatatagctggacgatctgctgatgaagggaaaactcggggttctcagttgaatacaaccaggattatcaacaaatatcaaagaagattctgctggaatgaaggtatgatgctgccatcgatcgaagattatcctggatgcagtgacactgcagggagttcaggccgatcctataatagaggtaatcggctgagtcaaaagagggtacctgttcattagaggttgggtctagtaaaccaagattatcaccatgatgaagatgaagataggaaaacacaatggtgtgatacaggaattttcaccaagaatcagaagagaagggttcaaagaatgaggaacaaggagcgctttcaagaagtagaacatgagattaaccatcgactgaagaaaacaaataccaagcaggagtagcgcattaagtgcacggtcacagcagccgatgaagttgaagccgataaagcaaaaatattgctcaagggcaaggcaactgcgcctgcatcggtaaacatggtttttatgctaccagcaaaatttgaaccgaggcaagccgatgtggatgatgttgaagaggtttctgcgagattggttttgtcaccggaacaagcgattttcgagaagccagaggggacagagaatcggcatctcaagccgttgtatatcaatggatttgtcaaagggaagccgatgtccaagatgatggttgatgggggagccgctgtgaatttgatgccatacactacattcagaaagttggatagaaattcagacgatctcattaagactaacatggttctcaaggattttggtggcaatccatcggaaactaaaggagttttgaatgtggagctgacagtcagcagcaagaccgttcctacaatattttttgtcatcgatgggaagggttcctatagcctgttgctaggaagggattggattcatgctaatttttgtattcattcgaccatgcactagtgcttgattcaatggcaaggcgacaagattgatattgtgccagctgacagatcagttaacattgctagtgccgatttagctctttgggagatgaatgatattgattgcctgtctgaaaaagtttgggattgagattttctaaaagtgtccgattgtgatatacagccaattgaagatggagagcccaaattattattttgagggagtcgtggagggttcaaacgtctacaccaaggatacagtagatgatctcaatgacaagcaaggacagggtttcatgtcggctgatgatttggaagaaattgatataggtccaggtgatagacccaggccgacattcctcagtaagaatttatctctaaaattcagaaccaaattgatagagcttttaaaagaatatagagattgcttcgcttgggagtattatgagatgctagaactcagccgatcgattgtcgaacatcggcttcctattaaaccaggggttagaccataccagcagccgccgaggagatgcaaagccgatatgctcgatgctatcaaggctgaggttacacatttgtacgatgctggtttcatctgaccatgccgatatgctgagtgggttttcaatatagttcctgttatcaagaaaaatggcaaggtcagagtgtgcattgattttcgggatctaaacaacgctaccccaaaggacgagtacccaatgccggttgtcgatcaattggttgatgctgcttcatggcataagatattaaggtttatggatggcaatgcaggttacaatcagatctttatggcagaagaaaacatttttaagatagctttcagatgtcctagtgcaattggcttgtttgagtggggtgtgatgacttttggttaaaagagcgctagaggtatatatcagagggccatgaactacatatttcatgatctgatcagctggttcgttgaagtttatattgatgatgtggttgttaagtcaaaagaagtagaagaccacatagccgatttgaggaaggtttttgagagaactagaaagtatggcttaaagatgaacccaacaaagtgtgcttttggcgtatcggctggtcagtttttgggatttcttgttcatgagagggggattgaggtaactcaaaagagtattaattcaatcaagaagattcaacctctggaggacaagaagaagttgcaggagttgatcggcaagataaattttgttagaagctttatctctaacttatctggaagattagagcgttttacacctttcttgagattgaaagccgatcaagaattcacctggggggcagaagagtagaaggctttgaataatattaaagaaatatcttagttctcctccagttttaatccctccacatgaggggattcctttcagattatatctctcggccggtgagaagtcaatcggctaagttttgattcaggagcttgaagggaaggagagggctgtattttatttgagccacaggctcttggacacagaaacaaggtattcttctgtggaaaagttgtgtttgtgtttgtatttttcttacacaaagttaaggccttatctattgtcccatgaatgccttgtgatatgtaaagccgatgtggttaagtacatgctatcggctccgattttgaaaggtaaggttggaaagtggatatttgctttaacggaatttgatcttcggtatgagtcaacaaaggcgattaagggacaagctatagccgattttattgtggatcatccgatgactaatcggctcagtcgatattgtgccttggactttgttttttgatggatcagtgtgcactcatggttgtggtatcggcttagttataatttcccctcgggggaaagtttcgagtttgcctatactattatgccatatgcaactaacaatcaggctgagtatgaagcagttctcaaggggttgcagttgcttaaggaagttgaggccgatgctgtcgaaattatgggtgattcgttattagtgatcagtcaattggcaggagaatatgaatgcaaaaatgatacattaatggtatacaatgagaagtgccgagagttgatggatggatttcggctggtgattttaaagcatgtatctcgggagcaaaatgttgaagctaataatttggctcaaggggcatcagggtacaagccgatgatgagggatatcaaagtagaagttgccacgataacagccgatgattggaggtatgatgtgtatcaatatttgcagaatctatctcaatcggcttctcagaaattgcattataaagctttgaagtacacattattggatgatgagttgtattatcggatgattgatggggtgttgcttaaatgtctgagtgccgatcaagccatggttgtgatgggtgaggtacatgaaggaatttgtggtactcatcaatcggctgataagatgaagtggctgctttggcgttgtcggagatatgggtccggggatttgcgaagtgtggggaatctaccttcctatcctgctgcgtgtccgtacagcctggccctgcccccgagcacgcgaaccgctggagcagccggggggggtcggggcctcggggtgccacgtcatgcccctcgggcccttgcactgcttcgccccgaggccctcgcctagccaccatttggcggggggagcgagcgaggagggggcccaggctgagcttccattaatacgcgcaacgccccaactgccccgtgtcacatttaatgcagtgaggcagacgtgcggcgtgcgaatctgacgcgccataatcaagaatgaccggtctatgaccggtcatgacaccggtcacgtctgactagaccgacaaccgtactcccacgtcgcgtctgctcccggttgagtgggggtaggtatgacccgtcccatcggagggtcattcggacggcggccaccacaagtcttcatccattaatgggggaatgatagggctgtcccccgtgtcaggcgagggacggcgctgggccccactcaagaacaagcagtggcttagcttccaggcaaatgcacgggtcaagttccggtcaagatagggtgggtccccacccgaaagaagagtaggtagaggcggtgcatgtggtatccccttgagatataaaaggaggaccttccccaccgagaaggacgactctcagaaaacctgaactctaggagaagaagggcgagagtgctctccggagtaaaggaacccttgtaatactcatccataatcccaaacacaggagtagggtattacgctccacagcggcccgaacctgtataactcgattgtgtgcaaggtagctagcagcctagggggcggatacgtgatttctaagaggcgagcttcttcccccggccgaactcacgaaaggggcgtctcacaacctcccgctatcgagggacttccctcgataggcgtgcaggatatttttggccgaaaatgttggaagattgttttagatattacaaaaggtgtcaggattgtcagaagtttggagcaattcagagagcaccagcgtcgactatgaaacctatcatcaagccatggtcattcagaggttggggaattgatatcattggtatgattaatccaccctcgagcaagggacacaagttcatattggtggcaaccgattactttaccaagtgggtaggggcgattcttttgaagaaggttgattcaggggatgctatacaatttgttcaagagcatattatttaccaatttaggattcctcatactattacgactgatcaagtgtctatctttgtgtctgatgagtttgttcagttttccgatagcatgggtatcaaattgttgaattcttcgccatactatgcataagctaatgggcaatccgaggcatctaacaagagtttgatcaagttgtttcagagaaagatttctcattatcctcggcaatggcatactaggttggctgaagcattctggtcctatcggatgggttgccatggatcgatccaagttcctccttataagcttgtttatggacattagaatcggctcgaggagaacagatttgcagaatgcgttgtcagccgatgaatattataatctcatgtccgatgtgaaggaggatttggttcaatccagattgagagctctcacaaaagttactaaggataaggaaagggttgctcggcattataacaagaagataatatctaagtctttttctgagggagagcttgtttggaagttgatcttggcgataggaactcgtgataacaaattcggcaagtggtcactgtcacgtcctgataaattcatcccaaaataaaaatcattctctaaatggaataatagaattaattaaaattcgaaaagaaattggcaaacactaaaatacgtacaagaaaaattcgaatgtggtccggagaatttttgttaaattctccttggtctaaaaggagccctcaaattttacttgaattttcagagcaccgaaaatatttattaagcaacaacaacaattaacaaagtttattaaaaagaaaactaaaaataatcctccttttcatttgggccaagcctccctctctctctctcgtcccgcacccgaagtccttctccctctcttttttctccccctctatgtcacgcccagaaattcacgaaccagaatttctaagctgaatgtgcattaaatccctgtccaggaccagccagggtacacaaacgacaattgttgacatacagatccacgtcttacaaaaatagaaaagattacaaatgcagcggaaaagataaaacgagctagacttggaaacttgacttctgcagcgaggcgactcgactccacaggcaatccttgacggcagcgacaaaccaacttcgacaagacagctcccactaggaagatcttcagctctggtataggggaaaagagagcaagactgagtactacccactgtactcagcaagtcataccggaagaggaggtatgatgcaggatataaccgaaggaggctaaaggttcttttgcacaaagcaggcatttaaaaataatagttgaaagcagtaaaacagttgtagtaattaatcaatattaaccaaacactgtccaacgctacaccacgttgcaacaggcccaaccaaccacctaaactacaccagttcattaagctaaactaggggtgagactaaccacggtgaatttggttgatcgcccataactgcgggcacggttcttcgaatagttttactctgatcagagttgtacaactgtacccacaagacacgattccacacatgtcgccatgccccgaagtatcaccatgatactgcaaagggggaaatcgtgacaagaccctccacataaccctcccctaaccatccacaccacgctaagttttcacccccacccgtcaaaaggcagtgggcggtcccctactgcgccgcggtgaatccggcagctggacaacctgacaccccggccgacccaactccatcacgcccaccctcgccaccggtgcctaggaaagggtcgagctatacttcagatcaagcagttacccactcccgcttgtggtaagcacggtaagtctcccagggtttcccgtgaaccggtccttaactgccatgggtgcgaccagcaaaaccatgcacccacagcccaccgtccagtgtattttaattagctaacaccattgcggtggcaccaatccaaagctatgctcatagttaaagtctatgtaataatgtgatccctatttgtgtgctagttgagctaagcatggctaagcatttcctaaaccaacatctaatcattttgatacccaggttatcaatggcatatggtaaacaataaatggctgagtaataggacccatcccagatgacattgtaaaagaatgcgacatttaatagaaatgcgggacatttgtagattgggtacaatatgatcaattgtaatgcatgacttgccttactctcgcactgatgagaccacagcaacgtcttcgagaaactgcggatcgacgaaacggccgaaatctacgcgacaaacaaagcacacaagcaaaacatgctataagactactgaaacaggaaacaaaaccatttttaatggattctagggatttttatgaatttactgagacttgaatggacttaaacggagctcggatgaattactaataaagaaaaagtccttaattatttattgcgtaataaatcccaagggctgacgtcacccaaggggggggcgccggcaagcggggtccgcatgtcagtggcacaaggggagagggagggggcgccggctggtggctcaaggggaggggtggtccaccagctggtggggcccaccgggcagcagcacaaggcgggaggggagtggatggtggttcggcacggctcaagccggccgaccatggcaaggcggcagcggccgcaggcggcctccgacgacgaccggcggacggcgaggcggcggcggccggcgtgaaggcgacggcgacggccggaacagcggcgtggctcggcgctcgcgggaaggggaaggaaaggaggaaaggtgtcctcaccggcgatgcgagggaatcgggttccggcggtggcggatggcaatcgagtgggaccgaggtgcgggcgacactggcgagcgcggcggcggctttagcggtggtgggggctgcaggaa

SEQ ID NO: 42181 - DNA, 5406 bp, Oryza sativa
cgagcggcggccgaggtagctctcacggcggcgaagctagcggcggtgattgcgcggcgaggcgacggctcttgcgatggcggcgtgcggccggaggcggcggcaagtggcggcgctagcggcgagcggcgcgggctcggtaggaggcacgggagggggcggcgagagcggaaaggggaagaggaggctcgggggagcaatttataggtggagggggaagcggacgtggccgggaaagcctccgattttgccggcgatgtggggtggagagagagagaatgggggggattcaaattcgaatcccgccccttgcaagcgcgcgcgcgggccgggagacgcgggagagagggcggcaacgtggggaggacgcgggagcggcacggcgtgggcgcgggaggagcggaggaggtgtgcgcggcggtttcggcgacggttgccgacgtggggcgggcggctggaggaaggggatgaccccgacaggtggggcccacctgtcggcgtcccagagagagagggagtgagggagggcttcggggaggggaagggaggagcgggccagcccagcaaggggcgcgcgggagagtgatgggccgacggcccatcaagagaaaaaggaaggaaaagaaaagaaatagagaaaaaggattttcctgggatttaaaattgcactttggggatttttagttggttaaaattatttatagggctctgaaaattccactaaaaatcctgttaatcgattgtgacatctagaatccaagaaaaatcccacaatgccatttccaattaataattgcatttattaattagggattcaactctaggttaattagaacaatttctccggacgatttacttaacaaatttttaaagcaaggaaaaggttgaaactttagggcgtgacactctgtctctcaagggccgccccgccctccttccccttggcccaactcccctcccctccccctcccgggccgcctccgcccatccgcccggcccaagccaggccgagtccctcccgcgcacgtgcgctgtgtgcgctgaccgcgtgctagcaggaggggcccacgcgctggcaggaggggcccacgcgcggtagtcttcctcctctagccggccgttccgctctgtccctctcccgaaccatagccacctccccatcaccttcctctctctcctgtgctgacggtcaactccggccgcccctgccgcagtgcctgtgcgccggccggccgcgccgtgttctcgctcggcctcacaggtgcatcatcttccctggcgccgcctccgattcgtggggaaatcgccggagacgcgtccccgccggcttgcagtggcattgccgctactataccatctccaaccatccctgccacctcgcctgagtgcaggccgacgtcgctgccacctctgtcggtgctgcagcgccatcctcttctccggcccggctgcggcgtcgcccgaagttcgctgaaacgccgccgccgcgccaaccgcccgttcctccttgccggctcgtcgccccgctgcaccaccaccttctccaacatcgcaatggcgtgttccacgccgtcccctactccggcattgcagcggtgatgtcgtcctcggcatcgcctccccttcggccgaacccgccggcgtttgtcgtcgcctcctcaccggttcccaccgtcgtcctctcgtcgttcccggtcgtcgtggtgttcgtccctctgtcaagccattctcgttcgtcatcctcgctccatcaagtgccacagccccgtcgtcatcttcgtcctcgcctccgcgtcgtcaagcattgcaccggccgcgtcttgccttcgtgcaaggatcgccgccgaagtcgttccctcgctgttcgcctccgtcgtccctgagccgtctccgccgtgcccgttcgtcatcatcgtgccacacctcgtcgcatggtggtaagggtctctcctctcgctgccccgccctcgtcctttcgatgtcgcccctgcccgttgtgcggttgtcgatcccgctacccgtgtaccggtgtcggtagtcgtttgtgtgtgcgtgtggtgaccgtgtttgtgtgcccgcttggtagccgcgtggtttccacatgtgcagcccgcatggtgtctagtggagtccgtatgtcagccactcgtctcggttgacacacgggatccgcttccatcgacccgtggactgtctctgtgtacccggtttgccatggtcccttaggttgacatgtggggtccgcatgtcaacagcgcagccttctcgtcttttctaggctagcgcttacacatgttttataattgcaaaacctaattataataatccgcaaatctccagataacagcattaaactaaagaaccatgtgcttcctttttatgtattgttactgcttctttataggcttgtagctttgcttgtgtgcttcgtgtagcttctgtcgttccagaggttcctgaagcgtggttcgtggtcgtcgccgaatgttcggaaggccattctctctgagcaaggcaagtcacatcatccttgagcatattgaatcccagtttataaaattattttgatttaaattaatgcattatctctttatttaaattcctgcgttatcactgttttatttagccatgcctatttacctttgttatgaccttattattatttctattgttattattaccttgttcaccctaggataaacaaaaccccaactagtgggtactctatttatggttccactagtatgaacttaggtagatgcttcgctgattaattaggcaacattaggtggttttataactttagactttgggaattctcatatcatttagacactatggactggttgccttatgttggaattggacacacacctccccctctattcaaaacccccaaaatggttttagcctgggctcgaggtgcgtggttgggttttgttagtcgtacctcgggtactataaggattaagctcaggcctctattgcaaagcactaccatacttccacatgtctagtgggtaaggctaagtttgtggctcagtttggtcataaacaaaggtacacggatggagatggacgaagtcggggctcgatggacatctctaggacaaatgaaggctacacgagctgcggctcggtagttgagatgtcatggcacagggccggtgttctgctgctaggggctcaatcctacctacctgtctcgggggttccagccgtaggcggggttgggtcggtactcttgtctatggctaggatgggttgggaactatgtcacatcgtccgtccgtatgccgtggtggtatgtggcacgtggttacacgtgaggaagacgtgtcttgtgggtaatgatgtacacctctgatcagagtataatctatgcgaatagccgcgccctcggttatgggcaagcctagcaatgtactcaagttagtgttttaattcttaaaaccgcttaacaactaaaatgtgaaatggttgggctgggttggcttgggacgagctgggacctgggtctggtggctagttcggtctgaatcatcgtaggccttgggttaaggcaggttcgtgtgggttcacagccttgattaataacattgtgtagctctagaatcatctttacaaaatagctttgggcaatgaagtaacttttaaatgttgtttactgcaaaacttaacccctattattatccccttgtacccccttgcattaatcatgcatctgccggtgtggcttgctgagtattgtggttgtactcattcttgctctatctttacccccttcagtaagagaagctttggagaagaagtcgtaggtggagtcctggcttataccctagttgagcgcctgtgaagatggaaccgtcggcccgctagtccgctgctgattatttctgtttgtcaggccttaagtgcctttgtaataatgtaaatattatcgatataataaagatgtgccttttgtatcatgtttgtttggtgtaccccagcttttcctgggacggggattaatacactagcgttctggaaaaggtatttttccgggcgcgacagtcaccgaattgggaaggaccgtttcaaatccataaggttgtgtccaaaggagtttatatgttacaaggacttgatggaaaagtttatggacgagcacttaatggcaagtacttgaagagatattacccaagtgtttgggttaatgcatgatcggttgggtgttgccgatgcatgatagccgatgtgtttacatcgccttgagatggccgatatagttatatcgcccttagttgttttactatcataatcggttgtgttttgccaatgtatgacggccgatatagttatatcgcccttagttgttttattatcataatcggttgtgttctgccgatgtatgatggtcgatatttaatatatcgcccttagtccaaattataattttatcgatgccttcatcattgcaaaattaggggggcacatatatacaaaagttgagaattatcggcagaaaggttcagtgataatcaaaaggagtaccaaagtttcttagccgattacaaaaattttctaagtcctattacaaagataatcatctagacaagttacgctggattgccgatacagcccgttggctaatttgatctacttcttcaatagcttggatatcttgggcgtcggttccaggaatgacctggagagacttggtcaaatcggccacgttcctgatagccaattttagtctggacttttgttcttcgacagcctttgggatatcagttaacttcttctgctcaagagccatttcggcgttgcattcctctagttgagctatgagatctattctgcgagcctcaagccgatctattttagtttgaattggcccaaccaagagttgatctagcttagctttctcttcatgaacggtttgccgattggtttgaatagtggcttcaatatcccttcgctctcgccgatcggctatcctttgcttggccttttctaccttgaattgatgttgctcgaggtatacagctggagaaatggtatttgccagatcattcgggattagggattgaatctctgcaaatcttgcccggattgtaccgcagtcaaccaccaagttgtctaatgatgtctctagccgatgagatatgtcttcaagagttcttttgacatcgtcatctagagggactagagttttgcttgttattttttcttctacctcttcatcaaagtaatccttgatgtcaaacaagaacagatcggctaaagcctacaaaaggaaaattgaagacagttaaatttcaaagcgaattatatagccgatctaagatttatgacaatgaaagacttactggtatggcaggagcagctcgttgttcttcctcctcaatattgtggctgcct

SEQ ID NO: 42182 - DNA, 1770 bp, Oryza sativa
taagagaaaaaggaaacaatttccacttaagagtttcatgtgtcatgcctatgatggataggcaagaacacactagctcaaagtcctgaagatggaggtatgggttttcactaataccaccagagaaggtttgctctcaaaccatggctataaagccaggaccgatttcatagccatttgaaaggattggttttgaagaataggatgactcacaaagattagcccgaggagcagaaatgttttgaattgtgggttgctccatcaaggaaaggaataaaacaagaagaagtaaaaataaagatatgaggatgacctagactcggataaattagcaaccgttccccggcaacagcgccaaaaatgcttgttggtatttcttacgaccacagataaatccgcaagcgcacggaataccgttgtagcacttcaccttcaggtgaccccaaaaagatatcgaactcagggaatgtgtgtaatctacctaaggctgagactatccaaggacagcaactgatggtaggcacgctagagaggactctctatgtatttttaattatttaagctaagtaaaggtaattccctatctgttgcttcaggcaccgacccctgcttgtctgccagcgtggttccggctatagctctatgatgtatccgaacgtggaggattactaggacgggattcagggctatcaccacctgccaactacctctaacaaatccgtgggatacacaactaacaaaggtaatctctaaactagacaccacgtctaagttattaattactactctaatacttgcgcaagagcttccttctctatctggagtcctagtactagagcacttagtataaatactaaacaatgaacccgcaaagatggatatctatcttacttagacaaagtaattaaataacataagaaagaaacacgaatgcttactttatagaagaagttctccgaacccgaagcagagtgtaccgacggctccggtactcctccagaattcctcctaggaagctacactccttgaggtagaagtcggatgagcgccaaacttccgggcactcctccagaacttccccttactctctaccttattctaatgtacaaaagatacaataaagcctcttgtaattcaggtcaaagttgtgtgttggaaatgagagtgagctgcttcttttataggcaggtatgacggttacaacctatgcgaaatgaccaaactaccccagaaccgccattaggatgtgatcaggaccgtccacgtgaaatttggcgatcaacggctaccaaaatcgttcggccaaactggaggttcggccgaacccgggacggctccattcggcccatttttcgttgtggacactaattttgaggccctcagcccattggcatgatagttgggcccatttggagttgtttaattgacttatggggcctccaatccgtgtaaatgtgtcctgaatgcgcggaggtgcagtttgtcgcttgacggatgtgttttcttctcaaaatactcgcatacacatatttcaccaacactagtggaaatgattagtaataatacctaccactacgttggataccatgttttatttcgttatatgcaggtattgatggtcagatattatgatttaaggaccgtcaacaccaaacaaccgagtgatttcgataattgtagccaaccaagtgacttaatattaatatatagtatatgcggtgtgaatccccgatcaacatgatccgagtgatataccgactgctttgcaaa

SEQ ID NO: 42183 - DNA, 1499 bp, Oryza sativa
ctcggggtataaatatgaaacccttaacattgtaatatgggagacaatccaataaaacttcctcgcatcgccacccttttcgcttttacttttcaacgagttcacttcacaacaagtaacccgtctcgatggcttgtgctatcggggctattatgtcattttatccttgtatcatgaccattgttatcttatgtctttgttaatctagtcttagcatatcgatttagctctatcgactgcttctcgttttaaagtttctgccggtatcggctaaatcgtcttgctagattagattagcttagacatccaccaccctaaaaattcagtcaatgggttgactgtttagatatcgtgtttcttttcatacttagtgctgcatcagtacattcgacttactaaatcatgtttagaacaataatctctagcctgcttcttgattgttaataggggtagcatcggggtttcagccgatcttacctaatatacatgcttctttacctgtttcatgtatatttgccatctctatagacagatcatctaatattaatatattaagtctaggtcatattggctaggctatcattattgactattgacctctatttggtatattactatagattgatttgcttatatatttttgctctaaatattgttccatcgactactttcataatattgtcttaaacttctttattaaatctgatagacagtattacagctgatgaggcatgtttaggtttaatattcactgatatatccagtccatagccgatttggtctagctaactgcattggctgagaccaccaatgataagctatcggtcgatcggctatcgactgactaactctgcttttgtctttcttgctgattgtaggattaaatctactggcacacccttggtacactcgagcctaggcttagacctacactagagttaagcagatctcctagtgtggagattatggataccccatacctacacggcatgtatagtccgactgggtatggggtaccatgtttagatagaatatctttaagaggactcgggttaggttctaaacttgcatatcaaggaaatatctgagatcctagtcggttacgattgtattttatctgtaactacatattccgttaaggatatggactgtattttgtaataaggaccccttcccctatataaggaggggtccgggtgcctctaggggcacgattttctcccagatcatacgatcaataatacactcggcggattaatcctcggacaggagtagggtattacttcttgattaagaaggcctgaacctgtataaaattccttgtctctaaacccatccacttttccaacttgatagccaccccttttagtattgctgaaatcttgtttcgacagttggcgcgctaggtaggagtagcgtcaagttcttcgccgattggtgcgatgggttccgtcttcggcatcgacgacttcgtcttccctcccgggcaagtgttccgg

SEQ ID NO: 42184 - DNA, 1120 bp, Oryza sativa
gaagccgaacgacgccgattagaagaggagcgctaggcacaatagcgagaacggctgcagcgtgagcaacaggaacgcgaacgggctgcaaaggaggctgaggaccgacgacaatgaggcttggatgccaggcgacgagcgcgagaacttatcgggcagcaagacgtcgagggaacagcagtctttcgcacccctcaacaaaacgcggttgcagcgatcactctcctcgacaccctcctcaaggaagacgcactcaaccatgctgatcacgtcatcaacatcttgaaccagactaagaccatgatcgccgcctcggtcctggttaactccgcaagcgtccgcacgccgactggcagccgagttccccatcttcgatctcaagattatcaccagccaagcctcagtatcgccggcgcgggatccaattgcaggagcaggggccacgaggagcgatctgtccactcgcctcccgaacgacacagggagcgccgagttgaacggccacgctccccacctcgcaggcgccccgtcgatcttcgtgatactatcaaccagcgccgcgcggcacgaggctacgccccccaccattcaccgaatcgctatgacgacgacgtggatggagtcgctgccttttcaagtgacctgcgtcgagtggattggccagctggcttcaagccgactagaatcaagaagtatgacggcaccaccaatccggagtcttggctcaccgtctacggtctcgcgattcgtgcagcaggacgagatagcaaagccatggcaaactacttgcctgtggctctagcggattctgcccgatcctggcttcatgggttaccccatggcacaatcggatcatgggcggaactttgcgaccacttcatcgccaacttccatggcacctttgaatgccctggcacacagtttgatctctacaacgtcattcagaagtctggagaatcccttcgagattatatccgacgcttttctgagcaatgcaacaagatctccgacattaccgatgatgtcatcattgctgctttcaccaagggaattcgtcacgaagatttagtcggcaagttcgggcgcaaaccgcccaggacggtcaagcagatgttcgaaa

SEQ ID NO: 42185 - DNA, 3585 bp, Oryza sativa
tcaaagtgcatcgaaaaagaaggacgatgatgacgatgccccgacaggttttcaagaccatcgcaaggagctcaatcacatctttggcggacccttggcttatgaatctaagagaaaacaaaagctgaccgaacgggagatcaacgctgttcagcccgatacgccccaatatcttcggtggtcggagacaacaatcaagtttgaccgctcagatcatccagaccgagtggtccacccggggcggtaccccttggtactagacccagtggttcgtaatgtcaagcttcgcagatccctcatcgatggtggcagtgcactcaacatcctcttcgccaaaaccctagacgacatgcaaatccctcgcacagaattaaaaccgagtaatgcgccctttcacggagtcattccagggctatccgctatgccgctcggccagatcactcttccggttactttcggtactcgggagaacttccgcacagaaaacgtctgcttcgaagttgctgatttcgagaaaccgtatcatgccatacttggacgcccggcgttagccaagtttatggctgtcccgcactatacctatatgatgatgaagatgcctagtccgcgaggagtcatatccctgcggagcgacatcaaacaagctatcacatgcgacaaggaaagctgcgagatggcccaaacccgcgagatcacgatcgcccgagaagatatccgactggctgcaactacggcaagcgaaggagaagtgcctgcaaccaagatgccaaagagtggagaaagcgacgccaagaccaagaaaattcctctagatccctctgattctactaagaaagctgtaataggcgctgagttagattgtaaataggaaagcgtgctcatcacctttcttcaaaataataaagatatctttgcatggaaaccatctaatatgcctggtattcctagaaaggtgattgagcactctttacatgttaaggaagatgctaaaccaatcaagcaacgactccgccgcttcgcacaagataggaaggatgcgatcaaggaggaactgactaagctgttagcagcaggcttcatcaaggaagtccttcatcccgactggctggccaacccaatcctggttcggaagaaaatgggacaatggcgcatgtgtgttgactacaccgacctcaacaagttctgtcccaaagatccttttgggttgcctcgcatttaccaggtagttgactcaaccgccggctgcgagctactcagctttttggattgctactcaggttatcatcaaatccgactgcttaaagacttcattcatcacgcccttcggggcctattgctacatcaccatgcctttccgattaaagaatgcaggagcaacctatcaacgcatgatcagagatgtttttcaactcagatcggtcgcaacgttgaagcttatgtggatgatgtagtcgtcaagaccaagcagaagtatgatttgatcacggatctagaagaaacctttgcaagtatctgcgctttcaggattaaattaaaccctgacaagtgcatcttcggagtaccgtcagggaagctgcttggatttatggtctctcatagaggcatacaagccaacccggagaaaatcaatgccatcctcaacatgaaaccgccaagttcccagaaagatgttcaaaagctaactggttgcatggcggtgctcagccggtttgtttcacgactcggcaagcggggatgccctttttcaagctgttgaagaaaacagacaatttccagtggggacccgaagcccaaaaagcctttgaagacttcaagaaactcctcactactccaccagtcttagcttcaccgcatccgcaagagccgctgttgttatatgtatcgtcaacttcccaggtcgtaagcacagtcctggttgttgagcgtgaagaagaaggccatgttcaaaacgtccaacgaccaatctacttcgttagcgaggttttggctgactccaagacaagatatcctcaggttcaaaagctattatatagcgttttaattaccctcaggaaactatctcactatttccaaggtcactcggttacgttggtcacatcgttcccattcggcgatatacttcataatcgcgaagcaaatgggcggatcacaaaatgggccatagaattgatatccttggatatatcgttcaagccgcgaacttcgatcaagtcccaagctttagctgactttgtcgccgagtggaccgagtgccaagaagatatgcccgaggagaagatggagtattggaccatgcactttgatgggtcgaagaggctttctggcgctggggccggggttgttttaattttcccgactagagaaagactgagctacgtattgtggatacatttttctgcatctcacaacgtagcagaatacgaggcgcttcttcacggactaaggattgcaatctctttgggaattcagcgtctgatagttcgtggagattctcagttggtcgttaatcaagttatgaaagagtggtcctgccttgatgataacatgaccgctaatcggcaagaggtgcgcaagttgaaagacaaattcgatgggctcgaactcacccatgttcttcggcacaataacgaagcagctgacagactggctaattttggttcaaaacgagaagcagctccttctgacgtgtttgttgaacatctttacgaaccaaccgtaccaaggaaagaaacaatcgaagccacggacgctcaaaacgtaggtatgattgaagccgactagagagagcccctcataagatttttgaccaaacaagaactcccccaagataaagatgaagccgagcggatctccaggcgcagcaggctctatatcattcatgaaactgagctgtacaagaaaagtccatcaggaatcctgcaacgctgtgtatctttagaggaggggagacaattgttaaaggatatacattcaggcatctatggcaatcacgctgccgcacgaaccattgttggcaaggcttatcggcaaggttttttctggcccacagctgtgtccgatgccgacaagattgtacggacatgcgagggttgtcaatttttcgccagacaaactcatctacctgctcaagagttgcagaccatccagttgtcttggccgtttgcggtttgggggcttgacatggttggcccgtttaaaaaggcagtcggcggttatactcacctctttgtggctgttgacaaattctccatgtggattgaagctaaaccggtcatcacaatcacggcagacaaggctagagatttcttcatcaacattgttcatcggttcggggtacccaatcggatcattaccgataacggcactcaatttactggcggagtatttaaagacttttgtgaagacttcggcatcaagatttgttacgcctccgtagcacaccccatgagtaatggacaagttgaacgcaccaatggcatggtacttcaagggataaaagcgcgagtcttcgaccgactgcatccctatgccgacaagtgggtggaacagctgccatctgtactttggtccctgcgcaccactccc

SEQ ID NO: 42186 - DNA, 924 bp, Oryza sativa
gcaggcatacttcttcgtcttccttttgcttgtttattataattccctgaggttgcatgtcatcgtcccaccacttgactaaaatgggcgggcgagaatcctcagctgattgtatctggaggatctcctcttcgtcgctgattattgggccttgagcatccatgaataaaggtgaaacaattgaagaaggtctgtcagattaaaacggattttggagaatgtgttaacctgtaataatttctggtcaaggacgagcaggctcttgtactttgacaggagagctgggccctggatctgcactggcatcctttctgggagggctgttcgtttgagtttctacttcaggaatatctttacttggctctgtacccgactggtttccagtcgggggctcttgattagcatcggctccagcttgggccgactggttcccagtcgggggttcgttgctagcttctacattgtcggttgccggttgtttgtcacttgaacaatcctctgcagttggcccggtttcttttgaaggacctgtctccacgttagtcggctccgagtcttttccggaaggatctatatcagatggcttcctacaaatttgagttatgccatcattattatttcaatagtgagtgagcagcactacgaggaagatggtcaaatgattcgtacctggaagatttcctaatctttggcattggacgactggatgttttcttctaaggattggtttgccttggctgttttctagtcacctctttattgccagattttccagcatcatcgccttcatcattactcagaaccaatttcctcttgcgcgagtccaactggatggctgattttgagatgtttgattgagtatcagaccgaatttttggtccaccacttgcctgaccagtctgccggcaaggtgatcggcgttgg

SEQ ID NO: 42187 - DNA, 2208 bp, Oryza sativa
agaaaaaccacaaccgcaaaagaaggggtaatcacacatagaagttagagaggagtaggatcactaacaattctacacttaagatctctaactatctataacttctattcatcaagccatccaccactgccttccgcgggattagcaaataacgatgcaggtgcgaagtgtgaaaattcatgaggagatgcagaagttgatgcagtaatattgggggcagagcaggagtaagggtcttcattattttcttgatcatcagcatgtatagaaagatgttcctgtgtctcaagctctcattcttctggatcttcctcttcgtctggagattcagtccaaattggggcagtatttaagtcattgatatcaaatacccgatttggcctgagtacttcaggttcttggctaggttcactgatatcgatagctgaatgcatttcttctgcttcatcatcagaataaataggatacaacggtggtggtgatggtggtaaaccttgtaaaactccttcaccattatcctgaggatgtggttcatcttcacgtactggtgagatatgtccttccataccatcatcatcatcatcgtcatcactacccatatttgggatttggtgaagacagaaggctgctcttgcaacacaaatattgaggatagaattatgtttttctctttcctcatataattcgtgaagtatacgatatttgtgtttgagaacagcttctctgcgttcagcttcctccaaacgtttacgttgtacatccatgtgttctagggcttcttcatacatgtcatctgcagcttccatccagatagacatagttgcttttactggttgttcatgataatccacgtcttgaagagtacagtaatcttcgcccggctttcgcataggatggtaagaatagcgagagtgttgcagcttatcttgatagatatgattaagacgtagaaaagcctccctggacacatcatataatgcagctcatacggtatcccacctatgacgtgttcggaagtaatacatatcacgttcacctcttgggggattgatcttcacagtcatatcacactcccaacgttctcccattgataggcatgtgaatagaattccggcttctcatttatcttcagcttagtcatcaagctgattagttgatcagtgtagtcattatcatggatagtaatcgcaatttctataactttttgctcatgcccttctgccattgtcctaaaatacacagatgacattataatgcatgctcgtggattaaatctaccccccttaaaaaaataaggttgaggtaaattcaaacttaacttagttagtagtccttaaggttcatcctatagtcaaaacatatgctctgataccagtcctctcgggtcccaaaattaattacttggatccgactatgattaatgtatcaatccccggatcagtaaatattgatacatacaatataactgcttcttcattacatacgttaaagtttcacaatactaagggttttacaataataggtactcaccaaattgatcaactagaattaatacatagcggaagtttctatacattctgactagggaggtataacctttagggattttctaaattatcggggtcatcctagtaatagccataggggttctcctcttgactcataactgaaaaaggggttataagagcaaggatgagtattcacaatactcagcaagttatcatggaaatatgttatgcactggcatatagtagggttctttgcaaaaagcagtaataaacaatctggaagagttatagcaagaatttataaatatatagactttaaatttctaaccagtgtaccatatgagtcccggtactcaactccatgagtacggctattcgaatagtttcaaagatattctactgcagcagatgtacgctttacccgcagtccacgacttgctgataatcatcggctttagtcatggcccagtattaagttattaacaattgtggcacctgttccatgaacttatatcctcatatgctctaaacgtattgttaacagcagcaagaggagttctggcgttcgcgaggtatttaaggggaactgatcatatgacaccacgtcatctcgatcaaggtttagaaatataccacatagtttacactcgggtatcacaaaccatatacctgtacatggtaatggttaaaagtagccctt

SEQ ID NO: 42188 - DNA, 1645 bp, Oryza sativa
gaattcctgcgccgtatatagatggttaaaacggaagaactcaccgagatcggttgaaacgacggattgcggccggaaaaacattgcggcgacgaagaacagagcagagcaggggcgacggtgctcggctcggtacggcgaggtaaaacttgatgcagggcttcggttagggctcactatactagaacctggtcgatataaggtgttctaagggttatttagggtggatggatggacgggcgtggagtcgatcgcgcacaaggtgttcgaccgacgggcgagagtggttgatgagatagattggtgaagcagagcttcggagttgtggggctatggttgttgatgatcgatgatgaacaaggaagggattagggtcctatttatagggccaggagaggtggatgagctcggacgccatcatcgccatggatgagctcaaggattggatatggcaaaggtggcagaggctgtgatagggtggccaaggtcaatttgagtggcgggaggccacgtttgaatacttaccggcgaaggattggcttgaccccgggtagaaacggctggtgacgtgttagcgccaatccgggcgcgacgcgcggcggcggcgagggttaaaacggccggcttggaggtgaatggtgagaggggaaacgaccgtctatcttcaattcaaccgtgcagcaagaattggcgcgattcaccccgggtagaatcaagatcggactcggtggcggctttggatgggagcgcacggcgtcaagcggcgatttcttgcggcggaggtcgtcccggctttgtcgtcgtcaagattggtgcggcggtggcggtctgagggcgtcggacgagcgactacgcgccaagacgatcgggcacgcgcaagcggccccaaagccgacgcgcggcgacacggcgcgtggctatgttggatgcccgggcggcgcgcgtgaaggggaggaagaagcaaagaaagccacggatttgagtgggatgtggtccccaaggatcaaatctagactttgcacaagattgggtagaggttgggctgtgttagttgggctagacattctgtcgagcacctagtgtgaaatgaacagtgaatttcaagaattttgaatatttttcctagagaagatttgaatttaaactatgaattttgaaaggtttcactagggtttggaatatagcaaatccttactaatattagggtaaattagtaaggttctaaagaagtaacacttgaaccaattaagaatcaaataaatttttagagcacactaaattaatcaaaagccagcatgatgcagtcaaattttgtttaaaatttgaggattctacacatcgcttgttgggatattctgtttcgtaaagtttgttacgcaatatgtaattatatattatgactggaatgattggtctagttcattacctgtttcgtaagtgcacgattttctttctctgttgtgacatcactttttaggtcaatatgtgttatgaattatgctcaatattgttagatgtaatcatgtaattcaatgcacagtgatgggtagaaatcttgttcaaggtcgttacctggattgtaggatgctctttttctttgttcccagcatttcctgtaaacaaactctttgcaactttggaaact

SEQ ID NO: 42189 - DNA, 22380 bp, Oryza sativa
atacaaccttgacggagagccgacatgggcgaatcaattgatcccggtggaacactacaccatggaaggggtgaatgcactgtgggcgcagccccttgtgacagtgtcgggctcccctgcgaatttggagcacttcggcgaataccctggttcggccgaaccctcctcggccacgttcggccccctcttcggcagcgtgatccctgtcccctcgccatgttacgaagaccaaaattcaggggggattcacctgcgcgacggctgacaacaggcaagctcggtctcttgaaggcacgacgccattgtcaagatgatgagaaggccgttccgcctccgccgagcgatatgtgggcaccctgttcactaaggcaggagatgaggtgctccacaagtacaccacatctactactactccatccactccaaaggaggatcggttccgcattcagggagtgcgaactcctggcggtgggtatggtaagggcttgctccggcctttgacggtgtcaaaaaaggagggggcagcagaatcccgtatccctccacctataaaggtgaagcgtcatttgacgccccctccaattgtaagggcggccggccaataccaaggagatgaagtgaagtcaccggagccctcggtctataagctcgcctcgcaagtgagggaactccgcaaggagaacatagagcttagagcttgcaacacggaactaggggtagaactcgctgaacttagaaataatgttgatacccttagtcgcggtttgtgtgctaaaataaagcatgcattcgtagagatggggaaggagaataaatattatgctaattagatgtctcctctcccataaataaagtaatagtaggtgcttggttttatttttccaatcatgtaagcacttgctataaataatgtggctcattggtgttaaccccaatgtttgctgaagtttgtttttgtttaataaaattcaggtttttgaataagtgtggggcagatatcgcagcttctaacgtgcacatactctgaatattgttgaatctctgaacacctggaaggcactgaactctgcagaaaattgcagaggaaatgggcaccagagtggttcggccgaactaccagatgcggccgaaccagagctggccccaatccctctcaattttcacaggtgagcatgtgagcacgtcttttatctgtatatctccaccatggtatagtactagagctgaaaatcagaaaacaattggttcaagcataagtaaaagataaaattttcaactaatgaaattcttcagatgattgatcttgtatattcattattctcagctgaacttgtgcttgtgaacagccatccatgtttagggaaccttatgcatctaagtaattgctttatgtgaggtgaataaagatgaaaggaattcttgcaacttttgtcatgactcttgggaatttgttttcaaaataaaattgttttaaaagctcattcctccaattgacttcattctttattcctaccaaggccatatgcaagtgcatctttgataaaccttattatgcgtatgactgcttgacattatattgagttttgtcaaatttatgtgactcgtcttagatatctttcatacactcatgatcaaggagtcatttccattttcatttccacatatataattaagctaatcttctacactggaagttgccttccaacaaaaattccattcaaataaactccaactttagaccatgctttcttctcctagaaaaattcttggcaaaaagaaaatgataaaaggagggaaagacatggctgtgaaaaaaaagagagaaaaaggaaataaagtttgctcttaaaacattgagcatgatgaaaacaaaatatagccatgccccttctatattcatgccaagaaaacaaaatggagagaaagtctagcaaaaggggagaattatttctttattccaccattccacaaaatattttacttttccattttctaccacaaataaagacccttgatctaggggtatgactgatgatcttcttgagtccatatctttggctttgcaatatatatgttgcaggtatgtcacaatttatccctaccgaactccacatatcagccttagaataggggtaaattctggcacattttgccttggtgaggatacaaaaagaaaatatacacatttccgacaattcacatgctctacaaccatcatacctgcctatttaaagagctctcatcctcactatcttcacacacttcaagcaagagctctctcatattctctcaagtttagtttactagtctcaagctagtggagtaggaatagaatagaaatcagagtctggaagtcttcggaagagttcgggtatggctctagttgctctcctttcttctttcataagatttgtactttatttagaatattcttctttatacaattctggtattgaaatactttccgagtatatgaatgccagctttactttatgttcaagttatactgattatactgctagcttatctgggagatgcataggtacaattataatgcttgcaattgcaattactctacgtcatgacaatgacattagagtagtatctggtagtttaggcatgatgtctagattatagggtaatataatttggggttatatgatgtggatgagaggtgggccactaatggtgacagcccaatacgggtattcctccgcgcgtgtatatagtcctaaattaattttctgggaaggggactcctacgtatttagcctcggttgtatggtcatgacgggctgtcgtaaggaactcggcagtcaggggtggcttctcaaagtaccaggagggcatcagaaagagggtattagaaggttaatcatataactaggatatatgtataatatgtattggaggtataccatgaggaccttctgtcacaccctgaagttcttttcccaagcctaaatcaaagtaataattggtctcaagaaattacctctgtaaaagcaagagagaaaccttaatttaattaacacaaataataatcgaaaatggcatgtggaatttttcttgggttcctcaagtcaaaatatgctaacaggatttttaatggaattttcagagctctagaaataattttaaccaattaaaatcgagcaaaagcattatttaaatccctggaaaaaaactttttctttttccttttctttttcccctcctttttccttttgggccaccggcccacttcccctccccctcccgcgcgctagctggggcggatcgaggccgaggcccagccagtggctgcccgcgccctcccctctccgagtcaccgacaggtggggcccacctgttgggcccattccctacctccggctggcgtgcccgcaatcgccgctcccgcctctcccgtgcgtccccgcccacatcgcctacctcccgcgccacctcccacacgccccacaaccgctgccccacctgcccgcccgcgcccgcgcccgcgctggagacggccgggattcgattttcgaatcacgcctctctcctccccacctcccccatgtcgctgttggtaatcttacgatcatagataaaatccgcaagtgcacggatataccgcgatttagcacttcccctacggagtattccaaatgtgtcaaatccaagggaacgtgtgtgatcagatcatcctccggttcatccaaggacaccaagcgaatgataggccaggatagagaggatttactagtgagaaatagtgtctagggaaagcttaactttaatcctaatgcaatacttcaggcactggcaacccgctgttcccagatgtcgctctactacgtacccggacagggaggacttaagtgatcttgagggctgtcaccacgtctacacctacctcaaacgtactgtgggatatgcagcaattactggataacaactacctaaacaccacgtctatgaaattaatatctactttagtgtttataaaacacgaaagcaatcactatattttagttgattatagtgaacaataatcccgtatgctacttaggaactaaccaagagataattctcacaagataaatctaaaatactcaacaagaatattatattgaattcagagtaataaacagaataaaagaaatataagaagattaccgacaactctagaattcttccgacttcttctactatactcttttcctattctagtatacaatatagtacaatagagcctcttataattcagctaaagcttgaaagtgtgtgtgagagtgaatgaagtgaggtctatttataggacatgtatgacagttataggaagggatatagtccgaagtgcaccttaaccgccatcagcaatgcatctggagtgtccatgccaaaacctgggatcaacggtgatcatcagggttcagctgaaccagggggtttagccgaacctgggctggccccccttgcctggcctttggcctggctcctctcctggtcctcctctatccattcttcggtgttttgggctggttctctggtgttcctatgaagtccacaacccatccttatatggatacatgatactcctcactttaagtctaggtttcctcccatataaatatacaccaataatgtggaatatgtgagatttaagaccttatcactgtgttggatgttttattatctgaattttatgcagatgttggcggtatagaattgacatttagcagccgccaacagtcaccggcccctcgagcctatataaaccatccccggaccctcctctctctttttcgcattgcaatcgcccgctcccaagctctcatctgccctagcgccacgcaccacccaccgccgccgctttaactacctccggccgccgctcgccgccgttagagccgccgccgagccacgccgtcgcctccgttatccgccacttgccgccgctcgtcgttgtcggtgcggcctccctccttcctctctctttctctctctctctgtgtcctgtgccaccgcctagcgccgccgcctagccgcgtcgccgtcgcgttgccgccggtcaccatcgtcagctgccgcctagcgccgccgcctagccgcgtcgccgtcgcgttgccgccggtcaccatcgtcagctgccgccttgcgccaccgctagcgccgccgctgctagagccgcaccgctgcatgccgcgcgccgcctctgctgtccgaactacgtgagggtagatcggggccgtccatccaccgcccgcgtggccggcacgtcggtgccacgtcagcgccgcgtggtactcccatcccctgtcccgtcgactcagtccaccatggaccggcacatccgagccgatgacatgtgcggcccgcatgccggagccgccccccccccccccccttcgctgacgtcatccggggttaattaatgcgcaataatccaattaaggttttttcttttattgtaaaaacaaagtgaatcttctaaaattcatagaaaattcatctgtgctccgtttaagcccattcaagtctcagtaaatccagaaaaatgcaaagaatccattagaaatggttttgttctctgtttcagtagtcttatagcctgtttgcattgtttgctttgtatgtcgcacagaattcggctctcccgacgctccggtgtactttgagataatccgcagagcaaggcaagtcatgcttgtctcttgaacatgttgatcccatattgcaaatgctctattgttttcctttaaatgttgcactgttttataatgttactatgggatgtttacctactgtctcagccttatcatttgttatcctgttccgttgttagcttggggatgtaacatgttagccttatcatttgttagattaggggttgcttagccatgcttagttctactagtacacaatgggggatttacattaatgcatagacttcagattctagtattgatgttggattagtgccaccgctctagtgttggttaattaaaatatattaaatggtgggctgtgggtgtatggttttgatggtcacacccatggcaattaaggaccggttcgcgggaaaccctggaagaattcctcgtatttaccacaagccatcgtgggcaacggctgggcttgtagtgtagctttcctctagctgacacatccaggcaagggtgggcgtgatggagcgggatgggccctgcgacggcctttgtcgcttctggattcacctaggcacgagaggggacttcccgctgccttgcgaggagtgggggtgaaacctaaggtgtggtgtgtttggttagagggggttatgccaagggtcctgtcacagcctctatccggtatgtcgtggtggcatgtcggcgcacgggaacatgtggtggggctgtgtcttgtggctatagttgtacacctctgatcagagtaaaactattcgaatagccgtgcccgcggttatggtcggtcaaccagattcaccttgattagtctcacccctagttagttaatggaactgattagtgcaagtggtggtttgggcctgtctcaacgtggtctagcgttgagcagtgattggtttaatattgattaattattacaacttttttttctgctttcaactaccgtttataaatgctagctttatccaaatgatcccctttagccttcctttggttatatattacatcataccctctgttccggtatgacttgctgagtatagtgggtagtactcagtcttgctgtatctcccaaccctcagagttcgagtatgtgttcgatggtggtttctccaaggagtaggcttcgtctgtgccgtcgaggatgcctgtggagtgttgttcccgctgctatccaagtcaaggcttagctccagttatcttttaatttccgctgcatttatgtaagacttttataatgtttgtaagacgtggatctgtatatcaactttgtcgtttgtgtaccctggccggtcctgaacaggtgtttaatgcacattctgcttgaaattctatttgggaatttctgggcatgacaagttggtatcagagccgacctttacagtaggataagccaaatagaaaccctaagagccctcccaatccttttcattggcatatgttctttgcaattggatttgtttcgggaaaatttggatttgttccttgggttcatggaaaaattcatgatcgctcgtttcattgaaatttgttcaaatgaggtcagcctatggttttagtaaaattatctgggacatatcgggatttaatgggaggtatgccttaggtcctaactaaggaatatgggttgcaggttatttatgctcttgttattattattattattattattattattattattattattattattattattattattattattattattattattattattattattattattattactattattattattatgtatctaattcctcattattttgttgctatgtatgtcagtcttatttatttgctctcatgcaaaaatgatctatgcacaaaattccgctcttattcgcttattttatttgagtcctttaccgttaattttataattgggtttgagcatgcattgactctccatcctttgtcttctatagatggccggctgtcccctaacacaccaaggtcagactatgggaggattcatcgcagagctgtcccgcatggcgtttgtgatcggttttccatgggagccgcagcacagcagcatccaccctctcagtggcgagttcccacaccaggtccgcttggagcttcacggcatcccctcctacctacccaacatggaggtgacagcttgccggggcacatttgagcatgcttgtgaggaggccgccctcaggatgatggcccatttgagggagctgcacgacgacaccctgaacaccaccgcctactgcttccacccttgtcgcggttccagctccaacaccggcaccttcaagtcagcttggcgagagaacgacgtcaccttcggccacatgagtgaggtgatggaaggctacaacaagctgcacgctatgcttcaccgggcgaccaagaggctcaacgacaagaagcttgtgaggatcgccgagctgcaggatgagaacagttgcctcaagaagcaggtagccaggctgcaggggtgcccaccgccaggaggagcccgcatccgcaccatgccaaggaagttggccacagctcccgtgcgcatccagctcgcgcccaggaacccgcctccacctcctcccgcagctccagctccagtccaagctcctgctccagcgccaactccagcatatgccctctcctttgtgccagcttcagcttacaggggtccagtaggtggcagtggagtatggctgctagcttctcccagtggtggtcgtgcatcagcagttctagctcagaggcatgcagcggcgacacctaccagctagagtactccaggagccactcagagggaccaggcgacaagcaggaggacgccttagtagttgtttgtcgactgcattccgagcaattgcaatttaaattcctatataataaagcttagttcctgagcccctatttttcttcttttccatccgctccgtctgttcttccttcagatggtcaacaccaggaatggcagtcgtgcagcaggtgagggcagcagcagcaaagaacgcaccgatggtgggcaccccaacagcccctctagcaatggtccgccaccgctccccgagaacccgacgcttgcacaagtgatggcccatcagacccagatgatggcggccatgatgcagcagcggcaccagcagatgcaccagaggatgcaacagcaggccgatcagcagcagcagtttggtccccctacccctcagtccaagctgctagagtttctacgagtcaggccacctatattctctagcaccaccaaccccttggaggcaaaagactagctccatgccatagagaagaaactcaaccttctgcagtgcaatgatcaggggaaggttgcctttgccacacaccagctccagggtcctgcgtcagctggtgggacaaccacatggctacccgtccaccaggcatagaagtcacttgggcggaattctgtcgcagcttcaggaaggcgcaggtgccagacggggtcgtggcacagaaaaagagggaattcccggcactcaaccagggaagcaagaccgtgactgagtacctgcatgagttcaaccacctagcgtgatacgcaccggaagatgtccgcaccgacgcggggaaacaggagaaattcctggcaggcctggatgacgagctaaccaaccagctgatctccaaggattacgctgacttcgagaagctggtggacaaggcaatctgccaggaggatcagctcaacaagatggacaggaataggaaggccgcttagttcagggcacatcagggaagtcaccagaggccgcgtttcacttccggacagcaaggtggacccaccaccatgattgtttgacaacaccacccctaccctttcgacaacttccaccaaggcgccagtggcagccagaaccaccagggaggtcagcttaaccgcagcatagctccgcgcccgctaatggcaccagcacagccagctccaccagctcaagcaaaggagaccggggcaaagccagggccctgctacaactgtggcgagcatggccactttgctgacaagtgcccaaagccgtgccgtgccgggccaaggtttgttctagcccgcgtcaaccatgcgtctgcagaggaggcacaaacagcaccagaggttgtactaggtacgtttcctgttaactcaatccctgctacagtactttccgattctggtgcaacccactcattcatttccaagaagtttgttggggtgaatgggataagaagggaagaacttagtacaccaatgagggttcataccccgggaaatagttcaacctctgtctattatagcccctccgtggtaatagaaatccagagatcacaatttctagccaacttcattcttttttaatccaaagacctagatgtcattcgtgggatggattggctgaccatgttcaagggcgtcattgattgtgtgaatcgcacggtcaccttggtcaatgagaaaggagaaacagtggtgtacaagtctccagcctcacccaagcaaggagcctcattgaatctggttgaggcgaaaagttctgtgaccgcagaggagaagagttcgacgaaattggaagatattcctatcgtctatcaatatccagaagtgttccccgaggacctcactaccatgccacccaagagagagattgagttccggattgattttgcactgggaactgctccaatctacaagaggccgtatagaatggcagccaatgagctagcagaggtgaagaaccaagtcgacgaacagcagcagaaacgatacatccgaccgagtacttcaccttggggtgctccgatcatttttgtggagaagaaggacatgacgaagaggatgttcgtcgattatcgcgcacttaatgaggtcacgatcaagaacaagtatccgttgccgagaattgatgacctattcgatcagttgaaaggagctaaagtgttttccaagatagacctgcgatcaggctatcaccagttgagaatccgggaagaggatattcccaaggttgtttgagtgcactgttatgtcctttggacttaccaatgcaccgactttcttcatgaacctgatgaacaaagtgttcacggaatttttagacaagtttgttgtggtattcattgacgacattcttatttattccaagtcgggagaagagcatgagcaacatcttcgtctggtactcgagaagttgcaagagtaccagctctatgccaagttcagtaagtgtgacttctggttgtcggaagtcaaatttcttggtcacgtcattactgctcaaggagtggcagtggacccatcgaatgtggagccagttacaaagtggaccccacctaagacagtgacccagattcgaagtttccatggacttatgggttattaccgtcggttcattgagaatttctccaggattgccaggcctatgactcagttgcttaagaaagatgagaaatttaagtggacagctgagtgtgataagagttttgaggaactcaagaggaaattagtgtctgctcaagttctgattctgcccgatcaatcgaaagatttctaagtctactgtgatgcattccgccaagggctaggatgtgttctgatgcaagaaggccaagtggtcgcacacgcctcgcagcaggtgcgtccacatgaaagcaattatcctactcatgatctagagttggtagcagtggttcacgctctaaaaatctggcggcattacctcatcggtaaccgttgtgaagtttacacggaccacaagagtttgcagtatatcttcacccagcctgacatgaatctcagacaacgaagatggttagagttgataaaagattatgacatggggatacactaccatctaggcaaagctaatgtggtagcagacgctttgagcaggaagaactactgcaacgccttgggtttgaagacatgagcgtcaaattgcaacaagagcttgaacatctcaatttgggaatcgtggaacataggtacgtggctgccctaaaagcacgacccacgctcgtggatcaagtccgagcacctcaggtaaatgatcctgaaatagctgaactgaaaaagaatatgaggttcggaaaagcccgtgatttccatgaggatgagcatggcacaatctggttgggagaaagattttgcgtacctgaagacaaggagttgaaagacctgatactcaccgaggctcatcagacccaatactccattcatcccggcagtaccaagatgtaccaggatctcaaagaaaaattttggtgggccagcatgaggagggaaatggcggagttcgtcgcagtctgtgatgtttgtcagcgagttaaggcagaacattagagacccgatggactgcttcagccccttcagattccggaatggaaatgggaagaaatcggaatggatttcatcactggtttgcctaggacatcgtcaggacacgattcaatatgggtggtggttgatcgcctcaccaaggttgctcacttcatcccagttaacaccacgtatacggggaagaaattggcagagctgtacttaggaagaatcatgtgtctgcatggggtacctaagaagattgtatctgatcgaggaagttagttcacttcaaagttttggcagaagctgcaagtagaattggggacccatttgaatttcagcacagcctaccatccatagacagatggccagaccgagagggtcaatcaaattttggaagatatgctaagagcttgtgcacttgattttggcggagcctgggacaaaagtctgccttatgctgaattctcttacaacaacagctatcagaacaatttgcaaatggcaccgtttgaagtattgtatggtcgaaagtgccgctaataaccgctgaagggagctcacctttgaagcaagggattatgtgtatcttcgtgttccagacgaaaggtaagttggcaccacgcttcgtgcaacatacaagatcttagaacgaagaggaaaagtcgcatatcagcaagagcttccactcaacatggctggcatccaccacgtgttccatgtatcgcggttaaaaaagtgttaagggtaccaaaagagcaagccaattcggagcacatcgatattcaagaagatccgacttatgtggtgaagccagttcgcattcttgaaaccagcgagaggagatctagaaacaaggtgatcaggttctgcagggttcagtggagccaccactccgaggaaaaagcaacatcggaaagggaagatgagttaaaggccgcccatccgtacctcttcgccagctcctcccaatctatgggtcgagatcccgtttaaggagggtaggtttgtcacaccctgaagttcttttcccaagcctaaatcaaagtaataaatggtctgaagaaattacctgtgtaaaagcaagagacaaaccttaatttaattaacacaaataataatcggaaatggcatgtggaaattttcttgggttcttagcgtcaaaatatgctaacaggatttttagtggaattttcagagctctagaaataaatttaaccaattaacatcgagaacaagcattatttaaatccctggaaaaaaccctttttcagtttccttttctttttccccctcctttttccttttgggccaccggcccacatcccctccccctcccgcgcgccagctgggctagcccgaggccgaggcccatccagcagccgcccacgcccctcccctctccgggtcaccgacaggtggggcccacctgttggacccgtcccctaccttcggccggcgccgtccgcgcccataaccgccgctcccacctctcctgcgcatccccgcccacgtcgcccgcctcccacgccacctcccacatgccccgcaaccactgccccacttccccgcccgcacccgcgcccgcgctcgagacggccgggattcgattttcgaatcccgcctctctcctccccacctcccccacgtcgccggccgattcccacgcctcccggccacgactcgcccccccgagcctataaaccatccccggcccctcctctctctttttcgcattgcaatcgcccgctcccgagctcttctccgtcctagcgccacgcaccacccgccgccgccggtttaactgcctccggccaccgctcgccgccattagagccgccgccaagcgacgccattgcctccgtcgggttcacgagcccaagggccacgccgtccacccctcccctgtccaatttcgccgccggagccctccttaaatcgcgcgccggtgagctcgacattgtcgccgccttcgaccggcgtctctgcccgtctcactccgtttctccctctctaatcccttccggttcgttcctcaggtcgtcctggagcccgtcccatcgtcgccgccgttatccgccactcgttgtcgctcgtcatcgtctgttaggcctccctccttcttctctctctcccgcatcgccgcctagtgtccccgcctagccgcgctgccgccgctcgccgccgtcggctgccgccttgcgccgcctccatcggcgccgcgccgccgcgcgccaggccaccgggccggcttaagctgcccgcgtgtgcacccggccgcacgccgtctttgccgttctcaggtagatcggggccgtccatccgacgcccgcgtggccgccacgtcggtgccacgtcgacgccgcgtggtactcccatccccggtcccgtggactcggtccaccatggaccagcgcatctgaaaaatgcaaagagtccattaaaaattgttttgttctctgtttcaatagtcttatagcctgtttgcattgtttgctttgtatgtcgcatagatttcgaatctcccgacgctccggtgtactttgagatagtcgccgaggtccctccagctgcaaagcaaggcaagtcatgcttgtctcttgaacatgttgatcccatattgcaaatgctctattgttttcctttaaatattgcattgttttataatgttactatgggttgtttacctactgtctcagccttatcattcgttatcatgttccgttgttagcttggggatgtaacatgactagatgttggattaggggttgcttagcgatgcttagttctactagtacacaatgggggatttacattaatgcatagacttcagattcttgtactgatgttggattagtgccaccgctctggtgttggctaattaaaatatattaaatggtgggttgtgggtgcatagttttgatggcgcacccatggcaattaaggacaggttcgcgggaaaccatggaagaattcctctaacttaccacaagccagcgtgggcaacggctgggcttgtagtgtagctttcctctagctgacgcatccaggcaagggtgggcgtgatggagcgggatgggccctgcgatggcctttgtcgcttccgaattcacctaggcacgagaggggactgcccgctgccttgcgaggagtggtggtgaaacctgaggtgtggtgtttttggttagagggggttatgcgaagggtcctgtcatggcctttttccggtatgtcgtggtggcatgtgggcgcacgagaacgtgtcgtggggatgtgtcttgtgggtacagttgtacacctctgatcaaagtaaaactattcgaatagccgtgcccgcggttatgggcggtcaaccagattcaccgtgattagtctcatccctagttagttaatggaactgattagtgcaggtggtggtgtgggcctgtctcaacgtggtctagcattgagcagtgattgatttaatattgattaataattacaattgtttttctgctttcaactaccgtttataaatgctagctttatgcacatgatccccttaagccttcctttggttatatattgcatcataccctcctttccggtatgacttgctgagtacagtgtgtagtactcagtgttgctctatctcccaacccttagagttcgagtatgcgtccgatggtggtttctccaaggagtaggcttcgtccgtcccgtcgaggatgcctgtggagtggtgttcctgctactatccaagtcaaggcttagctccagttatcttttaatttccgctgcatttatgtaagacttttataatgtttgtaagacgtggatctatatgttaactttgtcgtttgtgtaccctggccagtcctggacaggggtttaatgcacattctgcttgaaattctatttgggaatttctgggcgtgacaccttcggccaggcctaccgaagccaaggacataggcaaaggcacttgctggaggcaagaggtgaaggtcgaagggacaacataggagaaagccaaatgaaaaaagccgtggcatcaagttgacaagctttgccaaagaaggaccctgccggaggggcgtacggtcaaaggccatgaggcgaaagccttgccacgaagggcatgggtttcgccaagtatcgaaccttgccaggtgaaggcccagcgagccgacacgcctttcagaggcttaaccaaggactgggccgagtcacttggcccattaggagcccttcgagcaaaagacactgtacgcccatgaagatgtccctatcataaaggcaaccatgtaaattctcctgtaaagcctaaaccctaaagggagagtctgtaatagggctataagtagccccctagggccatataacagggggatctgagtaatttttacaaagcaatacaattgtctttacttccaacaactgttaaacgaaccacgtccttcgacatgaggcagttgtcgattcgacaacagctggcgccgtccgtggggacctccgagcacaaccattgagagtaagagcgaaaccactgatgccaccgaagaagatcgctaaggagagagtagccaagcgaaaggaaggaaacagcgagggggagatggttggcgaagagggagcagagccttcggcttcggacgccgaagcaggagctgcgctgcttccggtggcagcgccttctctcccatcttcggcgccgaccacttcgacagaccaggagacggtgaaagcagcggccgcggcgaaggcgctccagattagggacgtaatcctttcatctcaagtgctaggggcgtctcaagccgccgcctcgtcgcagcatgctaccacttcgaccgcactcaccgcctcacaagccaacgctaaccttgaagcccaagccgaagccgacatgggggctatgcggcagaacatggccaagttgtaggacacgcttcgccaaatgcaagatcagcagcaggcgtacgaagcggcaagacaagccaaggctaatgcctagcagttttcgacagtctacacacagccccaagctttccctccgcatgttgcacaagttgtacaggctccaatgtacttcgccaagaccgctctggctatggccgcgcgccctacccctcacatgacttcggtgccggttcgcctggtagcacctcaagtacagtacttgaagcctactcatacgccccaagcaatgatggaggcagctttggccttgcaagcctagtttcaagcattttctacagcagctcaatcaacccaacaacaatgtaccaagaactttgcctccggtccaagtcgagggaagtccaagtcagggtgctccggccgggcaactgttaggccagttcaccatgccaagtcaggcgaaccagctagctcaaggtgctacgcctcgaagccaactaccacagttcaaccccagcgccacgattcaagcacccatgaccttcatgcatgtcgtgcctcccgggtttggaacagttccaccgccgaaccaagcctggaaccgagccatgatcgacccaactatggcggcgcaagccgcttcgacggttcagcagacccaggcgttggtgttcggcacggggcatcaatcaacacccgcagccaaccccatgtgcaagccgtaacttcgccattcgcacttccataccaacagataagctggtcctcccagtatcgtgcagtgataaagccgtgtggcgaaaagggtttgccactaagctggggaatcaagagtcatcccatttccccacccaattcaagtaccctcccgtcccaagttactcgggagaaacggacccaaaagagttcctttccatctacgaatccgcaattgaatctgctcatggtgatgagaatatcaaggcaaaggtaattcaactcgcgctcgacggcatagccaaatcttggtactttaacttgcttgttaatagcacttgctcatgggagcaattgtgcgatgtctttgtccttaattttcgtggtacctgtgaggagccgaagacccaacaagaccttggcattcaccaaaggccagggaaatcgacgagggattacatgcgccggttctcgcaggcgcgttgccaagtgcaagatataacggaagcatctgtcatcaacgcagctttggccagcttgcttaagggtgaactcacaagaaaaatcgctcgcaaggaaacaaggacgatcgaacacatctttcgcataatcgatggttatgctcgaggtgaagaagataccaagtggcggcaagaaatccaagccaaatacgacaaggcagctgccaccgcaaccgccaccgcacaagctcaagcttaggcccaagctcaagcaagccattagttcgacacctgtgatggttcgcccttcacctccggcgaatcaagggcagcctccaaggctgaaccaagttccgatgacctagaaaaagttcagaatagatcgcgccggaaaggtagtgatggctgtcaaagaagtgcaagccctccgcaaggagttagacgcacagcaagtagtctgccagcaacaaccttttcgcaagaaagtcaagaaagatttgtacaatgcctttcacggttgctcttcacacacaattgagcaatgtccaaatatccgatagcaaggcaacactcaagctccaaggaagcagacagtcagagccgaagaggtgcctcgcgaagctgttcatgtccaagcaccccaggccgaacagcgccaagatgcacaatgaagagtgatccaagtcatcacaagatctgatcgcccttcgtaggcgtcgaaatgctagaaaaagatgcaactccgagcaatgcacaacattgcttcggcaggcgaaggggttccaaggtacttgacgcagtagatatctttcggaccagaggatgccgaagtagttctgttcccacacaaagaccagctggtggtatcggtacaaatgggcggttttgaagtttggcgtatcttgatcgatgggggtagctcagctgatgtcattttcgccagaacgtatgccaagatgggactaccgaccctggcgttgtctcaagtaccaaattcgcttgggtgttcggaggcgaagcagtgcaagttttgggtcaagccctcttgaaagtcgccttcggcacacaagaaaacaagagagaagaagagatactcttcgatgttgttgacatcccgtacaactacaacgccatcttcggccgaggcactttgaataaattcaagggaataccacatgcaccgtcttacacagtccatcattggatgggcgcccacatgtcttaggtcaagacgccgtccatgccttcgaccggaagcaaggcggtcgttcgcccccaggtgggtcccagtgccatcctccggctgacacgggggacatccctgtcattccctcttaattccatggagacttttgtggattcgtgtatggggggcacgctcgactgcgtgccgatgggacggggcatacctgcccccactccgcctgacagggggcgggacgtgggtgcgctgccacccatcccatgcgcctgtgaccggtcatagaccagtcaaacccgattgacgcacgtcaatcgggcggcgcctcacgtccgcccacgccacattaaacgcggtgagggacggttggggcaccgctcatttaaggcgtttggcagtgcctctccctctgcccactcggccgccacgtggtagctaagtgagggccttggggcagtgcgctccaagggcccgaggggtgcaacagggcaccccgaggccctttggccgcttcacgagcgctcgttctcccctgagggggtaggaacaggccatgcagccacgtggccaaatgaaaggattctttccctctatcttgcgtaccaccgggcccatatcaccgacagtagcccctagcactacatctgaccgtaaccctaccagggcggtctggcgcggtgtctcataacttcctgttttgtgatggtgggtcccatggggagtccaaacggccgtcatcggtttgcctagcttgagcacctaccatgatgatgacttgaccgctaataactgcgccacacacggggacgcgtagggcaggaaaaccgaggggtctgctagaccgcgctcggaatcattacttgccatcacctcgactgcctgactatcaggcacgcgaggggacggaactaatggtgggcccgcccaaccgcaaccgtaatcattgcacgtcccacatcgattttgccgctgacaggcgcattaaacacgggacgtggatttagtaggggaagcaggacgagtgggcacgaaaaacgaggaggcgggcgcggccgacgcgagaataaaaagtgagggaggaggagaattcatctacatcctttcgccattctttctctcacactcgcgctcctcagcgccctatcgttgcaacctccgaccaccgcgcttcgcttactcagtttctcgctcatactcaccggccgccatggctcaacacgccgggaatgttgttctcccgtcttcgcacatcacggaagagcgacacttgagcctcatccgcaagatcatgccggacggctccgtcgtgagggcaagggaaccgcagccgcggccgcggtacctggatcggtccgtgcaccttctgtccttcaccatggcagggctgatcccacctttctcccgtttcttctacaaggtgttgatgtaaaaacacgaggcctgggagatctgcttaactccagtgtaggtccaaaagcttgcctttaggtgtgtgagcatgccagctgatttgatcctacaatcaacaagaaataaagacaaagaaaccgcggttaaatccataaatgatagccgatcggctagttgccgatgacgtatcatttatctctgaaccgatgtcatatgtagatcgatcggcaatcatgaataagtaagaaagaactaaatctactcgatcggctatagacatttacaatatataattcttatgtcgatatatacttaaatcaagtgattgggatagatcggtcgccatgccgagacagtataaatcacttagatcgaaatatatattcacaacaagactatatatgttcataacatagccgatcagatagatctagcatgtatcggctaatactctgatactactctatattaagatattaaagcaagttgaatatactaaacaaaagcctaatatacttaaatgcaacaagatcgtaatataaagggcagatttaacatgtcaatcaagcatatagagtacgaagtagttaaattaggtaagatcggctgaaaccctgatactaccgtaatcggcaaccaaaagcaggctaaagattgagattctaatcacgacgtataagatcaaactcaactgatgcagctataagtatgaaaagaaggacaatatctagacaatcaagccgttggatgtttcatacagtggtaaatatcttatataatcaaagtcaacatcagtatttaacctaatcggctgccttctagtgacagatgttagccgattgggggttagataacgatattgccagagactatataggatatatgataactcgacgaattacataaatgagattagagtatcataaagatggaagcactaatcccgagaacgcaagccaccataacaagttttacctctaattgaagatcgaaatcgatgcagctcaacccgaaagcaagaactcgttgaaacaaaatgaaagtaaaagggagtcgggcgatgtattgaacgagtgttagattgattacataaggctcggggtctatttatacccgagattacaaaatatgtccgtgtcggacacgactcttatctctaactaactctaagacaccataagtcttgcggaagacttttgcccaaacatatctccaaacatatcctaattaatagatacaattgccttctcaggactcaatccgtgcgtggcaatcctcatgaagcacattaactcaacctgacaacgtgtaccgtgtcacattgtcggattcggttcaatcagctaacctagcccgactcgaactatgccgatcttagtcgtaaccgatccttactctgttcccggaatgatttccatctcaaactccgcctcgatagcatcttcatctccgatacttggattaccaaatttggtcgttaaaacatgccccccaagtccggaatatttgataatgtttcggattttccatatctcaactccgagaggatatcgcacttgccatttttccgaccgttaccgcatcgctttaaatactaaccgtcatcccgacaaatttcacaccgttaactccgttttcaccgcttaagccaactttgtcttttctctctccagcgaacccctcggcgcacaaggcgatctcaaagcgatttcctttccggtcaaatct

SEQ ID NO: 42190 - DNA, 6928 bp, Oryza sativa
tctaccaccgaaagtgcgtcacacgatccaacgtctgtgcgccttcttcaatgcgattggacagaaggttatagatccagaagatctagatgggttgcagaccgatattgtgaataccctctgtctttctttgataaaatggttcatctccctgttcatctggtgaagcaaacaaaactatgtgtcccggcttttctaagggaaatgtggccgtttgaaaggtacatgggagatctaaagtcgtacgttcgtaacagagctaaacccgaggggagcatcattgaaggttacacgaccgaggaggctattgtgttatgtgtcaattgcatgtccgatgccaatcctatcggagttcctgcgtctcgtcacgagggaaggttgtcaggtgttggcacaatcggaaggaaaagaattaggcccgatcaagcgtcctacgcgcaggctcattacgctgtgctccaacatatggcagaagtagacggatagtcaaacgttagacacagaaacctaggaattgagtctttttggaacagagggagtagatgcaagggcacaaaactcggtaagggtgaaaaaaggcattatattagttagcactaacctccaggctttccaatattgacaagattaacaaagaagcatgaatatggtctggtctttaatttgtcatattcctttttcatataagattttttttatgactcgaggaagtaaataataatacaattatttcttgaacatgcataatttatcatgaaactaatttcgcactgtagtttatcttatcaaaagaagtaacacatagcatgagagacgcactgctaattgtgcctcctgcaaggaagaaagttagtagagctaatcgtttgatagtagtgttagttccaaaggctactgcaagaaagagagaagcagattactcttatcttttagagaattttcttactatgtatgtaattctatactaagtaattctgcaatatttttcatgcacaaatcctccttcacttcagtttctcatatactcaatcctcaaacaaggagggcagagatacctgcctcaatcacaagagctgaaagctttcaaaaatttgatgaagctacattgaaacttcagtctgaagacctgaaacaccaaaaacaattgatagtttgactccgaattgatttgtgaaactattctaaactcaattgcgtaaattactaaattggattgaatacaggattggttatagggcattgagtaaaacttctgaaacatttgcaaaatcaaaattgtaatcttaaaacctaaacagatgcataaaccaatcagtaaagaacgcaaggcaagcttaattaacctttgcccgtgctgtcgcagtagttgttgcacgcacattagtattgatccagtccaaaccagttctccatgtactcatctaggcttgcatgctctgtggcaaccggagagaaattccacttgttagaactcttaacccacaaaatagagagctaaagactaaaaccacagtttcatctataagaacactcaatcctcgatggagagctaataactgaaaatgcagttaggattgatgtgtttcaccttcactttcctgcacatgcaggatgacacctcagaaaaagaacaaaatgctgatccatcgtgcttgcccattgcagggagtcggcgtcgtcgcacgcgaaggaggggtgtcggaatctacggcgcccggcggctgctgtgatgcagttggagcggcgactactgttgggttaggcggcggccagcgttgcgtgtgagaggatgccgggcgtcggtggcgccgcgcgcgaatgcggggtgtccgaaccgacggcgggcagatatccggcatcggcggcggagatcacggcatagattctgtgtgagattggtggctcgacatcggcagcgaccgcaggcctggactggtttgccgcaaagatcgtttttgagccgttttctcgcccgcgccgcctgtgtcagctgccacaacgccagcccagaccgtcgaagaaccaccgccaccgccgtcgtagtcttcaccagctgtcgcacctgattgtatcaaacacatttagccacaccacacacatgacgttcgtttcggcaggcgggcggagccggtcagcggctgccgcggaggagatcgtcgctggctcggcgatcttcggcttcagaaattcctgcacgaataataagaaaatctttcacaatggaagtcatcataaatcttgggcaggaaaacaagactgaatccccaaggcaacgcaatacacgtgaatccccaaggcaacgcaatacaggagaacaagacagaatccccaaggcagaaacaacacatggatttttttcattcagaggtaaactaacaatcattcagagttggcgatcggtgcggtggtagctcgtcgttgcgttgtagctcccaaatcctgcggtggcggtgtcgagaagcagcggggtgaggagacgaagcgacgcggggcaatgggctgatgggtaggaggagcacgcgaacggcggcagccacggcgactgtggcgatctggaggattagtcgtcggcggcggctggtggtaggaggaggcaggtgggcagcacgcgtggctagtgggcgaagtagtaggcgtcggcaacggtggcgtccacggcggttgcgggtgggtgacggcggcgtcgacggctggggtggatgggcagaggaggcaagcgggcagcgcgcgtggtgagtgggcggaggagtaagagtcggcggcggggaggaggaggagtaagactctgcccggcgggggatctggagcggaggcggcggtggttgtgggtgggtggcggcgtcggcgaggaagaatcgttcgtgggggtggattggcggaggagtcggcggcagttgcgggtgggcggcggtggcgagtggcgattggagtggagaaaccgtctggcagtctactgcgatggcccgtttgatatgacgatccgatggttgatattacacgtatctgtccgatgtctctgctaggaatcaagaccaccattacaaattttctaagtagtagagatgagtttagttaagagtagtataagtcttggcgctcattaaatgtgagtacggctattcgaatagattggtttactcacattgtaatagatgtacgcttttaatttaatggagatctttagtacacaacctaaacacacgcaaataaataacaaattctattatacaaactgggctaggccttccctagaggaaaaccagactttatctgagaatgctatttcttttaaataaacttctaggaattatacttcgcaaatagagtttttagtaaatactttactggtagctattatttgcaatatagttgccaaaagacttaaccctttacagggactcatagaaaataatcaaaacaatatttcttttgtaaaatagtatttgttttaatgactatcccaccgagggtgtccatccataatagtaatatataattttatttacagagcaaatataccagaggggctctattatatagagaagggtttttaggaagataactagtattagggcctgttcactttgataaaaaaaaaccttattaaaatttggcattgccaaaattttggcaactatgccaaaattttggcaacttatcaaaatttttgcagaatttcttatatagttaccaaaatttaacagcaaactaaatatagccacttttttagcaactttaccaaaatttggtaaggttgaaaatggcatcaaagtgaacaggcccttaatatatttcataatcatggttctttaattaaataatatttgaaatcaaaatacacgcatattcttagaagttcctcatttagcccatacataaccggaaaacgaaaaataaaatcaaataaattctagcatgcaagggagggcctcatcggttgccctatagcttataaaccaaagccaaaatttgaattttaaaacttgattttgaatttgattttaatattttttcaacattgtttttttttcaactttggcttttcaatcactaagaacatacatacaaaagttttactcgcatattatttttttaatcgctaataaaccgttatggcttataataagaagtgggcaaccgatggggaccggagttcaaaagatttttggttattccgaatttttaattccatattttagagtcaaaatttttagggtgttacatggggcccacaagttgtttgaaagtggcacagctgaccgttgctttgccggttcagccgaaccccttgtgggctgtaacatacccaaaatttaaaatttaaaattttgcacctaaagaattagaatgactttttcctatctaggaatcctagaatttttgcatcagacatctaaatgagcccatcatagctagaactcaaataacaatttaggacaatttaaaacttttccattctaatttaatttgacacgtaatatatttcatgtttgcattagcacaaagtgtggtgtgtgatttgagtccttttaagtgtttttggaatttaattgcattgcataataggtatcatggcattaattaaaaactggaggcaactaattttgtagaatgacttaataactttattccctaaaggtcattcaacttaaatattccagcctaatcagtggcaaactctaatatattaaattggacacacttccctggacattgtcatgagcataaagttttataaacacaataactccttaccctgaagagaactaataatttgtatagttaagtgatcaccacacacgtaatccaacttctagaattcataggaaatttatattagctttaaatattatgaactcggttttgttagattaataaaatatttttcttcatttgtatagacagcaagtaacacatcatgtacagataaacatctaaaactatatatataggaaactactaacatagaacgcattataatttgtagaatgcataagaaattcattttagctccaaaaatgatgaatccaattatgttgaacttagtatatcatgacctttcctgttaaaaaaatgaaattgtacagaacatggttagaaactacctttaaattcgaataaagcctaaatgacataattgtagcctaggacttgtaaaattcctatctcccaaaataaatgagataaaatagaaattcttttacctaaattcatataaggacagaaccttcccactgcgcacaaaacattcattttagagaattttgtatttttcgcataatttggtatttatttgcatgtcgtgttatttgtctagataatttgcattcacgttaaaggagtgacttaggaattgtccaagttgcacaagatcaaggcaagtttttcctcccccttcgtttgatcacattgaaacccatgttttgggagatgaaatgtgttgtttgcaaagttgcatttatattttattaaaccaatatttgaaaacttgggatatggtagttatccctaacttgctgcataaactcccttgaattattgtacacctctccatttgtatacttaggaatggttagagtacaacacttgtgttcatttggggctacaaatgcttaatatgctactatgtgcttagccatgcttagaattatgcaaataatatttatggtcactttataaatgaaattttgggtattattttgctgctgtacagatatgaaaattatgattatttctgaactaaaaatgaagttaaacttattttaagcttgggataccactggtgtgcatatggtggtagttgcacaccaatagggggagtgttcgcccgggtcgattaaggaacgaacttcgtgtcaccctctaatgtttaccgtgcatcgatatgagttattatggggtaaccttggcctattaagttaagtatgtctctaaccttgtactcgggaggctgttctagtaaagatggcggtcacggtttgtggagctatctttaggaactacctatgtgtgtgtgtttgtttgtaggatgactagttccctatgtatgtgttctatgggggacagatgttccacctcacagcatgggcgtctaagtccgtccaatacaatgatagcatgcctcgtgggggaacggatgtgttcgccgccacagcattaggttaaggcgtgggccctccacctaacggctctaggacttaagcctagggtggattcacacttatcgtgctcatgcaaggttaggtacttcttaatgtaaaagctcgttgtgtcctctagaccacactcaatgtgtagagagtggtggtaccgacgggtaccggacaaactagagcgattcatatcatgtgggtaaagctatacaaactctgcagagtctaaacctaatcgattagcaatgctcatggtcatgagcgacatagtgagtggtatgggtatagttttatgatttatgttttcaaattgtgattgtgaaatataggttggaaaatggtaactagtgtagaattgtattgattatggtacatagatgaataatgtgagacttgatgccggtttaggtatcaagaatgattataatatgatatatgataaatattatgatatatctatgttcgtgttttgtcaattgaattgtcaactctctttacaaatgattgtgaactaaaatttgtctttatgctaaaatttgagctaaagaaagccttcctttgaattatggccttacatgtagtatgttaggcttgttttgtagttgtcagtacattaatttgattaatgtactgactcttgccaattgtttatgatcttgttttgcaggtagtaggtttaaattatgtttagtgattcgggtttcgactacttcttctaggacttgattcattaggggtctaccactagtcggctgcttatgggaacgggtatacaa

SEQ ID NO: 42191 - DNA, 2943 bp, Oryza sativa
ttgtgggatagagagagtaacaggacggtatctacttgtagggatgctaatataggctgtgtttgctgctcagggttcctaaccattctttgtcgttttccgcgcatactttttgaactgcggtgtattttttgtaaaaattttctatacaaaagttgtttaaaaaaatcaaattaatctattttcgaaaaaaattaactaatacttaattaatcacgtgttaatggaccgctctattttttttacggagagaaagagttcctatacaagatctccgaacgcagctatagtactgtttagctgaccattcgccataagtaaattgggcgatgctccggtgctctctgtattatactacaagtagaaaagatttgtaccgttcattattaaagataaattagtaatttattaatataataagggtaacttagccattttccatttttccacctcatggatcggcaggtcgatggcatcaagcccatgcaccttgacttgctagttggctgtgagcctgtggctagctcggcacatcgtccagatcgattccatccagaaattaaattggatcgcaagttatggcggcggcgagtggcaagtcctccgcccggcggcgcgtgttgatcctgccggcgatgacgcactccggtggcgtttgaatcttataaatatgaagatgaaaattaagtgtttcatataaaataaggtggtaataacatgtgattaattaagttataattattacaaactaaaaaaaatagattaattttatattttagagtaactttcatatagaaagttttcacacgaaacatttttttagcagtttaaaaagcgtgccacaaatattcaaaattttattctctcttcacagaggattcgagcggggcctccaccgtgcccctttcttctcgtccacccatccccggcaacccatctgtgccaattttgcacgcatgagcatctctccgatccgttccacgcggcagcggcgcatgggctactaggattagtgagtgtaaatgacaactatacccttccacaaataatttttcctgaacaataatacccctccacgattctactaccgttaagtgaggtggtagtagaaataaatttaaaccctttgatcaagcagtccattagcgcgtgatcaactaagtattagttttgtatcaaactgcgcacggaaaaaggattaatttgatttttaagcaactttgtatcgaaatttttttttaaaaaaggcaccgtttagcagtttgaaaaacgtgcgcgtgaaaaatgagggagaggggttggtaacagcatgaaacgaacgcatctgccctgttcagtcaactgatggatgaagattatatacataaaacgagaacactattaacatattgattaatttttaattattttatacataaaaaagaaataatttatctaatattttgttaaaaagttttcgcataaaatacaccgttcaaaaatatgctaaaaaaatcaaaataaaatacgtttctttggctgtgtttagatctaggaataaaaatttttgccgtgtcacatcagatatacggaaacacattggaagtattaaacgtagtctaataacaaaaaaaattacagaatccgcatataaactgcgagacgaatttattaagcctaattaatccgttattaacaaatgtttaatgtagcaccacattgtcaaatcatggagcaattaggctcaaaagattcgtctcgcaaatttggtcgtaatctgtgtaattagttattttttagtctacatttaatattacatgcaggtgttcaaatgttcaatgtgatagggtgtaatttttttgtgtggaactaaacaccccctttataagaaaagaaaagaacagggctagcactgctcaatgctagcagtacccacaatggtcagcaacaacgataacgaaaaatggatgagcaagagacattgagagaccccatgtatccttcggggtcgaacggacatgctacgaaacccctatcctcttgtcaaaggatcattgaagtctggcctgcggcctgcccgtacttgtgatccgcctgcacgacgacggcacagtgcaatggatacaggaaacagtgcacgcctcactgctacacgttcccctccctacgcacgctaaaaaaaatttctctcccacagtgcaagggtcttcatgcgtagctttggttttttcgtttcagcccctcgcattttctatttcagtcccttgctatctttctattaacaaagaaatccaaattttacactttgtatctcgaaagtcagataatacgtatagatttctccccaatcagataagcctgaagctgccgtttcttctcccctcacaacgtcccatccccatccccatcgccggcgcccctccctccccatcgtcggcgccctctctcccatccccatccctgtcgccagcgccccttccctccctgtcgtcggcgcgacgagccgcgatcttgaggttagtttcttgggttgctttgctgcagagactgatctcctgttttttctttcttcttggactgctctttcagatagaattttttagatcggttttctgttgaggaaggcaagttctttcgagggtgatttgttgtttgttctcgatgtcttttttattgattagtactaaagcatctattctagattggtcttgtgttcatgaatacgcttaaggtgttgaagccatcaatcagttcagtgtgtgctaacctgttccaggttctcatctgggttcatgatttgaattggtttagttttttttggtctttgcgattatgaaatttcagtagttagatgttgattttctaatagatgaacagtcgtgcagtgcagtatgtcaatcggtcaatgactaatgcagctgttcatgtcttgtgcttgattcaggagagcgcgggaggagaaga

SEQ ID NO: 42192 - DNA, 19394 bp, Oryza sativa
tctcttataatgtgttcttatttatagaaaaattaaactctactaaaaatccattaaacttcctagattctcatcctaccatatggcacttctataaacccttctaagccgtcacatgaccttttaataaattgatggacccatagttaagtagatttacatttgcaatgaacccgacattatagggcatatattagatatgttttttaagaaaagttcatgtgcctaggtacgtgcttacgtgaaaaccacgttcggtgcgtgtagctcaccctttctattcctttcgtattctatttcaatgctatattaggggctatttgggataggaggaacttattttagtccctctcgcaaaagtttcagtccctaagtcccttccatccaaacaccaccttattaacataaaaaatcattggtatttacaacaataaataaattttaaattactaaaactgaatctcctgtcctatacacctacgtatgaacgtatgtacgccctccttcctgttctgcggccagtgttccccttctattgtttcttgtttctgtattagttttttttcaatagtggaatataatatttcggcctttgctcaagaaaagctacaactaattattacaaagtagcactcgagataatagtatagttcaaataaaatagaacacatttaaataggaaaagccaaaataaggagaacacatttattctagcttatttgtgaatctctatccatagtttgcataaagttgcataaccattgtctccaacttgcgacatgcaactttcaaaaactctccatcttcatcacacctttgtaattgtgcccaaaaccggagccaatgagttgccctgaaaattacctgcatatagaaaatagatggtgatttatcaaaaaccatatcatttctactcaaccatagagcccaacaaatggccgaagctctgacaagtatcagtttactctttttcttgtcaacccccaaaagccacctatcaaaaatatgagatatactaattggaaggttaaaaccaaaagaaaactaaactgctctccatatgaattttgcataatgacaatccataaagagatgttgaatagactcattattcatacaaaagcaacacctcaagctgccgttccaattccgtctcgccaaattgtccttagttaacacaacccctttaagcaagtaccacataaagatcttaatcttaagtggcatcttaagcttccaaatacacttatttctctcaacatagccattattaattaaagctaggtacgttgatcttaccgagaacctaccgttcttatggtagttccatctaaaacaatcagaagaacgattcaactggatatgcacaatagaagcacacaactcatgccaatatacaagattttgaccaactaaagctcttctgaaagcaacattaagcggaacagaacccatgacagtggcaatagaagacgatctccttcggacaatagcatataaatatggatatttatccttcaaggccaagttgcctagctatttatcttcccaaaatctaatttgttccccatcattaacaatacaagaacccatatctaaaaaagtactcttgactttcatgagccctgacaaaaatgataatcaccttgtttctgtattagttagaggaacaaaatagaaaacccaaaaataatactgctaatttaaattattacaactaaatttatgactcgagagccaagttaattactcttaagtatattttaacataaattcaaacggttagtagagtattgaccattttgcaagagatgtgtgcattaattatatcaaggtccttttattgtggtttttttaatagaactatctcatgatgagttgcacttaatgatgttttactacagtagtatttggtgaaaacatattatattgatttttccatgtcatgtttggagaaggactaacagaaaccttaataaggcaccaagatttattaccacgtcgtaaatttatactataatgattaatattacgaagtatcattggattagggaaatttgaccaacaccgtgtaaaatcctgccggccaaaccatttaacactctagctctaaaatctacattaacatgaactctatatgttgattgagcgttcatatgcatactccacttacacttctatcctcacttcatataaaaatgattaaatataggtattatatttaaagcgtcaagactgatttataaacagacttttatccatgtacaaaaccactaattataacaacctatggcatatatgggcctcaactacaccatcctgtaggcttcagacaagctagggagttgaatcaagggtcaccggcctgtaaggtggtgttcttctctcgtgaagatgaacgtaaattttttttacgtaaaatgaggtggtattaacgtataattgattgagtgttaattattacaaacttgaaaaatagattaatatgatattttggagcaacttttatgtaaaaagttttcacacgaaacgtaccatttagcagtttgaaaagtgtgcaacaaaattcttaatcttcatccaactcttgttggagaaaagaacatgacataagtatgaaaattctaccacatcaatgtctaaatttcatattaatcaatgtcaccacatttaagtaaatttaacaataattacaataaaaattgtggatgaccaatttggaatcactatatatcatgagaaaaagctcacgagtcattaaggaaaatagaaattcaggaaaatagaggtatatctcaaaattcatagaataattagttcaatattatctgtagatctcagctatagttttattgctcaatgtatatacatgcaatcaaaggcgtcaaattctttacgtgtaagcaagctttgaaggaccaatgactgcatgatggggggactgctatatacattgatattttacagaaactttatgtatagataaaagatattagtcatcataaaagattctaacattaatggaaaaaaagcccatggtatcgtgtgggctacctttctaatttgacttaaataattacagtagtattaactattatacatattatatcatttgacttatatttaaaaatacatttatgtgtgatactaattttaattttatagttgttagattatatataatatgaaataaattacagaaaacctacactacggcatcccgtggagacgggatcccctcctcctacctcactcctctccccaaaatcatccgaatcctgtcctcctacctaactctcctctcccaaatcacacagcactgcagccctctctctccctctcccctttctctctctctctctaaagaaggccgagcggagacgaagccggccgggaggaaggggtcgtctccggcggccgaggaggacgacgacggcactgcgtcggcgaggtcggccaaccctcggcagggtcaccctcgagctcgcctcccctcgctgcgccgctctagctcgccgccctcgtcggtcgggtgtgtgccggggagttgtcgccccgaggagggcagaagcgggagctcccctcgtccttgccctcggcctcggcgtcaccgtcgtccctgctgcggcctgtcgcttttgcgccttcggtatggacgccggcagcccgcgtcgacctgcaacaggtatggccatcaaactcctcctcggctcctcctcgagacttctcgcgctctctggctcaggcctcgctcctcacctcgctgtgcctcctcgacgccatcctccgccgttgtggccctccctctcccacgtctcctcctccttttgacagtaccctccgatacctcacaagtatcatgcttgataccttggtaccaaggtctgatacctagatatcacccggtaccttaggcaccgggcatcaggtatcggtcgatacctagttggtaccaaaggtaccaggtaccaggtaccaaccggtacctaaggtaccaggtactaggggagcacatgtccctcacctcgccgtgcctcctcgacgccatcctccgccgttgcggcgctccctctcccacgtctccctcatcgttaccctctgataccccacaagtatcatgcttgataccttggtaccaaggtctgatacctaggtaccacccggtatcttgggcaccgggcatcagttatcggtcgatacctagttggtataggttccaaccgatacctaaggtaccaggtattatgtaccaggtactaggggagcacagaggaaagaaaaagagagagtcacttaaaatattccgttgcaacggtatccgccctcaataaattaatagtcacgtacttagaatttgggcgagcagtcagcaccaatcacgctgtttctgttgacttctactcctaccagatgctacagtacctcccgtgggcccccacactcctactgcttcccagtgggcccccaaccagtccaccatctgctctgttcctgtgcaagtctgtaaccaacgctactgaccaccatggacacttggacatatcacagcacaaaacattcctcgctccatcttccgctccagtctccattccccagctcgtagtagtagctgccttcctttacactataaattcccctaccttacacacagatgtgtccaagtgctcatcaacaccgcctgactcatccagtgtgaggccgtgagggtgagtgaaccctgtagcggcagtcatgaaggtaagccagcgagcgagctagctattctactccacaggacgcatgctgcgttgtcgtcgtcttgttctactaatagtttcttgttccgttttttcttcatgataatggattgatgctgtggatgtgcacgcgtgcgtacgtgcaggagagggtgaggcggcggcgcatcccggcgttcggggagtggaactacgacggcgacggcgaccttggcggtggcggcggctgctatggctacggctaccgcgacggcgactggccggtcacacagtacttcgactccgccatgcaggcccgcggcctggtcatctccctgccgccctcaccaaaaccacccaagaaggtataaacttgtctccgcatcatcgttcattggcaacacttgcaaagaaggtaaacgtaagtgttgttctgaggcggatatacatcatgtttttttttttataaaaaacaagatttggacaaaaatcgtgcttagtttcatttaatggctatcatggatctctgacagggtaaagaagtttttcaaaaagcacgatacatggcgtttgcatgttgcaacctgacagtttttcttacggtcaaactcacgcggtaaacagatgattggacggttgtcgctgttgatctctttttttaccaggcggtgaagtggattgacagcggcgcacttggggaggaggaggtggtggacgagaagcagaggcagaggcagcacaaggtggtggtggggctggcggtggcaggaggagagcacggggcggcgaggaagcaggggaagcagagcagagtggctgacggcggggcccatgcggcgatgggctacaaggggtgcaggccggcggtggtcaaggccgtggaccgggacctctacgagatcccacccgacatgctctgcaacaagccaagggtaacgcacctagtactccgtatctcttgatctctctctcgatggtggttagtagtactccgtaggggtcgcgttgcaccagcaccactccatttgcgagcctgcactgacatttgtgcttgtctcaaaccacaacctcgctgactcgtgtgataccattacatgaatcttttctactagtagtctatccatttcacagtgctgattttgttattcctaatttttttgggcctatttagttcgcgaaaaaaaaatttttatgtgtcacattggatgtttgatcggatgtcggaagggctttttgaacacgaataaaaaaaaataatttcataacttacatgggaaccgtgagacgaatcttttgaatctaattaatccgtcattggtacacgtgggttactgtagtacttatagctaattatggactaattaggctcaatagattcatctctcattttcctccttaactgtgtaattagtttttttatttatctatatttaatatttcatatctgtatttaaagatttgatgtgatgtttttgggaaaaaaaattagtactatcattatgctgaaaaaaaaatcatgttcagtaaaaaaagtttttttatggacaacccaacacggatgcttgtgcaattatacttaatgaagagtagttcactgatgcttgtgcttttcttcgtttcatgtggtttcagaagagggtgaccaggagcctgtggatggggtgcctgggactcagctgcgttgcctagggatctcaccagatagatcgatcgatcacacataccaaacctgccttgttttgcgtgtcgttgtaaagtgaagcagaaacccatggacggaccccatcgtgatcgatgcatgctgtcaccacggtcgcacggcccaaactttcccattcatctatctccctcacctgtctcagcagcactagtgtttggttggtgtctctctgtgcgttttaggagtagtagtaaaatgagatggacatggacatgatgtgtccggcagcgtcatttcctcgtgccaaagaccactcgagtgctgcctctctctctctctctctctccccttttgatctttttccgatgtgttttttttttgtagcctctgcttggttggtgtcccatgaaattacggaggcagctcggtgaaatgtggttatatgggttggtgccttggtggacactcgacactgatgagtagcagtggaaaaaggttgatgtaatggaacgctgtagtctcagctcaggggacttgtgccgcccgtggtgaaaagaaagaaaggaagaaagctttctgttgatccatgtcttgctagtactactacaaatatgtgtttatataggccgagtttagttttaaattttttcttcaaacttttaattttttcatcacatcaaaatttttctacacacataaacttataatttttcatcacatcattccaatttcagctaaacttttaattttggcgtgaactaaacgcaccgatattccggcactgtgctgatagcacctttttctgtcattgatgtgacagtgtgattgtgcgattattatcctgggtgttaggactacttcagtgataaaggctgtgtttagtttcacctcaaaattggaagtttgactaaaattggaagtttgaagaaaaaattaaaagtttatgtgtgtagaaaagttttgatgtgatagaaaagttagagtttgaagaaaaagttgagaactaaactcagccataatcatatcttccaagttatacttctgctttcggccgtgtatttgcaagggcttcttttccctactcacttttgatttgtaacgtgcacatttaattgctatactaagtagtattgtcaagctcaaaagcaattaataccaatgctgaatacttgaaaggaaaggggtgtggcctatcagagttttccgtttaaaaaactaattcctcgctataggtggactgggatgatcgctgatatggctataaagtcgcgtcccgtatcagatacggccacggatactgatacgtatcccacatattcacgattgtaaaaaaacaaaataaaatataactgacatcggcatactgcattggttcgggatggaaggaaaaacacatgtgcatgacgtgagatacgccaacgatacgcccatggtctgtctccgtcttcgctcgcatcagggatacgccgcctgacgcgctcccaacctgatggctgatgtcttttgcctgtacccggttgttggtgatatgggccccgcggtacacaagatagagggaaagaatccttcgatccggccacgtggccgcgcggcctgtccccccgcctcccccggggagaacgagcgctcgtgaagcggccaaggggcctcggggtgccctgtcgcacccctcgggcccttggagcatgctgccccgaggccctcactcggcttccacgtggtggctgagtgggcggagggagaggcgctgccaaacgtcttaaatgagcggtgccccaaccgtccctcgtcgcgtttaatgtgacgtgggcgggcgtgaggcgccgcccgattgacgtgcgtcaatcgggcttgattggtctgtgaccggtcataggcagatgggtggcagcgcacccacgtcctgccccctgtcaggcagagtgggggtaggtatgcctgtcccatcggcacgtagccgagcgtgtccctcgtacacgaatccagaaaagtctccatggaattaagagggaatgataaggatgtctcccgtgtcagccggaggacggcgttgggacccacctgggggcgaacgaccgccttgctttcggtcgaaggcaaggacgacggcttgacccaggacatgtgggccccatccaatgatggactatgtaagacggtgcatgtggtatccccttaaactataaaaggatgaccttgtccacttaaagaaaggacgccacttgagaagcttgagcctagggttagaactcccttgtaacagcacaagcctaataccacgcacaggagtagggtgatacgcttcctagcggctcgaacatatataatcccttgtctctcattctcttgcaaacgacctggtaagctagatccatagcggagatacgctcttgattatcgcgccttatctcccggccgaactcacaaagggcctcgcgacctcccgcttgagaggatcactcctcgacaccggcgttgccgccagacgctggtagtagccgcgcgtgttgctgccgtgcgcggggccacaatgtcccctccgcgagaaggcagagccgctactgagcagaggcgtacctccttcgccgccaacctcataggccaggaccattgccgcgtgagccatttcctctgacaccgggcatagcggtggccagtggcaggctggcagcatggaagcacggaacagctttttctttgttcgcttgactgcgtggccgggtaaatccatgctcttcgaacttttcatgcttgaatgtgggatcccatgctgtttgaatagggactgcaagcttagcagttttagaccttcagtgccgttagatcaaaggatccaacgatcaggatatacgtaggccctgtttggtaggactccaaactccaaggagctggaggttatgtgaaaagtgtttggcaagcttggtctgctccagaactctagaaacagaggatatgagggaggttaacaaaagtacccttgtggttttttctgtttttgtgatgtatgactgataactgtttatttttctttacaatttcagcaacaaaatgcaaggttaaaaattaatccacaaaataattgacataattagtgaaagcaccaagtgttttcttggtttagatctgaaatttgtatagtctaccattttgttctcacttcaatttgtataaacacataatttttcacttctacatagttcttataaaacaagaatcacccatgacatacatgcaaaatcacctattgttcttttggtctagatttcaaattggaaaaaaaatgaaaaaatggtagaggggattagctcctcacagccctagccgccggccgtgcgccgccgtcggccagctggtcgcgtccgctgagccgccgccggagagccgcgacctgctgcccgcctgaacatcttgatcttgcggcgctccttctcgagctgatgcacgcctccacccccgtcgcctccttggccgccgccgctgccatccttacagcgctcttccttggccgagccgccgccagagcaccgccgtcgccctgctacccggctgtcaagccgccgccggagcaccgcggcttgctgcccgcctacgcgtcgccgagcagccgccagagcgctgcggccttctgcccgcccgcgccaagccaccgccgaagcgccctcgtcgccttgttgctcggccgcgcgctacggttggcccgccactgccgcctattcgcccgccgctgccgcctcgctcgatgggtgggacttggagagttacgggagggaggtgaggaggtgggggtaggttagtggcagtttcacgtaaatatgtcaaataattaaagggtagtgggtcctttggggttgagtggagctgtggagcagaaaaacccagctccacccccttagttcattttttaggagcaactctacaaactccactctagaaaacttaggatctggaccgtttggcacagctccggctctatataagttggagttgggagctagagctgtgccaaaccggcccagagtataccgtttgctagcatttgctacaggattaatctgctacagtaatctactccctccatcccaaaataaatctgcttctggaattcaaattttgtcctaaaataaatcaacttctacattctaatccactatcaggtcataaatcaaaaaaatttattccttcaatatcccttacctacctatcaattaacagtgaaatttggcaagccccgaagacgtcatcggcctaaaatcattatcggcttcatagtcctggaatcggccgatgggaattatcaagtcgccaatagtcagattattgctgtatttggttaaggaaattaatctactaaaggaagtttatccagaagtgactgagttcaaggaggatgcaacatgacagtttatctattagttacgaagagtctttttgtttccttttatctttaggaaggtgtgtttagtgtcccataaggactttatgtttcctttttatctttagaaaggtttctttcttggcctaaccggtttggccgaaccagggtttcggccgaacccctagtgggcctaaccggccccacttttggccgttgggttccaatggtcagtgtggtcgtggcacaataaattttcattgaaaattttattttgtttgaaaaatcatttgaaagaatttcctcaaaaatcaatcttaaatgcaaaaatttgaaattcaaacatgcattgatgcaaaagttcaaattgttgaaaataaatatgcggatacataccaatttaccttttggcgaatatcgcgtaattttgggtccaacgtgcaagaccgtacctcccttcagttcagatcgcggattttctgcccgtctgccgagtggtggagcgggtgtctttggctcttgcttccacaccttctttagttttcgtgcgggagacggcttcttctgagccggcttctctagcttcttagccggtgtattgagttttactagcgtcttccaataacggttcctgggaatcgttgtttccttttcctagatattctgcataaattttaccagaatattcatcttgggtggctccacttcgaccacttgaatattctgcgggtttgcccgtacttaatccggaccatggagcattgttcggttctcggctagaactcaaatttctcttctttctcgttgatatggaaacggatgctatccgttcccacgtcaatgttggcttctgtggtgctaaggaatggacgccccagaatgagcggcgtttcctttttagtgtccatgtccagcaccacgaagtccaccgggatgaagaaatcccgtatcttgaccggaacatcctccgctatcctagatgtgtaatggaccgacgaatcagccaactacaggctggtgttggttccaatatcgtgaagttgagcttatcgaagacgtctttaggcacgatgctcacgcttgctcctaagtcacagagggcttggtcgaattgctgtgtcccgattgagcaggtgatcgtgggacacccggatccttcttttctaggagcttctggagtatggcattgctgcactgctccatcagcttgaccaccttagttgtcggaagcgaccttttgttattgaggatatcctcgagataacacgcgtatgttggcacttgcatagcatccaacaatggcacgttgatatggatcttctgaattacttcaacaaaatgagtgaactgctcgtccactgacggtttcctgcttctttcaggaaacggcagcaaccgggtgtcgtagtactcctgcggcatagtcttctcttgctgaacctcttcgtcagtcgtattaccggatggtgcttctctggtgatactgctagtccttgtaaggttaggatatggcggatcacgagtagacttacctcccctcgttatgatcaccttaacatttctacggaagattcgggctgccccggaatcctcgcagactcatttgcaggtactaacacagctaattgtgccagctaagtttcaatcatcttattaaagctcagctgattttggaatgcagaagcaaagccatctagcttaacatttatattctctaagtccttgtcattagcagctagctttttgctaagagcatatgttgttttagcttgcgcaaagacgagatcttcgaaggagggctggttagaaaagttaccgttgttgttacctccttggtaatatgggcatggctggttccacccctgacctccttgtggacgatacccattattgttgttgcccatgtacatcgcctcttcatgggtctccgggcagtcattcctagggtgacccgtgctgccgcggacctcacacgtgacgtgtgagtccaaggccttgacggtgccttgtggcctcttgtcatggtcgtccaagcgtttcatgaggaagtccagcttggcagcaagaatctccatctccttgatggtgtgcactcctcgctgacgggtctggagtcgttcctcgctccaacccatattggagaccattttctctattaaatcgatggcttctcgaaccgtcttagagaaaaatgctcctccagctaccatgttcaggtggtcgcgagacatgggagtgaatccaatataaaaattttgcaggataagccagtcgtccattccatgatgaggacaggcggccacatattcctgaagtcgttcccatgccttaggaatggactcgtccgtcgtctgctggaagcttgaaattcttccacgaagggcttggatttgcccctcgggaagaacattaataagaatgccgtagagcatttgtcacaggtgttgattgtagcacagttggcataaaaccactgcttcgcgttccaaaggagggaaactggaaacagccgtagcctgatggcgtcaggactgacttccttcatagtgtacgtgttgtagatctccaggaattgttgcaggtaagcattggcatcctcgttaggcttgccgcagtacgggctagcctgcgccattgtgataaggctagacttcagatcaaaatccacgtctcccatgttgatttgcgagccaatggccacgttgtcagcagagggagcaacgaattcacggagggtcttgtcagccatagtcttgaaggttagtggcattgttatggctggtttctttatcgggagagttttttgtggagcgacgactctcggcttgacgctccgaaagaaagcttctggattttccttaaaagtttttcggcaagttgaaaccagtcatgcactaccctgtttccacaacaaaagtgataacaaccaaggttagcctacaaaggacagtgattatacagaggtaaatagaaagtattagtattggtaatctcttctataaatcttccccggcaacagcaccagaaatgcttgttggtatttcttaacgacattactagaaatataattcccagcaatggcgcagaaatactcctggtatattatggttatagagttcatccacaagcgcatggatataccattgtagcatttcacccgagagtattccaagggtatcgtatttatttaatcccgtgggaagattatagtagacagaaccttactaataattcatatgttacttgtaataatcatagtctaagcaggggttaatataattcaaagggtagcatggcacataagcataagacctctcattctcctattaagttatctaagctaagtgggaagaaaatagaaaagaatatattcctatacttctagtatacatattgttgtcgaatcaacaactgcgtcacgtcgaaggacgtggttcttttaacagtggttggaagtaaagacaattgtattgcttagtaaatttttttcaaatccccctgttacatggcggtttaggctttacagggaaatttacatggttgcccttttaatagggacatctttatgggtatacagtgtcttttgctcgtatgggttcctaatgggccaagtgacatggccttgtccctggcgaagcctctggaaggcgtgtcggcccgctgggccttctcctggcaatgttcaataattggcgaaacccatgccctttgtggcaaggctctcgcctcgcggccttcaaccattcgcccctccaacagggtccatctttggcgaagcttgtcaaattgatgctgcggctttcgcctatgttgtcccttcgaccttcgccgcttgcctccgtcccatgcctttgcctatctcctcggttttggtaggcctggtcgaaggtcctcgtggtatacctccaacaagcccctcacggcaagggtgagtagggagcttcggccgaggctgtgcaaatcgtgtggtataccatgaggcgcctccttccggccgatgttcctgccgaaacctatattttgtacttgcgaaaaagtctggcgttttgcattagcagatctggtgatcaatgttctttcctttcctcgcttattattggtgaaatggttgaatatgttgggattctcgtgaacagtaatgggctagatgagccggtctgccgttactttcggcctttcactgttcggcctgccttaacgtggcagtcccttactgggtggtaggcgaaccgtcgcacgggtgggttatatatatacttccctcccggcgtcactttcacttttacctctagtcactttttccatctcctctgtggctggtatcgctttgtttctccttgcgttcacgggcttttgtcacctacttcggccagcgtgaccttggctcttacatcgggctttccggacttttcgcccatggcccctcataaacctgctcttgctttggccattggtcctgatctggggaagattggcagagatcacaccggatatctcggcgcttcacttatcaatgagacggagttgacgaagctggttttggctagggtcgtggccgaaggacaagccttcgctcctggcaaggtggtggtgaagcttggggacaaccaaaccgtggtctttgctgcattttcgatgcggggcttcgatttctgtgcaacatcttgctgcttgagatacttcggctcttcgagatcgaattgccccaacttagcccgtgcgctctggttcgggtcgccatcttcgactgggcatgtcgaaccgcgggtttcgagccgaccgctgagctttttggggcgatcttttatgttattgtcaactcgaagacggtggtcaccctggccggcacctggaggacggtcttcgggagcacaaactttaatttccgccctgagctctccgatttgtggcccgtgaatgcatcgatgcctaagtgggatcgccattggatgccgaaaaggttttacaacagcattccttttgaggccgcatcggatgcagccaaggccatgaagtggcagcgtagggccatcgtgcgtattcggaagcccaaagtggcgatcgacagtgcaatggaggctcacttcgccccacttcggaagactgctctttggcttagctgtcgtgtcttggtggaagagttttgtatgctttagattcttcccctttcatggacatggcaagtcgaagttgacaaggaggaggaggcggatggcttgccgaggctggtgctccctgagggggtgaactgtgagttttctatttaactcgtgatatcgttattttttgatgttgttgcttttgcctatgcttccaccttgtactatgctcattccttttcccttacttcgacagtgctttcactgcctcaggctgaaatcgaggcccaaataatgatcgaggagctcatcataaacaagtttagccagctgctcacccgtcagacaggcggcaaaccgtattttttctggcgagctgccgagccgtgcaaaccctatcaaggtcgtcgtcatcgacgcagatgatgccgaaccatctaggaagggcaagcgggcaagagggaaagctgcaccgcggaaacacagaccggcatcctttgctgactctgatgctgacgaggaggaggccgaaggcgaagaagagggggaggaggatgccgtggatgagacgggtgaatatctgttctcccccagacacgacccaggccatgagcacgtcgaggcgggggcagcttcgagctcgtcccctcttcgcagaaggagctggagtgggcgaaggctttggccgcaattgcggggattgctccgttaaatgtcggagcgggtgcgaagagggctacgagggtggttgtctaagttggcaacgcgtttagagacagtgactcatcacaggacacccccacttcgccagccgggtgaagcccgagtctgccggccgccgccaccgcagctggttctgccggtgaggtgggtgggagctccgggcaggtgcttctgcttctgccgaaggcgtcgtggaagcggcctttgtggcattcgaaccccctcttcccggcccccgcctttcgccacttgaacccccatggggaaaacaggcagcgactgagaccttgggttcggacaactcgctgtccgccccccgctttgtctcgtctaacttcgagacccgggcggagcttgttccttttgtgaagggggtgttgcaccttatttcgccggtgggcggcctcgttccttttacggagctgaacgagtttgatgaaggatgcactgcggcaaaagcctgctcgttcgggtacgaacgttgattgctctgtttcctttttgttatacgtggtcccatttatcaaactacttggttgtttaagcaggctctttcggctcaatgctcaatagagtagatggcgagggtctacctggatagctacaagtcccagcttcgttcgttggagggagagctgggccgaaaagaccttgaaaaggaggcgcttgtgagttcactaaaggatgcgaacgccaagatcaaaagacttaggcttgagctcaagaggaaaaaaaagggaaactcagggccttgtggactactataatgattccgagagcaagatgaaggctcctcgccaggaattggagtcagagaggaccgccactaaggatgttaccgacgaggcgaagaccgcctgccataccctccggttggcgctaactgatttgggggccaaggttagtgaagttcctaccggggacgcctccgtccttgccttcatggagtggacccaacaggcgggcagcgccatggctgagactgccgtcgcttatggcgattgctacgctcgggtgtcggccaccttcgctttgggccttttggagcaacatagctgcgatcacattgttgacttcccaagacttgccaaaggggattggtcgatgagctctcaagacgtttcgacacctctacgttaaggctgaggttaaacgtttctatgatgctggttttattcggccttgccgatatgctgagtgggttttcaacatagttccagttatcaagaaaaacagcaaagtcagggtgtgcattgatttccgagacttaaacaaggctacacaaaaggatgagcatccaatgccggttgccaatcaattggttgatgctgcttcagggcacaagatattaagttttatggacggtaatgctggttataatcagatttttatggcagaagaagacattcataagatagcttttagatgtcctggtgcaatcggcttgtttgagtgggttatgatgacttttggcctaaaaagtgttggagctacatatcaacgggctatgaactacatatatcatgatctaatcggctggctagttgaagtctatattgatgatgtggttgttaagtcaaaggaaatagaggaccgcatagccgatttgaggaaggtttttgagagaactaggaagtatagcctgaagatgaaaccgacaaagtgtgcttttggcgtatcggctggccagtttttgggatttcttgtttatgaaagggggattgagataactcagaggaatgttaatgcaataaaaaagattcaacctccggaggacaagacagaattgcaggagatgatcggcaagataaattttgttagaaggtttatctctaatttgtctggaagattagaaccttttacaccattgttcagattgaaagccgaccaaaaatttacttggggggcagagcagcagaaggctttggataatataagaatgtcttagctctcctccagttttaatccctccacaaaaaggaataccttttagattatatttatcggccggtgagaagtcaatcggctcggtcttgattcaagagcttgaggggaaagaaaaagttgtgttctatttgagtcgtcggcttttggatgtagaaacaaagtattctcctgtggaaaagttgtgtttgtgcttatatttctcctgcacgaagttaaggcattatctattgtccaatgaatgcactgtaatatgcaaagccgatgtggttaagtacatgttatcggctctgaatctgaaaggaagggttggaaagtggatatttgctttgacgaaatttgatcttcggcatgagtcatcgaaggcgattaaggggcaggctatagccgattttattgttgatcatcgtgatgactcaatcggctcggtcgaaattgtgccttggactttgttttttgatggatcggtatgcactcatgggtgtggtatcggcttggttataatttctcctcgtggggcaagttttgagtttgcctatactgtcaagccctatgcaactaataatcaggctgagtatgaagcggtcctcaaggggttacaattgcttaaggaggttgaagccgatgctgttgaaattatgggtgattctttgttggtaatcagtcaattggccggggaatatgagtgcaagaatgatacattaatggtttacaatgaaaagtgccgagaattgatgggtgaatttctgctagtaactttgaagcatgtatctcgagaacaaaatgtcgaagctaatgatttggcccaagaggcatggggatataggccgatgataaaggatgtcaaagtagaagttgccgcaataagagccgataattgg

SEQ ID NO: 42193 - DNA, 1120 bp, Oryza sativa
tcgagatctgtttggaaaaatggaaccggcataaattcagcattccatttttgtataattttaattttgggtttagacttttacatttgagtccctatagattttatatttacgtttgagtccctgtaaccttacattaaggtccttgagtcagtttttgttaaaaaaatcaagataaaagtgagaaaaaaaggcagaaaggtgcataaaaaagaaaagaaaaaaaatccgcaccaaaaaaaacagaaaagaaaaggaaagaaaaaaaagaaaagaagaaagaagaaagaaagaaaagagaaaatactgttatgtttgagttgaacttcatatatcagagttgtgcatgagttgttcctagtgctatcttgtgctatcatttgtgtctaggctcgcgtctctagtacgttctagcctaggaccagcacggtacttgactttgaacaattattcaactttgcattatctgagttgagcatttgctattcctttgctacatatataagcctacccagagctccacagatttgattacagccgtaccgcaagtatttgccaaggcatcgatacatccaacttccattggggtgcttggttgagtcagtgtatgtcaccattccactttcaatggtaagatcttggaagagcttggttaaaagcttgagtgtgtgtgatttttgagctgccactacctagtagttaataggaacgcgcatatttttgtgtatgttttttgttttctactaacaatggcagggatacgcaagataattggggatagctgtgctcaacatcgacatcttcgtcgagacatgaggagtgatcaatatgaccattatgaggtaagtgatgatgttctaggtaagatcaaatctgcactgccttatttcgagggaaactatgatcctcatgcttacattaattgggagctagcggttgatagtgaatttcaaaagcatgtcttgtctgataaacaaaaggttatgtgttcctctagtgttttaattaaacatgcttctaatgattggaaacatctttgtaggcataacaaaataccacaatcatggaaagacctgaaacgatatttcagagatgtttatgttccatgtattatgctgac

SEQ ID NO: 42194 - DNA, 5301 bp, Oryza sativa
cttgcaatgctgaaagtaaaatagaggaggacatgaagaagcaacatgctatgtttttgtcttctaatactaaccatttgcaggaagtgcataatcatgaaaaggaggagagagacatgaaagagccgccagttccattgttcacactcaaagtcgaggcacctccatcatctgaagagggcatcaaaggtaaaacttaatggtgctgaaattaatcaaggtgagtgtgttgttaatgaattgaatttgtccacttttcatactatagcagagcaaccattagtggaaccaactgctgagattcctttgtcacaagttgatttgtttgcagttccttgtgataaagaagagttatgtgataatgcttcacttatatccatgccacaactagtgaatgaacatgctattcctactgttaattcatactgcgctgattttaagcatgttgttcacattgctaatgaagtagagaagcgtgaattgagatcttctttaaatactttgggctatgttcagtttgatgatttttgtgagctcgataatttgaaggagaaattatttgctaagtctgatttgccatatccaaccaatattatatttcacatctttggcgaatataatgatcttggaatatattttgtgcatagagtttacatctgctcggatttagaacttcctgtacatgtggataaaacatacaagctagagagaaatgttattgctaaccaaattgtctcaactttgccttgttttgattggaagaaacaggttgttgtaaatggactacgcaaatagcaccatatggaaaaaccgaggatggttttccgtgaagaaggggaggatgatgtgaccataactaccacgaatgcaaccattgttcacatcatggatgaacaagaagatatcgagatcacgtcgtccaagtgctggaatccgattcggccacttgctatagtactgacttcaaacggtcgccgaatctgcatacgacctccattttcagcccgtgagtacttgatagaatactctcggagccctctttccaacggatctagcctcatatccgaattccatctcgtgtggctgaaatcacaggcacaaggtgctgcgtcacctataatgggcctatgggcttgtaacttcatttgggaccccggcccaggtggggcccatgtggggtgtgccccaaccaggtagagcacgcccctaggcatccctaggtcgtcctcccacccctatatatagctaggtacccctttagggtttattgggttttgatatattaaagtttagccattgctacttgcttgcagcgcgcgtgtcagctagaccgtccgtctgcttgttcttcggaaccccaacttatcatttgtattaaattcctatttgcaatatcagattgcttttatcttgttcttgcttgtttcttcgatttgcttgcaggaatagggttgatctgcaccggcaagatcaacaacccacggagaggtgtattgatcgctaaggcgcaacacaacgtctcgtacggttgtagtcggatcgtcaacgtttctcccaaatcgtagttatcacaactcaccgaaagatcgaaccaacaacagccttgagtgtcgagaggaactcagggttcatcacctgtactattcgtaaagaagaaagatggaagtttaagaatgtgtgtagattaccgagctctaaatgaagtaactattaaaaataaatatcccttaccaagaatcgacggtctatttgatcaattaaaaggagcaaggaagagcataaacaacacctacgattagtattggagaagttaaggcaacatcagttatatgccaaattcagtaaatgtgaattttggctagatcaagttgcatttctaggacatataataactaaggaaggagttgccgtggatccggaaaagtttaaagctgtaatggaatggaaaacaccaacctcagtacctgagataaggagtttcttaggacttgccggatattatcgaaggtgtattaaagatttctctactattgcaaaacccatgaccagattacttaagaaggacaggaaatttgaatggacaccagaatgtcagaaatagttttcaaagattgaaacataagcttactactacgccagtattaatcttgccagacatccaaaaagattttgagatctattgtgatgcctctcgacaaggattaggatgtgtccttatgcaagaaggtaaagtagtagcttatgcatcaagacaactaagacctcatgaagaaaattacccaactcatgatttggagttagcagcagtagtacacgcattgaagatttggcgacactacttgattggaaatcattgtaaaatctacatcgatcataagagtttgaaatatatttttactcagatagatcttaatcttcggcaaagaagatggttagaattaattaaggattataatttggaaattctataccatccaggaaaagctaacgtggttgccgatgctttagtcaaaaagtttattgcaatttacaacaagaaataatgtcagaacaattacaagcataaatgcttagactaaatctgggtattattaagtatggagaattgaacactttggagttaaaacctaccttgatggatcaaataaaagaacatcagaaggaggattctaaaatacaaacttttaaggaacggatggtgcgaggaaaggctacagatattaccgaagacctggaaggaatattatggtacggaaatagaattatcgtaccacaatcaggaatcttaaggaaggtaatactaaaagaagcacctgactcagcctactctttacacccaggtagtacaaagacttatactggtggccaaatatgaaacgacatattgcagaatatgttgcattatgttatgtttgtcaacaagttaaagcagaacaccaaaagcctacaggattattacaccctttacaaatacctgaatggaaatgggatgaaataggaatggattttatcactggactacccaaaacttctactagatatgattctatatgggtaatcattgatagatttacaaagactgcacgattcattcctgtgaaaacaacctatactggagcacaactcgtagaactttatatgacaaggatagtatgtttacatggagtaccaaaaagaattatttccgatcgtggtacccaatttacttcacacttttggcagaaactacattatgaattgggaagttatttggattttagtatagcatttcatctgcaaaccggaggacaaacagaaagactaaatcagatattaaaagatatgttaagagcctgtgctctagattttgctgctagttgggacaaatgtttaccttacgcagaattttcatataacaatagttatcaagctagtttaaaaatgtcaccacatgaatccttatatggaaggaaatgtcaaacaccattgatatggacagaaatcggagaaagaagtatatttggaacggaccttttaaaggaagctgaagaaaaagttcgacttattagagacagactcaaagtagctcaatctcgacaaaagagttatgcagactctagacggagagagttaacttttgacattggtgattatgtttatctaaaggtgtcacctttacgagggataaaaagatttaaagtaaaaggaaaactagcccctcgttatattggaccatatcaaataattgctaaacatggagaagtagcctatcaattggctttaccaaattatctatctgatgtacatcctacattccatatttcacaattaaagaaatgtttacgtattccagaggaataagtactattgaattgaataaagatttaacctatccacaatatcctattagaattttgaatgaaacacagagaacaactcgtactaaggcaataaaaatgtttaaagttcaatggaatcatcatacagaggatgaggcaacttgggaacgggaagattatttacaattggaattcccgtatcttttcgaagactcctaagcaaatctcgggacaagatatctttaagggaggtaggtttgtaacatcctcaaattttaaactaaaatttgactgcatcatgctggcttttgattaatttagtgtgctttaaaaatttatttgattcttaattggttcaagtgttactcctttagaaccctactaatttaccctaatattagtaaggatttgctatattccaaaccctagtgaaacttttcaaaattcatagtttaaattcaaatcttctctaggaaaaatattcaaaattcttgaaattcactgttcatttcacactaggtgctcgacagaatgtctagcccaactaacacagcccaacctctacccaatcttgtgcaaagtctagatttgatccttggggaccacatcccactcaaatccgtggctttctttgcttcttcctcccattcatgcatgcctgggcatccgacttagccgcgtgccgtgtcgccgcgcgtcggctttggggccgcttgcacgtgcccgatcgtcttggcgcgtcgtcgcctgtccgacgccctcagaccaccaccgccgcaccaatcttgacgccgtgcgctcccgtccaaagccgtcgccgagtccgatttttattctacccagcatgaatcgcgccaattcttgctgcacggttcaattgaagatagacggtggtttcccctctcacaattcaaaccattcacccttaagctggccgttttaaccctcgccgccaccgcgcgtcgcgcccggattggcgctaacacgtcgccagccgtttctacccgcggtcaagccaatccttcgccggtaagtattcaaacgtggcctcccgccactcaaattgaccttggccaccctctcacagcctctgccacctttgccatatccaatccttgagttaatccatggcgatgatggcgtccgagctcatccacctctcctggccctataaataggaccccaatcccttccttgctcatcatcgatcatcaacaaccatagctccacaactccgaagctctgcttcaccaatccatctcatcaaccactctcgcccgtcggtgaacaccttgtgcgcgatcgactccacacccctccatccatccttcaccctaaataacccttagaacaccttatatcaaccatgttctagtatagtgagccctaaccgaagccatgcgtcgagttttacctcgccgtactgagccgagcaccgtcgcccctgctctgctctgttcttcgtcgccgcgaagtgggctgc

SEQ ID NO: 42195 - DNA, 11215 bp, Oryza sativa
ccaatggaggcgcttgtcggcggatatactccgcaccttgccgaaggtcggcaagctgcccaaacccttctaggtacctcatagatgctctagaacccctccccgagccatgtctgactcacatcaccccgatcaccttcacggcttaactatgccatcgccgccctagccgctagctcaaccacataccaaattaacccctccgccgccgcttgccgtcgccggagaaccctagctccctcccctcctcggccgcaacccctttccccctctagcgccgccgtaatcccaaaccctagcgccgccagccacatttggggaacggctggaggttgaagaagagaagagagagagagagagattgataggtgggacccgcacaccgtgccatttcacatttaattgattttcaaactttagaagcacatatcttttaaaatatagatctaattccagtaaaacttggaccaatattcttctaaaatcattctctatcttttgagaccccttttgttatttttctattttattttattttccctatctttcttatttttgaattttatttgaattccttttgaatttgaattttatatgtctaaccctaggtcttgaggattcttctaacacactagataacagcaatcaatttcaggacatcgagcaaggcaagttaccatataccttttgatcatttaagcctatattttacaaattatttatttatagccttctattcaatattctattttatatgcacaattcaaccatagaaacccagataatttagccttgcttacttcgcttataatctggttaaaatatcttatacttagattgggacagtacgttagaattggatgatttccgggtggctagtaccgtctcgatcgatatagttattaccaggtacttatgtcgaacgaacgggtacgaccgctgtttctagaatggggacaaacctagatattatgttaattagcaatatggcacctccgtatagtggttcttatttttaagccctcgcgcaggaggcatttatagccgtgaagagcaacttttaaccattaccaggtacaggtaaatggtttgtgatactcgtgtataaactatatggtatatttctaaaccctgatcgagatgacgtggtgtcatacggtcagttccccttaaatacctcgagaacgccagaactcctcttgctgctgttaacaatacgttcagagcatatgaggatataagttcatggaacaggtgccacagttgttaataacttgatactgggccatgactaaagccgatgattatcagcaagtcgtggactacgggtaaagcgtacatctgctgcagtagaatatctttgaaactattcgaatagccgtactcatggagttgagtattgggactcatatggtacactggttagaaatttaaagtctatatatttataaattcttgctataactcttccagattgattattactttttttttgcaaagaaccctacaatatgccagtgcataacatatttccatgataacttgctgagtattgtgaatactcatccttgctctcataacccctttttcagatatgggtcaagaggaggacccctatgactattactatgatgaccccgataatttagaaaatccctaaaggttatacctccctagttagaatgtatagaaacttccgctatgtattaattctagttgatcaattaggtgagtacctaattgtaaaactcttagtattgtaaaactttaacatatgcaatgaagaaccagttatattgtatgtatcaatatttactgatccatggattgatacattaatcatagtcggatccaagtaattaattttgggacccgacacgatgtcactgcaaacaaagaaaatgtggaccctactataggaaaatctaaagtttccaaagttacaaagagtatgcttactgaaaatgttgggaaagggacagcagcgaaatacatttcctctaaacaactactatctggtgctctaacgtgagcaagcaacaggaaacaactggtaagaaagttaatttttgcattgccatttcacaatccagcccaacctattgctatcatgcagttcaaaccatgtttgtattcagcaggaaactcaaactcgggcggcacattaagactcaaagattggtagacatgggaacaaagaatagaggggttatggaacaatatagggtttatggacattttattgttgaatggatgaatggacaagttacaatgtatcgtcatatttatgtactcgttatttcaatgggctgtaagactaatgatagtttgctacctcaaaaatttcaatatatatgttgcagtaaccaaataaatcattgttatgacatatttcgcttcgttgctatatcctaccgtatgcgacgactcctaattcgttgcgatatggttctatccaatcgttgcgatatggttcaatcctatagcgacgggtttactttgttgcgatatagttgtagcctatagcgacgggatgcatgttgatgccataacctagaagcatatagccacaatccatacttagttgcgatatccttcgagcgtatagccaccggttacatgttgaacttagttgcgatatccttcgagcgtacagccacgggttacatgttgttacgatacacgtttggtgtatggcaacgactctaacttcgttgcgatatccttcaagcgaatagcgacgatttactttgttgtgatatcctttaattgtatagcgacgagtcctacgtcgatgtgatatcctttaagcatattgcaacaccgtacgtgttattgccacttgcaaatatcgttgcaatatacaggattgcaacgaaactgaaacgttgtgataattcttgtttgcaactatctaacgttgttgcgataacaactattgcaatgtcaactcgaacgctaaatatcgttgcttcttcaatctttccccatgcttcgtctcgttgcaacagcccgattttatggcaacgcgtgagcactcgttgcgataccctatcgcatcagaggtacttgcaacgcatgccaatgaaattttttcgttgtgatttctctgtattgcaacgaaaacacccatatcgcaacgatttggcgccgtggtgctaggccgatttccttgtagtgtgtgctcttgctctttctgcagtcatgaagagaagaatcacgggtttgttcaagaagggatcaagctcatgttcaagtcatcaccaagataagtcgagtacacactcttccaccgatgtctccatggaggaggtggacacctcgccaaggcttctcgatgactccaacctcgacctcataggagaccgggagatgcagggctatcacatgctcaaggatcggccatttgctgacaccccagcatacgacctagaacttcttcagaaaataggtacggatgttgattttcgtattgtttggaaggctataggatgggagaaatttgctgtggtagatgagccaggttctcgcttacttacctagaaattttttatgtaccttgctactttgctagaagtagatgatggcatttctttttggtttttctgtaaggagttctatctctcttttaaagaattgagtctgcttttaggttttgacaaaacttgcaaaattaatttttggaaggcagcttccaactctgagaaaaacaagttatgtagaaggcctagatggcatccataatcctactcttagactcatgtataaatggcttggcatgactttatttcctagagctaatcttagacccattcgtgaagataagttgattatcttatttgacatggttagaaagataaaagtttctcttatgtaatacatgattcgccaatggttagaaaatttcaagttttccggtcctattgagtgcacttctttggtttctcgcatagaaaatgcacttggggtaataaggggtgatcaagtcttacttagttgctaaggttattgtgtacattgatcatgctgctctaaaattcctgctcactaagaaagatgcaaaacttcgattaattagatgggttcttccactccaagaatttgattttgaaattaaagatataaaggagtagaaaattctgtagcagattatttgtcgcgtttaaatattttacatttcgcatacgttacttgccttccaccagggcatgtcacagccacctcatcaaaatgttgccaaacggccgaagttcgtgatctctttgagctggtgttcgtcgatggactcctgctcatagttcctgatccatctgaagccaccggtacctcgtccaaaactgacggtgttggaaccgatccggaggcatcatactcgttatttatgtatgacgctgataggtaattagggtcaaagtcacccaaattgaatgacagactgctcggatcgtccatgctgaatattataaccacatggacggaatttcaaaagaaatatacatataacataaaatacgaataataaaaaagggattctccaattctttcttaccttctttacaccttgtgcatgcagttttgctaaaaaaaagtggacttcacaaagtatttttgattttgaacaaattttgtttagataagaaaattgaactagcacacaaaagaacaaaagatagcacaaaatggaaggtttggatgattcaaaatctccatagtgagtgtcctatttgtaaaaaaaatagaacttttctgatatttttcgcattttttatattttttttgtgctccaacgatcttctcagctggattggtgcagacgggcgggcgcctactagcactattggcaggcatggctgtggcgactagcggcttggcgcaggcgggcggtgtgaggagagggcgggaggcaagatgcgcgcatgctgcaattggtgaaggcgggcggcccgcgtgagccgcgaagggaggcggggacgcacgggggtgcgtgcgagcgtgccgcgcgcacacattggcagctgggtgcggcactgtggacatgtacctgcggtgggctggtggcttgggcctttcgtgccgtgctgggccatgcctacccagtacacgccatgccataccaacccatgggctgtggcctcgacccggcacaacccagaagctcgttggccagtgccgtgccgggttggatactgtatgtcacgtccagaaattcactggtaatttcggaacttatttgtgtataaaatcctcatacagaaatcagccgagatacacaaactgacaatttaatatacaaattcatcaaaataactaaagcaataaatacctacataagaggtacttagtccccaccacgaaaaaaactgcagcggaaaaataaaatctagtgaagcttcagctccactcccataggcagctcaactggggtataagccaaacgtcttctccttcacaacttttcttcaaccgaggtttgattgattattgcaaggtgagtacatggaatactctacaagccacacaacaaaaatgcaagtgcacaaggataccaaagaatggcataatatagggctcatttgcaaaagcaacatttagcaaacatttgagaattgtaaaacagtagaataataaatcattaatattaatcaacactgaacagcacacccatgctgcatatgcctaaccaaaactgaacaaccatacccggctgtacagatctatctccaaaccagaaatgtaccattccaaaccaggagctaagcaaattattagcaattatatcatcatttattatggtgagaagtgtgagcctaatcacgaaagacattgttagacccgcccacaaccacgggtatggctatttgttgggtcccaaaactaatgattcggaaaccgacatgtttaactgtatcaagccctggatcagtagattgatacaggttcaacaatctggatcttcattgcatacatttgaataaggctccaaaggagatgttattacaaaatatatgggtatttacaaacttgtggctaactaatacagcagaagctatagaataaaccaactctagtgtattgctatagacttaaaccatctaactaatctagacttgagaactagattgaaatgaaaactaacttatatgattgaactctcggcttcggcaagaactccaaattaactctgaaagaagggggttaaagtaagggtgagtacaacgtactcagcaagctattatattcaagtatgaatgtatgaaataatagtatttgagtagagctagatctatttgcagaaagctgagaaagtagaaggagaaagtctataatgttttgaaatgcaacaatatttaataaaatctggagttatatttctaaccaagatgccatagtgagtcccgatgctcaatatccgtgagcacggctattcgaatagtttcagagatactcatactgcagtagatgtacgctttacccgcaatccatgacatgctaatattcatcagcttagtcatggcaaagcttttcggttactaacatcaacggtacctgttccatgaactataatccccacgcgctctgaacgtaacgttatcagcagcgagaggagttctggcgttcccgaggtctttagagagaactggttgagagacccccgtcatcccaaccaggttttcacaatacacacacagtgcgcaataatcaatatatttacctgcgtctcggtaaatattataatcgctctgctcggcgtaaatttgcctcctgcgcaaggacttaaagaagaaccactgtacagaggtaccacctttgctagataacctactttgctaagtctgtccccattctagaattgcggtcgtactagttcgttcttcacatgtacttggcaatcttatgtcggttggaacagtactagccacccgaaaatcaaccatttctaccatactgttccaatctaagttcattatattttatgcaatctaactaggcatggctaagcaaaatctagcatatatctggtttactatatgttcaagttatgcatttaaaatcatgaatggctaatgcatggaataatagagatatagaatataggataataatgctcaaaggggaggaataataacttgccttgctccaacgcaaacaaatccaagataggcaacctaattatccgatcctcaaaacatcacaagttgccatccaaaagataatagactctactaagaaagacgaagaactaaattcaataaaagccataaaataacaagaaaacgataaatggttaggagggctagggtttggttgtgtgttagtcgatgctagatcataacgactaggtttggtatcttctctagccggtgtcaacagacagcataacggttagagggataggaggtttgtgtgggtttagttgggcggaagtgttactccgacaaccgtgagtggcggcggagcgactaggatcacacagagctcgagagctaactgtgcggcgtgctgtggaggtcgagggaatagtgaagctccgaccgctatacgcatcaaggcgtggggtgccagaagcagcacttcgaccttgggtttaggctttgccgggctttataaccaacggttcgacgttgaggtccgtagaccgcgcaaacgtccccatggaaggcataaagttccaaccggcggctttttagtggctaaaggggtaatttgggacaaaagaaaatatttgaaaaggcaaatataaattcaaacgatatttgaataaattcaaataaaattataaaatacaaaatttggtgtcaaaagatagggtttgaatttatataaatttaggtccaagttttactggaatcggatctacggtttaggaaatatgggcttctaaagattgggttttgaattaaatctagaaaatgagaaaagtcactgtgcaggggacccacctgtcaggcttttctttttcttcttctttttccttctctccttcttcctcccgttcctttcttcttctctttcttgccggcaacagagaagagggagggaggtggggcgccggtgctccggtggctggatggcggcgacgccggcggcgggtggtgttccctagcaccacgcacctggggaggccgttggctggtagaaggagtgagagataaggccggaacggcgacggtaagggctcacctccggccggcatgggtggagacggtggtgacttgattcaaaggggaagagaagggggaaaggggcaaaatggagttgtcggaggtaggcaaagccggaggtgcgaggaaattgataggggagctatagagaaagagatcgaccgacgacggcgacggccggacatggcaggagagagagagagatggagcttggtttgtatgcagagaaggggagggattggcgggctatttataggagggagaggtcggtttggaggaggagggcaagagggtcacggcgccggtggagtggaggagaaggaggcggcgccggctttcgtttcttagcagcgacggaaaaaaattggcggcggcatggagaagacgaacacgtcgcccgttctgtcagttgattggccggggaaggcgcttcggctcggcggctgacatcagaggcgtgaggtggcgctgacgtcgggcggcggttgcttagcgtcgaagacaagacgacggcggcgcaaaacttcgagtggcggcggcaaaagccgtgacggcagcggtggcctgggcgccctgtgcgcccacgggaggagaggcgttggctcagctggccggctgggcttggctgggccgaccctggtcaattgggccaaaaggaagaaaagaggagactttggcccaatagatgattttctaaattttgaatagaatttggaggagattgactaggaaagtttgaaaggaaattatatttgaatataatttccaaaagagatatttctatagttggtttgagtgcaatactttagagatggagtttatttaatgcactcaaatagaaattcaaaatattcaataccataaataatatggctctagatttgaatatttttgagtatgtggagggaatatggagggagtagagtaaatagaattctagcccaaaatatgtggtatgaaatttagagaattagatatgggctaaacgaggttttgaatttggggcggagggataaagtctattctcttagcacaagagcaattattcacaatatttgtaataatattatttttgtgccgaggaggaaatcaagccacggaaattaaattggtggctagattgaaaaaaggaatttggatacttgaaatttggaaagggaactaaggataggtttggaatcaaaggataggttgacaattaattccaacaaatttggaattgcttcggtttaggttcaaggatagtgttggaggatttcttggaccatgattcataaaagattttcaaactaaatttgaataaaaggaattttgtcaaaggaaggtttttaaattaaaacccaaaatcaagaaacaccttaatttaactaaatatatttttaaaggaaagacacaaaagaaattaaataccagaaagagattttatgcaggttaaatttaggaggtctctttaattataatatcctaggtttaggaggttaataaaaacataagaaccggtatgatgcataattagaaaatagctaatttttagtatgttacactattcgaatagttttactctggacagagatataccactgtaaccacaagacatagccccacaacatgtcaccacgcgcctcaataccaccatggtacctcggaaaggagctgtgacagtacccctcgcataacacaatccatcacagcgcaccgttcctggatcataatcacctccttataattcaaggcatggactccccagcgacccccgtgggtttatctccgccacttctcagtatggtgccccgcaatgaactatgttatacaaaaggtaaagccgttgcctacgctggcttgtggttggcacggttaatgtttcaaaaccgaaactcgtgaacaaatttaagccacgatatcattagctttgttaaatttactccacattttttttgttaaatttaaaaaaatactccacatttttgttcaatagaggatggcggatggtggggttagcacctaaaaggaggagcgtcgtagtacggtagtacctttcagagtgtgtgtcataacaaattacagatatgcaccttcacctaaattaagattcaatgtcaaaactttgtccaatcacttttcaaaatgtttacttatggtatcacggcaattcctaaccaaaaaaatcatgttttttcgttcttctaatgtgacttatgctcaacaccagtaggtgaccacattgttggtatttcttaactacattactaaaaatataattcccagtaatggcgcagaaatattcatggtatattatggttatagatcatatccgcaagcgcacgggtataccattgtagtatttcactcgagagtatttcaaggttatcatattagtttaatctcgtggaagattataatagagagaaccatgctaatatcaaaatataagcaggggataatttacttcaagggtagagtgccacaaagcaaaagcactcaatattctcatacatacaaattctaggctaagtggaaaagaataagaaaataatcatttcctatacttctaatatacatacataccacttcagataatattatctactatataattatataatcaataccccctttacaatgccctcctggggtttcgagtgaccacccctaatttccgagttccttacgacaacccatcatggccatccaaccagggctaaatacggaggagtacccccccaagaaagtaacttaggattatatactgtcgtggaggaatactcatactgagctgtcaccatcagcggcccacctctactaactcgtagcctataaccccaaataatgatattcaatagcctaagcacctcacttatgctaccaaatactactgtacaatcatcgtcatgacttagagcaatcatataaatgaatattatacccacaccaatgcatctcccaggtaagctagctagacaattatatcccgaataatatatcggaaagtaatcagagtgaagtaaagtaccataaatatattgagaagagtattctataaatagtacaagtct

SEQ ID NO: 42196 - DNA, 1721 bp, Oryza sativa
tctcggcgggaccacaaggtgtcgtagatgtagttgaccattccttgacggtcattctggagatttgtgacagtgaccacttgtagatcaaggaaggcaacttccggtgcatgcttcttacaccattgccaacttaacctacacacaggatcaacgatcttgtaagcaagttaaaccgattgttattaccagaatgagttgggcgacaatacttacaaggagtagcacttaaggagacttgtgtccaccgctcggagcctgtagaggtcgaaaagatccttgaagtcgatcacgacataatttattggaccaaggaatggctttccatcgtgctgtccaagtatatcggtagctttacttggcttcctggcgttagatttctccatgtagtataagtgaaggtccttgcaagcggtgcccattgcggcaagcacgtcatctccaaccaatggcatgcctagttggaactcctgtggagcgacgtatttcttcttgacctctttgcccttagtctcttcctggcccttgcccagatctagctttcttggagctagaagcgaggtctgcacctttcctccccttcctctccccttttcttcgggtttatcgagagtaattctctgaggggaagagtgtgccttcctgctcttcttcatcggtgggggttcatgaatcgccttgctgtcggcctccgttcggtcctccccaaaatccgtgtcgtactgcaactgcacatcgtaagattgtgcatgacgatcttgagcatgaggggctgaaggagcagtggcgggtctctttggtggaggaccgcctggtgcagtggttggcctcgctataaccctgatctcaatgaggtccttaggccattggatgaaggtaccacgggcatttcctagtgagaggacctcgtcgttcggtggatacttcagagggaacagctcgtattcgggcttcaccgagtcgacttgaacttttgcacagtcggccctgagttgcgctccatgcactcttgtctctggggtcggcttgtacgcaagtccctcggttgctagaacagtgaaggtcagcatcaccctaactgtgagggtgcagctcgttggttcctgcgatagattaatcaatttttttagaatattatatatcatatggattcgttacatctttcatgtattgagtaagttcacggttaccgttatgtggtcgacggcgctgtcgaccgatgttggattttctgccaattcagttgatgcgcaactgctgcgtttttcggtgggacttcctaactctttgtgcgcagcagcagcgccggcctgggggatctgttgctcttctcggatctcttgcctaatcttggccctcatcgactcgagcttttcgtcgaattcagatgtcagcttagctcgtatcgactcccggatcttggcttcaagtcgtgcatctttctccgccttgttggaagtccgcttcttgtactgccacgcatagtctggaaatccatacttccagggaacagaagacccaacgccccgtgtccgtccacggtgttccttgttgcccaacgttttcgtgaggaggtcgtcctcgcgtctttgagagcaggcctcttgcgaggcttgttgctcggcaaccaactccttctgcattacaatttagtggggtcaaataaactgcacgatgggaaacaatgcgaacatctagtttgactagacacttactatagc

SEQ ID NO: 42197 - DNA, 1563 bp, Oryza sativa
ctcttggatctggatttgccgggttgtaaacgaactcgccgactagcttagtcttgaagttcttccaagcagtgcccataaccttgaaagcagcccgcctgagacggtcctcatgctccgcaggataatcaaagctctccttgaacgttagcgaagcaatgtccttctctgcggccggcacgagcttgaagtcgtcttgcagaatactgaatttctgccttcctatgaccccgcagatagacctaaatcggctcaatattttccttggagatgtcggcaaccctacggcgtccaccgctgttatgcggaaccgttccttaggaattttgttccctgtcctaggagtacgtgcccttgaggacccactagttgtcgtcgacattggttcgccttgctgagacattgtctacttttttccaaaaaaacaaaaaaaacacaattgagtgctacaatctattacaatctattaaccacatttcacaataatttcattaatgcaccacatttcatcccaacataaataaaccacatttcatcccaacacgaataaaccacatttcatcccaacataaataaatctcatttcatcccaacataaataaaccacatttcatcccaacatgaataaaccacatttcatcccaacatgaataaaccacatttcatcccaacataaataaaccacatttcatcccaacatgaaccacattgcatataaataaagttaaatgaaccacatttcatcaatcactacaatcatctatcacaaaattcataaatgcaccacatttcatcccaacatcgacatgtctcactaacagttcaatcacatatcatccacatccacatttcaatgacatgtcattcacagttagcagagggcggcgcaatggaggactcacctgaggatggccggtggggctcggtggcggtggcgcccgggctcggtggagggcggcgccggtcggtggagacaccgatcgggcaggtcggcaccgggcgggcggcgtcgtgctcggtgggggtcggcgacgtgggtcggtgaggacgcgggtggcgactacgaggaaggccaacaccggtccggtcggtgtaaaggctcggtggcggcggcggcgggctcggggggggggggtcgacggtgaggaggctcggcggcggaggtccgaatggagggccgaggaggctcggtggtgacggcggcaggcttgacgagggaggacgactgcggcggcggcgggctcggtggtgacggcggcgggcttggcgagggaggatgacggcggcgctagggttctaaggaggcgggaaactgtagcgggacttagaaaaattttcgatccgctctgagaaaccctagttatattagagtgatgagtcatctcaagcgggctttgccgtagggcccgtcacagatgactcatcggtgacgggctccatactaatgcccgattgagatgacattcaggcccgtcacggatgactcatctgtgacgggccctaagataatgcccgatagagatagattaatctctatcgggcttgaactaaggcccatcaccg

SEQ ID NO: 42198 - DNA, 2010 bp, Oryza sativa
gctaacttgtacagctaatcaagatctacaacttttattttggtcacttcttcatccgacaaagtgatagtacgaatgtttacaaaattgacatatctgtgttgatatttataaaccaatgagagaaatgtgatttttgcgaataatataactatcactctatcggatgaagaagtaaccaaaataaaagttgtagatcttgatgagaggataaactttgttgttgaccatatttccatttgaaatcatttagtatttacaaatgttgattatatttgtcatattgtcaaaatcaatttcaagctgttgaaacaaagttatatagataaatgaccaaaataaaagttgtagatcttgatgagaggatcaactttgttgttgaccatatttccatttaaaatcatttagtaattacaaatgttgattatatttgtcatattgtcaaaatcaatttcaagctgttggaaacaaagttatatagacaaatgaccaaaataaaagttgtagatcttgataacctctacaattttgttgttgaccatatttcgatttgaaatcatttactatccgaaaatatgttatgactaataaaatgaattattatacaacagctatatatcttgtactcacaaatataaagacttgcctggaaaatggaaaaatagtcatcggtgatgggccttagttcaagcccgatagagattaatctatctctatcgggcattatcttagggcccgtcacagatgagtcatccgtgacgggcctaaatgcaatctcaatcgggcattagtatggagcccgtcaccgatgagtaatctgtgacgggccctacggcaaagcccgattgagatagattaatctctatcggctgtaaactaaggcccgtcactgatgactcattttccatcttttatttgttgtgagtgcaaaatatatagcctatataatttttattttggtcattattctgtataatttttttcccaacagcttgaaattgatttcgacaatatgacaaatctaattaacagcatttgtaaatactaaatgatttcaaattgaaatatggtcaacaacaaagttgatcctctcatcacgatctacaacttttattttggtcatgtgtaataaaacaaaattagccatattaatgactacacatatcaagtctatgcaataaaacaaaatactttattcattacaatagataagtacaaatgcatcagccacaaggttatgccttcggtatgatctgaacgagcatatgccacaggctcttggggatcatcgtcaaggtcaatgtgaggtcttatatgaagattatggttgttttcttcttcatcgacgacgttgtcaactcctacaattcggcgctttccatccctcacgatgtgcatcttcttgtttgaagggtcttttatgtagaatatctgctcgacctgtttcgcaagtacaaatggttcataggcgtatcccaccttagatagatctactaaagtgaaaccttccttgtcggctttgacaccagtgcgtagattcacccaacggcagcggaacaaaggaaccttgaacttgacgtagtttagctcccagatctcctcaatgtggccgtagtatgtgtttgacccaacttgatcctggaatgcatctatacggatgccgctgttttgcactgtgcttttgtcatcttgtttgacggtgtaaaatgtgtatccatttatatcgtatccttgccatgtgtctatggtccaagacggtcccatccccaacaactgtactgtctcatttgggacaaccatggacattgtcacacgattcttgaaccattcgttgaaccgagaattatgttctctgttaatccatgcatcagatcgccccaagttctcatctcggattttcgctaagtgttcctcaaagtatgggccaacttctgccatatgttggagcatagcgtaatgagcctgcgcgtacgacgcttgatcgggcctaattcttttccttccgattgt

SEQ ID NO: 42199 - DNA, 4305 bp, Oryza sativa
  unsure (1)..(4305): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaactatagagacctacaatgctcttgcaaatgcatttgcaaagggtggccttttccaggaggctgaggccatcttttctcgaatgaccaacaatgctgctattcagaaagacaaggattcattcgatgctctcattgaagcgtattgccagggtgcacagttagatgatgcagttaaggcatacatggagatgcggaagtccaggtttaatccagatgaacgctcccttgagggggtactcaatgcctactgcatagcaggtgttatagatgagagcaaagagcagtttgaagaacttcagtccatggtgactgttcctagcattattgcttattgcatgatgttgtcactctatgccaggaatgacaggtaactatcaaagaaaccttcatgctgttttaattaaaacttatgtggttctgattgtaaatgtaaagcattgagagtgataaatagggaataactttaatcaactaaactggctggttttggggctgtagaaaaatatatttggactagctatgtggggcccaaatgtcagccacaaggaatgtttaaaggagtaaagatttgattaatcacataaatgaccataaaaatatatttagatttgattaatcactatatggaatttgaaatataaattttatatatgaccataaaaaaacttcctctaagtaacatggggctaggtctaggggcaatcgcatgtctgttttgtgaaattccataaaatttgaatggcggtttgatagattaggaattctaccccctttgttggtccagttaacttgatatgccatatgcggcatgtaatgctgtaagtctgtaacacacttgttgctccaatcttgcaattttactctcatttcatacgctgcagaactttattactctaccgattcatatttctagagaccacttgtttctttatggttcttgaggggtttgaattcatatttgtaccttaaaatttgagaaagatctgggctgtgatatctttccttttttcctttgttctctcttcctgttatttatcctgcttaaatcatttagagttttgaccagcatcattcaggtagcattgataggcacaaggccaaaacttgaatactttgatctaaaagcacttaatattagaacaacacaaggtactataaatgatgtggacatcaaaatttctagaatccttaaaatgtaatgaaactacaacataaccgatgtacaatttcaggtggacagatgcttatgatctgttggaagaaatgaaaacaaaccgtgctagtagtacacatcaagtgattgcttccatgatcaaaggggagtatgacgatgactccaattggcaaatggtcgaatatgttcttgacaacagtaacttggaaggctgtgactacagtttacgattctttaatgcactccttgatgtcctttggtggtttggccagaagggtcgagctgcaagggttttggatcaagcattaaaatatgggctcttccctgagttatttcgtgataccaagctggtctggtctgcagatgtgcataggtaatattatttatcactctcatctggttctgtgagtgatccagtttttttattcgtcaagcggtgcttaaggttgtttgcatttgcaggatgtcagtaggtggatcattagtggctgtgtcagtgtggctcaataaactttatgatagactaaaaggcgatgaagatcttcctcagttagcctcagttgttgtattgtaagcttttagcttaagatttaccatgttctatagttatatcatgatatgttctagcactgttctggaatcgagttcgtgattcccatgattatttcttgtcttttcacttgcataaagaaatgcaatacgtagctacttatacatttttccgtttgctctaattgactgacagttctctgattgccaggaggggacaaatggagaaaagcacagttacaaggggattgccgattgcaaaagttgtgtactcttttctgaatgatacactatcatcatccttccattatccaaaatggaacaagggacgaatcatatgtttgaagtcccagttgaaaaagctccaggcagccatagattcttccaatggtgctgcaatttctggttttgttcccatgacaaactctcatttgccatcccctggttccaaattgtacactagggagtcccaagctgataatggttctgcccatttgactgatgaaaccttggtagaagaaaaggaatcagaactccttgcactgtgagttttcaggagcttgctgcctccttccttttgcagatgcgatgttatctggccgaacaagggaagataagacacagaatgtctcacaattttgaagtttgggcaatcagatcgtcctaatgtgcaatgagatggccttatgcctttgcagtgctctcttgcttcactatatgcagtggacgtgactcccaatatccacaatcttgcctagaacccagcacataagcatgagttcgtgatactggatttgcgctaacttgatagacaatgctggacttccagttgtgtttcaggatgtagcacttagtagggagaatcagagtatgcatgttgttgttagttgctcacttgttctatatgacatttcgtgcctgccccattcggcaagaacgaaccctgtctggaatatatggattcactcgatgcaagtaaaacatgctgatgagtcagtggaacacatcagtcatcgatacgtttctgatggaaataatatcgggagtttgtatcaccgtatggttccagttcctacatgatgtatcagtgtgcccgatctttttaatgcaagctgccttctaaaaatattcttgtgtatgatgctgccatgctggtgtttgtttttgaattcgtggtgtaagatcttgaaagcttatataagtaacaaatatgaaggtttaatttgtgcaatgacattaatagacgtgtcaagaaaatacttttatgtagttatattttatataattcgtatgaatatatgatcagagaagagtatgtaatcaagcctgtgcgagcgagtattttgtagtaaactgtaatgatataatcaagttctccaggcctccagctaagtgagtcgaaaaatagtactccagcctgttttttttttaccttatagtctttttaaaaaaacttattttaggatgtatttttttcgtagcgacaacatcattggcgtcgtggtctaacatgacggcattaatgtcattgacacctccccccttgcctcctaaccccactagtgaaagctaagtctaatctatactttatataaaattataaccaactaattccaaagcttaacatgcaaccatgccacatcatcacccaccaacaataattacatattcaacctcatgcaagcatgaaagagcatctacaatctatttaattctacaaattaacatgcaagcatattcaatcaccatctctcacatcatttccctaatagttttacaaatatctttatcatttttatattatttaatatatatacttatcaacatgttctacattaaagtgtaaattttatttgtttcatggtaaatattgataagcccaaagatttgatttttttttctttttactcctagctgaattataacgaaaaataatattaaaatttacttagtaatttccgaagcaaagcgcggggaatcccctagtataaagtatatcgacgtcgaggacatatttgtgatttttttaaaaaatgatctatttataataaatatatttacatttagaccctcgatgtgtcatcggcatcgaaaacctatttgtaaatatatattttttaattgcaaatatgtcattcgtaatattttttacaaatagtaattggtgccaatgaccgaccccctttatattagttacttaacttttacttttgcgggtgatagggacaatgccaacgtcgttgacataatcatgttagatcatgacgctaatgatgttggcgccataaaaatagtctattcctgtaataagttatttcatgggtctatttataaaataagttttttaaaaaataatcaaaaggtaaaaaaaatccatgttctctagt

SEQ ID NO: 42200 - DNA, 2213 bp, Oryza sativa
ccgtgcacagtaactctgaaccagagctacccccaccaaccggagtatcggactccggaagccggaagcgacggcgccgcccgatatggaggcggagtcggcggcggcgaggcaggcgaaggagtcgctggagctggcgttccagatgtctcagatcctcgacaccggcctcgaccgccacacgctgtcgctgctcatggcgctctgcgaccgcggcgccaaccccgaggccctcgccgccctcgtccgcgagctctcctccgcggctcctccgaccaccgccgccgccgcacccagccccgcgtccaacgccaccgcggcgccgtccgcaaaagccgcgtcgcttttcccctccggtcttcgcaaaccctagggttcgtgcccccttctctcagacgagatcacactatcacttgatcctacattacgttgtcttagaatgtaaactagcggatcgttctgctctgtagattcgttttagccgcaacaccttcctggcttgtatcctcaagagattatgcacaatttttctatcagaactccttaattttaggagatcgtgacatggatccgttcagagatatggggatatcggtatgacatgaatatttgattgcggagacacttgtggcattaagactgagaactcatatttgtttgggcacttgataattttgaattcaacttccactgacatggaacggcctcatgaattgccatcttgatgttgcattgttctagagaactcctgttagctagttgttctttgtcagttacaattatggtatagccatttgtcaacaacttataatttcatcagttatgtaggttggttgcattttgatcctacctatgttttctttgtcgccctgggttaaagtggttatatacccatcaagttagttcattatccttcaatagttttcctagataaaaaggtcatgcttgagaactgtaggttatgtggggtttggtcatgtcttttgaccaaacgaggcactgaaaacacagcctatgctccccaccaggcaccagcaatgtatgtgggttggctttgctgatgtaccaagtagtaacgttggattcaactgagatctctgtttatagtccgataattataggcttttgatgtttatactgtgcattgctcagagtaaaaaaaaaattgaatagaagcctttcaactgctatgatactttgaaactaacaaccttaatactaacttgagacaagttgcaaatggttcctaacactcgttttcccttagcctgaccagacttattgcagtgctttaaatctcagattacatcccactgtgatcactgccagcagtagcaatttttttacagtcatttcaacactacgctaccttagtttttggcaacatttcaatgctacctttggtttcacttatcaagcatgatagaaatatataatgttcttgtggtttcaagctttgttagtggcttcttatcaggttcagctagacttaaactggatttcattgcaaactgttttttcttggtatagttgccgtgagttaactgttacctgtacgcttaagcagttactgaagaccgagtggaaccgatgtgcttgattttaaggtagagcagactcgagatttgattgctgggagaaaggtattgacaatcttaagggagatgtaaaatctttctttagaatgtatttgtgatgttgtgactggcctgtttcctcaaggaaggtgtggttcatggaacgctgtgtgctttgcttgacttgtggaagataagtgttctagtaatcatgggaatgttgcctttcccatttctaatagccaattgtatgtatcagcaagacatatggtcttttgttaattatcctctcttgaccttgaagtcctttgctttgccacatgcttatccaagaaggaatgtgtcatctccattggttgaactctcattttcagataacaatgaaagcaatgtgaatgttatctctgttccaccatctggttcaagttcaagtgcactgcagcttttcttttcttttttcttgaactgacactgcagcttttcatttctgctccatttggccccttttcaccaaattctactcttggttttatcctgtccagataaaaaggatagcatttcaattccgttcatgcaagtggtgaataaacttgatcaagcctttttagagaataaactttatgaagccatgtcact

SEQ ID NO: 42201 - DNA, 14179 bp, Oryza sativa
gttgtgtttgtgtggttggttgtctgatttggtgccggtgtgtggcttgccttcgtgcaggatgatcacggaggtgatgcagaaaagcagcattgaaaagttgttcatggctattgagcccctcatccgaagaatggtgaggcagcctatggaacctactttcttattttccatttctcacccatgtgtcatgaatttataggaagatatgactttttggtatatgatgtgcatgttttatctgtatccccttttgttctgttgggcttagggttatgtttgttgctaacgtggcttttatattgttcattcataattttatcgaaagtttcatctgtatctggtgcagctggcattcttagatctgttttgtacttttgaattacacaaaccctacttgtagtcttcaacttaatgtaaggaaccctgtaaatccgtaaattgaaacctaacaagtatttaatccctggaagactgttaattcctgacctccattttttggtttcatttgtttctatttagaagatagtattttcacccaaagccattgaaagtttatcctaggcaggattttcttcagccatgtgttatttggctgtccaatgatggccttcaggccttgatgttttatccgattgtaatttctaggtgaaagaagaaatcgagtcagcgtttgcaaatcatgccattatgatggcaaggtacgacattgtaacactgtcttaaactactatttgacaagtatcagccactgtatagattcattaagctaatgcagctttctttaagtttaacaacttgatttcttattttcccattagaactgtcatggacgttgttccacctacatcgaaaaatttccagctacagttcatgactaagctttcacttccaattttcactagctccaagattgaaggagagagctccttaagcataactattgctctagttgacactgttaccagagaagttgtagcatcaggcgatgagtccctgatgaaagttgaaatagtagttttagagggggattttgaaggtggagaaggcgatgactggacagctcaggagtttaacaataacattattagagcaagggaaggcaaatgaaccttgcttctggggacatttttgttggccttactaacggcatcagtacaatgggggaactatcattcacacataattccagttggacatgcagccgtaagtgtggttaaaagcattattttgttatgttgagaaatataaaaccatgaaacaatatatttcttagatttgaatgaataaattgtttttctgtggatggtcatggtaatctgagctcaaaagttttttcctcagcaagcagatgtcacatttctatccatatgtctgaatttgtcattgtttaattgtgttgtagcatgcttttgcagatgatagtgctattcagcaaaatatatggatatattggccctcttattctcaaaccatgcagatattgggcagtggtatgtcaacaaagatgtgggaggtcacagttgagcattcaaaaacttgtattctcactgacaaggtgcatttgtactatccacacagcctaatcaaaacagctgtcgtgttcaatgttgttggagaagtgagagggctaatatctgagaagttcgtttgtgctgatgatcttatggaaaaggataaggtattcacattttctctctcaacctagttacttagagaagattcttgtgtatttccctccaccagttaaaatctggaccatttttttaaccctgacttttgttctttctaggctgaagcacatgcagctgtgaagcaagcgtatgaaaattggaagaatgtatattcacctataacaatgaaacagcacttccatcaaatcattcacagctcctcgatgtgagatctccatcattgctcgcaaatgaatataaccaattcccaacacaggtttctactgatggttttggtttgagccagtcaagcataccatcagctgacattggatccttgtcaactgggaactgcagaaagcaatgaaaatcaatatcagcccgatttacccccacttggtggccatggaccacccgtagtatcacagacaatggataaagttctctaatttggtttatgatgattgcgccagtcatccctcattcagtgaagattactatcgttgtgcagatccatctgtatcctttgacacacaaagaccttgagctgcactgaaaggcttcgttgcaacgatatctaagcccaaggccgggtgtagagaatggaggacattgtcttatgttctagggtggatattctacaccaataggattgttgctctgaaaagaacgaaacctgggaaatgacggttttcctacttgtttatccctgtggactgtggttgtttagttaaactgtgaaatatatactatctccatctcaaaatgtttgacgctgttgacttttttaaaaatcccaaaatgtttgacgccgttgacttttttaaaaatatttgacctttcgtcttattcaaaaaatttaagtaattgttaattctttttctatcatttgatttattgttaaatatacatttatatatacatatagttttacacatatcacaaaagtttttgaataaaacgaacggtcaaacatgtttaaaaaagtcaacggtgtcaaacatttaggaaaggagggagtagtatataagtggggaaaagggaaatcatgtacatatgactatgagcttggcagtctcgtaatctttttgggcacagagctggtacgctttgctggtttacgagctacatccaacatttttgtttttagcaagagcattcagcattgcctgtaaataatcggatgaagttttgtgaatttaatccgtaaacatttgtggatggtgtcgactaaaccatgttctctagctcacctgagtagcacttcaaggtcctgaaatcaaatagtatcagattgggttatttgagggttaagttacttgtttgataggttgagtttctaatttaaaaatgttgtatatatccggttggatgtaggtacccttctctaggtctccagctcaattgcggttatcatcagctagttatatgatgttggcaagaacaatgttcctgcaacattagttcccctttcactcttaacagtttgcattgtttttcgcactattctattggattgatgaaatgtcttgattagagacagacgttagagacagacgttgatgaaatgtcttgatcaaagtgagcatcgctgatcactccatgctgactggagtaaagaacagtaccaaaaaaaaaacagtgatttggtgttcgcaggtgccaacgtctttattccctggtcactgcctgccaaaccctgcaagcactccacgcattatattagcgtgtgattactgatttgctggcacttggcagaattatcccaaaacctaatcagtacttgcaaccattactttaaacttgattacattacatgattcggtggtcggttgattgattgataccttgcggccgaaatcctcattactactactgcatgttaggaactgaataaagaagaggaggttccctctagatcctttacttgcacctttggcctttcttttctccttaatctacccacatggagggatccatgtggcccccagtatcaagttcaggtctccttgtgggccccaacggactcatttactcctcactcattaccatccaaactcctcttttaaccactgtaaatttattactccttgctaataatcctaataatagtcacattgcttagatttgtagtagtagtagtaataatttaacagtgtggtttgactgagaaaaccgcgagattggtggcagcctccacgaaaggagggcgtttgatatgattatatatatgcaggaaaaaaacgagatatccctgccgtgcgtcgcggcaacaaaccgccggcaaaccaaacgggcgtgaaatcatttcggaaaccccccatccctcctcccctttttcctcgtaataaccggacgccgacgcggccccccgcctaggctgccgcagctgaaccacggcgcaagcgcaaccaccacgccgcgcgtacgcagcgcggcagtaaaagttgcggtagaaaacggcaaaaacgccaccaccgccatcacggctgcgggctaccaccaccacggcaccaccgcgtggtttgactcgtcgccgactcagatcgcctcgtcggtgacacacacccacacacggcgagaaagagtgagagaaagacgaagtggaggactccccccactctataaatttactggggtttggttggtgcgtgtgcagtgcagtgtgcgtgagtcatcgcggagtcgtcagtgtttcatcgtgtgcgccgcgccgctgcgtgcagtgcgttgcgttcctccactcccgcggcgaccgcttcaactcgcgcatctcgaggaggccggctcggctgctgcgcctcactctcactctcactcacactgcagtggtggtagtggtaggcaatggcggcgccggcgccgaagcaggaggaactgcagccgcacgcggtgaaggaccagctgccggccatctcctactgcctcaccagccctcccccatggcgtcagtgcccattccctctctcatcctctctctctgcattccaggagtggatcgatcgatctccatggttggctgcttgacggcgccttcggtttctttatgcagcggaggccatcctgctcggattccagcactacctcgtcatgctcggcaccacggtcatcatccccaccgcgctcgtcccccagatgggcggcggcaatgtacgtcccctcctcccgccgccgccgcggcgtcgcaccgctcacttgcttctgtgactcactcatttggctgccgatggatgcaggaggagaaggcgcgggtgatccagacgctgctgttcgtcgccggcatcaacacgctgatccagagcttcctcggcacgcgcctgcccgccgtcatcgggggctcctacaccttcgtcgcgcccaccatctccatcatcctcgccggccgctacaacggcattgccgatccccacgaggtcgccctcctcactcccccccgcacccacgcaaagtttgctcctcttctgtttgactccttgctgtattgacactgacaaatgtggcgtgctgggttcggcatggcgttgcagaaattcgtgcgcatcatgcggggaacgcagggcgcactcatagtggcctccacgctccaaatcatcatggggttcagtgggctctggcggattgtcgtcaggtgtgcatgtctcatcctcagggttcagattccaggtcgtttgatcagtgtaccttaactggccctatcattctgctaattcatgtttatattcttgtaatgttgcaggctgctgagcccactgtccgcagcaccattggttgcgcttgttggatttgggctctatgagcttggattcccaagtgtgagtattttgtactacaattgtacatgtacagtcgtctggatgtatttgcaacagtggtatgacagcataaatttactatgcaggttgccaaatgtgtggagattggccttccacaaatcatactgctggtggctctttcccaggtatacatcaagatggctattgtgtgaattctaacggtggatgaatccttatgaatgttgtgtaaatctttgtgcagtacatacctaagctggtgcctttgttggggactgcgttcgagcgtttcgccatcataatgtctgtggcccttgtctggctttacgccttcttcctgactgttggtggggcgtacaagaatgctgctccgaagacacaatttcactgtcgaactgatcgatctgggcttgtagggggtgctccatggtaataccatgcatctatttccatgccatcctaacgtcggaaaggcgttacattacatctgtttgcatttatatcctgcaattgccagtttggcactaaagaaaagattagctaatataaatagattttcgtctgcattttataggataagtgtaccttacccattccagtggggagcaccaacgtttgatgctggtgaagcttttgcaatgatggcagcttcttttgttgctcttgtggaggtactgtggatatatctatggtttttagggggaggtgcagtatgttagagggcattatgcatcaaccagctaatattccttactgtctaatgcagtctactggtgcattcattgctgtctcacggtacgccagtgcaacaccatgccctccttctgttatgagtcgcggcattggttggcaggtaccatctagactccttaatctgcaaatattttgtccgagttcttgacaattcaaatggcatgcaggcatcttacctactttatttgtttgtgtgttgcctagggggttggtattttgctgggtggcttatttggaacagctaatggatcatctgtatctgtgtaagtacattctagattactgttgcctatattttactgttttatacagtttcatattaatactagcatttgatgttggtctgagatactttgtaccgttctggaacagtgaaaatgctggtttgctaggtttgacacgtgttggcagcagacgtgtggtgcagatttctgctggatttatgattttcttctctattcttggtaagcctaatgctttgatgtaattatgtatttagatggttttgatcgtactcttctgtcaagtaaagatgtatttgtgagtttgtgagagtggaaaaggtgaagttctatatccaggctgttatccatgacctgatcaagtatttcctgtaatgttcagaggtggtttgttaatggttccaacgactgatagctggataaatagctaagcttaaaatcagttcatgaatagtttctcaaggagccgcagttagccagaagctgaatattacaggaaatactattgcacaatagcaaggctgacactgactcagatttaactaaagttaaagtcgtgattactgcataaaaacctatacttgtgatgttctctcaggctttcataatttcttttgcttatttaagcttatcatcttgtcatacaactttaaagcatccttgttatgctcctgcaatactgacaataagcatgtacttcatctggttgtactgattctgtgttgcgttcctagggaaatttggagcggtatttgcttcaattccaggcccaataattgcagctatatactgtcttctctttgcatatgtcggtatgtacaatgaagagaatcttaaatgataaatctagctttctttctatcatatttgaattatgaacacctgcaatatatttggtttctgtccacaggtatggcaggagtagggttccttcagttttgcaacctgaacagcttccgaacaaaattcatcgtgggattctccgtgtttatgggtttgtcggttccacagtatttcaacgagtacacctctgttgcaggctatggcccagtacacactcacgcaagatgggtaagacccagtaaatatactcaagtgttactactcctttcatgaacctaacaattgatggttatgtttgttcctgtttgctctttcccagttcaatgatatgatcaatgtggtattctcgtcaaaagcattcgtcggaggcgctgtagcatatttgttggacaataccctccagaggcatgacagcactgccaggaaggaccgggggcaccatttctggacagattcaggtcgttcaggacagacccacgcagcgaggagttctactctctgcctttcaacctcaacaagttcttcccatccttctgattttgcacgccagtgttttgtatcaaattgggatagcattgtagtacgattagttcttgggtaagtaattctagcattgccagattgttgtttctcctagtgtttttatactcctgagttctgaatcctgcagaccccagtgtaaaactatctgaggaaggagaaatgactcggtatttttgggtgtatattagttcggattaacagttaaatcaacaaactgaaaatgcctagtttttcttcccccgaggctgtaatttcagctgtgattttactatcttcagtgtaagcagttaaatcctttcagctgtgatttcactatcttgctgatcttctcgtggtatatggattgccttttcttcttcagacgacctaaaaaagaagtggaacagagtgcttcaaactgagcagatgatctacaaactgaaccatgagcccatgacgagatggaaatccaattggaccttgaattcgtccaaaccaaccagctgatcttgacaatgatacgtctctcttctttttttctcatgcctcatgcatgttcgagacaaaactctcaaaagcattgtcagtggagcccatctgccggtgacacctttggatcgttgacatgccaggtgtgagagtgtgaaaccacatgtgaaagagcatggtcatatgcgctagtagaattttccaatttgaatttaactcgttcggatcaacaaacctaccagaaaatccggaccatttcaactcgaaacagcgagctgcagcctgcaggtgcagggggagtcgcgtacacgacctcgtcaagtaccaaccactcacatgcaattatatgcaaaacagaaaaaaaaaacactttctaactctttatttcgtgcacatacagcaagtacaaatattatactcccatttagcaaccgacgttaaacgtgacaatacacgagggatactaattctttatttgaaccgtgaaattcgccagcaaccaatagtagatctgatgcaacggaaccaaactaccaaaggaggacagtttaaattcaaaattccctgatggctccctgaaattcctctgttacaatttatttttttaatcccccaataattagctgcttataatataataatcaattaagaaattaattaatcctttgctccctgattgcctctctgcctcgctgtacattgcccacttcgccgcccgtttcggtttccctttcttcattcttcttcttctcatcccaaatctctcctcctcccatcccgccgcgcccgcgagagatcagcagctactcgactcgactcgactcgaatcgaatccgaggtgcgcgccactcgctcgctgcgattctcctcttcttcttctgctggtttcgatcggttgcttgcttcttctgcggttgctttgcttgggatctctgcttacgttgctgttgtttgggggtttggatctcgggctgtgcgtgtggtggtgcaggggggcggcggcgaggggtggtggtggtcggccatggcgcaccgggtggacaacgagtacgactacctcttcaagatcgtgctcatcggcgactccggcgtcggcaagtccaacatcctctcgcgattcacccgcaacgagttctgcctcgagtccaagtccaccattggcgtcgagttcgccacccgcacgctccaggtcccccttccctcgcgcgatccatcctcttctctcgcgactatggttcagaatagtagtgttggggatttcgcatgtcaccattgcgttcgatgcatttttgtttgattggcctgtcgtgatgtagggtttttctgtttgatatgagatgattacttcgcgtgtactgaacatgaattaagttcagttcaattctgtgaatctgacgaacgaaatggggggaaaaatatctactactattgattaatgatgcacacgttgagctctgactctttttgcatgtaccactcgtttaatagtagtatgtcattttgttgtgcttcatggggcccttggaatgatttgaagaaagtaactttattcttaactgcactggtatcaacataaatcagatccataggtacagagctacagaggtactaagtatcatttatcatgtccttatttaattgattaaggggatattaagaaaaaacttgaattacatgttgctaaagtcaatttggtagtcaatgtagaagatggtgagctttatgctgtgctagttgaacttatgttgctaacttatatgtggtgcataaatctctactttttctgttggaagttctacaactgctttggcgtatttcactcaactgtctttcaatattggaagtatctctgaaacatgcatttatattgcattgccttctgatttcgtataaatccaaactttgcagtttgtcatccattattttgtttataccttgacttgggtgtatggattatgcgtatcattatttgaacagtatatttcacattgcaccatatattttgaccaaagtttcacaatgggcaaggtccaaaccaaccttttttcacttaacaccatatatctttgcactagttggcactttggactagggttgagcacatcaaaggaagttgtcagagaaaagctagtttaaatcatcaattttagtgccacaatattaggataaatatctttagaaaaagttagcaaatcagaaaataacttttttcagcaaatcacactaaaacaatgacgtgaacatgtttaaaagtggcacaaaatgatctatacattggggcaaatgaataaatagaaaatagaactagttaattaccacacactgaaaagaaggaagaaaacataaaatgttttgccttttataattatccctatgtaaatcatatgaatttctctcatattcccttgttttgctcaccccttgtccaaactgaaaacttatgtaaagatgtatgatgttagtgaaaacattgatttaaccctagtccattatgaaaccttggtcaaaatatgtggcccattgtaaaatttactcttatttcaatagcatgttaaagtataccgttatctttgtaacgtcataaagcttgtattaagttcataacaccggcgtggtaactataattctgcaggaattttttatttgatttgctctgttgctggagcattgctgatgcatttacagagcttctgaagtctgagcagtgtatttatcattattcggtatacttgctcaattcaaactgcttgttaaaaaatgatagcaacttgcactgcatagattgtacaagtggatcctgtccagaaatattttaggagaagggtaacattttggggaggtcggaagggggtatgtaccattactcttttgttttcttttagtgttgtaggcctctgaatgtacctgacggttaacacacactgtttctatagatgagtcttttgattaatttgttgcatttcagagaacttctgaattttgggagctgttttgcctgtataaggctctgatatagtgaacttgtaatagaccttaacaatctaatttcaccatactatagcgacttctttcatggcaaatactcaagttaaatttatccatgatattggtattttggctcaccatattaggtatgttggtctttcttatttagtgtggtatcatgtatacagatagaagggcagaccatcaaagctcagatatgggatactgctgggcaggagaggtaccgtgcaatcacaagtgcttactaccggggagctgtgggggcacttctagtctatgacataacaaagaagcagacgtttgaaaacatccagaggtggcttcgtgaacttcgtgatcatgcggactccaacattgtcattatgatggtaggcaacaaatcagaccttaaccacctgagatcagttccagaggaagatggtcaggcactagcagagaaggaaggtctatcattcctcgagacctcagctctggaagcccttaatgttgagaaggcatttcagactatccttaaagatattcatcaaatcatcagcaagaaggcacttgctgcccaagaggcagcaggcagtggacctcccactcaaggaaccaccatcaatgttactgattctgctgttaacacaaagagaggatgctgttcttcctaggtgcaaccgaagatttggtgatgctgcaaaaggaaattcccatggatcttacagcactaggtgttatgtaggtcgcttgactccttttggcctgtaattctggtggggttgtaatcacaatttaaatcgctagaaagaaatattccttttaaggtagataccatgtgtagttgcaaaattttggtagagactgttgctgggcaagactttctacagtttcatatctatatcatgttttctatcagtatgcttgtgttatatatcttgttatagtctaaattgttggagctgagaaatactatgatgttttccatgttggtgtaatatccagcatcttcctgctagaaactaaaaacatttatttttgcctttttggtggtattatccattccaacttatgaactgaacagctaatatatctccattctcacttgtactgcattttgcctttctgctgatcctgtttctttcttctcacttgttgcttgaagtatactgcatctgcggtccctgctcacgtgtatcacatccttcgattagttggtgtaacatcaggatttcagttcatttgattcagcgttttttacattattaggccagtcacaatgggggtttcactggtgtgtcatgcacatttaataggggtaagactgaataaaaaatgattatttgcatgaaatggggatgagagagaaggaaagagtttcatcctggtgaaactcgtcagcgtcgtttccaagtcctcggtaacagagtgaaacccccgttgaggccgattcgtttcattcaccggatctcttgcgtccgcctccgccgtgcgacctctgcattctcccgcgccgcgccggattttgggtacaaatgatcccagcaacttgtatcaattaaatgctttgcttagtcttggaaacgtcaaagtgaaacccctccactgtggggattgtttcataaaagatttcatttgagagaagatggtataatattttgggtagccgtgcaatgacactagccattgtgactggccttatagaatcagttctatgctatctgctttagcataatctgcttttccattggaccgggaacagcatactttggcatcgttgtcagtgctggcctggccatgcatagaccatttgtgtcatgagagacatttgttctaagactcctaccttaaaactccatgtaactttgatccacattcgcttctgactttatatcatgagaaagttaatcattcttccatttttgggctggttcatttcaggacatttttatttatgctgattcagacatcaacttggtgatcatagaacatttgaacattatcatgaaaaattttaatcattcttccatttttgggctggttcatttcaggacatttttatttatgctgattcagacatcaacttggcgatcatagaacatttgaacagtaatgcatgtttgcatgcatggagaatcttacagagataaggcaagcaggtgacaattccttgtgatttttcatcatacctcttgtggtcttatattgtgagactgatctgatctcactgaagaagaatatgttctcctggcacaaatgtcagtcaatcctttctgctaggatggagatagatgcctttttttctgcatttttccttttgcgattacatgaaagacgtctacgcatacagaccacacggactgccattcgcgagtacacccctttaacatatgctcaagagtcacactcatgtatgaatgatcgtagatattatgatttgatcttgataaatggagtcatgcacctacaactccgctaacatatcctttttgggatcagaagccaaagagggtccatcttttatagaaagcaagaactacatcaatatatcaaaggtgtttatcctatttcttttttgcaaattggaggacaagagagtggcaaaaaaaaatcttgcaggtatgtcaactgcagagtctcctcctctggattcttgatggacgcaacatctgccgaatcgtgttctgttcacttccaagaatgtgcagccaattagctgcaacggccttccctttctttctctccctttttcgaggctcaaaagatgttcgagaaaactctagctcgctttttgctcgtacgttcaaaatacggtgcatctctctaaatataaatttcaatctaatggcaggcaggcttggagctgattgtgatctgtcctgct

SEQ ID NO: 42202 - DNA, 30143 bp, Oryza sativa
ttcctgcagccctgcattttgattgtgacctgatcaacccatccacccctaggacattttcggcacatgttgatgatcgacaagactagctactatggagatggctcatgctgagtgtagcgtgcgttttttatgtaatcgaaaaacataaatgatactccctccgtttcaggttataagacgttttgactttagacaaagttaaactgtttcaaatttaaccaagtttgtagaaaaaaatagtaacattttcaacccaagacaaatttattatgaaaatatattcaattattgatttgatgaaactaatttagtattataaatattactatatttatatataaacttagtcaaacttaaaatagattgactttgaccaaaattaaaacgtcttataatctgaaacggagaggagagagtaccgtatatgttggatctcatatatgcatgcatggatgacatttatgctcctaatattttaagcaacccctaaatgggcgacaagtggactgaccacgcgcaatacggtgacgcatcatcactaatctcttcattgtgtgatagtcaaatcgtggcactgcacgttcacgatcagcatcatactgtcatgttctcgcatgtcaaagagacattagttcgtcgatatatggatgatgtcgtccatatataatgggggtacattgtggctagattggtacacctgattgatttgctagctttaattatatttactcccacaaagcttggatcaatccgtagaaagttcattcatgataggtcaaggtcaggaacactgctataggcacccaaacaatatagaaaagttaggtaaatacagagtgtgaattaatagaaaatatcgtcgtatgtgagaattatacatgaggcctggacagcatgtttaatgttgatgtagtgtggtagtttctaatttcataataatcatagttgttgcacgaagaaaattatgtaatacagagtgtgaattaatgaaaaatgccatagcatgtgaaagtgatatatgaggcctagtacatcaattctaggatgatagaggtggtgtttgaatctagaacaagtgtttcacgcaaaacgaggtggttgtaacgtgtgattaattgagttttaattattacaaacttgaaaaatggatttatctgacattttagagaaactttcatatagaaagtttttgcatgaaacgtaccgaagaatccaaactttcatatagcagtttgaaaagcgtgccacgagaatccaaaattttatcctactcttaccgaagaaacgaacagggccagagggtggtatttttcccattttacaatcatcacataaagaaaaatgatacaattaatcatcacagaaagaaaaatgttgctaaaccaaatatacagcttagaaatcaggtagttgatgaacctatttgtcagtgactgtttcgattacaaggtgaggtaactgtgaagtacatgtagctagcctgcatggaattccaaagttgaaagtgtgcatcgttagtgaccctccactaatcacaaaatgttgcggctatctccgtatgagctagctgtctcaaattttatgctccatttcttacatgtgctaattttggttagttggaggcagactaaagcaaaaaattaaagtgggagagcaaagttgtggagtccatccgtccatccgtccatccgtccatccatccatccatcgccgattgcatccaacttgattttgtcggcaatgcaatctaatgcatgcttgcatggttatcgtctctactgacatctcctaatccagcaaaatattcagtgaatatgactgtgcagagacagtgtcgcgtgcagtgcatgcatccatggaattattgttacttaaaaaaaattcagccagatgtattaaatgcgttggtgtttttggttcattgacaaaaccaaccatataaaagaattggtggtaatacttgcatatccatttgggggtctgttgccaaaaaaaaaatgaaggggctaaacacaagcttcggaagtaacattgccaatttttttgcttgacaaaattttagtaaggctaagaatagctataataatccaaacaaacctattatggctaggcactagaatttgaattgttagcaccctgcaaaaatatttgggaatagcaccctgcaaaaatatttgggaatggtgccatatttgtcaataaaaataaaattttaacacgtatttacatgtaataatcaaatattacaatatttaaatctatatatttcgaatgtaaatttcagaacttacaatataaatagtatcaaatgtttacagtgtattttttttctaatactcaatgtatataagatttgagactaggaattattggttaccggtgctgatcaacaaatgacgtaaaaggggaaaataaaaattggaagagagagaagcggagggatatatagtctgttcgccaagccaagatttggggacatatgttgcccacgacggcatgaacatctatcgcacggtccaaatccgattgaaatcaatcacaaattgctggcgatagatttttagcaataccggaatactcctacttttacatcagaattgtacatggaagttatgtgtgcatcgatctgtaaactagtactggtaaattgttgcacaaagcttttgtgcgtttaatttgcggaaacaaaataaaagaacttaggtattatcagtgtcaaaaaaagcagcggaggtgacggactcatggcacatcagtttatgttgtatgtcatcctagaaatgcttgtgctagctgactagctccaccactccagtcctctgatcctctactgctcctgtatacttcttttcactgaattttcagtgaattggttgttgcttgttagtactccctctgtcccagattataaaaggttttaaatggatttaacacatcataatactacgaatctatacaagctttctgtctaaatttgtaatattatgatatgtcaaatccacttaaaattccttataatctggacgacaggtgctatattggcatgaggaagagcaattcatcatttacgattcaagacaagaaccatcaaaaatgtattaaacctgcttagattaggtcatatatacaatagatttttttgaactagaacaaattatttcattgttcttcagacaaaagaaagaaccggacaaattaatcatggccattagtacacactttatgtaattattttcctttaaaaattatcttggtctgatcaacgtcatccacagaatactatgcaggttggtagtgcttgttgtaaaacagtgtgtaacagtgaaaccgacattttttgcccctgatatgggctacacatgggagagctagacttttattttaagaacaagtaaatttcacaaaactactggtattttggttaaattatcaaaatattatagatttaatatgatgtatcacaaaacgatatatttaacactaaatttatcacagaactacagatttaaagtagaatatcgcaaaactatatatttagtagcaaagttatcacaaactaaaagtttaatatcaatttaatcacaaaacttagacatatataactcaaacatagcattggtgctaaggatttaaaccctacaatctgtagctttatgacaattttattagtaaatttgtagttttgcgatacttggcctttatgataattttattattaaatctctatttttgtgatatatcactttaaatttatagttttgggatgatttagccaaagtatcatcacattacatttactgtaagagaaatgatccccacaagagagagagaaacgaaagtgcaaaccattcctagaataacattacatttgctggaaattaaaattcatccatctttgattgcacattatgtagtataaggtggcatcacatttttagtcatagtaatcaaacatggtaaattgacaaacttcagacctttgggttggagaatttgaaatatttttgacaggtttgaatcaatttccatgagaatttaacaaccagacggcatgtgcccaaaaggttctaaaatacttccccacttcggttcagatgtgaaatttgttcaaaatttatatgaggctcctattagaaatttgatgagggctagagacttacacatgatcccatctcttaaaagtgggttgaagggtgccaatcaatcacggttgtgcgtgtggtgtgagtgtctagtggtatgtgtgcaccctgcatgatggaacaatcccaaatttaaggaaccaccacgcacctaaccctgagcatattgatgttcaaactagtcattaatttttacatagacacgataatctcaagatatatcggtctagttttccagatatgctcatagagatagatgtgagcatttataagggtgagtgtgcgtgtgttgtgatcgtccgcagttatacctgtttctcgaaagaaaaaaaaagatgatcaaaatatttcaattgacaattagtaaatcatcgagttacacattgtgaacattttagtcactaaaacatatgaaagaaatatgaaacatgtaaataccatttgaaatatttctctattttcttagaaaaagtgttcctttcttatatgaaatatcaaattttaacggttaagacatactccgtatattttcttacgcataaaatattttaagggaaaaaaattaaagcttgctaaggagctttattctttgtatgaaacatgcagccatcaatactaggtatctagagagaggagggaaaatgagcatgcagagcgtcctatgagcaccctcgaggcatatcttatattgataaaatcactataggtgtcttgctttctatgagtgctgtcagggttatagataccgcatacccaatagtaatcgactaagctcggcgggcccactacataccaagtcttatacggaatcataccttgtatatagaaggggttccagataagtaaggacaagtaaagttctatatgaaaacgacaaggactagattgtatccatattggtcttcctagtcttatttggacaaggaaacatctatgggtataaatacaagcccctaggaggagaggggacacgccacaaagccacaagatcaacacacaatacacaagccaacacacgccaagacatgccgtcgggtatcaacatcagagattagcctagacaaaccccgtccggtttctacggaggccggcaatagggatctagcagcatatctgatctcggcgagtgcggattcgaggaggaagactaccctgtcgtagtcggttatctagccgccaagtcaacgacaacaagataagttatcccaaatattatacttgtgtaattcaaatgaataaaggagcaacaccggcttcagccaacaggatgtaggggtattacctgtcagataaggggcccgaacctatataaaaatccttgtctctgtctcttttactccaatctcgcatataccctagtaccaatgatccccataccatctaaataccgtagtcgcgatctcaaacgtcgacaagtgcgttgcctaccactaaaaaaataattaaccttaaatacaattgcttatgtgaagtgtaggacttggacctgaatgggccaattccagctaaaggaatctattgagctactctcactttgattgaactctaatttcacgaagagatgtcctctcgtttattatatgttatctaaataattataaacaaactgataagatagattaaataattccttgaggcaagataaaaatatttttgccttctgaaacagatgttgagtgatatatcatgtataaaactatcttttttttataaatgtttagatggtatatatgaaaatagtttcccaaaagaagcctgtgggcgtaaattaggactcggatcctctacattaaaggaaaaaaaatgcaaagaatctacagtacacttgcattaggcatggtttttaccgttggatcttcatcaaacggctagaaacggatgttacactgaactcgaatagtagaaggggaataataatattttgtcaaccggtcaaacccacactgtgcaagcagtttttgctacagtactactatactgttctaacagtggcccttgcattacaggagaggatccacgtcccgtaaattatttcgtcctttttggatatcactgaattatttgcttcatgttttctaaaatatactccctccgtctccaaatatttgacatcgttgacttttttaaatatatttgatcgttcgtcttattaaaaaacttttatgaaatatgtaaaactatatgtatacgtaaaagtatatttaacaataaatcaaatgataggaaaagaattaataattacttaaattttttaaataagacgaacggtcaaacatgtttaaaaaagttaacaacgtcaaatatttagagacggatggagtatttgcttagaaaaaactttccagtagtactcattgcttttttttttttttgaacattgtactcattgcttgaaaacttatttcaaactattgactccatgaaaagtatatgtcatcgagttgcaacttgcgacgtcgtacaactccatttgggaattttgcaggagcgtttacacatggcgaagaacacgacgagcggttggcagttagccgctgactgaaacgcatgcagagacaagcatttcctgcgaaaaatcaacgccgattccggtgggcgatcgatcgatcgacggctgcatctgcgcatccaacttgcttagcttgtatcttcgtaaaacggccacgcgtgagtgagcccgtcaccctgcgagagatgtaaggagggcatgtacaaaagatagttcgacacgacacgatctcttagttaatacttctgcaatagttaaaaaaatataacctcttaactattactacatcaaaataaatttttattacccttattttcttttcttctctccatctccatgtaacaatatttcagttaataaatgctaccaagagttgaaatctaaaccgttgtcatacgtagcaacgctgtttttttttctttttttttcttttcacgtcactaaatttatatgcatatcaatcgaaaatcaaaagagtacgttaataaatatcattgtacatgtctaagaaaaacggacgtgaaaacgtgcacgctttaatttactggccctgcatctcggctagtttccatgcagaacagcggcgctagagacggcgtatgcatgatagatgtatgtatctcttggattgatgacgtttgctggaaatttgggagtcaatgcaaatttttatgttttcaatgtattatatctttgtgatgcatacaatatcttctcagtggactatttaatctccaggatttgatacttcatagatttcactcaaattaatgagtgctggagctattgtgtatgcatggcaaacattaattagaagatcaaggaaaaaaaatatagtgtgaggtattagctatgtgttcaatactccaccactaaataagggagacagattttgactccaaatttgaacgttgtggatagctatgatcccaccaccacatatgtgatgcttcccttcttttcggaggatatgcaacatgataatctatactccctccgtccaaaaataagtgtagttttgcactattcacattcaaggcaaattttcaaatttttcacaattttttcaaggcaaattttgctacaggacatcgcaattgtgtggttttaactcagggacaccgcgaaagtgaagttttgggggaagacatcccataatcgtggatattagccgatggacaccgtgccatttaaattagctcagggacaccgtgaaagtgaagttttgggggaagacatcccataatcgtgaatattagccgatggacaccgtgccgtctaaaggaatcttgccatgctgacgtgacggacggatgcccttttttgacgcggttggacctaaatgcccctgcgccttatctccttaatgtttggccccacatgtcatcctccatgtctggccccacatgtcatcctcaatctctctctctctcatctacaaggagaagactagagcaaggcaggcgacgaccagagctgggcaggcggctgacggcggccggagctggccgcgaagctgagcagagcagtagctcagcggggagcaaagcagagcagcagcacgcacgccctggatcccccgaagcaggaggtggtcaagccgtcgccgccgggccgcatccgcaacagcacgccctcctcccccaacctcctcgtctcgagcgccgacgccgatgccaagaacatgtgctgctactccgcgctgccgagcgcctgcccctcttcccctctctttccaatcctctccagcggctcccacgcgcgtgcgctcctgagcaagatacggcaggcgcgcgacggcacgggccgaggcgacggcggcggcctaaagggagcctggcggcgttgagtggatggggataaaaggctggctcagcgaggaggtgccagggcagcgccgagcagaggaggcggaggtggaggcgctgggtgatcgcggaggcggcgcccgtgtgggccggcttggccgtgcgcgggggcggtgctcgcagcgtggtggtggccccgagcaagacgaagacagcgggtggtggcgaagcagcagtggcgcgcgggtggtgctcgcacgggagatgtggccgcgcgcagtggcagcggccgagcgtggcgacgacttggtgcggcggcggagaggggagagaggtagctagcggcggtggggaatggcctgacgggaaggcctttttttgctgacgtggtgcaggggtatttacgtccgatcgcgtcaaaaaacggcctcccatccgccacgtcagcacggcaagattcctttagacgacacgatgtccatcggcaaatatccacgattatgggatgtcttcccctaaaacttcactttcgcggtgtccctgagctaaaaccacacaattacaatgtcctgtagcaaaatttgtcttttttcaaatgagacggacggtcaaacgttgggcacggatatccacggctgcacttattttgggacggaggtaatattttctttctttcttatataaaaaaacaaaccacataaaggaagtcgtgggcttaaaaatccacatcagtaacacactacataccttgtccacgaatacaaaaaatgattggaggtgtgaggtgagaaaattaaataaagagcggtggctaggagaaatagtttttgtgaatacttatatttgtatggcaaataaatattaaatgctaaaattctttatatatagtctatgaatctttatatgtgtaaataaattccaattattaggtatccttatatatacatatgatgtatttcaacttttttaaatgggaggtgtatttctactttgaacatgatgaattgagaaagttgcaataggggtcaaatctcttagatatttgtcatcccttaattattttccaaggatagtagttggcgatatttggtccaacgtttgtttgtagtaaaaagtaacggcaggagtacaaaaattaattaagtatggttggtaaaagctcattgaattgcatgcggctgatgaaaaaaacgtcaattttgtcacagatattttcacaccttaattactactagtattttacttaagcaagtcatctctaaagcagtgaaagactgaaagtagtgagcactagccactagcttgaagataaacacgccaagttaggccacagattatttttttttaaaaaaaaacacgccaataattagtgtagcaaaaaaaatccttgaattcccattaatgcgtcgccttcaaagattttttttggttagctagactaattatttccattttttcacaagattagactaattcaactaattcttttcatcgattcgcctttcacccaaaatcgatcgagctctcctttccctgattcgattcgttataggcccatcgatcttactaataaaatgattacaaatctaatcaacagcgaccactgactgaagccgcagtaatccggtcagtctgcgagtgagctcacacctcgatcctcgtcctcttcttcgattcctcctctgttctcgctggccgtacgtgtcaagcgtatccagcacacacggctatataaaggctgcacctcgagccccttttcctcccaaccaaccaacctcaaatcaaatcaagaacagctcgtgcttagatcgctctctcgcttgctgttcttccaatccactcctcttgtttgtggcaaagatctgggttctttttttttctttttttgccgggtttttttggagaggttttgtgagcatggagggtttaaggggcggcggccatggcgaggcggcggtggacggcggcgacgagaggtgggtggaggactcgtcggtggattaccaagggcggcctcctctccgcgccgccaccggatcatggaaggccgcaatgttcatcatctgtaagccactttaatttctcgatgaatctttgtccgtacgtgttcatgtgatttcttactgatcgactgagtgacgtgttcgtcgtcttcctcctcgatctcggcgtgaattcgatcgattggttaaatgaagtgattgagttcagcgagaggctgagctacttcgggctagcgacgagcttgatgatctacctgaccaaggttctccaggaggagatgaagttcgccgccaagaatgtcaactactggaccagcgtcaccaccctcatgcccctcgtcggcggcttcctcgccgacggctacctcggccgcttctccactgtcctcttctccactctcatctacctctcggtcagctctctcactagctctaatggcgttcctcgccggcagcgagcgatctctgatgatgatttttgttttgttttctgtcattgcaggggttgattctgctggcgatatcgcagctgtcgccgaggctgaaacccgagcgcaacctgcacctccacgagacgctcttcttcgtggcgatctacctggtgtcggtcggcaccggcgggcacaagccggcgctggagagcttcggcgccgaccagttcgacgacggccacgcggcggagcgggtgcagaagatgtcctacttcaactggtggaactgcgcgctctgcgccggcgtcctgctcggcgtcaccgtcatcgtctacctccaggagaaggtcggctggggcgccgccgccgtcgtgctcgccgccgtcatggccgcctccctcgccgtcttcctcgccggctggcgccactaccggtacagggtccccgagggcagcccgctcacgccgctcgtccgcgtcctcgtcgccgccgcgaggaagaggcacctccacctccccgccgacgccaacgagctctacgaggtgaagccgcagaatatcaagaggcggctgctctgccataccgatcaacttaggtgaccacttcatttcaactcacgttactttccttgccccttcttttctcgcaaaaagacactaatcattgacgcacgtacactgcaccacggctcaaccaccagtcgacccaaaaacttaagctgacgagagaaaaaaattatcgatagtgaaaatgataacaatatttgatcacgttgtaaagttatacataaggacttaccttgtttatccaaaagcttaaactgacgaggaaaaatgcaattgtgattgtaatcatggaatgtgtggatgacatggcatggcaggtttcttgacaaggcggccgtagtggagcacgacggcggcgaggagcggcgcggggcgtggcggttggcgacggtgacgcaggtggaggagacgaagctggtgctggcgatggtgcccatctgggtggcgacgctgccgttcggcatcacggcggcgcaggtgtccaccttcttcatcaagcagggcagcgtgatggaccgccgcatgggcccgcacttcacgctgccgccggcgtccaccttcgccatggccgccatcggcatgatcgtcgccgtggccgtgtacgacaaggtcctggagccgtacctgcgccgcctgaccggcggcgagcgcgggctcagcatcctgaagcgcatcggcgtcggcatcgcgttcaccatcgtggccatggcggtggcggcgacagtggagaggcagcgcctccgcagcgcctcgccggcgtccatgtcggtgttctggctggtgccgcagttcttgctgatgggcatcggcgacgggttcgcgctggtcggtctccaagaatacttctacgaccaggtgccggacagcatgcgcagcctcggcatcggcctctacctcagcgtcatcggcgccggcagcttcctgagcagccagctgatcacggcggtggaccgcgtcacctcgcacggcggcgccgccgccggctggttcggcaaggacctgaacagcagcaggctggacctcttctactggcttctcgcctgcatcggcgtcgccaacctcgtcttctacgtggtcatcgccaccaggtactcgtacaagaccgtcatggccggcggcaaggtcgtcgacgacaaggccggcgacatcgagtgcgccgccgccgcagctgctgctgcctactgatcaatatcaagcagtagctgatcgattagctagctagctagaaaatcatggtaagaaagaaaatggcatcatcatgtattatgatctgctttcgtggtacgtgacaacaacaaaaaaattgtaaggattatgtcgttcgtccatgtatatgcttaatctgcttgtgattgccatctgatcgtgtgatctactgctactgctgatgttgccaagtcctgaactgattcagtgtagcagtgattagtaagttacgcgtgtgcttagtgcaagaggcgaagtgctgagtagatggattacgtgcacttggagttaagagtgcgagattgagatggcccgaaagcctgcttaattcggacccatgggcggagccactacgattcctgcgtattccgaggaatatacttcagtatacgcacatgtacacatattagttagccaagtactcttcctaactgagatgcgtatagatgaaaggtttagaaaagtgaaaaatcttcttaatctttccattatgattgttgaaacaaagttgcacaatagacatgagattgtttacaagcttctcaaattggttatagtactttcagtagtaacagctagtgttcaaataatcttttatgccatgaataatgtgaagaataaattgataaacaggctgggggatcaatacttaaatcattgcttggtcacatttattgagtgtgagatgtttttgaaagtcaaggactgtgatattataaaccgctttcaagctatgaaggaaccaaaatagaaaattagaggtaccatgtaatatttgtagttttatttcttcgattatcggtattgacatactgtgaaccattgatttttttttactatgaactttttttttgttaaacgggaatacccaacttcgaaatcctggctccgccacttcggaccgagtttgcagccttgcgctgtgaggaaaaagtccaatgtatgtccctctaatgattgagtttcgatcacgtccctcaatcacagaaacaggtacaacgcattcctagtcttccaaaagccagtgcaaatatagtccaaaggcagcactgaggtcgtttttagctgacgtggtgcagtggtgcttatgtagcgtattgactaggttttcgtcttacaagacatctacgtaacacttacattcaagaacaaaaaaattttaggacctatgtggggccaacatgttaggggttcttcttcctccaaaacctcccttctttcctctcttccccatctctctccacctctatcctctcttcctaccttgtcggtagggtggtggcaagtagaggccgagatgatggcccaacacaggtagacaagatggtcacatacaatgagatggctaccatcactatcgagtgtcgcctgccttagttattatgacgtaccactttcattcatttcagcgagtcgcgtgtattagatcgattcaatcggtttctagtgcatatcgagatgacatggcatccatggagatggatattacaatgatacgacaagaagagcaagtcacaccgccctggtgtgatactgtggctttatggatgactacgagcaaatggaggacgatgaaccaccctcaccgtgagtcaacaagcccgggtttttttttccttatgccactgccggagcagaaggtgtccgtagcatatcatgcgtagctttggcgtacgaatgcccgaataaacaacaagtatgggtctcgtcggcccaatgaaaagaggaggaagaagaagaagtccaagcattatgtgtcgccgttgtcgtcttcaccatagtcgaggtcgccttcgccagcctacgagatactccctccgtactcgtaaaggaagtcgtttaggataatgtttaagtcaaaccttaggaatataaatcatgaataactctcaggttgttgagtttgaaaatataaaaattatataaatagatttgtcttgaaaaatactttcataaaagtatacatatatcacttttcaataaatatttttatagaaacaagaagtcaaagttttgtttttagagaccgtgtcgctatccaaaacgacttcctttatgagtatggagggagtatctccaaccctcgaacccaacgacccatactagataccaagaagaggggggagaggtagagatagatggggaagagaggagacagggtgaggttggaggaagaagaaccgctgacatgtcggctctacatgagccccatcgggtttttttattaatgtaagtgtcttgtgggatgaagacctaatcactacacaacgtgagagccacattacctagtccctacacaacgtcagtaaaaaccggcttcagtactatctcaggattacattttcactgattttagaagatacagatgtgttgtagccaattttatggttgagcgacaggataaaatggccgttaattagatagagacgtaaaagtagacttttcctgcgcatcaacggctgaaacagcccaaagagtagttacggtgctttggttgggttggactcgctgagtcctggtattgggccatcaagtcgcaatggggaataagttcagtttagacccctcactgttgtccagtctaaaattgataccgaaatggatacaacgtgtccatcaactcccaaaaccaccccaaataagatcacaagatggtttggatgacgatttcaactgatgtggcacctacatgaatggtttgattatcgccatgtcacgccacgccaagtgcagtgcgggtaatagttaagggagtcgaaagcccaataaaaagttggattttggcccaatagtaacaacaggttggatttaggcccattgtgtatgtaagctacagtaataagtactccctcaccaaactgcgtgacgtgttcaagatacagtctctcagttgacccgtgaccgtatgctcaccaaacttttttcttaaaaaaatcgccctgttctgtaagactgtaacggcgagttctgtttttttaaataaagaaaaaactgccgaccagcttggctaggctcgttactagaatcaaaatattgcattataatactcgtattctgaatctgagaatacacagccgtgctacacgtttgtcttaaggacgtgtcattaaaattctgattcgattcctcgtgtgtttggtttggataggtcatatgttaagaaaaaagaaaggctttattaccatgtgggacacatgtcgcagttgttttaaaacggttgggagttttggcttcggactggctttcacacggccgtgaatggacaccaccaaccaaacgatgccgcggaatattccttgcaacgattttcatcagggtcaagtcaattaaatttgtttatcatctgggaaaagtaagctaaagcgaagcaagagcaaaggagattactgctaatttttctgctctcttcatccaaatatatactccaacagtctagaacatatttagtagagctctgacttctaaatttgactccaagagttatgagtagagttgtagagccgccgaaaaccgtcgaaactaagctctatctctttagttcattagagtgttccactcagtttcacttctattttagatggaactaaaactctgtttgactaaagctgtagatgtgccaaacagacccttaaaataagattagatccatttaagaactacgaatataaaaataggatttgaaattagcctatttccatattcatagttctaagctagtccaatcaactactttctctgttttataatataaaatttttattaacgtctatataaatgtatgtgagtacgaagagcgtatattgctatatattgagaacgaaaggagcattacaaattgcactatttttgtagaaaagaaataaactaatctccgcaccaagacaaaagggagggagcaaccagcctcgctggaacggtagcgtccttatcctcctcctgctattgattattttgcgttcccccgtcgccgcggtcccattccgacctgttatcgcgtacggataccggccaccactcgcggatcttctatggcatcttcacttcaagagtatcatgtgcaatctttttcgattaaacagaagaggcacaaccgcacacatcaaatgcacatccacaagtatgacctcaacatgataagatcaaatataaacaaagaccaatagtatatatccttaatcccactaaatttctattaaaaacacatttaatgtgtaatattcgtgagtatagatttaaaatctagcgagtgagagttatgcacccaccattgcaccagtgcaccaccgatgtttcctcaatattatgtacatattggtgaagtgaagaaagtggcggacctaacaaccaagaccttacttttgtgttatactcatgatagtaattcttttaactaaccataacacttttacgatatagacaaatgcaaagcatgattaacgaagggtcgataataatggtgaaactgcattacatctggtagccttatgctcatgatagtattttttaagccaaccatagtgctctagcatctatagagtagtagagtccaatgtaattcgttgctatattgcttagacaatagaggtaacaccatgtacgaacaagattactatatcctgacactagcatatcacaattctttagatccaccactcccgataccggtaaatcataatttctgggatccacgactagttggtattaccttcatcctaaaataaaagagattttggttggatgtgatacctctagtactcgtgatactaggatgtgtcctgtacatccaaatttttttatatttaggatagaagaagtaagcagcgttaatagtaccaactacattagtaatatcacataaagtttcagtcatatggtgggttagtgatactattatccattgatttttataatagataagtatattataaactgtaagtagtagcacggtatataaatagatggtactggtacgagattaggtgctactaataagagtgtgttcttcgcagagcacagcacgggtggttttgtggtgtactatggccggcacagagaatcccagatggcattgcaggctggaacacctccgagtgggagtggcccatgaaaggtagtgcttcgtcgatcttatctccggtgactcatttccgcatgtgaagtggcgcgacgctccagcttatcaattgtatttcggatgtgttttttcacataacccctcctgttattcagtttctgctctgcacttccctaatatagaaattgaaaattaaggcccaagtttgcttcaagtttgtatcgtagacacacttccaactttccaagacattttacacaagagaattagagatgatattgatctaagcttgcaagaacatttactagtttgatttggaatatgtcggcatctttcatttaccaaaacaaggttgtgttcgccagtgtgagttcctaactccacattcttcattttctgtgtgcacgtttttcaaattgctaaatgatatactttttttaaaaaaaactatacgaaaattactttaaaaatcatattaatctatttttttaaaaaaaataatactaaattaatcatgcgctaataagtcgtttcgttttgtacgcaaggaattagagcatgtttaatagtatatcgaacgactaacttcaaatcatctatagtcaatttagtagccaatttatacaatagatacctataaacatatacaacactagtaatatctggtcctacctgtcaaacacacattatattttataatctaggtacaaatttatagcccgctgctcttctctcttcttatttatctactcgatatgtgttaatagttggcttatagtatgctgttgtactggctcttaggtcccatctgaagctactgaacacaacctaagtgtgatctaagcttgcataaacatttaccagtttgctttggaatatgttagcacctttcatttaccaacacaactaagtgtaatcggggtcatcgttttcttctaggatattgggttgtacataactttgtatttcaatgtacgtaagagagaaaaaatccattaagtagttttatgtgctatgcatatctttgtattttcctctggataactaagggctcaaattatgaacatgaattatttgtgtcctattttcggaaacttcatgtagctaatttttttcttaaaaaaatatagttttaaaatctagtaaactaggagttggttcagattctcatcagaaatttttagaatcaagctcatggagccttcatactccacaattttggggaaatgtagtggtcacacaaaaaaaaagagaaatatggcgataagaatctcctaattctatcacaatataagggcccctttagaagttgtacacttatcatcacaccacacacccctatctatcgtcaacttggtggtttctcagtgggcaggggagcagaggggcacacagtttagattttgtccctataagagcagacttctattagccgcgtacagatagatagacacaacagcaacaacaacaagcgaattcttcttgcagatagggaaaaaaaaacgaaagcgagagatgaggagcagctcggctctgttcttggcctttgttcttctcgccgtcttcctcgcggcgctccccttcgccgaatccagcggcaggcaccaccaccaccaccactcccatctccatggcagaggtacgagcaaaagcagaggaatcgaaagatatttgctttcttggagcgacttcttgcttgggtcaggagctaaattgaaggagaaatatttgggcttcttttcaggggaaggcgagagaggaggagaagcacggtcgctggcggcgaagggggcggcggcggcgtggccgtgctgcgacaactgcggcgggtgcaccaagtcgatcccgccgcagtgccagtgcatggacgcgaggccggcggggtgccacccggcgtgcaagagctgcgtcaagtccagcctcagcgtctccccgccggtctaccagtgcatggaccgcatccccaacctctgccagcgccgctgcaccgccgccgcccgctgacctcccccgccgcccatctgacccgacccaccggccaccgccaccgaccggccttacttaattaagagtggtttttgtttgtccctttttttttttggaaaagctgaagaagtgaagaagcagtagtacctactgtactggaggtgattggagggagcagctggtttcaggtttatgtgctggaatcagcctccagttttcatctcctcgctctgctaactacggagtaattgtgtagagattactcgccgagctatatgtacaaacggcctgtgtgatgagacgaaattgtaatggtaaattttttttcaccttcatatgttggatatgagtgaaattgttgctagcgaaatgatgatggatgcgtgcttggttcatattttccgttgctgtttgtctggctctgatgctttctctcctcttctgtattaatctcaattggattacaaggatgcctgtaaaagcttatgacatgctgttggttgattttgtctacttatgtcgataagggttaggagaggacgccaaaccctaaatctaattgcccgatcaagtgcgcactgtaaggagtacgtgaggttctctgctgtttcttttcatcaacaggaaatcagaacgagaaaagcaaatgaacaaaagacaaaactagaagaatcattgatggcttcaaacataggtcggtagattgattttataattaggagaggtgattgtttataggctaaagcttaagatcttgtaatctagaactctaacatgatgagggtaatacagcatgaacctggacgcgatccggcatgctgttccggggtgtatgaacctggacacgattggggacgaacggtcggtgaaatttgggaactgcacatcagaaggcttgtgttgctgtcaaccgaattaatcaggacgattgccatgaacaacatccacgatagtgagcttgcactttgcttagtggaggacggtctgggcctctggggattcgcatttccacaaggatatgcgttgccatgattttcactaggccgcttgtttaggcacgaaaggatgggaaagtgaggaatatgctcggcaagaagccaagaaccaatctccaatagtgcaaatttggggtgactttacatgtttgaattcaacattgcagtcgcgcaagtttgcaataccactatctgaatccgtggtccaaatctgaagagacctgcagtctgcacggtctctagagcaacattgccagtactaaagaagaaagagttccactaaattgctcatgtggtgatgttttggacttagctaaaaatatgtcgacaattttttgggctgatctcagtcggcttctctgtgcgtccgattgctctgcacgagttttcggttgtgcttgccggaccgttcgatttcttctcaaaatcatctcctataaagtaaggactgcatatgcttttgctttttaacttttccaatgtaagatttaaatttacatctcacttacacaccacttacatatgtaattactatgtaattttaagacttacatatgtaattttaaaatttacattgtaaatccattaaatttacatatctaatttagtaacttacaatgtaaatacatgctgactattttttgataaaaaatatggcgctataaatatagctactcccgatgttttttattgattcatcatgtggtggtgtcgtggtgatgttgaacagttgaaggaacagagggagaagaatctgagacaaaggacggcaagagagagacacacgtgctgaaaagaacaggaaaaagagttgtccaggcccaagtgtgcttctctcgtactagagtgaggcccaggaagtagcttacccgtcgcagcctatcaatgtgggcctcttttgtctccaaaccagtagactacggcccatgcaggcccatcttgccgcctaccgaaaagaattttttttatttataattttttttattaaaagttttacaaaaataattttccattttgaaaattgacggaagtagttgcctaccgctctctgggagggcgatttttaagggcggcgaaaatgacgtggcagccggccgttcgctctcgggcgacggccgtcaacgaaatttgcaggcggcccccttgccgccctccgctagggcgattttatactgtgcggggggccgcctgcaaatgggcggcgaggggggcatggaattttgcaggcggcccccttgccgccctccgctagggcgattttgtactgtgcggggggccgcctacaaatgggcggcgagggggcatggaattttgcaggcggcccccttgccgccctgggggagggcgattttttgcctccccctataaagcccagtccctcctctgttaaatttcattatattcactaaaaatccaaaaaaaacgaaagagagagaggggagggcagcagaaggggagcggcgaagccctgctggttcgctcacttcatcacaggtatgctcccatacatcttttgcatttgtactaatatgttatgtttgagtatatatgttgcgttttagttttagttccatatattttagcacatctgtagcacagagcacatatgtgtagatccagagcatagaatataatagtatgaattgagacatagacagtagtgttaattgtaagatgtagttagtttgatctggagaatgtaacgtaattttagaaatttagagaacaatattgtagagaatgtaacttagggcgtagtacagaaatgcaaggttaacgcagttattgttttcatcaggcacaatgtcaagtaaggtcacatttcagatagttcacggtgaaggaaatattagatttggtccagatggtgttgatctgtcagattttgtaatgacatctaagggcatcgataggcctgcggagagaacatttcagtcaatttatagttggttgttgagaggatttagaatagaccaagaagtctacacaatgtcagtatcagttgtagtgagtcgtgcaacagaaggttatttttgggaactaatgccgatggacagcactgatgcttggagacggtatgtggaaatggcttttgaacggtcatggcccctcgttatatttgtgttggtacaagagaaagatataaatgtttcaatgcaaaccgaagatgtagagggtcctatcaatgcaggggatgttgttggaccatcgatgcaaaatgaggaaaatcaaccaagggaggagcaggccatgggcatggcggatgagggggagagagtcggtataattgttgatgaaatggagagggaagattcggataatgaggaagcggacgacgacgcatcatccgatgaggaaggtgatgtaatggccactgattgggcaaatgaggacttctctggactttactttttattactactgttaaatacttgtacgaaactgatggtccttgtccagcaggattcgcagccgggatcttcggtactggggcctcttcgtctcacgccggtaggactggtcctactagccagttctacgacgacgacttgcacggtgcacaccaccacgacgtactaggctcctctcagcttggaggagctccagaggcgcacactcaggagcagccagaggtcacacctgtacaggcaggacgggttggccgtgccgtacccccggaccgactcacgtactcccaggggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacatagttcttttcattcatatggtgctagaacaacttatgctcacgacaacacactttcggcgcttcacggtagtgtcagatccagtagcgcgcacagtccacaacagcacacatgaaaagcggcagctcgagttatcactatcaactttcggcgctgcctgttgacataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactagcacaccacacacgaaaatggaagcctattcattggtaatacgtaatctagatttaagattatgtagaacattcttcactacaattttacattttggcagcaaaccaaatatgatcaaatgcaattttaccttaccaaatatttggtagtgccaaaacttgcttatattttggcacaaacaaaatatttgtacggtaacaatccaaatatgccctaaaaataataaaattgtattttaccagtcttggagattttaatcttgtataattttcaatataaaaagatttgataactattgatatttattaaaaaatatagagcacactataaaatcgccctcccccagggcggcaagggggccgcctgcaaaattccatgccccctcgccgcccatttgcaggcggccccccgcacagtataaaatcgccctagcggagggcggcaagggggccgcctgcaaatttcgttgacggccgtcgcccgagagcgaacggccggctgccacgtcattttcgcctcgccctcccagagggcggtaggcgactactcccgtcaattttcaaaatggaaaattatttttgtaaaacttttaataaaaaaaattataaataaaaaaaattcctaccgaaaacgggtggaagcgtcggggattagtaccacctcgcggagtcgaggaggtgcgggtgggagagatggctataagtagagagccccgtgcactattgctccatacttacctggacggggtcaacgggcgatcaagaaggctcgtggcctaggccaatggcccacattgcacttggtgggcgcgttagcttaccatctccccaagtgggagagtggacgtcataatttgtggtagagggggtacgcgtccgcgcggcccctgccaactctcttagattaaatttcggtccttgctattgttggttaagtttaagttctttattgcattcgtatgctttcgcgcggcctctaccaattctcttaaattaaattttggttcttgctactgttggttttggttcttgattgcataggctccttgtatcctgaattttcggttttggtccgttgggtttacgagccatgtcaatctcttaaattaaaattttggatttgggtttgcgctggtaagttttgcatctatcattaaacattgttatttttcgaagagaaggtccaaatcaagcagagttcattacaggaaacaaaacaaaacgaacacagcaaccacttcaggaaaactggggaataccagctaaactaggacagcactagaacacacacaaaaaccaacttctcaaacaaccacttaaactacttctggggataccagctaactaggacagcactagaataccaggcaccagctaacgagggcggaaatactcttcatcctttggagaacgtgattggccaggcttcagttaaaggcttggtggtgtttaccttagctgaagcactgctccccgtccgacaaaccagcgataatcataaagggaagacaattggcatgaaaggaaggctgaaggaacaaggtgctcctgggaacttgaatcatcagcgtcgttgctcaatgtcgttggagctttcaacccagaaactggtagaggagcaatcggactcgtggttagaaattcagatggacaagttctcctgtcatcttggaaattcctaaggcgttgtgtagaggcagaagaagcagagctcctggcttgcacggacaaatcatctacttcctccatttcatattataaaactttctagcattgtccacatttatatagatgttaatgaatttagacatatatgtgtaagatgatgccctctaaaagatggcaaacgagaattcaagtacgatgctgccctgatgtttcattgacaaaagaataggatactagtgtctactcctttctgaatcacgacacagcgagtcatgaatttaatacatcagatacccgtaaattttcatggaaaatgctatgcataacaatcaagtttagcctgcatatgttttcttggaaatatatgccagatatagttatctgaagaaaataaaaagtaacaaataaatggcttctctaatgtaagcccaacacaatcaaacccgagaccattaccggtccaacccaacagattacacctgtctaggattgcaacggcctgtaatacaaggtccattacaaaccgccttattttggcagcccaagctagcacaaaacctctcagaagtcagaacacgagatggaaaccgaaaagaactctgcgttgctccacattagtaccacctcgaaagtttgcgtcgattgcctggtgctctttcggtataagtacagaaccccgagatccgttgctccatacttacctggacggggtcaacgggcgatcaggaaggctcgtggcctaggccaatggcccacattgcacttggtgggcgcgttggcttaccatctccccaagtgggagagtggacgtcataatttgtggtggagggggtacgcgttcgcgcggcccttgccaattttcaaaattaaattttggtcctttgctagcgtttgcttgcaattggaaaactaaacagtccctgctttcgttttttgtcgcttcttgaactcactagaagtaataaatttatgaaaaatttgctcaatttttagaaaaattgtggtgtttagattaagttttctaaaaatatgtggtggtttttgtaatgtggatatgaatagattatgaacgattaaagtaattgttttatttctcgcgcgagcacgaggtgaggctcgattcactttcactataatcgcggccatggcggcgaaggttgggttgttcccctcgtcgtcactcaccaccagcccccacgccatcgcggctgcgccgaccaacgctccccgcccacgcggggctcgtggattggcgtctccaggtcgatccgcggcggcgatggacgccttccacgtgtcgtcgcaggccgccgagccgctcctccgcaccaccggcgccgccgccgccgcggcggcggcggcgacggcgacctccaaccccaggctccgcgtgcggaatcctgaccctaatcctccgcgccctaattatagccgtcgtcgcttcttctatcctggggcaaggtgctggtagtggtcgtggtttttgacgacatggaggtggatgtgcaggtgcggacacatgcgcagggcggcgaggcgccctccagcggtggcgccggagatggcgcggccgggaaggagttctcgtggtcgtccatcatccttccgtaagatagctcccctctccatctctttggtcagtgacatttggggataaaatcggacagtgataggtgataagaggaatgcatttctagtttggttctagcttcccaatgttgagggatagcattggcacctaatttcaattcaagggagagagaatgctttttaactgttcagtagatattgcttgtttcatcgtgttgatgagaacaatcatattaaattagggcagactgtacaatgcattgtaagtaagatgcaatataattctgcactgtcttctcttctctgctttaatgctagataagaacatattataattcaggagatgataggtttgcatagtattttgattacatactgaagacaaatgttatagttggatgtaaaccattggtggttattatattaatacggcttggaatatggataaaaaaacaaaagcataaaggggaaattggaaaatatatcaagctttaactacttgtgggtcaatgtttggaacctaggttcttgttccctgcattgggaggactcctttttggttatgacattggcgcaacctctggagcatgcatatctctgcaagttagtccctattttggttggctatgcaatctgttatagttgtcatgtattgattcactctaatggtgtttattcctccagtctgctgaactcagtggaaccacttggttcagcctgtcatctatacagctagggctcgtggtaattttttagatattttcatgcttaccaaactttttgttttcccaatcaagaacactactgtctttaatgtgattttttgtcatccaatttaggcaagcggttcactctatggtgctcttggtggttcgcttcttgcatatcgcgttgccgattttctaggtgattcgaaaaaaaatgtttttcgttttttttccttactgtataatctttagcaagaaaattgactgctagtctactactaccatccttggttcaggaagaagaatagaactggtcacagctgcagctttatatatttctggtgctctggtcactggatttgcacctgattttgtacttctgatcataggccgtctcctctatggtatcggtattggtttggtgagtaactctgaggcaaccttttttctccccaaaatgcaatgccactgttattgaacaagtaaaagtataaattcatgtagatgaatgtcagaggaccaatagttatatatctttttgagttgggtagcacatgaaaactttaagagaggaaactgaactgcataatctgtatacttggactgcaaatgactcattacttccagatttagtaacagtgtagcttgatgaccacattttggtggaattaattataaaataagtggaaaggaaccatgaacgcgtttgatccttccagatatggcaatattgtgaatgcttgtagttgaaatccatcatttgggacaaggtctttccatatgaactttggacattgttgttactcagtgttgcggcagatatctatacctaattaaaaaaatacataaagcttccggtaaaaatttcgtccgtcaaaacccatgtccgagagactcttttatccccgcacaattagcgaagtcctgtttctgttaaccaaattaacaaatttaagttagaagcccaaacacggtcacgccaaaaagaaggcctgacctgggccttgaagaaggcccgacctggtttgtggcgttggggaaaaagatgaggaaaacagcctaagccagctggtaaaaccatggaaaaaatttgtatataccaaaaataatgaacaccacgtataagtggaagagatatagaaaataataccatctaacataaattattacaataatgggataattttactaatcagacccaataaatttaaccaaacattatcaacacagacatcaaataatctttacacgcatatttctcggtggtctcagctcgggttgggggaggaagaattactaataaaagatacacaaggattccgcatatttcttttcgtacgctgtccataccaatccactgcacacgaatgatggccagccggcgagcttccgagcttcccctgacctttttatcccaagttttgtgaatcactccgattttgagggaaacggaaagaaaatatcgtgtgggtaaaaaaacctcaactaattttgggagatcgagaaagatttggccggatttgatatgatgatcagcttcggtattgtatagatatgggactgtctcccggaggttgaagatgctactaaagcgcgtgggtttggcttggcaacgagagaagatatatgactatgctatctgagcctgtggctccatttgtgggctgggtcgaagagagccgagccgagcagagatatatagaggcagcagactgagctggggcttataaggaaggaatgattttagtgaaccttttgcattataatgtatagtgatttcaatattttaatttattgttcaacttctaatagatgttgtataaaaaaacgcttttacccgttgcaacgcacgggcattttttctagttaatactacaaacagtatatttgtttactgccaactaaaaaaatccgcaaatatctaaactgccgatgctttgttagaaaggtgttaataataactgaagaggaacataaatgcaaatgaacatattcatatcaaactaaaggtttggagataatgaatcattgttgtgtccatgtatattacatcatggggttatgtaacatcactgaatcaccatgctttgtgccaggcgatgcacggtgcacctctttatattgcagagacttctccttcgcgaatacgtgggacattgatatctttaaaggagttgtttattgtattaggaatactggtatatctctcttccaactgctacacacttttaagtatacccatctatcccctgctgactactccctctgtccccctcccccccc

SEQ ID NO: 42203 - DNA, 1526 bp, Oryza sativa
accaagatggcttcttctcagggcagttcaaggaaaggcgtcagtggaagataacaaaaagaaggcaattcaggcattgagatcactgagggggcgctttaggagtgacagggtcttagcagatgagattgatgatacccttctctctattaaggctgcttatgcagaacaagaatctgaagggaacatttggaagatgtttgagggagctagcttgaaggcactcatcattggaggaggactggttctcttccagcaggttttgtcctcatcagcccacttggaagcaacacatctaaatatgaaatctgaccgtgctttgatcatccttttaaatttgaaattatgtgccctaagttcagtgaaagttattatgtccaagttgaggtagaaaaagaagaaagataatgacctgtctattcatttcatcctgctttggtcatttcttgattttttaatagttgactaatgttacttctttgttatatggaactaaagcactgatattaattaaactattatttcagataacaggccagccaagtgttctatactatgcaacttccattcttcaggtacctctgagtttcttttcatacaaggacagacagaataagacttagttctccatatggctgtgtgccctgatacatacaattaaatccattctatcttcaacagactgctgggtttgcagctgcatctgatgctgccaaagtatcaattttgattgggttgttcaaggtaattctatgaagctaaattatttttataatctagtatatatatagggagaattagatatctattttgttatccagatggtaggtggaaaggtatagagcttacacttttttttgaacctctgtgtaatatttctattatttgcagttgttgatgacaggtgttgcagtatttaaagttgacgatcttggaaggcgtccactacttataggaggcattggtggaatagtgagtaattcttacagacttgtttaagttctatggatgcatggaaagtgtcattttcatcaccttggcacctccccagttatttgtactcattgatagtcttgcttgatgtggatactaagaaactggatgcttaaccaagttttgatcaaacatgttctgaataaattatgcttatgctttctattccctggaaatgcaggctgtttcactgttcttattagcagcttactacaagattctgaacagcttcccttttgtcgctgttggtgctttacttctgtatgtcggttcttaccaggtcggtgcctttactttctgtagaaacggtctatgactagtgcaagaaatttatgttgtccttgtgtttgcaggtatcgtttggtccaataagttggctaatggtttctgagatcttcccactccgaacaagaggacgtgggatcagccttgcagtacttacaaatttcggctcaaatgcactggtgacatttgccttttcacccttgcaggtacgttcacccagattgttgtcacctcacatatatatttat

SEQ ID NO: 42204 - DNA, 2319 bp, Oryza sativa
atttatgtgattaatatagtcgtacatgtagtattttgtacatgtaaattcttgtttggactaaaaatattctagagaaatccaaaaaagctgttcttgaagtgctattttttttggtcaacactggactggtgctatttttttttttgccagtgtaacacagttaattaaattattactagcgagacttaatgtggtactccgtagcagaagagtacgcgtatgaagtatgaactaactcaacatcgctgtaaatggggacatgaagttggaacctgtcgctcaggaaacgttaatgtctatcgctataaacccattaagcatttgcctctagactaacttaacattggtggaccaagcttatatcacgatcaacgaatttaataatcaaacaaaaatgctgaaaatataacatcttttgcccatattagaattgaactcagctgtagaatttttgacgtttgttacgtgacaagacgatttgcctgacgtgcttggtatggcgccctggttgtaatattattgtttatgaagttctttccttcggtccttttagctcaatacggtgtttcttttttatttctcttccttgatcatgaagcctaactcaatcgtctaaccaatcagtgattattcccaaaacaagagttgagctttcatggttcactgatgctttgccatcatgatggtaacatcatggcaagcaagaatccaatcattctagagggcagtagacgagctgcaacatcaaacgactgaccaaatgcagcaagccgaacaaaattgccctgctcacacaatggtagaagaaccactcattcagaatccaatcaaagcttggcctgttggaacgatggcatgaaaaatgcaaccctccgatgcgaacgtggccgttacttaggctgaagggcacacgtgtaaaatgttttttctcccacagtgaaatttgttcatagtgtagcttttttttttaatttaagcaactttattagagaaagacagagttaaggagctaaaccctagtacatcgcagaaggatataacacaaacaaagagaccatctctaataaggtagaggctaaccaatctaagaaagcaaacttccagatgaaactaaatagcagtagaggaccagatcgacggagctcagcagccgctacgaccggatccttaggcctccgtagacatgcaccctgcttgatagactggattaaacaaatcttataacttgtcattctctgatttttaagggatttgaggagcatcacatcttgtaggttcacatgtcagcgatccacgtcaattttttctgacgtggcaagctaggcctgacgagtgcttgcacacttgcaagactcgagtcatgccgtcgtcttcttctctgcaggacagccaaatctgaaactctgagaccagcaacgaggttgtttagactgaccgatcgatcgacgggagctttgggttccctgcaggaaggacaggaccggtgcaaccaccgggataaattccgtcttctgcaactctgccgttctcaactccgcacgcgttccttgaccagccatggctgcttcttcgctgtcgccgcaatgggcctcacgtgtacctgtccatcatcgatctatcagttcactacccccatttccttcatgatttcatctctccccgtgaataatccgtgatccgatcagcttccaacgccccggatttgatcctgtgtgcaggagatatactctttaaaaatactaggtatagtagattcatttactttcagaaacttcagatttcttggggtaaaaaaagaacaccacagatccagtaggcgagtcatgcgagcacgtaaagtagagaattatcccaaggatcccagcgttgcacgttggcacatgtgaagaatccatgctttccaggcatgaaaatctcgcgaatcaaacaaaacaaatcattttcaggacgtgaaattctttaaaacattcgcgtttagcagaagatacgatcacatagtggagatggacttcgtctagttaggtggtgacaatgatatcactggtagagaaaccatctttggtcggtcgacccatatccacaatagtcccggttccattaaaaaccgggactaaaaatgatttttagtcctggttaataagaggaagatctttagtcccggttgttgttaccaaccgggactaaaaatcatctttactcccggttggtaactccaaccgggacaaaagttcatttttagtcccggttgattccatgtcaggctgtgtcagggccctatgatctttagtctcggttagtaacaccaaccgggactaa

SEQ ID NO: 42205 - DNA, 44359 bp, Oryza sativa
cgctggccggccggcgcggatgggaggaggggaggcggcagtggccgccggccggattttttttcttttttttttgagatgtgaatctgtgatgtatttttgtgtgagatgtgaatctgtgatgaatttttagaaccctgtgatgtaatttttttaagagtttgtgatgtatttggagatgatttgtttgaggatttggagatgttctgtaatatgtgatgatttggatatgagaggggatggtgtgaaatcaatattcaatattaaaagcagaaaaaaaaagaaaaaatatctttagtcccggttggtgttatcaaccggaactaaagattctcccatctttagtcccggttggtaacatcaaccgggactaaagattgatttttagtcccggttatttgaaccgggactaaagatagtcccggattcgtagtcccggttggaaaaccgggactaaaaagcatttctccactagtgtatggatgcattcaagaacaagaggaggtgaaacgtgaaatgcattatatccccatcagctcctggctcatttggatatctaccactaaccggcaagaattgccatgaaaatcaccgggactccaggagactgcagcctcgaggttccgacagttatagcttctgtaagaatctttagagaagtcagattaaaaagttctaaaaaaagtcagataaaaaaataatcttaactgaagtcaaacagtttagaattttatctaagaatatatagttatagaattaaaaaagtgggagccctattggttgccctaataaaccaaagtaaaagctaaaatttttattttaaaaaataattttgatgttgattttaatatatgttcaacgtagttttctatattaatttttgagtgaagtacatgggcggtccctaaacttgtgccagtgtgtcatctagatctctgaactcctaaaatgcatttttagatccctgaacttgctatgtgtgttatataggtccaaacaggttctaacccactcgatgtgctgacgtggcaatgccacggtgacgcctacgtgtcagtggaatccacatgtcaagcatatataaaaaataaaattaaaaaccatattttctcctattaggtagacagaaaaaaagataaaaattttaaggtagagagaggagaaaatatatttttctaattatattttttttctatgtgactgatacgtgggtccaactaacacgtatgaactatcgtggcatgccacatcagcgcatggaaggggttggagctcgtttggacttgtatgacaccccaaaacaagttcaaggatccgaaaatgcattttgagagtttagggacctagatgacacacccacacaagtttagagaccgctcgtgcacttcactcttgatttttaaatcactaagaacatatatataaaagttttacctataaattaatttttatactcttttactagtaataagttaatgtgggcaaaggacatgaaatagaatagtccgtagatattgacgggtgacacgggcttatttattacagcgttcttgctccatctctgtgtctacgtttgggtacgtgtagccactagccatggacgatcgatatatcacttggacagtgaggcatggcactgtttgcacacgctgcgcacgtgccagcgtactcgactgccggtggtcggcgtctacgaaacgacgcaaacaggacacccaagtggtcctcgccgtagacgaaacccagcaaacgtttttttttcctttcctccgtacctgagttaatttttctcttctttttactttttaatttttataactagtactagtttattgcccactgtttgcttgcagctctgtactctatccgtcctgaaatgaacctggacattcattcgtccagattcaaaccctagaaattatctgtttttttcgatggagggggtaggtgacaactagctaggataggttgaggataggcctggcttagagcaaatttaatagtatagccaactactagctctaattcatctatagccaatctaatagctcatatatacaatagttacatattacactattaatacctggtcccacctgtcatacacacaatgcgtcttggagtccgtgctacagctggctacaaatctgtagctcgctgctcttctctctcattatttatctccttaaaatatgtttgtagctggcttatagcctgctattgtacctgctcttagggcgtttacaatgcatctttggaatttttttagtttctaatttttttttccaaaaatgtcacatgtaaaatctttgacacatgcatggcgtattaaatatagataaaaataaaaactaattgcacaatttgcatgaaaatcgcgagacgaatcttttgagcataattagtccatgattagccataaaatgctacaggaactcacatgtgctaatggcggcttaattagacacaaaagattcgtctcgcgattttcaagcgagttatgaaattaattttttcattcgagtccgaaaaccctttccgatatccggtcaaatatccgatgtgacacccaaaaaatttctttttgtgaaagacccttatgctctctcattttttgcaagcacatttttaaattgataaatgatgttctcttctaaagataagataattactttataaaatcatattaatatatttatttagttttttaagctaatatttaattaatcatacactaatctgttgctttgtttcacatggtaggaagaaggttctcaacagtcaaccccttttaaaaaaacacacccaagtactccagcacatacacttcacattctaaaaaatatatctaatacgatattgaaatttatagtactcctattaagatgtattatactcgctctatctcataagggcttttgcctggatgtgaacaatgaatctggacggtttttctgtccaactgtctagattcattgtattatctattcagattcattgtactagaatgtgtcacattcaatccaaaatcattatatttagagatagaggaagtactacctctatcccaaaatatactccctccgtttcaggttataagtcgtttgactttggttaaagttgaactattttaagttcgaccaaatttatacacaaatatagtaatatttacattactaaattagttttattaaattgataattaaatatatttttataataaaattatcttgggtcgaaaatattactattttttctataaatttggtcaaactgaagcagtttgactttgaccaaagtcaaaacgacttataacctgaaacgaagagagtagctatttctagcacaacatcttatcccaaaatgaaactatttcttcatctacctcctctcaaccaatcacaaccattctctttcacctaatttatcttttcaatcaatcacacaatttcttcaatcattcttacttacttccttaatacccgtgccaaccttaaaattatttatattttggatggaggaaatattctcttcgtcccattttaagtgcaactataagtttttgtgcccaactttaatcaactatcttatttaaaaattttctataattagtatttttattgttgtgagatgataaaatatggacagtactttactactttatatgtgacttatgtcttttaaatttttcaaaaaaatttcaaataaaactgacggtcaaaattgtacacgaaaaatcatggctgcaattaaaataagggagtatcttatattagatttgtctatttgaaaacaaaaaagatcacgaatagtatgcgaagccccgatcgatctcaattggctgtccttgttctgtctgcttctcatttctgaagggaaggaaaagaaaaaacaagtggaaaaggggcccagagtgtgcacgcactccctgcaggctctagcacaagcttagctagcaacgtgaaatctttgtaggcagttgaagcttatatgtgctgagctcctaccctccaatgccgtccatctccatgtccctctcgccgacgtcgccgtgcacctcgcatcgtcgccgtcaccgtcgccgacgaccagaccagcaacagtgccagcgacggcggctgctgcccaactccaacaactaaactgttcaactccttcagctactacttcacttgggttaatttgtacattgctctctgccatggcggcgccggcagccgttcttgccgtgctccggtggcggcagcggcggtggctggttgagctggtcgctctcctgcttcttcttgctcgaggtggcgctgccgcggttgaccaattcttgtttcccggcttctccggcgacggcgtggccaccagcggcgcggccgccgtcacctccaccggtctactgcagctcaccaacgagacgaaggaggtgttcggccatggcttctaccccaagccggtcagcttgagaaacgcctccaccggcgcggcggcctccttctccaccaccttcgtgttcgccatcgtgcccaagtatcccgacgcgcatggccacggcctcgccttcgcgctggcgccgtcggtggccgtccccggcgccgtcgccggcaagtacctggggctcttcaacacgtccgacagcacgggccagatcaagaacaagatcgtcgccgtcgagctcgacacggcgcgggacgacgagttcgccgacatcgacgacaaccacgtcggcatcgacgacaacagcctgaaatccgtgaactccagcccggcggggtaccacgacgccgccaccggcggcaagctcgccagcgtcaacctgatcggcggcgagcccctgcaggtgtggatcgagtacgacggcgacagcgcgtggctcgaggtgacggtgtcgccggccggcatgctcaggccggccgccccgctggtgtcttgcaccgtcaacctgtcgtccgccgtggccggcgacacgtacgtcgggttctcggcggcgaacggcgccgccgcgagctcgcactacgtcctcggctggagcttccgcctcggcggcggcggccgcgcgcaggacctcgacctcgccaagctcccgcggctcccgtcgccgagcaaacccaagaagacgttgccgccgctgatcatcttgacaattctcctcctctccgtcgtgatcctgctcctggcggcggcggccgtggcggcgctcgtggtgcgaagccggcggtacgccgaggaagaggaggaatgggagatcgagtacgggccacacaggatcagctacaaggacctccacggcgcgaccaaggggttccgcgacgtcatcggcgccggcggcttcggcagcgtgtaccacggcgtgctgccgaggtccggcgtggaggtcgccgtgaagaaggtgtcgcacgactcgcggcaggggctgcgggagttcgtgtcggagatcgccagcatgagccggctgcgccaccgcaacctggtgcagctgctcggctactgccggcgccgcggcgagctggtgctcgtctacgactacatggcgaacggcagcctcgacaagcacctgttcgccggcggcgagcggccggcgctgagctgggagaagcgcggcaagatcgtccgggacgtcgccgccgggctgctgtacctgcacgaggggtgggagcaggtggtggtgcaccgtgacatcaaggccagcaacgtgctcctcgacgccgacatgaacggcaagctcagcgacttcggcctcgcccggctctacgaccacggcgctaacccgcagacgacgcgcatcgtcggcacgctcggctacctcgcgccggagctgagcaagaccggcaaggccaccacgagcaccgacgtcttcgccttcggcgccttcttgctcgaggtggcgtgcggccggaggcccatggagttcaccgtcgacgacgactcgccggggctcgtcgagctcgtcctcgagcactggaaggccggcgagatcacggcggcgagggaccccaggatcggcgactgtgacgaggacgatctcgaggtcgtcctcaagctcgggcttctctgctcgcaccctgacccgcgccgccggccgagcatgaggcaggtggtgcagatcttggaaggcgccgcgccggcgccggagacgttgccggaggacctagaatgcggcgtggggcagttctacgacgagtcattcgacgagttcgtcaccggcttcccgtccacgtcggagatcaccacgtcgacgacgcagtccaccgacgagcagcagcggctggttggctgtgttcagttgagcactgccgattttctgaagacaacttaaaatgtaaaaatgtcagtgagcaaatacttgcagcattaggtgattgtttgggctttggatcttctggagttagtaacatagggatactgtcaatcattttcagatatgatcatatagaggttttgatcaaagattagtacagcattcagcttagaagttaccttgttgcagtttcagaagaatgtacacctgcaagaaggcaagaaccgtgtaagaaattttgcaagggaagaaaaaaaaatatggatcccctttttttttttgtagctgcatctttcttggggcagtttgctgttgagccagatcagaatattagccaatagactgatcactgatgtcgattctgtcatgcagaaaacatgcgatatataatatgacatattggcaccttgctcaaaaggaaccaaagatattgcagcctgcttctcatcatgggaaaaagacaatgaaaacctaaaaaaatgctgtcctaatgttctgcttttacaacaaaagatgaacatgacaaatattagcaaggtatcaaacaaaaagatgacaacaaatggagacagttcaggccatggttctagggattcttctgattcatacgagaactgaacgggctttcttgtgttccaaacagaggacattagattggttgccgaggaaaaaagaactacttgcaaaatgttgacaactgacaagcaatgccagattgtgtccatggctccatgcaacattagtttacatcctatccaagctaaaactagcatccctactacccaatcgtaatgactccacctataagcacaggtgacggctctcttcctcagagttattcatcatcctcctgagttccccgagaagcaccttggatcattttgtcatcaactcctgcgattaagttcagagcttttaatatcaaatttcaacattaacataagataaactggaagcaaggtaatgtataaggatttaccttcaatgaaggactcgaattcatcatcatcacttggacccattgatgtgatattgttgactggttggttaatctccgtccagtttgactgctctgcctggccagatataagtgcagatctatccacaacccaatcgtcgactatgtcaatgttgtcgactgagacaggatcaaatgctttggtcttgtgttgttgcctatgacagttattaatcagatcgctcaccatcatcaatcatttactagctaatgaaactcggtatatttaacataaggatttgattacctgtgttgtagccttagattgtactgaacaaatgtgagatgatgcattcgctggcgttcaaaaagattcattctttggtcatgaatttgttcgaaagaaatgtgtctccggtcacatcctttagcactgcaggtttgactgagaatgcgaactgctaaacgcgtcaaatttgggcaagctcctccatacgtataccaccattcagctgcaaaatagaatctataaggctcaccaaacaatttccgtaatcatatctaagtgtctaacaataacctatatctgggggaaattaattatgtctatcaaacgaaatagtaacacagctctagttttgtgaaaggtcggtgctgaaaatgcatttcatgtttttaggacaacataatttgtcaattgagtaagctagttcacaacggaaattgtatagtactaaccaggaggtaaagtgtgcctggctcggatagccatttgcctacgaaaatccccagctgcctcactccggtatacattgagctccttttggattttatcttggattttcacatcagaaaccaacctttctacgcagtctagcatacctgagaatatctcacttgatgttccacctcgaacaccatcgaaaaataatgggttcaggaaaaaaccagctaaatgaagtggtcgtggtgcatccttgttccatctccagtcaataatatcccagtaagccatgtagtcgttcttcctcaccagctctttcttgattgctgctttggcctgatacaatccagcgtaaacataccccatagatggcctcttattgctaccgactaacttaagaagatgcacaagtggttcggtgatgcgaaccactgcagcacacgaagaccaaaactgcaaattgccaataagattggtcacttcaaccccaccaggtttctttggcagcaagtagtgaatccattcatctgagctaatcatggcttccaaagaatcctttagattgtacatgttcttcagtgtgacaaagttcatagcagcacgagtttctgcaggaactagcagatctttcccatgaagatgccttttcatcaagttaaatgcaaatgcgctgttatagataaatcccgtaatgacctttgcattacatatgatctcattgattgcccccaccttactgaaatcttcaagcatcccatcgatgcactggaaagagcattgagaccagaacaatgtaggaaaagtttcgcatagcctctttcctgccaccgcatgaatctcagaattgtttgtgattacttggacaacatttttctcaccaacttcctcaaccacattcttcagcaactcatacagcggatctgacgacacgacaatgtcagttgcatcgactgacttcagaaacatagtaccttccgggcaatacacagagaagtttattaatgttctgcctctgtcagtagtccactcatcggccaacaatgtgcaccctgtccgggtccatgatcccttgtagaactccaactgagcagtcacttcatccagcgacttcttcaatatggaaccacggaagtcgtgatacgagaacgcctcaggcttccctcctgctgaggcaacagcttcaagcataggctgaaagtaaacggaatttactgcctccagtgacacaccagcgtcatacaagaacctcccaattgccatataaacctgctccttgttcgagccgggctggtcaaaatgcatcagttgcgatgcagccgaatcaaacgccacgaccatctgatgaaaaggctgggtcagaccagcaggagtagactgaagaggctgctgattctgatgagcaaggggcgccgtggaggcttgcctcgcagccaatttctttctcttcttgctaatactccccttcatctccctggtctccggtggtgtctcctcgagtggaacggagcccaagtcgagcacctcgttgagcgggatcatgtggatggggctctccatctcggcggcatcggccggagccggcggagaggcggaggcggcggcggcgggagccgagtgggtgattcgcctgatgccctcggccagcgattgcttccgtttcttcttcgccgcgacggcgtcgaggctgtggagcatcgtctcctgcacctcgcggggcaccttggggcagcagcacgcgttgccggggcggttcgcgaggtgctccttgaagcggtggatgccgccgccgaggaagtgcttgtggcagtagacgcacttgagcctcacgcgccccgccgacctcaccatctggcagtgcttccacgccgggtcgtgcttctgcgcgccgatcggcagcaccacctccggccccgccgccacctccgcctccgcctccgacgccatctccgccgcgagcaaccaccctctcctgcatcgcaatacccatcaccacacccacactgttactaccatttccccgccattgccgcaaaaattcctaccatatgagcccaaccaactgcgaattcacacggattttacaccaacaaacttccattgaaacggcacagcccactccgaatcaaaacctcaaaccatttccagagacagagccacataatctcgtatcagaaggtgattttcctctcgagcaataccccccaaaacccacaaacccaaaggaagatggggacacgacaccctctcgcgtcaaatcaaatccctagtaatccccgattagccgacgacgccatcgcagaaaataaaccgaccaaaaccaagcaaaccagggcgaaccagatatgaaggggagagagagtgagattggggagaggcgagactcacccggcttttttttcgtgaaggcgaagcggccgccaccaaatcggaggggaccggagacggagccggaggcgaagcggatgaggaggagaaaaaaccaggaggcgacgcgagagaaaccagaggagagagagagagtgtgtgtggtggttagcctgtgagtgggagtggagccggtccggtcggtccggtggcccgttatacgtggatcccgggggttggggaaccggcccagccggttttggcgcgggtttggtccgggttagggtgaggctctgggctcagacactggaatcgggagttgtgggccgtgaacactttctgggcccgaacgggaatgcaacttacgtgcagcccatatagcagcataattacacaagcactgcatattaattcattcatgtaagattcatcatcgaaatgtcaaaattaaacccattttggccgcacgaaatgacaacatacactgtgtaacaggatatcatcttttactcccaaaaatttcacaagtgcagaacacacccaagacaccacaaacatcttataaagaggctggatgccctgaacttgtgagctgtatcacctaaactaacaatatctgagctaccatcaccttctgaagacaagaatgggtacatcaaatacctgcacacagacaaccaagcaggttgcgatggctataggtatcatgcatccaagaacatttgagtataagaaataacttcgtaagaacaccaagtcagttgcagatggctatagacctatagttgcagcagtatgatatgctatgctatcggtatcaaatggctcagctgagcccaagttccttcttcagcttctccaaagcagcctctatctcagatacgctatcatcaaagctacttgtcgatgtattaacatcttgcttgtttttgcctccagactgtgtgtacggatcatttgcattgtcttccgcatcacttgagtcatcgatcttgagttcgttctccagaaactcaacaaattcttcaccaatggcctgattgaccagaatgtaatagaattaatgggagattaccaccaatgaccataggcatgattagaagttgcagtatttatgtactattgattagtgttcactcccaacagtagatgtttacaataatacagtggaaaagacaggtaaagaacttactgccaactcttcccacaagcttttaggtttctgttctgaattcagaccggcttcccagttctgaaattctgcttgaagatctctaaggaaatcccctgcagatccatgaccacagtataatgtcaaataatggaacatttttagttcaactatctagtaactacacaccctagagttccatttatctactgaagtttcaaaatacaaggattatgatgtgatctaatctaccagttgtttcttagcagaaaggatctctcttgaaacttcattttactcatcactagcacgaaattcctaaccacagaaaccataatatagctcactaatgcagaagagaaggtattccagtaccaaagccatagaatggctcttcttcatcagctgaagtagtgctgctcttcccgtatgtcctggacgaataatatgtgttgctgctagtgctcgcgtacttggaccggctctctgaattcatgagcgtgttgtacgcatgcttgatccgcagaaatttctcttgcgcgttgggctacgttgacacaacatcaaacacaaataatcagtgaaacgcaaggaggtgacaaggtttgggggcggctgtggcacgcacctccttgttgacgtccgggtggaacttgagagcaagccgccggtacgcgcgcttgatctcttcgggcggcgccgacggaggcacgccgagcacgtcgtacggggactccccccggccgcctctgcccgcgccggcgcgggccctcacgctcgcacgccgccggcggcgaggcggcgcgggcgcaggagaggagaggcgcgtggaggggccatcgcgggaggaagctacggcgcggagaacgagaggcgacggcggagcagcgaagcggcggcgtgaggagcggagaggaagagggggatgcggagtggcggcctgaagctgcagcgccatggcgcaacgcaaccggagtccggaggtggatggggttgaaagaaaaaattgcttttgaatggctcgcagcgagccttcaactggagcagacagcatcaccaccgttcagatcacgcggccctggtggagcagtgaggatcggacggccatccttagctcacaataaataggcaaagccatgtgagaactgattaatccccagtcagccagtctacagattaccgacacatattatacaaagattgaattcacagagactcaaaatcaaatcgtggaagagataagtatctttcatcttcgtattttaatagcatcacagattacagatatccaaaaacctcaatacatccaagagctcaggacaggattaaaatgcagagaatttcagcagattgcaaatatgtaggatctttttaaggttaagtctagagaattgcataagcgaaaaactaagcaatcccaacaagtctaggaagacggtccagggcctagcagcaatggtggatccttcttggcgctctcagactctgaatcttctttgggaggtggccttgatgctgcccaagcgcgaagcggcggctcaaacatgctgccaacgacatccggtggtggctgttgaggtgcatcctctccaggaagcacaacaagacccttctccctgagagacgacggctcgttgtaacactccttccagagggagtccacaagctgtcgctcctcacgatgtgcggagagatcgtcggcatccattgtgctgatgccttcgattcggctcttaaggacatctttcagcttgtcttggtcaggtagcacgtttccagcaccggatgtattgtcccgcgccagctcgagaagaccacctaaggcagcctcccggactccagaatcatcactcgatgccaggtgcatcatcagctttggaagaccaagctctgtagcaacactcctatcagccttgttgtcgtgcagtaggtactgtaggagatggagagctttcctggaattaataaagcagaaatgttatgaaaattgcaggtttgcattgcattgtttaactgcagcaaaaaataagtcatgtgaatgagatcaaaaaaaaaatcagtactacaggtaggcgcagccaaatagttacttcacttattggaaaaatgttgtgggctaagtttagaagtaaatatgtgctaggctatgctatcatatatggctaagctatcaaggccacgcatagtcctattgttcaacaagtataaataccatgaagaaagaacatagtgcaatgttagtgtcctactagctcccctgattatcatacaacatacctctgaagtctagcatcatcagaaccaagagcgtctctcagtgcagagtagccatttcccaggcggaatgcagcaactcctggctggttatgacgaattagagctgcaagacagtagtagaaacctctagttagcatatgtaattgaagcaattatgttctaggtcatggcaaagcaccaggtttattacagaagcaaatgacttacatgatattgctccaagagcttttgtgcgtgaattcgtgcttgcatcggaactgaagtttgtcaacagtggctccaggccattagattccatgacaagttgctggctcttggggttattttgcacaatcgtgctcacaacctctgcagcctttgctctgatgccagcatgtgaatttttcaagtaaccaagtaggggatctaatccaccaatagagtgcagatctggtggggtaatgcaatcatgttaaaattctttgcagtcaagagaataacatctacaaatgcagaagtacagtaaccatgattcttaccatttgccatgtcaatggattcaacatgctcctgtaactcatccaacatatctgaaaacaaagtaataattcattgatcagtgaaactgagaaaatctatcaatcccattctagggagggttttatatgttaatgttgaactgttaaggataatatgaaatgaaaagtgaaaactgtaggaaataggcaaaacaaaaacggaattcataattgcattgtccctaaaggaaccttacgtgtgagaatcagccactacaaatttacgttactagttatgtgtacgccagcccccacaataagcatatctaatgcacaataatagaaatatgattacttgcagatgctaccaaaaaaaatacttaacaaaaattactagccatgattttgtaaactttcttcagctagtgtttccgcactcctacaatcccaaaaattctacaagttgtataaatatgaaggaaatgctacaaggtggccaataaataatgaagagtgctgagcgtatatgaaattcattgttcacgtctacaacaagcaggtaattttagaaaatgaaaacactcaaaatgataccttcgatgttctctggagtcacaccttgagactgtagtacatcatctggagttttcatcacttgggtgatctccttcatcctcttaacaacatccattgtattagcttgcattgcctccataaaccatttcttgtcctcctcactgcaacccaaacaaatcatgataacagtgaacaatatgaacatgttttggcatgccacagatcgattgcacattccaaccactgcacataggtatcatttgcgcaaatttctgacatgacagctaacatgtcagtgttaataaaggagtaatttagcaggaaatatgagatgattcatcataatttaacgagcgaatttgcacatgaattagcagtctacaagtgatattgtgctagcgcatgtatacctgcagactacagtagaacaaacaccctatctcaaacctaaactaaactaaacacgcctaattccagagtacctagaagcacatcgatctagcgccccccgccagaacaaccccacagcttaacgcagccccttactcgaactgaaaggagatctcgctcgagcgggagcagcatacctgagcgagcgcggcttggcggtgccgtcgccatgggcgaggctccacttgagcaggccgttccagtcgggccctcctccgtccttggccatctcctcctctaccaactccggcgagggttcacggcgagacagttggttcaggcgtcggtgcgcggcggcgggaaaagacgaagcagcacaagcctcctcctcttcctcgccctcgtcctcccccttttatgggagggagaggtctcctcctctcgtcagtcgaggcgtcgtcgagagagacgggggacgcggcggcggaggagtccggagtgttcctgaacctacgcttcgcctcctcaggtggaaaaggcgtcttgggccgggccgtcttttggttccccacgtcgtcattgggcccacctagtcagatcctttctttggtgggcccggattacgaaaaggaaataagttcatcaaaggtcccttagcttatcaacgaatcatatttttgtccttcaaccgaaaactagatacaacaagtcccttaattgtcaaaaccggtggtcccatggcggtttgaacaacgatttaagctgacgtgacgtctacatggcaaatttgattcggtcttcatttaatgtggcggtcacgtgacactggaagcaaaaatatgataaataattttattttacaattgtggggcccacatgtcggtaagacaaatgataaaaattagtgatccccgttctcctctctatctccagcgacacctcattccccttctcccccttttcactggccgcttcgtcctcgactacttctttctagctgtggcaccggctgctacgagaaggcggcggtgtggaggcttcaacgaccagtcggaagccatgatggcctcgaggtcggtggccatggtgcgctcggccctgaggatggggtcggcagcagggatgaaaattagttggaaaaagtacaccgaaggtcccttaacttgtcatcgagttacaaaatcgtccctcgaccacaaaaccagataccggacgttccctcaactaacaaaaccgttcactttagatcctcctatgattttgacccgttcacttcagatcctcctgtgattttgaccctggttttgtcctacatgacggcttagtcagcgttgaacccaggtgggccccatatgtcagcattaccacatcagccttctctctcttttcttctcttctctcccatcctcatctctctctctctccgttctctgcggcaatgcgaggcgggagaggaggaggccgtcggcgaccggcgacctgcagccggagaccggcgacgcagcgacgggcgacgcggcggcgggggaaggggcggcgcgcgggcggccgggagaggcgcggcgcgcgggtggcaggggaaggagcggcacgcgggctcccccgccggccaccacccatgaggcccacgaggcggcggcgggggacgagctgcgggcgggcggcgggagaggaggagcacgaggcaacctcctcgtgaaatacatactctccatcacgcgtgacatacgtactctgcatctgattctgtacatgatggggtagcaaaataactagctctgaaaattttgttcagaacatgtagtggtgcttgtggtcgatcttggtgttgcttctccggcggtggtgggaagagctagagatagaagaagcagtagggtcggggaagccgatgtcgtggacggcgccaacggtgttgaagaagaggcgcttgttgagctcctccaccagcgtcctgtgcagcagctggctccgcatgtccaccatcgacctgttccgactcatcctcccccgccgctgctcctcctctccgccaccctctcgctgccgcggccgtccggcgtgccctcctcctccgtcttcagatgcagaggctggccctctctcgccggccgcgcgccgccccttcccgccgcccgcccgcagctcgtcccccgccgccgcctcgtgggccgcggccggcgggggagcccgcgcgccgccccttccctcgccgccacgtctcccgtcgccggccgtcggtcggcgacgccctcctcctctcccgtctcgcattgctgtagagaacggagagagagagatgaggatgggagagaagagaggaaaagagagaaggttgatgtggcaaatgctgacatgtgggtcccacgttgacttagccgccatgtaagataaaaccagggtcaaaaccaccggacaaccgaacaacctaaagtgaacggttttagttgagggatgtccggtatttttgcggttgggggacgattttgtaactcgatgacaagttgagggaccttcggtgtgattttttcaagttagtttcggcgtaaagttaagggttctcaaatgaaccaattccttacgaaaacaataggcccattattgagttagtacattgaggcccaaatttgtagtgaacatctttatgggctgatcaatcgattgttcgcgaccttttggagtcttttggagttttgggcaaggacgcgcgctgggcgctgctggctgtggcacctgggacgttcgtgaaacctgcacgaaagcagctcgccgctcaacgcttttgatgcgatttcgacacgaaaacaacgaagcgtcgggagaaatcggcacgtcccatagtttaagcagatgaactagcgaaccatagaatcgaagatgccgcactttgcagttccgtttcatacaacatcacatagcagaaggtagtgttagcacaagtcacatttcagaagttcaggaacatttttttcccattttctgaacttggaataacatgtacatagatacatagggtttttttccccctgctaaattaacaggatttcacacgcagggcggtagatagatacagctacttcccatcacaaaagcagaacagcaaatgcacatccatcttgctccacaaaaaaaaccaccaaacaagatgcaactgcagagttagcagcaatccctacacaaaaggctaaagctgtactagtaacactactataatgtaggagtagcagcaaccaacacactgtgcgtgctgctgcacggagactgggcgcagcagcactacgcgcagtggacgcctgctcgggcgggcgagcacgaagagcgactcgaggtccggcggctggaagtacccgcccttgggcggctcccgccgctccttccccagctccggcagcgccaccggcctcttcctcggcggcgccgggcactgcggcggcaccaccgggatgcggcactcctccctcctcggcgtctcccacccctgcagctcctcctcctccatcgccgccgccacctcctctccgtgccccatctccacctccattgcctctctcgatcgctactcctaagcaaagatttgaaatggcgaagctatgcaagcaaagcaagcaaccacgcttaagctaatatagaagtgagtgccaccgcggtgggtggtgatgtgcagcaacgaagcgacgaggagagtggagtggagtccagcggcgttgcgggtggcgggaagggacgcgccccgcggaatctactcgtttaccgaatgactagtgggaccaggtcatgtagggacccacttgtcagtgggaaaggtgtgaggtcgctggtggtgggaggggggttgggagagttacgtggcaccgactcgcgaatgcgcgggaaccgcgtcggtcgaaagtggcggaatggtctagagctccgccgcggattctctgtgccaaacccgcacgaacgccgcaggttgagcttgagctttcaggtcactgcacttgggagcctctctttgaagcccaacagttctcaattcctatatactccaacagtagtacggtttaattcaaaaaacaaaaactcggtagctgaaagtactcttgacacaatgctgccgactgtcttttagcttaaagtaactatatgttgctttaaaaaattggctatggcatttattaaaaaaaaagaacaaaaaaactgttagtttagcggcgatcattgcacatctgggacctgcaagtccaactgcctggccctcgaacgctcctacgctacgctcctaccctaccaatggggcaaccacagttttgcatgtccaatatcgtggttgcagtggatccagctttagctcagtagttcaaactcagcctcaaacattgattactcaggacgaaccatggataggctagaaaaatggtctgcaatggaaatatggaatggtagtggagcatatctcttcggaaagtgggctccatctctcctctcgccggagtacgaccaagctgtgggcggcggcgtgacacgtggagcccgtcccgtacgtcgccgggccatgagaaagtggatgccagcgtggcgcgaccgagaagccgcggcctgcaccggcggagcacacgccatgcatgaccggatgatgattaaactgggccacaagcccacgagtactagataagttcactgttttttcagatggaatagttcaatgtgatctggaaaaagattcgaacttttcaaagggggtcctaattcatttgcatttccttcacacagaacaaagctaaaagcaaaactttactttgatgcctaaatcaactaatataggttgctcactttgatgtctaaatcaacattaccaaattttggtagtaacaaattttggcattaccaatgtttgataaggataagggtgtgtttatagttctttggatgtaaaaactttgaaatatgcgaacacacatttgaagtattaaacatagactaataacaaaacaaattacagattcccgcctgtaaactgcgagacgaatttattgcctaattaattcatcattagcaaatgtttactgtagcatcacattgtcaaatgtaatcagacacaaaagaattgtctcgcaatttacatgcaaattgtacaattgttttttttccaacatttaatgctccatgcatgtgtccaaacattagatgtggcatttttggccaaaatttttttggaatctgataaggccaaagaagagtaagttgtgcgaaaagattctagaattatgaaaatttggtaatggaggcaacttttggcattgtttagattgttaccttgccaaaacttggtaaggttagtttcggcaacaaagggaacactgcatcaatgattgttcatgaacgggcttcatgcttttctatttagcaaatggcctttcttgaaaagattaccggaaaagtatacactgcttgcctgataccaaggcctgaaagtgtggcgacaggggtgcacaagaaaaattgctaatcaaatcagttcaacaaagattcaaatgtgtcagcactgcttcttcattctattatttctaccgtaaaccttcacagaccatgaaaatctccctcgaactagatcttgtcgccttgggtctcaataaggacactttcttgaacttctctttgcaaaatttgccaaaacctacaaagttaacagtttaatgaataataagttatacttggtgtcttgttaggatttttttaaaaaagaatagctagcatatagaagatgattgctggtcataacctggtatatcctcattctcaagaaacttaattacaaggctgcctccacgacggagaatgccatcttcatcaggatctggctcagtggagctctgaaacttctctaaaattgcaatgcaatctgaatcttttgctttcatcttaccaactgccaatgaaagagcacgcatgcccagctcgcaagatatagccgcatctttggttgtaattccagaaactactgggcacatgtctgacaatattacagagaatcctcgttcctgtaaaataagggaatcaaataaccaatggcgattacagggcaatacaattggtaatccttgcttcagcctttctaaccataggaaataagatattcagatgaagcgagcttggtagtgggaagattgatgaaaccatgtttcgtagtctatcagcgtgcgtactaaagtaaactcagcttttctcaagttacaaccttatgtggtagtgttcccagttgacaaattgatatttggaggcaaaactgaataaatacacgtttacctccacaactggtggcatcatattttatttagctagtagcagaaccactttatcaggttccatcgtgcctaccgacaaatagggtacataccttttatctttgaaagaaaggaatttcatgggaatttttggtacctagctcttcccaaggaatgaaaaggaggcatgcattttctggtaaaacattagtagcatctgtcatttgtacaaactaatactccctctatcccagaatataaggattgaatggtgaagggttgtgattggtttgataagagaatattggtgaagaagttattatattttgggacaaatctagagaactgaaagttgtaatattttgggacgaggggagtagttcacttgtcgcaagtaccactagtcaccaataatcctcggtgcgaaccttccaagactgttttcctttgcaaagatcatgagtctcaatcgaatacatatggagttcagttagtactaagatttcacaaattagaataaaccaaactagattgcagcctcggatcaaacgaaactaatttgtataacttcgtaccattccttccacgaactaagccagggaaatcggtagtaaaagctgaatcatatcatgatcattagcaagctatcgaacctgtggcgacattgcccgagcttgctgcttcatcagagccatcacatcggcgcaaacggtcctgaccctcgagtcacagtgcgcagatggaaccttcaccttctgctctgcaacaaccgagcatcgaatcaggccaaccattccgtcggcaaaatcagcctcactaacgaacggcaactcgatcgccactgaccttgacatcgacgccgacgatcaccccgcccttctcgagcggacccaggttctggcacgccacctacacaatgcaacaccgagctaaatcgaaatcgcgctgatgagaggagaggaggggatccaacgtcacctggagccacgcgccgggggcgcagccgaggtcgaggacggcggcgccgggggcgatgagcttgtgctgcttctgtatctggatcagctgcgacgggcagagcaagcggctcctcgcgtgagacgggagcagttggcaaaccgtacgagcgagaggggtgaggaggaaggcgctgaccttgaacgcggagcgggcgacgtagccgaggcgctgcgcctcgcggtagaagaagtcggcggtgccgcccgcgccgctcatggcttcctctccggccggcggcggcggcggtgacggtggcgaaggtgaagacgacggaggcggaggggattgctagggttttagcccgtcttcgcggcccaacacacaagtgaaacccaagcagcttgtttgctgggccggacgaagcgagcaaagcgtgacgtggccaccttccccgccgcgcgcacttttggcatgcgcgagcgcgacccctccccctcgaaccgccgcgaccttctagatgcttcccaaatcctcctcctcgtgaactcgtcgccttggtcttcgtctcgatctccatggcggactcgagcgcggcccgccccaccgtccttgtcaccggcgccggcggccgcacaggtgggtactcctccgtcctccctgtggcctccgactgggatatgaatcccagtagcgcgctctccagtacttttttttttttttgggggggggggggggggggtattggagcaaactgatgacagcggaatttggaatttgcctgttgtgcaaggttcgtgcgatctacagtacatgcttgttatatgatggggaattttggatccagtagagcgttctgaaaaggaattttggtcggaatgggattcatgtaatgtgttgcagtatcttgatcttctctaggataagagactttgtatcgcatggctgctagtcatatgatgagttgaatttgcaaggtttgtaaaattcacctagggcttaggcacgagtggggcttcttgggtactgattaacccattctagtttagctcaatgaactgaatatactatttggacttggaaaactgaaatttagtcgattaattgaagtgggtcaatgggtatccacagagcaacccacgccaaacccggaattcacccaatatgagtgcatgtgcctaagattttttgcaactatatggatgtatactgactgctcgacactatgtagtctgtactaatcctcaagggttactccttgtaacttgtcaggaaacattgtctacaacaagctcaaggaaaggtctgaccagtttgttgtgagaggtttagtgagaacagaggaaagcaaacaaaagattggtggaggcaatgatgtttacattgccgacataagggacagagatcatcttgtgcctgctgttcaaggtgtcgatgcgctcataatcctcacgagtgctgtgccaaagatgaaacctggttttgaccctagcaaaggtgggaggcctgagttttactatgaagatggaatgtatcctgagcaggttggctgattgaaacccctctagttaatatatagaatgtgattgtaaacttctgagctcatgctaatacttgctgtggtctgttaggtggattggattggccaaaagaatcagattgacactggtaaggttgttgcttattcttcttcatcattcatgtatcagtttgtaaatgtttgttaagtgaacattgcttgttttaacagccaaagctgctggagtgaagcatatcgtgcttgtgggatccatgggaggaacaaatcctaaccatccactgaacagcctaggcaatggcaatatactggtaagctgatggagtttgctagttctttttctataataagtcatacagcaaactttttggttcaagctttcaatagaactggtagattgtttccctctatcttaataacatttggatgacctccttcggtcatcccggcaaatagagtggtagattggtagaaaatgatctggccaccttaaatggttagcaagggaaaaccaaaaatacgagtgccaaactgtatgatattatcttacaaatgaactttccacattgctgatatcaccttattggatattccttgatatggccttatttatttgttataggtttggaagcgcaagtcagaacagtatttggcagacagtggagtcccttatacaataataaggtaccacctgcataagacaagaagccatacgtaatagcctgactaattggtccggttggcttaattcgctttgttcttgaaacttaggaaatgtttgattttccaccacaataggcctgatttgctacttcattgtcaatgatactaagccaattcgtatatgtgaaaaatataatatgttgtgtgtatcttccatcacttccatgtaggcctggtggtctgcaagacaaagacgggggagtgagggagttgattgttggcaatgacgatgaacttctccagacagacacgaagtcaattccaagagctgatgttgctgaagtttgtgttcaggtatgatctttgtggtcaatacagtgatagtttatctttgagtttacttagctaagttttccggcgatgaagcattgatgcatcggccatacgtttctactttctgtcaacaagcaccgtgaaaaaatatggatagtcacatggtgaacttaccattctgattgcaaacttttccccttataataggccctgcagtatgaagagacaaagttcaaggcatttgatttggcttcaaagcctgaaggcacaggcacaccaacaaaagacttcaaatcgttgttctcccaggttacagcccgattttgagccatcttgaggagcaatctcatctcggtttccttgtgtattggatatttggatgtatatcttcgtggttagtgaggtgtgaagttgtagtttgctgtaattcgtcatcgtttcctgaaaactcctattgaaatcagtgaattgttcagacaagacacaaattgatattattcaaggacatgatgtctttttaaaatgaaatccttgcgctgttataaacttctggcatggactgtggagtcagcctgcaaagggggcggatcgggccgacccatcccctataccctctgaccctatctatcttggtgcctgagttcgccccgtctctggtggaagtggagccggcccgttaggttcgtggccgacccaccgtagccgcgggccggatgcactaagcgtctgagccaccgtgtccagtgaatggttgactggctgtgttaatgtgttatcagtgaaccattaaagcaagtagctatacgtcaattcaattatacaagattcaaaaataatatgaacaatcattttatattaaactgatatcatttttgtactatactaattttatataagtcagatatcaagtgaaataaggaaacaaaaacacatacactagcatgatatctgaacacatactaacatactagaaatttcggttgtgcgaagcaaatcaacagcactacagcaaaataaataaataatcaaaaaccataccagaacacactgtatacccaatgcaaacattccgaaatgacttaatcttttgcattcaaaagtacaaacatcaatcactgggtactggcacccagttcaattaaaactaagtacatgcatgtactcatatcattcacaaaaatcgatttgaacaacccaaatatccggttcattatattgagatcaaacaaaatgcagccttccaagatcaaagtgggcatcatttggcattccctagcttgcactgttcgttgaatcacccaggtccagattctgcaggttaacatgatggagagatcgaatgatcatggtataataacaggaagaaaatatacaataattgttttaaaaaggtaataacctgcaatatctctcagaaaaagaaatggtgcatttatgttttatgggcaacaactgaatcaaagacatgagcatatgcagacagacagaggaatcaacgcagtaggtgttctaagcatttgagtatttgacatataaaacatgcttgaaaaacagaagtaatctgcagtcactcaatagtattcacaatcagagattaaggaatacaagaatcatctaacaagtgctacacaaattttgcagattttactaattttcttcatttatctagcagtagtgcagtacagtctatttttaggctatcgttttatttcagaaagcagagcattgcaataccagaaatgaggtttattccttttgtacatctagagcttctcatatgttgtacaagagttgaactagctcagattataaatagtataatacaagttcatgatagattactaaccatcaatatccagatcctttgtttgggcattcacaagcttccaccatcctgtccatccatggaatcctccaggtccaggttctatagataaagatgaatacatgatagagacattgaaacttcatattccaattttacagaaagctagcaagtaggacaacaaacccatataggcattgttcaatactggataaatagaaagagaaaagctggaagagatcttgcaagcaatcaagcaaatactgaataaatagacatctttctctttcagaaaattaaatagacagatgataagaagagcacaagcaatttactaaccacaaaattatcactgtagttgatttcatttactgagctcacatttatgttaggacctagcaatcaaaacataaaaataaattagttttagcaagataaatactagaagtaaatgaacgagggcagtcgtgtataccggcagaagctcgaaaccaatcttggaggcagataagcgcctcaactgaatccattgtaaggctacatctgaaatcgctgatcactctagatcctgtgctgaatgcggactcagatgcaactgttgaagcaggccatgctagcacatcctgtgctatgcaagcgagagttggatactttgagtgattggtcttccaccaatttagaatgtcaaatttgttcccaaattcctgaataggattctctttgaggtagatatccaattcagtatcaacttgctcacttcattgttcagagatgtgttgaacccaatcagccataggatcattttcagagatagccatcacatgttcagcttggcgcagtgggttagcattgctatccttgagtttatcagagtactccttaaacaacatgttcattctcttcttaactttgtcaatcctctctttagcattttcaccaaaggcttgcccaagccgaaattccacaaaattgaatttgaatcttgggtcaaaaatgacaggaatgcacagatatttgtaagacttaagccaatacttgtcaaatttgtccttcatcttttgaaccatacttgccacttcagtgtcattgttagagtgttccttgtccaagaccaatttgattttccacatctcatggaaataaaggtttgatgttggatataaagatccagacaccaccatagttgcatcataaagcaccttcaaaattccagagactatggttgatctttcccactgatcaggagagggtgcatatttgtaatttttgtcttgaacagccaatgaagcataagccctcatgaaagggaaggctgcattgagcattagatatgtggagttccaacgagtacatacatccacagtgggatgcaactcgcatgtgatcccttcttgggcaatgatctcctcaaacttttctttgcgagatagggaattatccctgtacttcacactttcacggatgttgcaaacaatagaatcaataaccttcaacccatctttggctatgagattgatgacatgtgttgcacatcggttgtgaagtagcttccctcctgctggtatagttttcttagctttcaaattgcactttaacaacttagccattgaatcattggctgaagcataatccaaagtaacactgaatattttgtctgcgatattccaatcttgaatgcagctgagcatagcattgaacatctgcactccagtatgaggtgtctttactccaaagaactttataatcctcttctgtactctccaatctgtgtcaatgaaatgacatgtcacacacatgtatcccattgtttggttcgaagtccacatatctgcagtcaatgagaacctacaatttgcacccttgaacatgtccttcattgctaacttttgctctttaaaagcagcgatgcaatcattccttatagttgttctcgaaataatcttgaagtaggggttaagactagcagcaaaacttctaaatccatcatactccacaaactggaagggcaactcatgtaatacaatcattcgcatgagctcttttctagaaacttcaggatcaaagctccaattctttaaccttacactattaggagacataagtgtagagtcaagatttcccacaatcttaagagcactaattcgcttcttgcatcttgtcaaatgcttcctcaatgaacttgttcccgctccacgctttgcacggatctctgtatcacagtgcttacattttcctgcaccaacttcattatcaatgagtatcggcacaaactctttccaagcctcagatctgaatttccttgttaaagcttgtattactggattcacatgctcatctacaggaccaacttgttcagagtcactatcaccatcacccatctcaatatcttcaccactgttagtgccaagtccaaaaaatgcgttgggtgtccgcatttcctcacttgaaacaaagcaacgaacaacacaaatgtatcatttgccatctaaaataattttctatcacataatgtatggaaaggaaattttggtgtaaaaatctgcacaacagcatgttgtcagaagcatgcaaaaatgctacttattcagtgtttcgttcagtatatcctgaatattgagaaaatccaggttatatagagacaaagtaaaagaccatctattttacacaaggcagtaggaaactttaaattagcagtaactgaaactttctcctgaatggcatgaaagcaaaatgaaactttttcctggcatacaaatctgggcctagcaaaatggcatgaaagcctagctataacagtcactgaaactttctcctgaatgagacactatatatacaaatcaaaccaaaaccgagcaagacagatgaacaagacagggttcatggaggaaatcatacttgtgctcacgagttagagaaacccagctggaagaaggtggcgatgtggccgggtgtcctccgaaaccctcgccgttgctgccggtggagtgtcctccggagcacctcgccggttggccaccaagcaggtagccgccgcccgccggtgcctccatccgccgccgaaagaaggaactgcatagaagaggaactaaagaatcaagaaccaaagaaaataaaaagaaaatcaagaaccaaagaatccgttgctagttgctatgatgtgaaccacagtaccagtcttggggggagttggagatgggaggaggactgaaggagcacgcccagccgccgccgcctcaacccgcggtggagcacaccgcgaagccgaagctgccgccgccgccacctcgatccgcggtggagctgcgccgacaccgctgccgcctccgctgggagccaccgccgccggctcgatccgccgtggagccgcaccgccgcaggccgggagccctaaagccgccgccgccatttgaacgcgagcaagtggagcgctcgaacaaggccgacccaaaaacccctagggtcaactgactcctggacccattatcacctaagaaaatatgggccggcccgaaaacctattggtgccacaaatttaggttcgggccacggacctaacgggtcgacccgccccacttgcaggctgtgtggagtggtcatgtgtgcattggacagaaatgaagtcggaatatgtcctgtttttcattgcaagtattgtactacagaaggaagaaaaatcattttggcatcgcctcgtgtagataggccttcacacagtcacgcagcccacagcccaaggcccgcacaacgccgggtcatcatgcccatgtcacaagtcaacagtcacgagctactcacattaaggatgaaaatgttttaagacgatatcatttctactgaaacgattcttgctcggtcaaaaaatttcatacatacgaattttgctattttaacagtgatgaaacttatatataactagaatctttgcgggtcaggaaatttttacgtcacagttttcatgtacccttggtggttcgatgcttggaagataggtcaagtgacgtttgctggttccggccggcgacgacgaccttagcgtttgtcccttgcccgaccgcttttcgtctcgatcggcaggggtaccaaccactcaaccagtcgtcactcgtcagaacgcaagccgcagatcgatcaaaaccttgctgcttgagctgcgtgctgtactgcactgcagctcatcgggtcaaagcaaactatctcgctgcggtcacggcggtgatctggcctgatcagatcatattgccgccgtgtccacgccggtcaattcctactccccatgagatgataagatgatgagatgagatgagatgagatgagatgagctaggccgcgcgcgctgcctgcgacgagatggcaacaagtgcgtcgcgccaaatgctcccgttcggctacctcctcctgatactaattactactactccagctagctgcaggcagcatatgtatcagtgacacgtacgccaacttgcaacccgccaggtagagtagaaccagtgacacagcttcgcctggaccaaacatcaaggcaaaatggtactgcttgcacattggagaatttggacacacctacctagtcccacacggattcatcctaaacaaaccaactttctttcattcagattcgtaatactgtaatatattgcatcttaaatttatatttcatataaaatttgtttattcaaatttatatttcatactaaatctgtttattttcaaacaaagagaaaacttactagtaatagcacgatagaagaagatagaggaagacaacagcctgcacttgatgacagtttgatcattcgcatataataacagtatcacacaatcgctcatgttacaccattagtcaagtcaacgcgcccccattttcaaaataagatggtgtttgaaactcatgtggataaagattaagtattttacataaaacggggtgctatattaattaaattgtaattattataaacttgaaaaatatgtttatgatattttgaagcagcttttatatagaagttttttacacgaaacgtaccgtttaacagtttaaaaaacatggcacgaatatctaaatttttatccaacttttattagagaaaagaacggggcctagacagttctctctttcacttgatccacaccctgttgccggttattttcccctgaactgcatgccctagtgtctgaacccatgaccctcaagtctcacggcatgcatgtgctctgctctgcatccaggcacaagaataatcatcagtcataagaagcaaacacaagctagctcagggcaaaacacctaacacgtactcccaatcctactactgcaggcgcgacttaaattgcagacaagcaaacaggtcaaccccttaccaatctgtccaggcacgcagcgtccggcggtgctaggctgctagctaattacagtcatcaaggaaccgtgacctaacacaatcttattagtggacacaaaattaagaggccagctgcatgctgcagcctctgcatacatcatcctgcaggagatagccatatggaaagtatcatgaattcatgagagctcgatgatgcgcagccaaagcagatccggcacatggcctgggctcaaggcttgctgcagtgtgcagtagtaaggtttcagagtttcaccgaaacaacaacgttagtcaatgctcgatcgataaacttgcagtctcttgcagagtgcagactcgatccatctctgctttgacgaccatcaacgccctatccgtcagttccagatatgctaacatactactactgatattaattttctaccggacatctcagtgtgatccaagcatcgcaatacaatactctctgtgtgcacggcacgcgacctatgttaatactatgtggaaacagctctgaattgttccgaattaatggtcaccattgacatgctcaatgaagaggtctgaccatcagggatagatcgatcgacgcagtgtgaaatgtatgaagaaatgagaaacacagatgcgtcggtgccaacgcatttgtcagtttcacaacaagttgaatcgaaatgaatgctacctgaacactaatgcattacagctttgatatactcctatagtgttgtactcgtactatatgagtacttgtactacttcctcaaaaggtcgcgtaaaagctatactagctgcgtcttcttcttcgcatttgcttgccgtgatcgggcgggaatttttttatcagtttccctttgttctcatcgtggatcggaaaagcgacggcatgatcgatccacaactactactgctgcgatagtacgtacatgagtcgggttccgaggcgagagaaaggcgaaagtagcacgtacgttctccgcttcttccttttgattggaacttcgcttgcccttctgtttggctttatctactccctctgtcaaaaaaatataaatcatgggtttttttgtccaacgtttgaccatccgtcttatttaaaaaaagtatgaaaaaaattaaaaagacaagtcacgcataaagtattaatcatgttttatcatctaacaataatgaaaatactaattataaaaatattttatataagacgaatagacaaacgttggacacgaagaacgaagaaccatagtttgttttttaggacggagggagtatatcttcgagtcatatcatctactactgcgtcttttatatgggaaatacttccccatctataaatatactctctcaatttcatattataaatcatttgattttttttctaattaaattttattaagtttaaccaaatttatagataaatttaacaacatctaaaaaattaaattaatttcattaaatttaatattaaatatattttgatggtatgtttattttgtgttaaaaatactactatattttttttataaatttaatcaaacttaaagaaatttaactaagaaaaagttaaacaacttataatatgaaacgagtggagtagtatgttcatcctaaaataattttactttttatttatcccatacatatcattacaatatgtgctataataccatttcctttaccaaattctaatgcatttatctcctactttatatatatgcttctaatgtatttatctcgtacttttaaaaactctaatacaacaattgcttggaattaagatgaacttaatttaggatggagggagtagcaatttaattaagatcggatagaatacatctcaatacttttaattaaatttatagtaatatgatgcgtcctacttttagattactgtatgttgggaaaggagtatgcacgtaatcctatagcaaacgagaacgactagtactcttctttcagctacgtcgtctacgtgatgtgatgaaatgaagaagatatgggatggttaggccgcaattcttgtagctagagtcgtcaacttgtcagacaactagtatgtccatatgcatgtttgctcggttacctagaggccaacccccaccttgatctgtccaacaaatagccgaaaagttcagagttagggtttgttcacatccatctactagctccttactgccgtctccttttactgtgctgccacaagtctacaacactacaatcgtcaggtcaaatcgttccaactttgccaaggaaaactccaaaagcaaggtacttaaggccatatttttttcagcttaagattattataatccagattattgagagtaagctgaaagaaacagacaacttattgaagtagcttattataatctggagcccagcttattattatttgataagctcatttaggtgagctttttccagattattaagtgaaaaattacccaccatgccaccccactccctttttagacttgcaaacccaataatctaggctctaataattcaggaaagaaacaactaaccacttattctactataaattataacaatctagcttatagtaatctgagtcaataatctagattataataatcctaaactgaaagaaacagtggcctaaatcctactactgatttggtcccattagccgcggcgaaggcggagttcatatatcaaaagtgaaagaagagttttgtgtgcagtgcagtggcttccgtttattcgaccaacagcacgagattgccatcacatggctagttgatctaccagaagaggagtcctagtagaagatatggcctactcctagtacaacaacaacaccttaacctttcacgaggctgcaaccaaccaccctgggtggctggtgctgtagtagcctagtagagctgaccaacggcggcagcaatgattgacgacgagtaaagtaaatcgccgtacaactctacgtactatgagctcagagttgacttgttttcttgccggtaaaacgcacccaaccctgcatcgcgttgcatctgatcgagtgggcatcaccagcgagctgaggctgcaaatgagatcaaccgaagcgtagatgcaaagcaaccacacatatatatcagactatcagtagtggtacatacatagactgtagtagtagatggagatgggcataataaactcggtggccggatgcgaccaaggaaacggttagagatggtgcgggttttgctcggtcaccagccacatgcgcccgcgtacgtggccgagacagcgcggcgggcgtacgctagctgcgttagtacgtgtgccccgcccccgcgcgtcgccatcgcattcacgcgccgatcgatcgagccacggggggttctcgcgctcgcgcacgtacagtctacttaccaaaccccagccaagacgccccgtcgcgttgcgcccatcgcgccgcgtcgggaggtgcgggcgcgcaccggccgcctgtctcgcgcgcgcgcgcacatcgcgacgtacgttacgttggtgcgatacgtacgtggcccgcggagggcgaccgcgacggctcacttgccgggctctcgctcgatcgggcgccgtcttgtgctggccttggcctgatagctactccagtcgcgacttggtaggtggatttgtacgtactactacttcgttcgtagtggtgtcgtcagcaaagtgcaaaatgcagctactgaaatttacagaggatgcacaaatgcaagggaaaaaaacgtgagcacttttcgtcgcggttgtgattaaaagagagggcgtgtcacgcactcacgtctcacggcacgcacccaccgcgagaggctagcggagaggaagacgtatcccgtttggggtgacccatgcgtacctacctaatccctccgtctaaaaaaactcaattcttaagttgccgtgtacaacatttaactatttatcttatatgaattttttctataattagtatttttattgttgttagatgataaaacatggataatattttttgtgtgacttatttttaatattttttaaaaataatacggacgttcaaacgctagacacgaaaatccaaaaattgagttttttttagagggaggatatgcgagacccatcgaccgtaccatttatatacgcaggcgtgcgtcacgcatacgcagtaaataggcatggaggctcactgctttgaagtgcgggtggaagagggaggagggaggctcgatggatggatgggtgtttgttcaggcgcgcggcgggaccgggcgcggcgcgggcgggcgtgccatgtgtgcggggagatcaattctggtgcggtttcgaggctcgaggtgggggcacaccggcgtggaagggtgggtgtgtacgggcaaagtcaccaaaccgaacaagggctccatcccgcgcacgcggaggaatccgagggcgccgtctgtgcctgtgcccctgcgcgtcctccactgtctacgatgtgcatggggcgcacctcatcgtgttgaaatgcaaggctgcattatccacggtttcaaccgtagcaatgagggtttacccttgtattggctcttccactttacatcccgtacgtgcatgcgctagtagcggtaggtagcaggaataggtggttgatcttataaaatctagatttcaaaaataactaactatgggctttggcatataaaacgatcctgacaaactagcacaatttgatgatcaatagtaggttcgactaatcgacatgtggtgttggattattgagatcaactgctgacgtctagtgagaatggatatggttgctttacattgctaccgtcgaacatgttcttggaatacgagtattttggtcatagttagtaatagaggttgtgtttacttcacactaaaattgaaagtttggtttaaattaaaaggatgtgatggaaaagttggaggtttgtgtgtaggaaagttttgatgtgatgaaaaagttagaagtttaaagaaaaactttagaactaaacacggcgagagttggacagaaatagtgttcaaaataaccttacaaacttcaaatagtattagagttcgctttaatttttttgggacatttaagaaaccttactaatctaatgaaaccatttttttcaaaataaataaataaatgaaacaagcatttttagtgtatggaaccaaaaaaacgggaagcttgtctgtagattacatgctacaggcaattcaggcctcttttagttcccaatttttatcacaaaaagatcacgtcgaaactttagacatatgcatagagcatcaaatatagataaaaataaaaactaattgcacagtttgtatgaaaatcgtgagacgaatcttttgagcctaattagtcaatgattagccataagtgctacaataacccacatgtgataatgacgacttaattaggctcaaaagattcgtctcgcggtttccagtcaagttataaaattagatttttcattcgtgtccaaaaactctttccgacatacagacaaacatctgatgtgacacataaatattttcttttcgcgaactaaacacaccttcagtccgatgctccatccgtgatactgcaaccatgacatcgatggatgagtggcaacccacatctacacagtgcaactgtttacggctgcctgcatgatcaaattagttcttttgccggagctattttgccaatttggcccaccctagatgtttttttatcgatttagagggtgtggtgccaactcacatgtttctatggagtcatagagtaacatctactcctacaaacagagcacgcatgtgctgcaattgaaacacagttctaatcatagttgatgtctatccttgtgcaacagtatatgtgtacatacagtacaattcggtaggtcgtatgtgttagagtaggatgtacgttctctgcttgtagaataaacgaaaactattcgctgattgctgtttacaatgccgtacgaaatgtaggaaatgaagtggatttcgagacaggtacggtgtagaacacaggcgtcggtgaaatgtccaaacgtgcagggacagagtttcctctgttccaagatgtcgcgtttcttctgtttcacctggtggttttcctgccgttttgaacttgaggttttttaaaagtttaaaactcaacaccactgcaaatccaggttgtacagtcggctagaatggattttcgcatatagtttgagtgatcacctataacaaaaggcctataaaaatagtttgattttccacataaatgtccggttcttcgagaggttcgtatgcgaaaaacaattttcacatatgacagtccaaacaacccctcttgtgcggatgtattttagcaaaaaaaaaaaagtaaatttagatccaatttaacttgcagaggatcacaaattccacaaagccctagccacaattgtctttgtagttgttgagtcgaaggcctcgcagcggccaccatgaagaattccattgtggatcgttgtggcattggtcgattgctgttcttttagggcggtttgatttgaagtaaaaacttaccctaccaagatattggcaaattaaacaatagtagcctggtaatatttggtttgctaccaatacttacttatatcacacagatgctaccaaaaatatttagggccaatttggtttgatgtcaaaatatgcactaccaaattgttggcattttgaatagtagtttggctagtgtttggtttgctaccaaaatgtgccaataagacacataagttgctaaagtatttggcattaccaaaatttgcctatgatttggtattgccaatattttgacatggtagcaaaccaaacaagcacttatatttgacaaaaggatgcccttgatttggtattgtcaacattttgctatggtagcaaatcaaaccatcccatagttacctcggcagaagagtgtccttgtggcctattatggcatccattagtcctgtaaagcttgcaccttatccattgtgtcatgtaaagcttgcatgcgtctttgaacttgaagagtgacagcatgatggtcggctggtcgccatagttgggtctaaccttacccagcacagctatgttcaacaaaagcatgctacattgctacttgcacagtgtggtactaccaagatcattcttgagcactcatcattcttttgagtcgcgggctgcatacagttcaatatcacaacatggatggcacaaatgcatgcatacatcgtgtttagttccaaaatttttcttcaaacttctaacttttccatcacatcaaaactttcatacaccacaaacttctaatttttccgtcacatagttacaatttcaactaaacttttaattttgatgtgaaaacacacccatacatacatacattcaagtggtcaaggaaggttcacgaggccgcggcggcagatggggggcttccctccatattttccggcgccttttgttcaaacatggcattggcatcgaaactttaaaccaccaccaccgtatcgtatcgtctagcctgctatgctacgtactcgtcctactaccccagcagagcagcagcagctgatcgatgcggtagaagaggtgaaaccgcgcgcaaagcaaaagcagtggccaaaacgaaaaggagaagccccacacaaacgcaggagaacgtcaagccgtcaacctgcacaggccaccggccatccagagccacagccgcggctggccggccggcagcgagagagaggtgcagtggatggaaatcggaatggcacaacttgcgatggaagcaaagcgaaaggcgagccaatcaacgccccagccgtttgctccgtgtccacgaacacgcgccagtggccgcgccgcttttggtctcccctttccctccgctgccgccgctccgtgtcatcgcggccgtccatttagaacgaaggggatgacacatctgccactggcgtgtggggtccccgctgtttacaccggctgcgcgaaaggctggagcgcgaatgatagggccaaaatctggccgtgccaatgccattggcgaattcgcgttacgtctacgaaaatgtggtgttgaacttcttttttttgttcgagatgacagttacgaattccaaacggatcgttggagattgtcgtgttggtgtttgatgggcaaagatttatgactcgtgggctcataccaggatcctgtacgatcttgcagccgattccgccgtgcatcatgcgatcggatcacaacttcacaagcaatgcaaggcaagaggtaattggccgtggaatccaatacgatccgagttactcaattccggatccactgccctggcttccaacagattaatcaccaccaatcggtgaaaagagaacaaacacttcgcatgcatgcatgcacgcaaagattaatctgctcatgcttttgctttagttcgaaccaagccaaaaaaaaaagaaagaaaaaggagaatgaatagttccaactgccccgcggtgcacgagatgacggccgcagcgaggaggcaaaatcacagctgtggcagtagtacttgtacgtacacacacagtagtagtagtgtactactgctattgctactactaccacgcagcgggtgacacacacacacacaaaaagtcacaaatctctacgttttttttcctcgcgaggcgtagggcgcgcatacgcgacgcgcgccattatttggtccgcctcgtgcctccataaataccgcctccgtcccgtccgcctcctcccccacactccactccactccactctcgccgctcgccgttgccactcgcactcacaatgtcgccggcgccgcgggtgttggtgttggtggtggccacagtggtggcgctgcaggtgtcgccggcggcggggcggatcccgggggcgtacgggggcggggagtggcagagcgcgcacgcaacgttctacgggggcagcgacgcgtcagggacgatgggcggggcgtgcgggtacgggaacctgtacagccaggggtacggggtgaacaacgcggcgctgagcacggcgctgttcaactccgggcagagctgcggcgcgtgcttcgagatcaagtgcgtgaaccagcccgggtgggagtggtgccacccggggagcccctccatcctcatcaccgccaccaacttctgcccgcccaactacgccctcccctccgacaacggcggctggtgcaaccctcctcgcccccacttcgacctcgccatgcccatgttcctccacatcgccgagtaccgcgccggcatcgtccccgtctcctaccgccggtaaatataatctctcaccaccattcttgctgctagtactgcatttcttggtgacgacattcgccttggttagaggagcaggaacagtagtacttctaggcttgttttcttggtccaatggaagcttttgttttgttttgttttcatttcatttcgcgtcttttgagacggcgtggggctgctgctgctgctgcttctgcttctgcagcgttttggactccagccacttctgcttccgcactgctttattactgtagtaaataaatttgatacggtatactccagcgcgtagtggctgcacggccaggtgagtaatattttccgagtgggatggaaatgtgcaccgacggcgcggctttaaaagcggaggagcgtgatagtagcggctagaaacgctgctcactgcccgtaaaaagttggcttggtacgtagctataaatggggtgtcccgtgttcgctttgcccttgtgcatgtactcgtgtaccggcgctacgcaccgtggctcgcattgagccgagcccaaactctgcttagcgcttaatcactgccaattttttttccatacatttgcttgtagtagatctcatgctagtggttacattcccatgctttaattaacagtacagtagaaaggaggagtagatttttgggagcattggcctgaataattgtaccactacaccataaagggacacaaaagatgtacagggaaaaaacagcactgttactgtgcaaatgtgtgtagtgtaagaccactgggcgcactggcagcagcgagaggcccagagaaacatccaacgcgagtcaagcgtgtagttgggaggagtagtagaattccgtagggccaaggcgcacaggcaaaacgcgcacacgcgcttttgacctttttcgctttccgctgtgttgtcctggcccggttgggtggttgggttggtgccgccccgtgatcccgctccgtacccgcgcctccctcgcttcgctctccgcaaccttggcgtggcgtctcgccgtctcccatgccctggcgggaaagacgacggtgtgaggtgatgaggtgaaatggcaggtctgcccctccgttccttctgtggctggtcccctactgcaggggccttcccgtcctttcgtcctgccggcacaacgttactacgcgtgaggaggctgtgtggccccatctctgcatgaacgactgcactctcttcctggtcatatgtccttgcctccttttggctccttgctacctatagttacagcgaaataatatttgctcctactactagtattgttctgttgatcttgattttaatgtgataataatgcgtggttaatgagtgatgaaaatgttggcgtgtgtgtggtttgcagggtgccgtgcaggaagaagggaggggttcggttcacgataaacgggttcaggtacttcaacctggtgctgatcacgaacgtggccggggccggggacatcgtgagggcgagcgtgaaggggacgagcaccgggtggatgcccatgtcgcggaactggggccagaactggcagtccaactccgtcctcgtcggccaggcgctctcgttccgcgtcaccggcagcgaccgccgcacctccacatcctggaacgcggcacccgccggatggcacttcggccagaccttcgagggcaagaacttccgggtctgaattgaatgaagcaaaactgcaatataccctcttatttactcatctagtaattactgtcattatagcgagcaggtgtgttttttaccttggttaagtttgggttcttcttcggttggtggccttgtcaaagtgaggggccgggggaaaacaggtggtaaagactagtactagtgtcaattagggttaaactggtaaattgctagtactgctgttactcatcatcatcatcgctagtggtcactgctagtagtagttgtgctagtgcatgtatggttatggatactgcatcatgttggttggtgatggattttgtccatgttttgccaaggggtttggtttggagttgggggtgatggggaggatttgtgctcaaagagtggctgaagtggctgcaaagctgcagctgaatttgggggtggtgagtgtagcccgcagccgcttgtgccgtgtcatttgtctctatggcacttgatgtttatcatggacttgatttatcattatggtgattggagcttgtaagaagattaattgcctctgttcctctcgctctgtgtgtgtgttttatgtgatgttctggttgagcatttcagctttgtagtgctggaatgatgattcttgccggcttctttccgtgaatgcattctctgtgttctccgtgagttgctcgatgggggagtgccgaaattacgtgaaagggataaaggtgaaagcaaaagtgcgatgcgagtagaccgctttgggaatgattttgcctgttccgttgcctcagttcagatgcaagaatggttcatgattgcgatggcgtgatcggccattccattcctaagcacggcttgcagcatcatgcattcatgctggccttgcaattgccatcggagggctacttcaggattgggagttatcagtctgcatcatcatgggatggaagaaccaaatgcgcaacctctcttccttaaagtcaacatgctggatagccatcatcaggtgtgttggggccgaaatcaatggctttgacagggaggttagcatttgacagtgtggctatagcccatagctatttgataaattgttatccatctcgccggagatttcggcccaaaccacttcagcatgacaccatcagaccactgaacacaacagtagacaccactcagtatgatccaatgatgtgttgatgacaatgtacctatgggtgcatgctgatcgatgagctaccaggaaagcttgaaccc

SEQ ID NO: 42206 - DNA, 2194 bp, Oryza sativa
acatgcacttctggtacatcgttctaaaaataacacggtgatgtaaatcactaaatgcacataattgcaacaggtccacagtaaataaaagctcacaacgtatggcaaacaatgatttgtttcccaacatccttccatgtacattttgcaattgagattaaactaaacatcaagccatatatatcattccccaaggagtgcgcatgcagaaaaggtgtatatgaaattcatggaaagcaatacattggagtgttcatatgttcatgcttagatgagttagattctaagctagatcacattcccaaagtcaacaatgcaaagaatgtcataaaatgacatttccgatgtggaggatgcgtaaaaaacaattccacgttattaatatgcttatagctataacaattcatgtaatttactgtagacaactacctggcctgccaatgtatgaattttctaatccaagatcagaaaacatggagaaaactgaataccaaaaactacacttcacaggttacctgttgaaagatattctggagcagcataaccatatgttcccatcaccctcgtggatacatggctcttctcaccaacaggaccatcctttgccaatccaaaatcagatagctttgcagaatagtcctgaacagtaatataatacattcctttcagcagggatacatgcgcactgaagtgaagttggttatcaaagatttactttcacttactgtgtcaagcagaatattggaagtcttgaaatctcgataaataacttttgcctctgaactgtgaaggtaagctagtccttttgcagctccaagtgcaaccttcattcttaggttccatgaaagaggctggaaatgcgaacctcctgcaacatgattcagatagcaatttatgataaaaggaacacgtggcaatagtgtatgcaatatgaaaagaatgcccccagatgagcagtggaacaggtcttgttttaacttactcctaaacagatgattttccaagctcccacgtggcatgaactcatacactagcagtcgatgctcatcctctaagcaatacccaaatagcttcacaaggttgggatggcaaaactgacctaggtaattaacttctgcctacatattgaatatttatacatcaaagttagaaaatatccaagtaacctttcaaaaggataaaaaaaacaagtatatgattgacaaaagctgtatccaatggtatacttaaaacaagcatggatttgaaggcaacacaacatagaatagcagtcatactcaccaaccattctcggtgcccttgcaaactctcctggttgagtcttttcacagcaacagcaattccagtgccaggcttgcaagcagataatgtattctcatcaatccatcctttatagacagatccaaaccctccttcaccaagtacactgtcaggacggaagttccttgtggctatcctgagatcactaaaactgaagatcttcacattggctgactgcagtatctcacattcagttttcgcagttggaggcatggaagctgaagaggctcgactactgcagccactaagcctactcccatctttagcaccactccttgagaacatccctgcatacatttggtacagttataatgagtagaaagcacatgactgcatttagctgtaatctagaagttctctagaaaaaagtcccagtactaatctttcccaggtccatagtatgatagcacagtaataatgtatataatgttctgaatgttcaattctatttttaaaaggaagctttgcacattaattaggaatcaactaaatcaatcatcagttgatccttcgctaaaatttggtatgagtcctgacagatgaaggatttgctatcagccaattgccacgcgcctacatgtagcactactagatatactagatttgctatcagcttacgaatgatgatgtgctctggtttaaaataacaaaatgacgattttgcatagagtagtagccatgaatataatgggaacagggggagttcccacccaaccagaaactggaaacaatcatatgcgctagtaaccttattccatcagaagtacatccgctaccatgcggctctccagaaagctcatatttatctactctatctttagtaataatacatttcttaagtagccgttatgatatgaatcaactaagttcaaat

SEQ ID NO: 42207 - DNA, 4306 bp, Oryza sativa
gatcgcgaagcataccagaggctcccggttgcgggctcccatccttgatccgcgcgccccacccacagcaattccccatccccctccaacaagcgactcgcccgcggcgccgagcccagtcaggatcgaaccaaccctcccgccgtcccgacccggcggcgccgcatggggtgaggggggaggagagctccacctagggttttgggggacaccaagcgcgaggcggaggcggaggcggaggcgttggctatatagcgacgaggacgaggtgcgctcgctggcgagagatgtggcgtgcggcgcgtgaggtgaggcgagcgagtgaggagttaatggcgggggcaagggaagcggccaagcggagagggagagggagcgaggcggcccgcgcagccacgccgctgctgctggctgctgctgcttcccgcgtggcttcttccggggaaaagggtggttggtgacggggagcgtggggaggaggagaggcgtcgtggtgcttggtgtgtgacgctgccgcgcggggaccaccgggcctccgggtgcgacgattttttatctttttaccgcttcacctctccgagttactgcgcgactctgtgagtgaagttacagtgacgtgagactctgtgggctttggcccggtaggcccactaattttattatgggctcgacttattatgcgtgagcatggcccaaataaaattgtttacacgcctgggaacacctgtaacttgccctccaacttatcaaccgcggcaaaaattaaattttacaacttcattttagagtaaagtttgatgttttttgatcggtgtttattttttaagtatttgcttttaagttgttacaaacacatataaatgttttacgtataacttttttttgttgctaacaagtgttacgacatctaattagttgtaggtgaaatgtacagattattttttgatgttgtcgtaatagatttctgtcggcaaaacgtgcaaatatcaaaggaagttttatgtaagggtggagctaatgtatttccgccaaaaaattgccctatgaagtactttggtgcaattttaataccaacaatacaacatataacgatctctttcatttggattgcgatattcctttttcctccaaattaaattcctctgttgtaaagtgggctttcatgcctagtgtagtgtatggaaatatcttgatttcttgagcacaaatataaaaagtacgtacatattgtatgtgacaaagtgtacagatcctttgaaacacaaaaatcgggatctcaaaacacatagtatggatttgcgcctttgaatggtctatccaattgttcagtgctacagaacatctatttagcgatgtattaggattcattccccttgaactctgtctttattaataaaagtttatgagttttttttaaaaaaagaatggtctatccaattgttcaaaaggaatttagggagaaaaatatcctaaaaattatgacagtttaatcttagaaaaactgatgtggcacattgtgattcaatcttgatttttataactatccactaattaaatctgacggttgagattcttttgtgtgtaagaatttagcgtatagcatcaaattcgtacatgttgatgggtgagagggtataactacataatatgcctcactattttgtgtggggatactgtaatcccaattgtaagatcggataccgtaataaactggtaaaactagacaaaaactatcaaatatggagtttttgttttaagttttttttaatctaatctgtttctgagctattaacgttaccaaaaccttgttagtacggtaaatcatgttgcacactctgaaccgatcttgcttgatcatgactaaatacgaatattaaaccttcgtgatacaatcatctcattttttaaattcgagtaatttggtatatgatgcatttgttctactccaagtaccttctaaccgatttgaaaatgcttaccttaaactccactactcaacaactactagcgtggttgtttctcttttgacaacccgttcaaacaaaaagagatgggaaaaaaaaaaccggcctacaacctttgggccgggcgtgttgaacccttcggacccaggcagatctccccatctccgggacgggacccggcgcgcacgcgacccgacgcgacgacgcaagcagcagtggtgggtaagggtggactcgactccggccgtcgcgatggcggccgccggctggccgctctcctcctccgtcgccgacctcctccccgcctccctctcgctcaccctcctcctcgcctccctcgtacaccctctccccccctctgcccccttcctcctccgcctcctcgcgctacttatcccttctccccgcccctcccgtgcgcaggtggtcgtcgtggtgctggccgccgccgccttcttcttcgagcacatccgcaagatcggatgcacgcactcgtaagcgattctgtgactccccccaatcctgtcgttgtttttgctcatggcgatctgcgtgcgtgcggttgtttgactggtgtgttgtttctggatctcggccgcctgcaggctggagaggactgaagtctcggccgctttcttcgaggaccccaactcgctcaacaaggtaagcgagggattctgtttacccacttcaaactgagtatccttttcccgctatttgtttccggttgctcggactgtgaatgttgtgcgcgttaggtgtttgttcatttgctcctgtaaactgtgctaggttcgttgcccttcaatttacgaccctgctgagaagtacatttcgttgatcatccccgcttataacgaggagcaccggcttcctgaggctctcacagaaacactcaagtaaggctctgatatgagcatttcctgttcctgttgctccgttgtttggagtatctttgaatgatacagtggctgtgttgttctggtcattgctctgttatgttaatctctgtgttcttttgtttctctggtagctacctgaaacaacgttcagctgtcgagaagtcatttacttacgaggtatgtcagggcagaacatgctaacagctttatttgacacagtaatacatcagggaagaaaacgttaggctgattttgcaagcaaaactaatcaagcgtaaatgagaaagtatgcatttcaccatcatgagatatgttagcgagctggttaatcacttcgccacaatggtgacaccgtggcagtccattagtcttgcaatagtaactgtttctatgtcatatattcactttttacctgagatatatcaatatcttgtttggaatgacatttgaatcactgaatttgttagctaggaaatgcacagtgtgggagccaaacactattgatccaataaagcatttacctaaactggtgtgtcaggttgctcggaccttaaagataggactttgtatctagggtagtgatgttttgttgataccgcttgctctttagatcaattgagaccataagctatgatgcctttgcaatgcttctgaacatatcagccatatctctcaattatatcatgctctttaaacacatattatgtataactcttattaacatttgcactattatatactgcataacaccataaccagatatttggcatattattattgcagaaccttttattcataaatcctgcttaaattagctaacattggaaatcggagaactgatttgcttttactgaatttcataaaggtcttgatcgttgatgatggaagtactgatcatacatcaaaagttgccttcgagtttgtaaggaaacataaaattgataatgttagagttcttctacttgggagaaaccatggtaaaggcgaagcagtcagaaaagtgagtaaatgtaccagtcgatcccccccccccccccaactcccctcactagttcaataaacacacccaccctcacccaaactagttcaatgaaataagcactgattaattctttcccatctgtggaaaaattgtacagggcatgctccattcacgtggtgaactgttactcatgcttgatgctgatggggcaactaaggttactgatttggaaaagcttgaagcccaggtctgtcataagttaaatcaaaacatgttttataaagttttgttatgcatactttgatcgtgattggtaacatcttggaatcatatcgtgctcctaggttcgcgcattggctaaaaaggctgagtccagcctagcaccatctagcagtccatctcagagactatctgatgctgaaattgctgtttttggttcacgtgctcatctggagaag

SEQ ID NO: 42208 - DNA, 1223 bp, Oryza sativa
tcctgggatcagagacacacaggtatgctttgcaaacataagtcgtaccattaattcatgtggacagttttgctttggtattgtgctatgaactaaattccattttcttattgctaatttagtgtggtttcaagatgtttactcgagctgctgcaaggaaactttttacaaatatcagattgaagaggtacctttgttgttatgttctctaaatattgtcatgcttctgtttatcaaatcctgtcttatttttggcgtgtaaccaggtggtgttttgatgttgagcttgtatacctatgcaagcatctcaggatcccaatggctgaagtatctgtaaactggactgaaatacctggatccaaagtgcgtatgacaagcatcctgcatatggtatttgagctcctgctgatcaaagtaggttatggactgagcatatggaaaatctattcatagaccatatgcacggtacgctgacaatcaccatagcttatcatcactggactgtataccaagcttagtctcacatgtaaaatttttccaagattttcacctagagagaatccatttgtggcgctgagtattccatcatagatttcaacaaagatatagatcacgtgtattgttcctgctgatgaaattctttaatcatttttttagcattttacgaagttgggaagaatcgaaaatttgactacccttcatgtttgatgtttgatttgacggatcgttttgtttttaaaaaattggcttgaagtactatgccttttggatggtctgaatggtgaataatggtaccgatcatataatcactaagtataccatctatatagttaaatcattagctatgtaataaatgaacaatggtgtgcttcaccgtctcggagaagactgtcaagaggttttgttgtctgccatgtaaaggtttgctgagaattacagaatgtgctccagaagccattttgtgaaaggacttgagctgatgttataggctatcagttgtatggcgatgttggtacagattcgactgcctatatacttctgacatcaccaatgcggtttttttagttttcacttaggctgtgtttagatcagtacaaagtttggattttggttgaaattggagatgatgtgactgaaaagttgtgtgtgtatgacaggtacatgtgatggaaaaagttagaagttggatctaaacacagccttagctattcgctccattcctc

SEQ ID NO: 42209 - DNA, 22476 bp, Oryza sativa
  unsure (1)..(22476): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttcatcatttgatatcatttctgttgaaaccaaggagtgcatgcaagcaagtgggaaataatctacaattccacttgcagacatggccagaaatgtcaattattggtgaggagcaatcagccacctgatctttgagccaatcagaagaggaggtgctgaatccaagacacaaaattaatttcacaagggcacattgattgtatgtagtaaatagatcagaggtcaacttaggttcattcatggcaaggataacccagggatcatcgtgttaactgataaggcaggcaacctggcagtgcctgctgaattgttcaagatggtgtgccttaaaaaaaggtcaaattggggtagctctggtgctatcatcagttaagaggtcaacacagcaaacggttcctgaccaaaaggaaccctttctctagaatcatcaagtccaacttagaatcagtctcccatgcacatgcaaattctcaccccccaaatgcatgaacaaaaacacatgcaaaatgtcaaagaaagttgaccaattggtcgattttataaattattaataattgaacaaatcctcatttacatcaacatattataccacgcggccagccctgcgggcgattcatggcgattcagctggatgtgccgagagcccaagccgaatccaaccccccacagtgcttggttgatattgtacagtagcaactgggggaagaggagtagagtagccgcaagaacacctctcagctcaaggaaggcatgggaagaaccccctctatacgttttgtttcactagcctactattgtttctatttacacgcaggatctccaaatcctgccctccaaagagatgacgatgacagatacatcgtcatggtatcgccgacgatcaccatgtggtatctcgatcagttcatgaaagtccattcctgcaacagcaatagatgtaaaaatgaggtcaggtcattgactgacaaaattcagcatcatgttctagaagttcaaaagttactgcaaaatgaggtcgacacatttgacatgtatggtgacttctttgcaaacacacctgctttgttggcagcacggaaaagaacttcctccacaagatgttgggcagggtcgccttcaggggttgttgcgatgaacatttcgacctgagcaactgcctcctcgttggtgaaatactggtaaagtccatctgaagataatatcaagaatctatcccttgtgctgagcttatgatgaaaaagggatggattgcatgatatgtatggggaggacccaacgtaatcaattctgaacatctccaggagtgcatcattccacttgggctgttaaaaaagagagagaattgtgagatcaaaatgctaaggaattatgatataaggtgcagacagagagcaaaaacaaatgatgcatgtattgttcgctatggatttgcttgtaaaattaactatttgcaacttccaaccaggctatctgaaaattgtaccgacaactaaatcagtagaaagggctgcctcatgcacttgttcaattctctgtgctgcttaactttgggggatttcttcattgacaaaatatcgcagatcgccatgtctgtctcatcagatagctcactttatgtccaagaaagagacttccctcttgcatagcagcaagatagatttgtgcagttgacaatagagaatagttcttcgcatgggaggagaaacgtaccttccttcaaagccactcaactcactcttttctggccacattttagtactgcacaagcagattctttgtacttggacagaagcaaaagaaacttcattttctcttggagcagcttctcattcaaaattttgaactggctatacacgcggtgactcaagaatttaactaattagttttcatgcgttgaagtttttgcccattgaaattagcatatggtttatgatgtccccgtcagacatggtcagtttcagtgtaggatggtcatatttctcaccccaaagaagtgagaatttagagtggctcactttacttttcaaactttggaccaattagaccagatccagttttcctttttctgacctagtttaattatgaccttaattatgtgtttgactcaggatagcagcaaaactgaccttaattattccgctcctggtataatcaagtttggaccgtatgctttatcatcaatacagatcccaaattcaaggaaggaagtcaggtcacatacttatttcatacattgactaattgtgtcattctgaaattgcatattacttgccaaaaaataaatccacatacgcaactttgaaacttggccaatggcaaaacgcttaatcataacggagcacaaaaaaatgtctttctgcaaaaaaaaagggcatattcaaatgaactaacctgtttcaaaaacccagcaccaaatgctctggtcaccttcagcgagcccttcacgcgatccttggagatggcagatggatcatcaggatgctcgtttcgtattctgattacttcctgtattcaggcagaaacaaatatgagacttaagcaacattaagaacagcaattccaataggattgaaccatgatatgagtcgattcaatcacctcttccactgaagtgctgtgatccgacgtgagctgcacggccgacaagcatggcgggcaatccccgactgatccatcgaatgaaccctggctgatctgctcgagatcgacgctgtccattgttgccaacacagcccggctatcgccaacattcatgatgtacatgtcctctcctttcatgagcatggcaagaacacaagagcccatgagcgcaagctcagggaactcgccgaccatcttgtcggcgatgtccaggtaagcctcctcggtcctgtgcagcgcacgggtcagcgccttgagcacggcgacgtggtcgttctcgctgttgcaacgaagacgctgctgcgttggtggcttcaggttggagcaatcccgctcctgctcccactcgcacttccaccgccgctggtcgtcgtcggcgccacgcggcggtcttgagcggcgggtgcggcggcggcgaccccactggtcttggttatctgaggccgtggtgcttggggctgagccgggttggtcggggcgctggtcgtgctgcacgttctgctcccgctgatcccagaggaggccgcggagctcgcggtggacggcggcgtagaggttggataccaggaagtcggtggcgtcggggccgttgaacccatcgtagatgccgacgaacacccagcctcgctcctccgacacgacgacgtggacgcggtcctcgccggctttcccctgcgcccactgcagaccacagggatcgcccccacaggcggcgacggcggcggcggcggcgtccggcgagcctagatccgcagaatcctgaaacttctcggtgcgcgcgaggagcgcgcgggtgaaattgcggaggcggcggccaccgtgggagaggctccggcggagcgcagggacggcgccacccatacgaccggaggtggcggtgccagggagagggcccgagaggagcgcggcgtcgagtggcccagattggaaccccctctccaagggccccgacatgaacccgccggagaagggcgcggagatcggcccggacgagaacctcggcaccggctgcagcggcacagcagcgaacgactccgagctctcaaaccccgacgacgcggtggcggacgccgacgactcctccggcatcagcagcagcacggacgtggacagcggcgtggatacgttggcactgagcgccgccccggatatcgcccggaacgtggtcgcctccccctccgccgccgcggccgccttcgcgtcagccaccaaatcatccgcggagaagggaaccacgaacttgtcggggcggacgtagcagaacgagtggcccaggccctcgtcgtaggccgggtcggaggggagcgcggcgggggcgacgtggcggccgcctcggccgccggcgccgccgccgcagcagaagcaggcgagggagttgcccatggctgggaagcgtagcggtggagatggagatagagagagaggaggtggggggaggaggagaggtgggtggttataatgcggagagcattaagcacggaggaggaaggaagagagttgacttgcgggggtgcggagtgggtggggttgaaatgccggaatattttaagagggactaggcgactacctatatattggacatactcctgctctctctctctctccctcccaaaatataatacacattttaagcaaagctataatttttcgtatccagttttaattatctgttttatttaaaaatatttggaaaaatttaaaaatagaagtcatacataaagtattattcatgttttatcatgtaataaaaataaaaatattaatcataaaaaaaattcaaataagacgggagattaaagttgggtatagaaactcatggtcgtatatatttgagatggaggtagaatctatatgggctgtctgtccaaattcgcaatacgaaatgttctatccgattatctgatttcattatattttgggacggagaaagtatgtaaatataacaaaattgatatgtaattatagcgtaacttatatgtaacttttaaaaattcctaggtgatatattttctttgtgaaaatgaatgtataatggtgctaaggtcgcattcatttctccaataagagttagatgaagataaagattttttgaggcaaagcttttcaaactgctaaacggtgtgtttcgtgcgaaaactttctaaataaaagttgctctataatatcatattaatatatttttgaagtgtgtaataattaaaactcaaccaagcatacgttaataccacctcgttttgcataaaaaaaatttaatcttcatctttatctttagaagaaaagaacaccacctaaaattccctcgcatgtgtgggttgtgattattttctctcttgcacgaattacattatattatagttatatacatgtcacaatataattacactatgattgtagtattgtacaatatttacgtctattattttttttaaaaaaaatttgcctataagtatatactccatccatttcacaatgtaagtcattctagcattttccatattcatattgatgttaatgaatttagatagatatatatgtttagattcattagcatcaatattaatgtgagaaatattaaaatgacttacatctagatttattagcattaatattaatgtgggaaatactagaatgacttacatttgtgaaacggaagtagcaaaaatcgttttaaggtggtttccacctctaggcgttgacccgtgtgggcgtccgagcccgccaaaggcgaggcgaggcagcagccgcgggacctgggaggtgggtccgggcgggcgcctcggtgcgggaaacctgatgcgaccttctgcgccccgcgtccgtgtggcccacactgtgaaggaggcgcaccttgtcttgccagttgccattgcttggatcggttggtttcctttgtcaaccatcgagaaagaaaatagcatgttcttctttttcaccttttgttttctataccttttaaaatagtcttttatgttgtaataataatgcagatagtttgactaaatttgtacgcaccaatggaaagcaatttggccactatattatgtttatatatggatgtaattttgttttattttcttcttcaccgtgatgcattcatgtgctttgacaaatcttataatatagaaaatataaaggtgcctataagaaaaggtgaagaagagcttaccgtaaatttatattgataaaaaaaatcaactttacagcttaaaaaaggattttatttttctttcgcagaaaggagtacgtttgagtagaaacaatctatatatagctatagtttgtgaaagtaataaatttatagaagcaaaacctagcaatcgaagtaatttgaaaaaaaataaaaattgttttgtaaaattacatatagtaacaaaactaagaatttagcgtcaaaattattataatatcgtaaaaccacatattaacaccaaaatagtatcatgaaaaatacatattctagagtatttctatctatatagcattgtacaccctctgtcatataaaaatgattttctgactacgaatttagacataggaataaaaacgaatttctatcatgaatctgtacatactctatctacatattgctagaaggttttttttaagagacgaagggagtatgtcccagggaattattaactcaataggctacagtgatcatgtggcaacttaaatttatagttttgttacaaaacgacaataatccataatgtagctatagttttgtgaaatcgcaactcgcaagtagcagtattacgttgcgccatttacaccccattactccccaacggcacaagttgctcggcgccggagacatcagcctggagaacgggtcgtagtggcctactgtacgtgggcgtcgcgactcgcgagccgcggcgccgaagaggactcctccatgcgtgcgtagccgccactggacgcgttccccgtttaccccaagtccccaaccccaacgcccgcgtagccgatcgtcgcgccgcgccgcgcccgcggccacgcactcacgcggtgtccatccgcgcgcgccccccacgctgccacgcagtttgggtgaccgaatcgatcggccgtgcagccgcagccgcgggtgtggctggggtgtactagactgtagagagccgtggcgccctcggttcacgtgggcgccgcgccaacgcgagcatcccgactgctcctgcttcagcacggcgcgcgcgtgggcgtgggccgtggctcacctcacggctcacgcccactgctgctgctgctgctgctgctgctacgtaacgtacgtacgctttctgctatccacacaccgcaagtcagcgggacggttggatctttttttcccccctcttctcctagtactaattgtcggggtcagtgatgatgaggtccacaatagatgatttcaggatccgttgtttgagtcggtcagagtcttctcgcacgtacgctcgcgtgtggccggcgttggatgatcggaggcttttggaactcgccggttggttgctgctcgatatatatcaaatctaacgctactagtaccagcggtagtagtagttgcgtaagtagtactccctccgtccttaaaaaaaaaagacaaaccctgatttccgtatccaacgtttaaccgtccatcttatttaaaaaaaattatgaaaaaaattaaaaaaataagtcatgcataaagtattaatcatgttttatcatctaacaacaatgaaaatactaattataaaaaattttcatataagacggacagtcaaacgttggcacagaaaactgcggtttatcttttttttaaggacggagggagtattgacttcgatctcaacagtccagctgcgcttttccatgtgcccattttcaacctgctttccatttttggtagctacgcacagtcacagcacgctgtatcatatcgctgtgtgccagtcgcaagctgcactagtcacacactggtgctacttgctgcacgtgcttttctcaggtccaattggatccctaccgcagtaccgctttattgccaacgatctggtcctgcaaattccaaaggcatccgatccgagtcacctaagctctggccgaatgcgtttgtttcgttgctgctccgtctcgctttcgctcagcacgctctctcgctggggagtggggaaataggcaagaatttgacgagcagatgcgtgacaaacaccggcagaaacgcgccggcgcaaacgacgacaggtgaccaccaacgcgttgtgcgtacgagtagatggcaacgcgaacgctttgcttgcttgcttacttgcttgcccgggtcaaaggggaaacacaacagtgtgcggggacaaaacgcgcgagacgacatttcgttttgccctcctttcgtggcacgtactcctactactgatgatcaatcactggatcacgatgggggtgagtgtggaataacctcgagttttttctgtggcccatgacgcgaccgcgttcgtgtggtttccgagccgtggccggcgccggattaccttttcgtattaattattcaaactcggtaaaccgagataggtaccggttgcatgacgctttgtatttggagaagtcaacatgacgatcacacgtactccgtatttttgtaccatgagatctcacggaatcgcctcataaattagtttatttcccgtacgtattccaaatatatacccaaaccatgttaaacataattcatgaaattatatacatgcagaacctaatgtgaaaaaaaatggttttagttggaattattattaatggtcagtatttcttttcgtaagatttgtagaagcaaaattattaatgtgttcatgcatgcatgcgtgcgtagagtagacaagagccatagacaaattcagtggtgcaggtgcaaagacagatttgcagagcaaggcatggtggtcgtgtgtgcgacggaggcagcttttgctgccctgcatcacgggaaagcaagcaagcaagcaaccggagcgcaacaacaaaaaatggactgggaaacgacgcaccgccgctggcaattttcgtccaattctccgaccgcaggccgctcccaaccgttcgtgcacggcgatcaagtccgttgccctcaacaacatgacagctttggtctttggcgactctgtatagcggtaagcgcgatagagaattcttatttttaatatactccgtctttgtaaatacgctaggacaagattttattaaaagtttgaaactttgatgatgatcagtgcacgtgtgtttcaaagcctgtgtttgtattatgttttaaaaaatataataaatatttggtattagatggtgtcttttaagctaaatctatatcgaaccatattttttccactaactaagcatttaaaaattgatggtggtttaaattttaaacatttgactaaatttaatcataaacgttaaatatttatgatagtgtttaaggatgcatcttttgtagagtgacagtcattttgacactttctagtgctagtaactgttagtaaggctgttaaattaaacccaatcaggtctctaagtacgatcataagatcatatattctatactaatatctagaattgtagaattaggacacttaattagaagagtagaatcctaaaatggtataacataattgacattttgacaagattaattgctagtatctctcgatacctatacggccatattgcccatatatacctcttacaaagaatctgattcgggtctatggctaagatgagtgttctggaccatatgagttaacatatggagcagcaatgggacccgtctctcgtcttgatcgttgacttgtaaaaacatatactcctactacagttgtcgtggggatcagctgggattgaatatatgcatgcatggatggacttttaggtcaccccctttcccggtcgccatcacttgttccccaacattcaactaccccatggctcaaattcatggaaaacaaagggagagctcaccatcaaactagctatacacaagaaaatactaagaacatatggttccaatttgagctagcttgctgttccttgttttggcttttgtttatctatccagctgacaggagacaagtaaactgcatgagtaatttacagctcaagatagcaaggcagatggacagtcacattcagctagctgcgctgttaattacttgctttgacaaagggcagaattttttttaggcagccggtggagattaaaaagctgtggtcagcaaaggtagtaaaaaaaaaacattaccatttcgctttcatgcatgcatgtgccccaaactctgaattcaccgtgaaatattttactagctgtggcgttctttgtcttgttatttgggaggtaaatgaaaaaaaaaaggtggtaatttgttgaataaactgaaggctctttacagtgcaacatcttaacctaacatgtgcaaccccacatgcatgcatgtgcaaacagtacaggaaatgcatcatcacgatgcataatgaagtacatgtaattattcaccttgctatgccctgataaatgtacttagtaattaaccaaaaggctcacttacccttttgatgtcttgcatatgttctgctttaattaattgctttttttctcctggtcaaagaacagatgttggagaccaaccaggcagtttaccaaatcgtggcgtcatgtgtatttctcaactctgtgttaacatgttgataaaattaatacgtcacgtaattagagtcgtacaagaggaaaaaaaaacagagctggtgagatttggtttcattgatctgtttttgttggacgttttgggcttcaacattcaagtggtattcaatacagattaagcagatcgatgtaccgacccagatacgtaaaagattagtttgaattttcatgaaaacgtacgatacaatacagtgcatattatattttcaaatcgttttgactttcttttccaatcattattccttaatatatattaaacgacattgcaattgatctcgagctggtcaccagctcaaaatttgtatctgccataaatcaaatagtttttcttttaccatactgacattataacaagagccgacaagaggcaccaacattttttgttgtacttggtatctttccgatgacctaaaaagaaatacaaatcaaaagttttaaaacaggtgggttacaactaatccaatccaatggattgacagtagcacaagtcaatgccctagtatgtgatggcctcttaaattaattatcaatgcatggttgacgacacccccataattcaaattactaagagcaggatttatttaatttgtttatagtatttcaagtaagaaaaagttaaggtccaagtgtgcacactggtaagcacccactaactccggcctactaatcaaatacttaattgcattttgcatccatcatgctaacatggattaggttgatcctcacgtcggcatgcaaataacaatcatacgggattaaacaaaaaacatattgcttttttttttccaaacaaagccaaggtctacataggcgtgctccctatggattgactcaatagttaatgtatttgctactagtatttattaaattagtttgtagatttgtagtcaaatgtggatcatggagttgcatatttaaatcgtgcgctagcagctgccgtatataaataaacttggttgttgtagtctcaatctttttaataaaaaactttgtctggcaattgtattgatttcaacgtttcactatagctcataaaccaaactgggttactattactaaagaagctataaaaatcgaactggtcggaggaaatacccaaatgtatcttgattgtagttcaatatatacgagtaaatttgtagtagtattttgaaacaacatcatgtgtatatatgacaggcttataatactgtgtactggaaaagctataattggcttgcgtttttagtcagccactgaaattaaatatatggactaatcgtggagtacgaaaatatataattgatgacaccagctgacttattttagtactcattacagtactttgtgatttatgactaggaaagctaatttggtggtacgtacgttgaactcgtgcaagcccacttagacattttggcgttcaacgaccatttcacacacctaaaattaaacgaaaggagaagtgtctgactaatctactactactagcttttgttcaaccagtttgtatatatatgaattcatgtatgcatgcaagcatggtagctagctgaccattctaagtgaggtgcacacaacgagaggtcgagactaaactaaccaattaaagtttgaccctgacataattgcatgcaagatctccaagattaagtcgtcactaagatctgaaattgtcattatgtcaatgtttatgctttcctttccagaaggagcaaagggaaaagcagagcagacaccatcatttcacagttaaacctccagcaagaagcagatcagctgatgatcgagagccggattagtcagagcactagctatacacactctgcctgcaaaaagtcagaactggagaagctttcaggccagcgccaccaaattacggacatgcacagtaggtcaacagataattaagctactaagatcctcctggttttcatgggactgatttgaccgtaaattaaagaaatggatcgatgcatgcgtcggattttgtttttcttacttgcatgttaagtaagcttccagaagtgagggattgacttttgctgctgctacggccgggaaacagctcgatcggtttttttgcatggatgtgtgattatgagttggttgctacggcgaaacggtcgtaacgccccgtgcggtggggaacggcggtgtcacgtctctttccggctttcgccgttgttctcgccgggcgtagcgagagaactgacgatcgatctagagagagttgtagtacgaggggccccttggcttttgacgaagctttgggttggcgtcgtgttactactgtacatggtggtagatggctagcgttcttgcgcttgtgacgtctggatcagcagcgtttcgttctcttgctggttggcgccgtgccccattgtaagaccgtgggttgagtacatcacatcggcgaaaagaggcccatatgtttcgcgtaatctcttccaacggcctacaagaggccttgggacggggtcactttccacgtgctccgttgcggcccatctaaaccaccccggcgtgtgaagcccacaaagaccgcctcccacggcgaggaggctctctgctctccccagcttccacagcagcgggcagcccagcagcagcgattgtactgtgtaacaaaattttttttcctctaatatatcgacgtataatttttttacgcgttcaccaaaaaaatcagcagcagcagcaggaaggaatcacccgtgtccactgcgcgctatgctatgagaaccgtgactccacgtgagggcgtgaggctgtgctcctctgtatccaagaagcttgtgcattgtagtacatccaagaagccgagatgagacagtgctggcgttttttaaataggacagccagatactgtcatactgataaactcaacacgtcgttacgaccattttatttcttgcaggccttagcccgatacaaactatgtgcccagccaatctgcagttgttgtctgcctctgtcccaagagcatcaccgtaaggcgatggaaactagtaagatcaagctcacgtttctctccagaatattacgtacttgttgtgtatatatgaaactagtaagatcaagctcacgtttttctctccagaatataacgtacttgttgtatatatatcgatctctggcgagattgatcactcgacgagtattaacattaacattaccgagagatggcagaacaagcagtcacttccgcggtggtcggccagatcactaaccggacgatatccaccgttgggcggaggctgcaggcgccagctaccgcacacgagaagctgcagcggctggaggtgctgctgctcaggatccggagcgccatcgagagcagctcgctgctccagtggcgccagaagctcagagaagccgtcgaggagggttatcgggcgcttcgcggcttccgatgatgagcagcaaagcagcggcggcggcagcagcagagccggcgtggccaccggcgcatcccttgccgtgttcttcacatggagtgctctctctggcatggcacggcggatgcacagcgccatgaaggcgctcttcgcgagcgaccaagacatggaaaagctgaatggatcgttggagaggttgggggagctgtctccagatatccaagagtttatactggaggtctcaccgaagctggagaagagacctagcaaacggatgaagcgttctcaacatattgagttcgaccgaagaaccaaatgctccaccctgacattgccaattcgaaaactgcaggtatcaactgaaaagacggaggaggagagttctgaacctattgtcatgtcacttcataggctattatccacccagacattgccaatgcaaaatctgaagatatcaactaaaaagacggaggagaccatcacgagtgaggagcttgaaaatacagaggtgctagtggaggatcagaaggagctcgccgaaatgctagaacaagtgctgatctgtatgggcagggctgtcgaggaggcagatgaaagaaacttggacgatttcaaatggctgggacagtgggcggctattctacgggaggctgagcagagaggcaacgtccttgttggcacaatcttcgccggccgtgacggcgatggcaaagctggcagtgagaaagcagatgatctttacggctttgcgcgtactgtggataggttggcattggacatgccatgtttcaacttcttggtggacctttgcccgtggaactaacttgatgcccttgtgtagtgttgtgcaactataaagggacaaaataatggcgatggaacttatatgccttgagtgagttcttaggcccttagctgatgtgaagtagctccatttttttaaaaaaaatgcagggctggcccatttccgccattaaaaatataaatggagggtcggccttatgatgacaccaactatgtctatggcacgcctagtttgtgtcaccaagtccctattaaatccttcaggcggtatggccataagaaacaatctagggttctactgtttttttctgttctggctcgggtattctatctagccgagccattcattcctttctatgaaagaaagataaggggacaaaacaaaaaaaacaaataaagaaacaaacgtattcaatacgcaaaagaaaagagagagaggaaagcaaaaggagagagagggattcgaaccctcgatagttcctagaactatannnnnnnnnnnnnnnnnnnnnnnnnnnnnnnnnnnnntctctccacagcctaatccttattttattcctacaaatagaacatagccatacgaaatgactcactaacctctagaaacatctcgaatacaagtcccttttcgatatatttctgtatactgtatccatgtatacaggatccgctatatccgcttgtgaaataaagcataaaaccccctcaaccccatatccaaataaaaaaagtggtgagtaataagttttaaagagaagaatcaatggattcatgattaaacccctcttacttcttgtattttattacaattttgattaagtgagggatcaaatataatatgtagtcaactttatttgatggtaacttggaggattagaaatatgactattgctttccaattagctgtttttgcattaattgtgacttcctcagtcttagtcattagtgtaccccttgtatttgcttctcctgatggttggtcaaacaataaaaacgttgtattttccggtacatcattatggattggactggtctttctggtagctattctaaattctctcatttcttaaatgtgtttagtatttagtagcccaatacaaaataaaaaagggccgtttattcggattgtgagacgcattaaaatgcaatttgcaccccgaattgattgacagacaattaaattaataaaaagaaaactcaaatagaaaatgaaacggtcgacccagacatagacggtcgacccaggcggcaaaacatctccttgccgaggagaggatacgggttcgattcccgccgctccatcaccaccgcagtgaccgccgtggtcgcagacagggcggtgtccaagattctcaagaacttcaaccagcaaacggccaccgccgagaagctccagcggctggagatgctgctgatcaaaatccacagcacgatcgaggtgtcagagaagcgcgccatcaagagcgccgcgttgatccagtggcaggacaagctcaaagaagccgcctcccgtggtgaggaggttctccatagcttccagcagcgggaagcagacgtcgacgaagccactggtcagaacgccagcgaccaccagcagcagcaggaggaaggcagcagtagcagttctgtgcctgctactgctttgtccttcaaaaggaaggccctatcaggcatggcacagcgcgtcatcaccatagccatcgcgctcttctccagtgacgaggaagtgaagaagctgaacggcgccgtggaggcgctggagaaagagtcggcgaacatcggggagttcatagcgttgctccagctagaggcctcgccgaatccaaagcggcgccgtagccaaatgtcctcaaacaacatggaagggttgtcatttaggttgcaggaaggtgatgccaacacacgattccttcatcagcattccgcctggcggcgtcgaaagaattttgtgcaacaaatcgagcacaactcgcagatcgccacagccccagatgaaaaggccgcccttgcccataatttcttctctgaagtcggctctgtcagtcatcgtgagttttcggtggatcttgactactttgagccaagggggcagcagctctctgacttggaggaaccgttcactgtggatgaggtgtggaaggcaatcgctgacagccctcgtgacaacgccccggggccggatggtttttctggtcagttctattactgctgttgggacatcattaaggaggacattatggcggctttgaatcaacttcatcgaatggatgggtccagccttggtaaggttaacaaggctttcatcaccttactgcctaagaggtcggatgccaggaagctcaaggactttcggcccataagtctggtacatagctttgtgaagcttttcacaaaagttctctctcgccgccttgcgccgaagttggatgcattggtcgctaaaaaccagagtgcgtttgtgaagaaacgttgcatccaggacaatttcatgctagtgcggcaatcagctaaacgcttgcatgatcgaaggactccatcggcgctgctgaagcttgatactgcccaagctttcgattccatttcatggcaattcattttggaagttttggagcacaaaggcttcggccttcggtggcgctcatggattgccatgttgtttcgaacaactagctcgagggtcttaatcaatggtgagccaggctgcccaattttgcatcggcgaggcgtccgtcagggagatccaatttccccgatgatttttatcttagccatgaatgtgctgagttccatcttctccaaggctgaggttgaaggtttgctgcagccgctagggattcctttttgtgtatccctctatgctgatgatgtggtcgcatttatacggccagctgtggatgagattcgcacagccatgcaaattcttgccatttttggagaagtgtctggtcttcgaacaaattttgctaaatgttcggcgctccaatccagtgcaatgagacggatcttcaaactcttcatgatgagttgccatgtcacgtcgcttcctttccttgcacatacctaggttgcctttgtccatcttccgcctgaagaaggaagacctgcagccgctggttgacaaaatcgcgcgccgtttgccttcttggatgtctcacttgatgacgcctattggccgggctaccatggtgaacgttgtactgagctcaattcccgtttacctgctcatggccatcaatgcaccgaagtgggttatcaaagggattgacaagatctgccgcggctttctttgggctggcaaagcttctgcaaacggcggcgtctgtcgggtcgtctgggctcaagtttgctcgcccaaggagtatggtggtttggggatccccgatctagagaggttggaaatcgctctgaggttgagatggctctggcagcagagaacttcaccggaaaagccgcggcaagggcttaatattccggtctcgcagaagaagcgcaatctagtatcgatttccacgtatgcttggtgggagatgggaattcggtgttgttctgggaggattgctggctgcagggttcctccattcggtcgctggcgttggctgtctatgcagccgtccctgctcgtctccggaatcatcgcacggtggccgaggcaataactgacaaaagatggatccaggacatcagttcggtgttgggtactcaagcgatcctggaatattttaagctttgggattgccttcggtcagtgtagctttccgaagaaccggtctctatcttagcggtgggagacctcaggagaatactcttcccgctcggctttatcgtgttctcttttttggtagaactcatctccagcacaagccaatttagcaatctttggcgcccccttgccgtctctacttcctttggttggtcgcccttaaccgttgctggatagcggaccgcctccggagctgtggtttgttgcactcagatcgatgtgttctttgtgatcaatgcgaagagatgattgatcatctcttggtcgcatgcccggagtcgcggctactgtggtgggttgcgctcagagctatcgggcattcggagtgcttaccgctcaatgaacactctttattttcatggttgtgcgactgtcgtaagaagatggtcaaggaacatcgccgaggtttcaacaccatcgcaacgttggttgcatggacgatctggaaggaaaaaaaaacaatgtcttcaaccagaagagcaaaacttgggcggaggttgcaagggttataacggatgaagcggagctgtggcggcttagctagagctgcaatccctgttttggtagcccatgttagtggagaagggtcgcaaattttagtagaagattaggcttttggtttttggttctcctcctgtaccctgtccctttcgctttgtttttttcgtccgctttgtacatatatttatttcttcttaatataaagatatgctcctcgcgtattaaaaaaagggggggtgttgtcatttaacgacatggaagtgttgtcatttgataattatgactcagtcgctcaggtagacggcgtttccctacctgaaggagcagattcctggaaactccatgaactagaggaaagactccaacaagccttggttgatatcggcgagtccgtcgagatcgtgccagtacttgacataagaagaatggaatggctggctcgctgggccgatgtcctcaaggaagctgagcgacagggttacggcgtcctcgatgcagtcagagccatcgccgacaaagagattatggaatgtgaccttgaaatagatcaactccgcagctttgtgcattccatggagagcttggcggaagatatggaatattttgacagcctggttaacttgtgtccgcagaaaatatagatttgaacgcatcaataatagaccaccatatatcaaatggcaatcttttgtcactatctgtctttagcttgtcaccaattaccatctgtctttgttaaaccgaaatagtgaaatacttcatttatctgtcactggctctctgcaattctaccatgttcttctctcagttcttcaaatgatcttacatctcatttccgaccagcaaccaccgaactctatcccaccaagctcacatgctgtcctgtttagggcaaaaaataaaaagaaaagttcgtgttcttctgaaatgtgcccaatctagtctcaaaattccacccctccaaacataacgttcttgtctgtcgtaaagtcgtagcactccccttggttttccacaaccttggtcaatcaaagttccatcaccggaattctttgcagcaggaaccatcgttcaagccatggggctaacaccagtcatttattatgctccagatagatcaagatcccattttcatgcatgcggcgggcagaatccataacctcacactgtcgagagatcaaaatttaatgatgcctcaggattgatcgatccaatctattggtgtatgtacaaaagaaaagttcaaccttgataattgatattttctgcaaaatcaagtgaattattgtcagcaaacatggatcaaaattagaaaaacatgaaaacggcaatcagaataaatagtactccatccatcccaaaatataaggattcgtaatactaggatatgtcacatccacccaaaatcccttatattttgggacggtgggagtatgaggtaggaaccctctgcacttgaagatggcctaatttgttttttgcaattaacttgtgctcatcatgaaatttccaaattttcgtatgaagcttatgcatattttgaaataagacaaaacttgtgtatagcctaaataagatgaagacttgtgcatcagaaatgtgggcaccgtatattcagatagactgtcaaaatccagaacacactttctgagtgtgttactgtataaaaatgttggactgctcacagattagcatcatagtgatttttgtttgtgtgattagcatcatagtgatttttgtttatgtttctctaggccttttagaacaacctttgatgcaagaactggggatgtgcatacggttcatttgcataaaagttatgaattatactgacagctgatccaaaaagaaaagcatgtatcaagaagactcagtttacaagaagaagtacctgaattatattccaattctgattccatcgtccttgaataagcatcacatttttctgtggaaaacctttgtgttgcaatgcagatgtgtgagacttgcaggagctccctggaaaattcattagcatcttgtccaaaacagaataaccttgtaaaacacaatttcatcaccagaaatccttgcatgagcaggaaccatccttgaagcgatggaaacgactccggtcacgcactacaatctcccgtcgataaacctgtgaaatgcactttatagctgcatgacaatccgagcacacacgtaggttcttaaccactcggacctgtgttccaggaggagttctcagtagtgcaaatgcaattgccagcttctcactgtgccactgaagtgcaccctccttatcttcctcatcaagatcaagtaagacctctgaggtagctgcaatgtgcccaacgcgccttagctctcttgccatttcctcaaccatccggtatatatccttgtactgcgggtgagactcatctccggctatgaactcatggacctctccatcaagctcaactatactacagcctggcactttcttgattcctctcttgctcatctctctccttatctctgacttctccttccatctctgtgttagtgcaaagacattcgagagcatgatatagttggcctcatgggccgggtactcatgaagaaggctccttgtgatgctttcacctagctcaaggcggccatgcgcacgacaagcagaaacaagtgatcgccatattactgggttcggttgtataggcattgtacggacgaattccatcgcccgctcaaccatgccagcccgaccaaacatgtcaaccatgcaaccatagtgctcaatcttaggctcaatgccatactccactttcatggcatcaaagtagccacagccttcatccaccataccagcatggctgcaagctgtgagcaccccaatgaaggcaacatcatcaggtggaacacctgcaaccttcatctcttcaaacactcgcacagcctccttcccacgaccctccatcgcaagcgcatcaatcaccgatgtccatgaaacaacactccgctgctgcatcccctcaaacacagccaccgccccatccacatctccacacttagcaagcgtgtcgatcagtgcattgcacagtgtcacagacttcccgatcccctctctctccacaaagcgtcggacccatcgagccagctcaagtgcacccaaatctgtggccgccgccaggactccaatcactgtcacctcatcggcctgtaccccattggcctgcatctccctgaagagatcgacagcatcactcgacagccccccacgcacatacccgccgatcatcgcactccaggtaacggcactctccttgggcattctatcaaacacattccgcgcgtcgccaaggaacccgccgccaaagcaggagtacatgtgtatgagagtattggagacgtactgatccgtcgcgaacccgaacttgagagcggcggcgtgggcctggaggccgacgtccggggatcccgggagcgcggcgcacgccttgaggaggaaggggaaggtgaacttgttgggaacgacggcgccgcggagcatgagggggaagaaggcggcggcgcggaggcggagggagtggatcggggaggtggcgtgggcgcggatgaaggtgtt

SEQ ID NO: 42210 - DNA, 1319 bp, Oryza sativa
aggcgaccgactggaggagggacgtgggcgtcgaggaggccgcgaggaggcggaggcaatgctgctcggccgcgcgcgccgcggacggcgagaggcgcggagccgacggggaggagactggaggaggcatttgctcgaacacatggcgcgccgaggcagggcggctcggttttggtctttcagaatacgttttcgcaaatcagcccactcgtctcttggatactatagtactcctgtatcggatgccattagggtataattgattaaatgtttattattataaacttgaaaataaatttattagatattttagaaaaacttatatataaagtttttgcacgaaacatactatttaatattttgaaaaacatgataatagaaaccaaggtagaatctactgtacatctcaataagaaaacaacggggccttctttgcaaaatattagtatgcttttacatcaactgttatttagaccgagtttagttccaaaatttttcttcaaacttccaacttttccatcacatcaaaactttcctacacacataaatttccaacttttccgtcacatcgtttcaatttcaacggaacttccaattttggcatgaactgaacacacccttagtactccaatctttccgacttgtataatacctttagttaactgtaatagatttattttattaattaatgttttaacttcctagatggtatacttaatgataatggtatggtattaagctatttagagcaggtacatagcatactataaggcagctataaacatattttaaagagataaaagaagagatgcttttgttgccagctgagatattcagctgatacatgataccgtactgtaatatgaagaatctgagagagtataatctaccagaaagtccggtagacctgtagagtgtaaatgttcagtcatctataatttattgcaactcaaatactaatgaattgaagaggaatggagcgaatagctaaggctgtgtttagatccaacttctaactttttccatcacatgtacctgtcatacacacacaacttttcagtcacatcatctccaatttcaaccaaaatccaaactttgtactgatctaaacacagcctaagtgaaaactaaaaaaaccgcattggtgatgtcagaagtatataggcagtcgaatctgtaccaacatcgccatacaactgatagcctataacatcagctcaagtcctttcacaaaatggcttctggagcacattctgtaattctcagcaaacctttacatggcagacaacaaaacctcttgacagtcttctccgagacgg

SEQ ID NO: 42211 - DNA, 1257 bp, Oryza sativa
  unsure (1)..(1257): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattatgggtgatgcctttgatggttcatgccataggctatggtgtttgtagatgcaagcagctgtgactgctggtgctaggatcatagcactaataactcattcttaaaatatgtataggagtagcaatcttatattgaataggatatatcttactattgcgaatctgtaaagtacgtgttatatttcctccgtctcatattaagttttttttagttcattttatttgtcctaaaataattttatttttagagtaattattgcattggagtttataaaaagcagtgaataattgtattggagtagataaaaaaatgaatagttgtattaggatttaatagagtatggatattctattttttttcttttgtattggcatgtgtgggatgtgtgaaaaatgctgaatttattttgggatgtaggtagtatatttggagacagaaggagcatgtaaggatcataatttctcgtgtagagcaaaaggacgttcggattgttgtgatccaagccagattattaagcaaatcggtaaccagaaacaaataattttaatttggatttaaaaattgaattcatattcttccggaccaattttgtttattgttagtagttcctagtaaggagtagtaatacgacgttatatagggacctgtccggtttgtcaagccgtttgcttcatgcattgatactgaggtactccgactagataggttgttggcttgttggtcgcagagcagtagatgtcagaatgtcaagtaccgcggcagcgtagtgactaggagttcttgactgagagatcgagagggcatcccggtaacaagaaatgagagaaagatggaaagaggtcctagctatgcacgtactactacgtactctagtctagcaaagatgctgggactactgtggtaaatagtgccactcgtagtgttcaagttttgttcaaagttttaggtataacatttactacttttacaggtggaaataaacacctgatatatcaaatgctcttgtctaaaaacatatatccaacgttgaaaatgatgccaatctaggctgtgggaaaccaatttcttatatgggagaaattataatagtgatg

SEQ ID NO: 42212 - DNA, 18877 bp, Oryza sativa
ctttccctacacgtagtaagtctgttctgtttttgtacttcctccatcctataatgtaacaatctagtatgggataagaccttatcctaatacaatgtatctagacatgtcctaggttgggtctcagattactaaattttatgacagagatagtaactatttaaactcatgtttctcaattactctatctaattatatagacttgctcgttaaaacctgggtacgtggtaccgaggttgagctaccgtttatactactacgatggtgcatcccgaatagcaagagtacacgtgacagtccatccgggcggtgctgaggcggagcccgggcgcccacagacccaaagctaggacggacgaacggtaaagcgaagaagcaaagcaaaggccccgtccctccctggctgcagtgtagtgtagtgcagtgcagaccaagataagggcaagggcggcccctccccccctcgtgccgccaccaaaaggagaagacgcgagaagacaagcaatcgaatcgaatccaagcgcgaaaacccacggccgcccccctcccccgatcagggtcccccgttcggtcggctaaggtttgctactaaaaacatgtgtaattttttgcccctctgcttacggagaaacacgcgatgacgccgcgcttttataaccgcgcgtccaccacgattccccctttactacgttctctccattccatctccccccaatcgctcgggcgcaatgcgcagcagcagcagcaaggccacacccacaacctcccctgcttttcgcgtcctctgctctcctcctaggttagcagcggctttgccaacgagatagataggcaaaagagaaagtacttgcatagcccaacaaggcaacagctgctgctaccctctctttcttttctctgcttctccttgctctctcttctcttcctttctttctttctatctcctgcagtgccaagagtccaagacccaacaagggggaggacggaggaggcgaggcagaggcatctcaccgaagggggaagggcgacgccatgtgggacctcaatgactcgccggcggccgaggccgcgccgccgccgctgtcgccgtccgccgacgactccggcgcctcctcgtcctcggccgccgccgtcgtcgagatacccgacgacgccgacgacgactcggccgctgtggttgtcgtcacgcgccagttcttccctccggccgtcccgggcggcggcggcgaccccgcccccgggaacgcgcgcgccgggtggctccgcctggccggagccgccccgccggtcgctgcaacggggccggcggcgtcggcggcggtgtccaagaagagccggcgcgggccgcggtcgcgcagctcgcagtaccgcggcgtcacgttctaccgccgcaccgggcgatgggaatcgcacatatggtaagcatcctcgtctcctcctgctcgttctttccattttcgagagctcaacggaggaagaaggagagagagagaggcaaaggggagcaaaagaagagcagcatggacgggtttggtattggattcgtcttgttttgggcatttcttgcttctgctccttttacctttcatagcaacatcttatcaagttattcttgccatactctctcctctctctctctctctctctctctctcttctcttctctcatcactcaccatcttcttgtcttctctctctcctctcatccttttgtgcaatgcagggattgtggcaagcaggtctatttgggtaagtttcattcatgtccatcttgtccataccccccatacttgggaactgctacaagcggcctccacgattggctcgccaattggagccgttttttctctatgggcgcggtttcgattcctcacaatggctgcctttgtgacgactgaatttgcaggcggatttgacactgctcatgcggcggctcggtaagttggactcaattcctcgtcttccaatcgctgacttctattccctgctcgcccaatcgaatccggcgctgtcaaaattctaatcttttttgttatgttcatttcccaatcgcagggcgtacgatcgggcggcgatcaagttccgcggcgtggaggccgacatcaatttcagcttggaggattacgaggatgacctgaagcaggtgagagcgcgatcgattattattacctgaactttcctttcttttcatgagtcgccacggtttcgttagatcatactactattactgtagctgcaagattaacgggatcattgcagatgagcaacctgaccaaggaggagttcgtccacgtgctccggcggcagagcacggggttcccccggggaagctccaagtacaggggcgtgacgctccacaagtgcgggagatgggaggctcggatgggccaattcctcggcaagaagtatgtcctaatcgatcaccgtttcttcctctttcgttcgatcgttcgttcttgggcaatctcccgtaaatcatcttgtgggtttttggtgcactgcaggtacgtctacttggggctgttcgacaccgaggaggaagctgccaggtaaaattattgggccgcactgtgcgcgcgcgcggccattgttgttgaatgtcgagtgtggctgctgcgccgtttgcgagtttacgcttctgggttagatgggcgagcggtgatggtgattgatgtttcttgtctcttggccacagggcgtacgaccgcgctgccatcaagtgcaatggcaaggatgcggtgacgaacttcgatccaagcatttacgccggggagttcgagccgccgggtgggtgtgtcatgtgtgcgcttactgctcatggctaggctgttcgtttgtgagttgtgactgctcatccggacaaaatctgtcactgttttgcagcagcggccacgggtgatgccgccgagcacaacctggacctctcgcttgggagctcggcgggctccaagaggggcaacgttgacggtggcggggacgacgagatcaccggcggcggtggcggtggcgcgggctccgaccagcgcgtccctatggcgttcgaccttgactggcaaacggcggcggcgaggagcaccaaagctaaggtaaaaaaagaatggggactttgctttccgcatcagccgattgtcttctcatcacgtaataaaaaggcttaaaaattcctcgttttcttgtctagttcgaccagaactcgaaccatccccagatgcctccggtcctgcaggtcacccacctgccattcagtcccaggcatcatcaccaagtgggtagctcactatacaactccactccacttcgctccatttgctgctgaatttctcgcgtttggtttcaccggtatccgtgagctgatgaattcttgatgtctgtgctgctagttcttgagcaatggtgatccggggacagcgggaggcctgtcactgacgatcggcgcaggcatggccgggcactggcctccccagcagcagcaggggtggggcaacgccggcggcatgagctggccgcacccgccgcacccgccgccgccgccgaccaacgccgcggccgccgcaaccgctacagcagctgcagcatcatcacgattccctccctacattgcgacgcaagcctcaacctggctgcagaagaacgggttccattccctgacccggcccacctaagatgatcaaagatttaaaattcaagatcgctgcattcatcgtctcctcgtcgatcgatcatggcaaagatcgatggagagagagaggtgtgtgtcactgacgcagggaaaaactcaatgcagatttaccagcaagaacaagagctggatgctattcttttgctctaccttttttcttctctctttcttcttctctgtttcttgattgggcgagcgagatggagatggatctgatcatgaatgggacacaagtgggcatgtaaatgaggagctccctagaaggcgagagagattggccaagcgtcgcctcaagcagtgtaggagtatctatcttttgccgtttcgctcgctttctttccttcttttctttcaccatggccaacaacgatgactctgggtgtcaacatcacagctcattttgttcggtctcatgttgcatcattcactgcatgatgaccatgattcgggaaaatttgctccatgcacctccgcttggccgacaacacttgccctctagtaagcatccttaaacacccacggtttctactactattcatcgctttataaatcctacggagtgctagctttacgctactactactgtcatgtaatctatcatcatcaaaagagacgatcagattaacatatatgtcaactatttaagctttggctctttgctttccaagaaacgtaactgccgagatgtggagcatatagaagtattcgtccttctagatgttggtactaaagtaatgttctttcttttctccctctaagaagagatgttttatggtgcttggtcttctaaattaaaaaagacatacgactgcgtttggtatcctataccaacaggaatcagatatgtgggccctatctgcaatgcaagaaaagaaaaatcgaactgttccttgcagaatcttcctaataatctcttaatttcatagtgttgggttacttgcacacatatctaacatctcgaagacaagtagacaaccaacagtcatctggacttgttggaattgaattcaaagcgtgattaaatagcaatcttccaaaaagaaaaaaaaatgaatcaatgtatatagacccaccacgtacggttgtgcttgatcatttgataaggtacggatctttaggttgctgttgcttgttgcgaaaacaaaaatgttatcatgagatttcccgaatagaaaagagaaaaagaggaataagcagatgcatgtatctcttttccgctcgcttttttatatccttggagatgctttaaaatgtgttgcctatgcacctccctgaaaaagaagagaagagaatagtgccggggcatagatgcaagtgggcgtaacattttgctagagaaaggggattccttgtttctaatttgggcattgcaataattgaatgtgtgtggggcgagatgagagagagtgaagtgaagtgcagtgcagtgcagggtagcatcagcagcaaccgggcatcaagcaaggcaagcatgtgtatgtatgcgactggttcacaaaagcgagctgggccagccactggctgggccatgaccatgagagccaacctctcgcggtaaaaaacaagttaatgtggtctcatccgatgccgtgtcgctctcctcggctctccgaatcagttcgccccctggagctaagctttaccttagctgcctctcaccggcaaccaaccaggcgagcgcattggccgttttcagtctccctgtggccattagagcaggtacaatagcagactataagccagctgcaaacatattttaaggagataaattaggagagagaagagcagcgggctacagatttgtagccagctgtagcacggactccaagacacagtgtgtctatgataggtgggactaggtattaatagtgtagtatgtaactattatatgaatgagctattaaattagctatagatgaattggagctagtagttggctatactattgaacttgctcttattgctagcaccagatctcatcagtcatcagacgcttggtcactttcacctcacttcgtccacctgttcctcgttcaggacttggtcctggtttttatcgttcgcagtggatgggcagggaaagagcttgtcagaaatcgttttggtgttcgttctagatttcgcttgtgtgtattgatgaacaggggtgcctcctgatggatcccttgagtttccgtgccgtgtgcatgtttgtggcaatctatgaaaaaaaatgcaatgcgatcgagcggtggttcagccggttgctagcatcagatatatgacaaggacaaggcaggattaattggctgcgtgttcagcatcattcttagtaagtagggacgtagtacgtctaaccgaagcaacaatcaggactagtcgtcgtgacttgttcgcaagtgtcttgtagcttttcttgtgtaagctttgctaggggccagctcgcgagggtgccatgcacatgcgttctatgcatttctactagccactataactgttgtgcaatagcagggggaaagaaaattttcctcttgtccccttgcgactcgcggacctgggtctgcatgcagctagaaaacgatcgatggcatatgcatcatgcaggctctcaattaatatgtgtggctacaagaaataatctgcgcaaatggtattgaactcttgatatacccgcgaagaaactcctgtactatatcacatttaggcccacatgatccatgagcttatcctcactaagctcatgacaaaaaacggcatgcataccatacaggcaactaaatctctcttcatcaatggccgttgcaagtggtttccttgcacggtcgatcgagtaaatggataagtgccacaatggatacgtctcggccggcaaggcgtggccgcgtggggtctcggcgcgggcggccgtactcggtttcacgggacgaaactagctgaaaccacccgatggcgcgcgcgcgcgagcgcgtacgtacgagcgtgagaccccacgacgcgcgcgcggggcgtcgctagcgagtagcgagacatgagcagctgcgagtgcgcgcactgtgcgcgcgcggctgcaggccctcctctccccggcaaaaatgcccccctcgggccgcatgatcgatgcttccactcgacggcccgggcgctctcggcatcccctgctgcgtggaactgtgcaacgtagggccccagcgtgccggccaccggaaatatcaagcgagcgcggagctgatcgatcgactcgtacgtcagctgctgaagcacacgcacgagaccagcatgcaacgacgggtcgacgtgcgtgctacatggacgaaggaaaaaggtaagcacaaaggtgcggagaccgggaagcacgcacgcacgcacgcacgcacagggcagcgttacacgcatcggctcatcgctacattgcagctagctatctaggccaatacatgcagccacggccggtagcttaggtaccactactagctagattcactttttgccggtagaatagtcgggagtagtagtggtggatttccctggagggaaggagagaggaggaaggaagggaaggaaggacggccggtcggtcggtggctcgcgtcgtcggtcctgttcacggcctgccccgaccttccccaaagggaaagtgggcaccgacgcgcagctattcaccagcaaaagccgctcccgatcgatcgattggtcgcattgtatatcgtattcttttttttctgccgcgcccccgcccgtccggtccagatctggcgccagtgcgcgatggcgacgtgagactggctccgcacggacgccaccaccaccacctctctcgcgcgtcgcgttgtctcactggctacgacctagcatgcgctccgatgctcttcccatccgtctatcgcccatcgcccgccacgcgccaccgtctcgtgtcgtgttgtgtgttgcctcgatcgaattggtgttgcttgcttggcccggcaggcagtcgacgagcaggggttaaaacggaactgctgatgaagcagaatttccacgaaaatcagctgaagtttggacgttttgatacgagtttaggacggcttgctgtactggagtagttagtagtgctacctagctataggtaaatggaaatcttgcagaaattgacttccacttcacggatagtggaggaagtacacacgctgtacccgcatgcctaattcgtttccatccaatgacctgttatgacgccgtatctatatgatgtatagtactcttgagccataatcaataatgccaagtataattgtccgagcaagcccccttgaaattgtggttccaggccggccgggcggcactaatctcctgtagaaccgtcgtgcaagcttagactttggcaccaccgacgatcgaagaacttgtctttagcacgggcacaagtgcgcgtgagatgaccctgaggcgtacatgggcgacttgtgtgagctgtgaagccgacggcataatcaacacaccgattgtaatgacgcaagaatgggacgtgtgtcgttccaagccgccgccgccgccgccgctttacggatgaaatcatttttctggggcgtatacatatgaccggcacagcacgcgtgcatacggcccgtgcatcacttggattacgtactcaccgtctcaccgatcgacggcgggtgatgcggaccgatcggttgtttacttgttcggctcggcgcgcgcggcatcacgcgtacgacaggcggagacgccgccaccgaggagatcgtcgtcgcggcggcacgggcacggagcccacccgcaacgcgcgacgcggcggtcggcgaggctgttttgcccatgcgcgcccgcgcgattggcccatcaaacccgggacagggccgcaattgcagcatggggcgagcgatgaggacacgtgactccacggatgcggcgggatggaccggtggacccaaaagtctacttagcttggtttggctatgggctggtggtccagcagattggcaccgggccagcctgcatggactggacctggatgttcagctcagccttttactcgaagtaaattcttcttctcttctcaacgggttacttttcttcatattttgcttcagagaaaaggcttgtccgtggtactgcactgcgctgcatggaaccccacttgtcacctctgcgatctgtccaacgaccgttacagcagattgtcaaattagcgtttgactgcatctgcgtggagctaatcgttgaagtaatcagccactgagacactgaccgatccatttcacagatctgttggcttgtggactgtgaattaagattgatgccactgactggtatatgacgctaaatttatcgtgcagcaaatatatgtgtcgctttaggaacatagctggcaatctttcctcctggtggtgcgcaagacagcccgacagatggattgatgaaccgatgtcacactagcttgaggtgtacacttccaacgtaagtagcacaaacaagttgtccgtactttcaatccgctgtcccttgattcatgcatcaaaccattaatacatgtgataagtgccaatcatttaggtgggtaaacctcacaaacgttctaagctgacggtggtcgatgccactgatgcacgccctccttatgggccactgctgcaggtcctatccactctcaggttagttatccaatatccatgtaattaatcactaagtaaaccattgtagtagcggtagtactatatgtgccaacaactagtattcttctgtcatcactgatcccttctctacactattgatgaatgtgctcacgaaaatcattttgtactgtggcaagctggcaatgaactctcctggacaaaaaacaggtaattattgtcataacttgctggaatcacaagatactcctgtacttatggggacaacaggagcagtaatttaatggggagtgcaatgctgctattgcactccattctactcttgtccaacggcaccgccgacacttaaaagccccaaacttaggcaaacactctcgagctaaatcgacttttcatcacagcatcacaggattcaccgcgcatacggatagctaaaatccgagaaagggctaaatttgagccccgggtccacaggccagtgagccaatacgcagcatcagtatccgctggtacatgtgtcattgcaaggatctactaagaaaaaaattacggagtgagaccccagcggttgccccacgggaaaagctgaacgatcgctttgttcttatacccgtgtcacctttttctcccttccatccacctttgtgtccttgtcttcatctccctcctccataggatgccgtcacaggctcacagtgaggcagcggcagttcattcttggtgagctgcagcagagccaccacctgttgtcactggaggtcagttcagttcagctcactcacctcacctcactggctactggctactagtgccttttcttgagttcttgaaaatcttgcttccttctattttactcttgcccttttggatcctttgtcaatgcgcggtgtgagcacactccatcttcttctttgtttgctggctgggaaaacgatggggaaatctagagcttgggctaaggacctaatgggtttggagctagttagatggtgatgtttttggcttaattgcttaactacactaacatgcatgccgattgcagaagccgctcttgctaaactgctggtgctcttagggatcctgtcttcttgtttcaccgtggagcccttttggggttttcgccatcagttctagctgatgtaccattttcacttcctgctgcgcagaaggaagcttattttgagttaatatttctagtgggtttagagttagacttctgagctctgactgcttgtttctgcatctttcttttctctcatcttcttctcttgccctccttgtgaattgtatatttgtctagatttagatgcaatcaatttgcataaatactgtctaaatagatattgtgaggttgggcctcactccagttagcaataaaacttcgttcagaggttttaaggtttactactatattcgagttgtccaaaatagtaaatgccatcaaaatagtaggccctaaagattgtcgagacaaagaagaagcatttcgtttttagaggtgtttaagtacttcagttcttttgacttctgagaggacgtacctgagtcacataaatgcctttgtaccggctggttttaattgcatcggttggtgacgcttctggatcaaagtgataggttcaatgtcaatgggcttccactattggagctgacacagaagctaaaagttgacgggcaattctgttaaaatttgttttaagaaactctatagctgtattttgccaaaaactttaccttttgaagtggtaggtacaaagagagtggaacagaacaagcttcactatatcctttactttcttttctgagctaagcatcgctttctgcattgaaaggaaaatgatattatggttagctgatgaagaaacttattaatcatgaatagtagattagataggggtcaatttctattaacatggcagataattaacagtactttacttctgaacaatcattggttaacaaaatacttgctgagctggcatacgccagccaaagtttttattaagcttagaaagtgttcaaagggatttctttgttttagtccacgagtccaaattcttgtatttttcaaccttgtctcatggaataaaaaactaacgtgtatacgatataattatatgaatttaactgggataaaatacaacttgctttcagattatgttagcttgggatagttttgcaaagatgacttgatacacacaatttcagtttcttaatagaatagcacccaaggaaatgttctgtctgtatccaccttttgtacaatttggtgggaatatatcttactaacatttatatttcttattaatttctagggagtttagaacggcgttgaatattgatagatatttagcatctcactaatggataataaaacatggctttggagaaaaaaatcctcagaaaggacaatttcaacgaagaacaaagccaatatatcagagagggaacaggaggtacatcacttatctctttaacattattaagaagccttatgaattatgatatgttcctatctggattttcaacttttccttccctgcagaaagagaagattgcacggttagagagatccttgcaatgcttaaatgaacagatttcatttgctcaagctgaatgcgtggagaaggatgctattttagctaagcaagcaaaagtggcagaagaagcaatattaggtaaaactccattcacttttcgctaactgatacatgttcttgtttcaaaactagttaagcacatgatttttccatcctagaagagaaatggacagctgcaagtatgcagatacaatggcaattaaagttctgcaattctttttttctgcaattcatgttattggtttacaactattctaggttgggagaaagctgaaggtgaagcaatagctattaagacacaacttgatgatactctagatcagaaagccgcaattgagcaaaggatttgccatcttgatgaggctctaaatgttgccatggtagagagggagttattgataaaggacactgctaaactgatttctcatgagcaagttaaagttgagaggctggaaggagatgtagtagagaaaataaacataattgctagcttggatgccgagaataggaaactttctgaaatgctctcaatgaaagagaaaatgatctcagagttaactgaagcaaagggtgtgatagagtcaaatttcaagaaccttgaggtaaaactagagtcagcggacaaattgaattcttctcttagatatgaggtttgcatgctgcagaagcaacttgatattcgaagtgaggaaaggaaatttaacctgaaatctgctgatgctgcacataaacaacatcttgagaatgtaaaaaagattacaaaacttgaagcagaatgccagagattgcgttcaatggtacgtaaaaggctaccaggccctgctgccattgctaaaatgagaaatgaagttgaaacactgggtaacaatgcagtaataacaaggacgagaaggttcaattctacaacatcattcaactcaggcaatctagtgcagaactcctatgatgcatcacatgaaagttcttcattgcttgcaaggctgcatgcgatggaagacgaaaataagactatgaaggaatctctttctagtaaggatggtgagctccagtattcgcggaccatgcttgctcgcacaacctctaaactttcccaagttgaagctcagcttgaggagttatcaagaggtcgggttgcaacagatttagtaaaatgcagtcctacagtggtcgagaaccctctatcatcaatctccgaggacggttgcaatgaagataatgtcagctgttcaagctcatgggcgtctgccttgatttctgaactggaacacttcaagaaggggaagctgactacaccctcttgtaagagtaccggagtatcagacttgagtttcatggacactttgaagagatagaaaagttagcattggcatgtgatgcgaaacctacagaatcgtatgattcaaggagggagtctagagaatcatcagggaaagagctagtaacagttgatggtcctattgaaacatctgaccaactccgtcagcacaagattgagaaggcagtcctgaagttgatagaacttattgagggtgttgtccagagatcatcaaaagattatagtagcactgttgtgctctctggtggcagtgagggcgaccgctctaacacattgactggctacgttgcacgtgcattcctgtggaaaacgtctgaacttacttctgtactacaaaatttcgtccttgggtgtaacgagcttttgtatgggagtacagatgttgaaagatttgtgcttgaaatcaatatcacactagactggataatcagccactgcttttcactccaagatgtatcagacatgagggagactatcataaagaacttggagataaatagcagttccggactagaagttgttccagtaattaagcacaccggaatccaaacaacagatggcatgtgtgaacccaggacgcctaacaagatgcagatggcgatagtatctgtatcaagcttaatggatattggatataaagctgatgatgactcagaaattttcaggaataaaataccagtctctaaatgtgaggaatcagaaggaaaagcttcaagcctgcgagcagagcttaatgcattgaaagaaacaggaaaaatgatggcacatggtgtcgatggtgaatccacaatcaatgaacttgggaaaccatccaactctgacataaacaagggcaatcaacacggagtgtcttctcttgaatccaagcttcagctagaacggtaattctttcagttatttatttttcatcatttagccttcatagtattatgcctaatgcagttatttctaaacagtttccctgctaaagaaggtccaaaatgtgtttctaggaatgaagatcagcatgtacagatggtaagatccacattattttacttcttgactttgttagtttgttattctggaacttgcctttgtactttgcaatgtattaggtatttcatttggagaatgtgttacatatttgtgctttgtatctgcaagtaatttgctccaccgatgataatcctgtctgtaatatatagcattgcttttgttcttgtaatacaaattgcaggcaagctcaaataaagagcagtcagtcttgcttaatatgttttttgtttctttaattttgagtcaagttgaataggacgtgatataaatttattaccatttagtagtgctacaattttttttattacccattcactctgtttctgttatctgtctttttttttattttgtctggtttttttgggggtaatacttttatgagcccggcgaaaaagtattacctttattatatatatttttttacaactcaatcaactttccccattgtgtctacagcggctggagatctcaacagcatcagagaagcttatcgagtgtcaggagacaatcctaaacctgggaaagcaactgaaagcacttgcatctccaaaggatgcgatccttttcgacaaagtggttcatacaaaaattcagtctgagcgaaaaccccggtctcagtcgctaaacgagatgctagccatggatgatggaggattcgattacctcagctcccccaaaaccaaggagatcatatgcgcggaactaagatcgcggcatgaaagaagttgctctgtcgacaacggaggcgatgattcagtaacatgcagttcccacccaatgccggtggcaccaccaatgaggccctacgatgtgaatggaacttgcaaggatgaggctgctctcaaggtagtagcacttatgccgagcaagcagaaggggaacaccaacttgctgaaaaggattctggcaggaaggagaaaggaagccatgaccaggccaaatgtcgttgcgactgcttagcctccatggatgatagattgccccttctccggtgtaaattaagtgtggccgtggatgatggattgccctcttcaggtgtaaattaagtgtggccgattggcacttgagctgtgtcgttttgatcacgttggtagtaagaactaagaacagtgcaatgtatatgtaacatgcggtatgtattagcgtgatttgcaatgtttccgcaaccattacactgttgcttgagcttatgaatctatctctgctttggtttaccgtgcaagtgaacagaaaactctaattctagttatgatagatctctggaagacggctggtttatcggcgcgtgtttttatgcctatcctggcgtttctgcagtgggatcccacccagaggaggatcagcagtagcagcattgccctagttttggaggattttgaaaagttctgcaccgatacggggagagaaattcagggtttcagagactgacctagtgacctctcatcttgatcgtgtgctcggtgtcgcggacgcggacgagcgcggggggagactctcctgggtcgtcggcagtcgcgcgcgcgtgattccgcggtggtcgggcgccggccgggatttcgtgcgggcgagaggggcggggcgcaggcggcggaggggatcggtttgggagggaagggtttgggcggcggtggtcggcgcctcagcaggggcgctcgatgaatctggaatttttttcgtttttagattttttttaaatatttacagaaataatctatcggcaaaaaaaattacaaaaatagaccctgccgcacacctctagggcggcaagctgacgtggcaaacgggagaggaacgggcggtgacggaggtagggttttttttgcaggaaaacccttgccgccaggggcccgaatgcaaaaaagccagtcggggccggccattttgcaggcggccccttgccgccctctggccgggcggcaggcctcgctgcctataaaaggcctgccgcctagcccccagccatcattcctcccccctcaaatccagtgaaaaaaaaagaagagaggggaggagaagagaagaaggggcgaagccctgccggattcagacgccgatttcaggtaatattcatagatcctatatgtgactattgagttaaatagtgtgtattttttaaaaatttgtttgaataaatgcattatatttttagggttttagttgtactaatctagaagtgcgtattgtagatatcggtaactacgcagatctgctagtttggaatcaatacattaccgttgcattggcttacacaagactttcgtcaatggctagacgccggatcattgtagatatcttggacgggcttcccatggagggagtgccgtaggtagcacccgccagtcgctctgttgttcacgatattgtcgttcataagccgcttttctctgtaagtattgctcagtactttcggatgcgaaataccatcgaccttcttgtaaacaagtggttaggtcgagaacgggattttctgtatcgacccactcgatgtatgcgcaagccgtagtgcgggtttgctgaatagagtagtgttacgaagaataaagcgattgcccatacggaatgaataagcatatgcagataataaaatacctcacggtcatagttagggcacctaaaaaagcgccttccttgaatatcaggattcctcgaagccattagttggcatcgatcaccgtataggcagagaggacgctggcaccaaggtggtagtaggtatacacaaggatcgctacgccagtttggatcctcgacaccccggcgtctagccattgacgaaagcaggtaggatttgtaatgaagcaagtggggaagggagtactgaatgtgacatgtgccggcttctagataccctcttgtgtaagccattgacgaaagtcttgtgtaagccaatgtcatgtgccgtcggctttgcacaagagcaatgacatgtgtcgtcggctttgagaacacactcctgcttcactctcttgcggtagatacccctgcctgccttatcttgacatagtatctcaaacctgtgttgttgggtaccttgcactagagctcgatgttccacaggccatgtcattgttgttatatgtgcacgatacctttcggcgcatgcacgattactttctgccgcaccgatgcagcctcctttattcgcgtgcgatacgagtatttgcccgccatttggcgcatacgaccaatgtaactttcggcgccgatcaggctgtaactttcggcgccaatcaggcgtacccaccataccccaccacgttcacatgtcaggggtatcactcgattttttgcgcctatataagtcgccttaacgagtgagggctcacaatctttcagaactcagttacattcagtactcccttccccacttgcttcattacaaatcctaccggctttcgtcaatggctagatgccggggtgttgagaatccaaactggcgtagcgatccttatgtatacctactaccaccttggtgccagcgtcctctctgccgatgcggtgatcgatgccaactaatggcttcgaggaatcctgatattcgaggaaggcgcttttttaggtgccctaactatgatcgtgaggtattttattcttcgtaacactactctattcggcagacccgcactacggcttgcgcatacatcgagtgggtcgatacagaaaatcccgttctcgacctaaccacttgtttacaagaaggtcgttggtatttcgcatccgaaagtactgagcaatacttacagagaaaagcggcttatgaacgacaatgtcgtgaacaacagagcgactggcgggtgctaactacggcactccctccatgggaagcccgtccaagatgcaggtgtggtgatcgttgtcaggttcttcgttccataaatcctacaacattgggtcgaagattctttgtttgttcaaatattcttgacgatgatttcatggtaagaatattttgattacatgaatccttattttgtcacaacatttactaactttgctcgctttacatctattctttcctcccaggaaccactaaggagatgttaatacagagaatggatagacaccagaagggttctaactccacctagccgtgttgtgcagcttgaactaccagagcaatacagggttactaaagcgcggtttgagagaggagagagatcctcacgtaggggttagctattatcggacaacttggcatattgaaatttctactgtcatgcttccttgtcccattactacatcgtcgttgtgttcaactattgcactacctccctcctagttcgaatctaatatcatctatgtaaccgcaatggaaatagttgtatcatgttcaaattgtactactatttcttcatgttacataattctccttgtttaagtccatataatgtttctacgaccgagactgcgataggcctatattaattatccgagtactaatacgtcgaataaggtacaaaataatacctcacttaacatatgaaattgcgcaacaaccaacttcaatacatttttataacaatattaacaagttttaccaataaatacttctttatttattattaacgtaacatagaaaaatcttttggccgtacttttttacatctgggtccctt

SEQ ID NO: 42213 - DNA, 11760 bp, Oryza sativa
cccagatgcaaaaagtacagccgcaagctttttatgggcggccaaaattgtaattagccccttcccggcctaatcgcaattttggccgacggcgacagacggcgcggtcgacccaccgtctgccacgtcaacttgccgctcaccattggagcggcagggtctatttttgcaattttttttaccgatagattatttctgtaaatattaaaaaaaaatctgaaaacgaaaaaaattcgatgaatctgttgcggacttgcgaggggagaaagcgtggttgggccgtggaggccggtttgattccttctgcttcgcacggtctgaacagagagctcgggccgacaacggtttgatactgggcctaactatgaatcaagttcaaagttcaatactggccaagatttgacctagtttaaagtgcgaggtgatagctaagttcccttcaaaaaatggcactgcgatgcaaaattgttactagtatttaggcctgttcattggttgaagttgggaaattctcccatatacaaggaaaacggaacaatgaattgacacgtaattaattaagcattagttaaataaactttaaaaatcaattgatatgatattttcaaacaactttttataaaataaaatttttaaaaacataatgtttagcagttcgggaaatgtgcgtgcaaaaactgaggagaaacggtcgtaacatggacaatagaaaatatttcatccgtttcaggttataagacgttttaactttggtcaaagtcaaactacttcaatttcgactaagtttatggactaatatagtaatatttataataccaaattagtttcattaactcagtaattgaatatattttcataataaatttgtcttgggttgaaaatgttgttattttttctataaacttagttaaacttgaagctaactttaacaaagtcaaaacgttttataacctgaaacggatgtagtattatggtagcgtagctgcattcttggcacatatttttaaatgccaattttatgattcttggttaaaattttaaatgcaatatagaagttttgagaaagtttcgtataatttaagttgaaagtttcttatgtgttgtagcagggggctaaacatcgcatctcctattggaccgaaatacggtttctaacacccacatgttatgttttaatccaaggcaaatacttctcgagccttcatgataggtgaataggaggcgttcatgtcatcagatgcaaaggttggccagccaggagaatagtgttcgagcacattgcaagagaaacatgctattcgataagggggaaaggaaacttgatgattacaccagcgaacgagaaatattccttaagaagatgtcacgggggttgcttcaaccacttctacaaactatgccaatagtcttagggaccactcaagcacatatctatgttcttaactattttagggcacattatagtaacttctcgtgtgtcattgggtatgtttttagcttcatatgtagagctggaggctatataagctggtcctatcctgtagcaagacacggagcatattcatatcaatataccacatcgtataacaatgattacattttgagttcgtgaattcgtcttgtctttagaataagtgggaaaaggagtattatttttttcctacccctgattcaagaggaaagaagtatccgttggcaacatagctgtgctaattagcaatcgtcgatgcgtttgagatactcgtgaacggtgaaccgtgatatgcctctgcattactcagatggaatggaacacaaataatactcggagaaaatatcaacgatactgctccgatataacgagagttgctcccacacaaaagaactttgtagtacagaagcatggacgaaccccatttcatcacacatcaaggacccaagccgacctacctacaggctacaggctacattctctgcacagtaaaaaggttacttcagcagcgaggggcccctgcgcaagcgagagccagagcggcggtacacgacaggacgggacctgccgctcctgtgcgacacggcccatatgcatcgcatgcatgggcgccaccacctgcatcatcgtcgtcgccatcgtcgtcgttttccaagcgcacgtccatgcgccccgagccggccggccagcccctgcctgcctctcctctgctttgacgaagagaaaggaaagccggccacgctgcccactgtgggagtctcggaaaagagcgacaaaagcggtagtgcaccgcattcgcatgcaccatactctctcccccacccccacaccgcggctggctgatcacggcgcggcccccgcgcgctccggtgactggacacggccgccgccccggcccgggcgcacaccgcacaggcgggcgggggccaatgacgccatgcggtgcatacgctgcgactcgctgaagcctttgcctcccctgctctgctactgctactgctgctaggcagctgcgcgggatcgtcttttgattttctcatcaggcggcgtgcaatgccttggcctcacgcgcgtgtctttctcacacctttcgttcgttcgctcgtaggcgccaccgtacatctgatctcccgttcgttgagagaaattctgcccacgagcgcgcgtggacgatccacaccgcgcgccgtccggcccctgagatcggtcgcttttccgcccctttttttctgggtattttgttgttcaaagagcacaacatcagagcagaggaaactgtttgcctaagcaagggcaactgtttatctataagcaacgcgttccgcgtgtagctgatagcgcggccgtaccgtacgtgcatgtgacaaagtacaacttgcgagtttgcaggttttgcagccctcaatctcagtggtacaaacacaaacacagggtatgtatacttctgtcagactcaccctttgaccacccggatgaatgcggcgactgcgtgcattataaaatattactaatatatacacgagtatggattttcatctcttaagaggatatcttttttttcatatcaactaaataattaaaaaattaacaatataaattaatataaaataaaacactccacagatatgcaaggctaaatccaatttctacaacttgcaacaaaaggacaaattatactgaaaataattaacgcacatttacaattatatttattattttattacaacatgtagaagttaattttgaactggcatattcgtggagtgatatatttcatattaatctgtattattatttttttaatattattttttaagaacaatcaattgactattagatgatatgtaataaaccaatggatattctcttaagggatgaaatcacttttgtatatatacatagaaatttaggttggtcaatgtgtccatctcctgcagtcaagaaaattgttgccaattgtttaaaccccattatctgtacataaggattagttacagtgatatactcctacagaacttcattcagtacgtctttgttgatatatatactcctacagaacttcattcagtatgtctttaggagtagtacgcagcaacagtgccatacaagctctgacacactctaaattattgtcataggaagcatgttttacgcaattatgagtatgatgtcactctagatgtttaaaggaggggacgaggagtgtataaagctggagtcgaagggctgctcaggccatggtataattggctcataaagcctgaaacatgcgtaggctacaagcatagaaatgattttgcagtgtgcaaaatatgtcaggccctgaacttctcactttacgattctatcagaaagtactttgtattgcgtactacgtactggtttttcccttatgaaatggattaattacctgcaaaacactgtattatggattcaactataccttgattaagccgacatacttatgtaaaaccaaacaaagtggccagacctgcttagctgtcgagtgttcagctgttcaatatcacaaacacgcttacacgcggccggattacacgcgcttccttccacgtgttaacagagcttaattaagaatcataatgaaaacctaatgtgccgaactttacagattcacgggtccccctaaaagtctccgatgtcatgatctcaatctatgtccacgatattgttaaattattcacctgatgactttattgtattagtcatttttacttgctactccactgcatgcaaaactgtaaactctgcacatctttaaccattacctgttttcgagtgatgtattcatagaaaaacattaactatgatatatgctattttaattcacttaaaatcactaatatattattctcaaaaaaatcactaatatattaagttgaaatatatccataagactctataaaatcaaatttatgtaaatatttttacagacagatctacttgatgatttttcatatatcaaaaaattatctgaaaaggcgatcctcatactaaaacaaaaagaacgaatatgtgtttttaaataataaaaactgtttaaccgccgcgtgaccagaattatatgtttttgttatcgagggatcagtgatatgttgaaaaaaatattgtttttttactatatatttgttcctagatactagttagtttatctcaataccaatattaattggttttgcataagaaatagtatgcttgatatatatatatatatatatatatatatatatatatgtccatcatatagcgtaataaattaacaaagacacatgccgttttccttaatttttggataacaattttgcttaataaaacgtcgacaagttttccgttagaaaaaaacttgatttttccatcgtctgatttgcattaagatttgtgctagcatggatattccataaaaaaaggactactaaacccgatggataatacatgcaccttttatttcccattaagtaaaaaaggggaggcgggggcatcaataatctccaagtacgctaactagtatttcaattagtttttaatgtatgatattgtttattttgagatatatgtttgatcattcatattattaaaaaacacaactattatttattttattttttccattgaaggtacacgcataacttgtgtttttcgtatctacacataaagataaatggtcaaacatgtatgtccaaaaatcaacgacgccatatttaaaaaaatggagggagtatgaaataatgttatgagattgacgtgacttgttgatatatgaacatgtacttaattgtttgtgtctttgaccttttaaaaatagcaatcacccttacatgcctggatgatgtcatacacatgtgaatatatgataagtacgtatatcaataaccggtggtgaaatgcatgcgcgtgtgtaagccctaattagcatatccaaaccttgcatatatagttgcgtgatctctacaccattcatgcatgtatatgagcaactgctaattccagtttggaactactgattatattcttccgatcaagcacccggccacaacacaatgcattatatgttcaaagcaatccaaacacacgatcgaccaactacaacacaatgcacacgcaaagacgagggaatttaatttccacaatcaacatcaacccggccaatccatgatgataccatgcgtgacagacgatcgacggagtatacatatatgcacatgcagctaattaagcttttccctggggatgcaacgggaagagctccagggtcacttcgtcggtgcagccgccggccgcctccgtcgccaccaccgcgtctccatcgccggcgccgtcaccccacgccttgcaccgccgcttgcagctcgccaatccatcttccacgtccttctccttcttctccggtgcctcctatatacacgcaaaaaatgtctattagccgggcagaaatgtctacagattcatggattattaaaattcggttaatttgctgattaattactttggtttcgttagcggtagcgggcagcaaggaagggtcgagcgtgctgagggtgaggagggcggcgcgcttctgcttctggcgctcgcgggccttgtgattctggaaccagtagaagacgttcttgccctcgatccggccgtacttgccgagctcctccgtgatccgctcgatctggacggagttcggcgtccgcatcccgccgcggtacagcatctccagcacctttatctgctccgccgacgggttccacctcgtcgtccccgccgccggcacctgcacctgcaaaccaaatatatacacgatcatgaacctgatcgatcgatcgatcaagaacaagtagggtttgatgtgtctaacagtgtagttgagcagcttggaagcgtttctggcgcgagggacgacgaagtccggcggcgcgatcatcttcctcggctccggcagcgagatcttgggcgcgagcgggcggaggcatttgaaggagaaagcagggaaggcggccgatccggggatcgacgacggggagatggatggtggcgccggagacgacgaggacgacgacgctttgtgatccaggtaggccacatgcagatggtgaagcctcattgtgtaatgtcgcagtttaactcagagttagctctagctttgtatgggaattggaagcagagatagattagattgttgtagctagggctaagcgagcaagcgtgatcttggcgtgtttttatacggggagaaggcgataaagctaggcagcgagggtttgagtgtgttttgtgtgagatatcgaggtaacagtcgagaattaaaggcgtgccctttcatgggggcgacagggaatgtgtagattggtgatgaaaggcgtcagcattcgtaaaatcgtaatcatcaaattcacgaaaaagcgggagctgtaataaaggtaaaaattctccctcgcatggagctaaagctcccctgtttcacctttcctgtcgaaattcatgacgacgactgacaagaaatatatgggaaaactaatcttcctttacaatgccttttaaagcaagcgtgaatgtgtgatttgtgaataccaatcgaattccagttacttgtacattgacctatacctttttttagagagaaaaatgatgttttagctaattaatacagtttttcctcgtaaagatgtgagcttgctaaagagtagctagctacagtacgagttttgttctcagttttgtatatttagtttactgctaattgtctgctttaacgacttgacctgatcaattaattcagcaagcttgctgatccccctctgttgcgatcaagatctgaccaggtatttggccatcataaatgtagttacatatttgctccagaatataaaaaaaaaatatctttgttatatgtactatatatggtctagtatatatgaagctcgatctgatcgactcatatagtcatatctcaaatgaaatatttatgaactttgtagtgtgttaaaattacagtcttcgtctgacaagtaattaccctgcttactttgctgtctgctagtctgaatgcattgcatattgtgtgctattctctctataactagctagctagtcacaactccatctatatatacctgcatatatgattgcgcatgatcatatagacctagctagaagcaaagcaaagcaaaacacagaaaagtatattcctgtccgcaatctctaagatcgatttgccatatatatttgctctatatatttagctaggttagccgcaggcagagagggggctatcgatgaggagaccatcaaaaacctccatatctgccatcgatgaagcggcaacatgctagtatatatgattggcaaagcatgcaaacgaaagcgagacccagaatgattgatgctgaggttgaccttggagttagcgcctccatctatcgttgaactcgcaacaggatactgcacatcaacagagccatggctccagacctccagtacgcactgaaaaaatattcctccacactgcatatgtagcagcagtaccctgtaatctctatgaacacattacatgtaggagtacacaacatggctttcctgaaaccctgataacccccggcaatatatcagcaaaagcagcagtactacctgcaggtaagtaaagcccatcatcccagagcttagctaatgatacagagagtgacacacatcattctcgtgcaaaagttgctgggtacagtcaggaaaacgaggtgcatgcttccttgcaaaataacatattttactgtttagttacagcaaatcatcaggatccatagatcgatcgataagcttagcttgtggcatggactacactggtcctgtgtccttggtcacactggtcatcacgtactcaggcttagatagctttaatttgtagtgtcattcagctagagcctcccatgccatgtccattgcctgcaggggagtgtctgtcgtctctacacaccatgcatggtgcaatgcaagtgacacaccatgcaatgtcggggaccgtcaaatcggtcggtcttttgctactcagcagcaatgatacaacaaggctgcgacgcgttagaggcccatcgatcagaacagggaatgcatgagctacttttcggtggaattacagtggccagcgagaagagagaatgtgttgaaccagacatatccatgtacgtacggcctccggcgatctctgacacgcatgcaatcgcaattgcaaattgttgcaatgcatatatatatacatagtcgccgtacgttgtagtagccaggcgtgtacgtatggatatgcacgatgggattactgaaaagattttggcaatcccggtaaaggcacactgggtgaaaggcaaaaagcccggaaaagagaaaaaggcggccatggatggccagactgcgtgccgagagatcagtgaaagcgccaagctggtcaccggcgttggcgacttggcggtgtgggggagactactacaccacaccacacgcaccagcgcgcgacgacgaacggtaggcgaaaagctaccagcttattactgcatccatcgcgcaaacagcgagcgcgctagctgtgaaatcgtcagggaccagtttagtagctagtactctgcacatctgcaggctcatgctgcgtcttgtctgaataatctcgcaatgtacgtaacgcaagtagtacagtacagtgaatcagtgatggcgttgatcgatctacgtacaccggcattgggacttgctttttctgggggggtttgatcgatcgagtagatcgcgccacgcgatgctgtgaaatcggggagatttggcatgcaccggcctctccttgctcgcggtaatcatcacagattcaccatgccgctgtcaactgggggcaatatcttaatccacgcgcgtaacaacgagatgagatctactgatcgatttgtttgctggagctagattactagtactaactagatttgtatcaggttatggatatcacatacctaatagctaatagtagttgactaaatctcggcaggactcaccacataccatgtcttatacgggaactgacttcggatatggaaggagttccggataaggaaagacaaccagagttctacatggaaacgacaatgactactcggattgtatctatattggtttccctagttctacttggataaggggacacctatgggtataaatagaagaccccctaagaggagaggggacacggagcaatagatcaagacacaatatcaacatacaagccaacatacgccaagacaagacgtcggatatcgacttcagaaataagcatggctagtcctttacggtgtctacggatactgttaggagatatatagcattgtctctgatctcgtcgggcacgaactcaagaaggaagactaccctgttgtcgactacgggatggttttatggccgccatattgacaacagttaaatatgctaccccaaatattgtactggtgtaattatggtgaataagagcaacgaccggcttcggccaacatgatgtagggttattacctgacaattcagcggcccgaacctatataaaaatcctcgtctccatctcttttacctcaatctcgcatataccctggtaccaacgatccctatactatgcaaataccggaatcgcgacatcaaacgtcgacaatttgataagggcttgttcactttgatgctatttctaaccataccattttctgataaagttgccaaaattatgcatatgtttggtttcttaccaaactttggtaaaaagaccagaaatttggcaactgcacagtactgaccaaaatttggtagaatatacgttggcaacaaagtgaccacattcaaaaatagctatcttgctaaaatttggcaacattatcaaccttactaaaaattttgacaataccaaaatttagtaaggtttattttggcaacagtctctaagtgtactgatcggctggccgacgaccatgcattgatcgacatgttccaacgatcgaggtggacaaattaaagtagcaacagtaatccagcagtgcttgttcgtcaaatccactcgggtcccatgccatgtctagcaagtacacaccacggtttgaccgtgagttccgaacaagctttgcgactagttgtttcttggtcactctgaaccgttcattttagatctaacgggtgacgttgatattggttaatgccgtatactacttctctaggctgtgggccaactcggcccgcaagataatccgttcgcaacgctagtaggccgaaagcctgcattccatcagttgtctttgtcctgtatatgggcctaacttagatgcctgacattgatggcgatccaaactttctgatgggtctattctgggccgaagctttcctccgcaaacttagctatactgggctgaacttcaggctccatcgattgttcctttatttggatagtctcagttttggttggctatgggaataagtccaaattgactcccttaattagtggttgaatctaatctatatccctaaaccacaataccggatatcactgacatggattagattcggtcactagttaagggagacaaagtgggacttattcctggctacggcgatggaagaaattactaatgggctgctggtagctacagtagaacagggagatgggcctgcgggctgtcaacacgggacagagtgcacgcgtcgttgcattttcttcggtttagtcccataccgtaggcctaaggccgtcgctacatggcaacatcaacctaggaggacgggacaaccaaggccaacctgagctttcccgtctccgtcaccactcgagctcggtgataccgtctagctcctctctcgttagctattggtttccgcgtgccaccatcctacaggcctagagagatgtggaagagaggggagacgctgaaatacgtttcagtgatgatatatgtgagtgggtaaactacgacaaaaaatcaggacagtaaaataccagtagcacacaactgaattttagtgctctacaacgacactaaagtgtatataagaaacacgttcaaattccatatcgctaacagaatagatgcaccaccaccaactaccttgtgcatggtttaaattcgaagattaggacacgacgatcacgcccatcaacttacttgcatatgtaattacacacctcatgattctaccgaatttcaaatttcgagatatatacacaaagaaaatcattcggaatcatcagatggcgacgaaatgctaattaaactcaatcaaaatatgcggac

SEQ ID NO: 42214 - DNA, 21116 bp, Oryza sativa
gatgaacacttccccactgacaaagtgacaatagtgattccgagaaaccaatcggagaggacgcattcgatcacccgacaatgccgagagcgccatgatcagtaggagatcccgacgagggcaaccatggtgtaggcgacgagctcctcccgcgacctccgctcgcctggcgacaacgacgacgagcgcccgtagccagacagctgcggcagctgcaccctgcgccgcccgctcaggaacatccgcatctcgccggcgaggaactccgccgcgccgcggagcgcgacgcagacgcgcggcaggtggcgcgccagcggcagcacgaggttgaacggccacaccaggaacgagtactgcaagaacgcctgcaggaaccctccgcccgccgccgccgccgccggcacggcgagaagcacaacgtgaacagccatctcgatctccaaactccgagcctctccagtttagtttccaccactgccgcgcgcttacatatgtgcgggccgtcgtggcgtgcgcgtggcctagctaccggccgtctgcctcggccatgatgccgatcagcgtggtggtggtgctctgcgcgctacagaaagggccatggcttggagtgggtgatgcctgatcgataccttgcttgctgatggagagatgcttttataattgaatccgatcggatgacggatcggctcgatcgcttgacaggtttggtaactgttaacccaaaccctctgccggttataaaaccagtcccaataacatgttagagatcgtaatgtgaaagaacgttatagaaaatccaaacgtgatgactacaccaagatatatttggtgagggagttcaattgtagtgattatcaatgttcttcctcgatccagtataattacagtgtgcctagggtatctatgagatcatgaccatcgaccaaagctaggctgaggactagttgtttctcgcctatactaccatcatcacgttattatatgtgtgtctctgtttaagagaggtctaagataaaagtccaacttcattattatcctactacttattacatgttttagtagttaactgtaatcgattttatacacataacatattcaacagattaaccctttacacaaatttttgcacggccggccgcccggccggagacctctcgttgttgcttgcgtttgtccaagtttggcgtaacggcgaaatggaattagtgagagacactgtgtcgggagatagcgagattcttggcatgggccaaccagccattggcatcgatctggaatttacctttctgggggagaaagtaatgacactgcctgattgcttgcgggcccgtacgcacgcttttgttctagtctgaactgaactgtaccgaccagctttacatccacatgcactcagccactcgctactttagcagtggtaccatgtccaaggtcactgaagcctggcctcttttttcatttggattattaagcgtattgttacggtaaattattgatttaattatagaagtgaattaaatatttttataaacaaatataacaactagttttaaaaaatggctaaggaatacagtaggaaaaaaatattttaagagattatattttttttgaaaagcaaataatccgttaataatctgataaataagctgaaaaaacaaagcattacgatagctgatcagtgatcacggatgtaaaagttcagatatgggcattgaccattctaagtatgaagttatacgaatctattaggccatcagcaatgggtactcttaacccgtgtctccgctcacggccgtctgcctcccgtcgctttttgaggccgaaccattccccagcaggggagcacggcgcctcgcaggggggcgcggctctctccgcgcctcgcctactttttcgtggggggtccgagccaggcaccacgttgaagcgtggggagctcgtggacacgacgccctaccccgatgtttccccttgtaccctcgcccttaaccacagccactggccgccggctcctcgtcctcatctgccgcgccgccgccggtggctcgccgttgaccaccgtgacgggaaagagagggaaagggacagggagaggtaaacggcagcggcgagagggaaagaagaagaccacatctggccacagcttgccgttgaccactgcgtcgacatgccagatccgcgcgtggctcccctgtcgtcagcggcgatggccctgcgacggcgacaaccccgcgacgagcggagggatctggctcgccgttgaccaccgcgtcggcatgccatatccgcgcatggctcccccgtcggcagcggcgacgaccccgcgatgagcggagggatctggcacccccgagcggcgacgggcggcaacgagagagagggagaaagaagagcggcggtggacgccggtgacgggagaggcgagcggtggcggcggagagagggagaggcaactgcggcttgagggagaggcgagtgcggcagcgaaaaaaagagaagagggggtgggagagagagagattaggggtagggtagaaaaaataaatatgggactttgtgggctgggatacccattgtgggttggagtgtctctattaagttgcttcagattttgaggagactatccagaggtatcctctattacgagctgagttcccctatgagtatcctcagttagtgaggacactctaggagtagcttacattatagatgcccttatgagccctcacttggccgacagaataaaaaaggattgaggctgtgttcacgattcttggttcccgagggaacattatgcacgaaaaacagagtggtctattagcgcgtgattaattaagtattagctattttttaaaaaaataaatagattaatttgattttttaagcaactttcgtataaactttttgtaaaaaatacaccgtttagcagtttgaaaaacgtgcacgcggaaaacgagggagaggggttgggaaaatgggtgccgaacatagctgaggtgtaatcggaagcagaatgattactgtatatcgcaatgtgatgtcgacatcggcaatgttggctttagttcacgctaaaattgaaagtttggtttaaattggaacgatgtgatagaaaagttgaaagtttgtgtgtgtagaaaagttttgatgcgatggaaaagttggaagtttgaaaaaaaagtttaaaattaaactcggacatcatagtggcatcttccagggcccaactacggatagcctgacacctgatgcacaacagcttcggtcgatgccaagcaaatgcattagcagctgtctactacgcggcaggctctgaaactaaaagaaatgaaatactctcgtttcattttgtagacagatcaacatcgtttttaagactggataaggtcttagctcgggtgtgtgtttaaatattggtctccctatatttaaagtgagtagcatgacattgcagttgaatttttgtgtagttttgcgtaccgagctagaacaggtcaagctggaagcaagaacaagattggatagttcagatatatctttcaaacaatgtagccccacaaggatcagtagacagtaattggtcgaaaaatcaacaaaccacttactcgatatgcacaagtttcgctatccattttgttatcatatatgccacatggtcgtttccccgcaatttttttggtcgattcaaggtacatgtgctggcctttctcggttcgagaggccacttcgattgcatttttggcctttcggcaaatccctggctgcatttgggatccatttgatctgtagatcatccactgtgtcacgatgaatcaatccaaatccaatcgatgaactgaaaccggcaagtttttccatcgtgacgtgcaagcatacttgttccctcaatcatgcctgcacagatagctacgttcgttgtacggtataaagatgttaattcagacaacagggacattcagctgtagaaaaatacgataatgtactggaatacactgaaatattactaagattcgttgaaactgtaacggaaaatgaagcaaatctgccacctgttactggtggcatcttcgtcctcaggcttcaaagccttcaatgatcctgacgctgcaagcaacaaaagatgaaggggaatgatggctggaatgattggaagcacaaatactgccgccgtgcaggacagctgtggcgcagggcagactgcacactgtacactccataatgctgtatgccacgatatattgctacagatcaagtgatcactcctgaactaattttcgcggtcctgttgtcgatagcattatggcatggcatagtgggcgggcttgccggccgggaccggataaatcaaggtaactgcctgtgatacaagagcagttatcctcccatgaaggtttttttatgtagccacagaagaatgaaggataggaacttagaaaccaaaaatcttgtgaaatactccctctatcccaaaagattgacgttttaaggattcttaagcaaattggatacatgtaaaaataatcaagttacccttattctggccctgttcagaggcactagctgccgcagcggctgcggcagcagcagcccagccgaacgcaccctctatttaatatgtgtggtcgttatttcagtgctatttaatttgaggcaaattaagtgaacatgcatacatgttatacttatgctgaaacgagagcttttgtgggacattttttgagatgtaaacgacatgttttgcgggacaaagaggctagtataaagacgaagtacaccaaatcagaactgatctaatgcaacctagggtgaccggcattgtatgcccgatctgacaacctatagtaacccaatctacttatgagcaactctttgcatgataattaactttaatgtatccaaatgtatctataaagtgcctcttctatgttaatttattaactcaattcaaaaaccaaagctaaaccctagttttcctgtccaaaagatactacatcttgagcctcaacttctcctctattcatacttaaaagatgactgcacaaaagccaggaatacactatctctttacaaatttggactcaaaacctacttaaatttagactccttttaaatatgaccatttttttcaattccaaacactttccatgtaagccatatagaagctctacctccacatatattgttctttatccaaaatatccggtatgatctccttactgatcccctcggtttaatcatgattatatcgccagcaacatccctgaagcctcaaacaagtcccgatatttgagaataagttctttcctaacttgattagtattagtataaacacagtatatcatacctatataaaataattagaagctataaacaattaaaaattaacgtgaaaaaaattactctaattacgagttaatcagtttgactgttgtgatggctggtctgacttgtcaagcatctctggttagatcgcctatgcaatgacactccaccaaattaatacctcttcataattctctcaataaaaatcattgcaaccaattgttcatgataaattaataatcataataatgatttcacaatgtcctgcttaaatcaggacagcaggacatcctagataatacctgcgcttgtgttagttttactctttattttagaaaaccttgtgttagttttactacccatttacagtttgtttcataaaatggtcacaccatcactaaaattgcggttgttttgctgaacgtagatggacgagttcagagtcgtgcagcactactgtcgtactgtgcactgatcacagtcagcgtaattggcgttttgcagagcggcaaagatattgcaaccgtgtcgtaactgtcagtctaagccgtctcagcctagtgcagacgcattctcgcagcatcaaaattcgcaacgttgagacgagattttctggccgtatttcacttgtatttacacaaaatcacgcggttacaacttacaaccagccctgaacctgatacggtgaacctcgcaatggtgtcgccacgtggaacaccaagagcagagcatcaagaaacaaaaaaagaatgaacccaaaaaaaaaaaaaaccaagaagaagaagagagaagcaatagcagttcgtcagcttttcagtaggagatgctgagcagcgcctggcggaggagctcgtccgcctctccgccgccgccgtcgccgccgcggatgcttcggctccagacgttgccgccgccgccccggcgcgcgtaggcgcggcgcagcaaggcggcgtggaagacaaccccgccgtagagcgcggcgcaggcggcgggcaggtggcgcgggagcggcagccagaggttgagcggccacagcagcggcgccgagaggtggaacaggtggaggaaccccctcgccgccacgatcgccaccaggtggaaccccataccacagcccgctcggccgcttgctttgctcggttgctcccaacccaagtttcacgagagcaagtcgtcgcttcgctgcacgctgcttgcgagttgcgagctctctcaagtagcagtgggcaactgggcatcattggtagtgcgtgtttcgtactcgcgggagctgtgcgtgtgatgtggcgtcggccgcggtggtggtggagggtggcgcgggtgcggccttccccagttgagggcgccgggcgcgggtgggcaactgggcacattgatggctgattttattttgtgtgatggtcggtcaaggccccccgacacggcaacaacgaaatggctaaaacggctgcaggtacgacgtgccataaaggacctgggatagctttgagaagcagctattggtagccggtttataagaatctggcttctgacttctagtttattttataaattctacaactacagcttctcagaatctggatcaaaagatagactgattgggaaagtttctgattttagaagaagctatagcagctagaagctccctcaaacaggcccagataaactcggaagctaaactagaagaatgaaccgtcgaaattaaccgttagcacttagcagctggctagattcggcgaattttacacagtttttggaatgctagcatagtaagcctcgtttagttggtaaatttttaaatttgattgtcacatcggatatacgaacatatatttgaagtattaaaagtagtctaataacaaaataaattacaaatttcgccaggaaactgcgatacgaatttatttagcctaattaatccatcattagcaaatgtttattgtagcaccacattgtcaaatcatgtcacaattaggcttaaaagattcgtctcacaatttacatgcaatatatttaattgatttatttttcctatatttaatatttcatacatgtgttcaaatatttgatgtgcgtgaaaatttttattgtgacaactaaacagggcctactactagtaagattctaggtgggcgtaaacatcacgggagcatctgaaccagcagtacactactggtgctagcgagcaagtgtcgtagtaagattctagcagcacaggcccacaacagaagggagcagcagaggctgcgcaggccaggccaggccagtatcccctgctgcatctcgtgtacgggccccgttttgagtgccatttcttatgggctttacatgggccatatttgcacgcgcgcggcccggcaacttgtatcctaacaatcattgtggtagacaattgttatgttctccatgtgaagtgaacagcagcagctagatataaagaaaagtggtgcaaacaacttaatgccgcaattgattccgcgtgcgccacagaagcagcaacatacaccccactcccattcccatatgacacccagagcacacactcccccaagaactttgcagtttaagtatctgaaaatgaagtccttcaacatgtactaggaggagtacaaggtagtagtagtgcgagtacgatctttttcgatatgcaaggccatatcattacaagcactataaacaaaccctcactgcacagaggagccatgttcaaaatataagttctcagagttctaagcactgggtattccagtactactttagtaagactaccaacagacaaagagcatgctgaaactaagtttaaaatcacgaaaacattttacagcatgctaaaattcttagctggaagcgaactagtcagagagatcatgaccccgcagccattcacctacattaggaactgttctactggctttttttttctgagcagatcaatgcatgcaacatcgaatggatcacttcagaattcagataatcctgccgacataaacccatccatgactaggaattgctagtaagatcgctgtcattgtctccggcagtatctgcttccttcacttcctgaatcatcttgaggacttgccaggcagttggccgactttcaggcgaggatcgaacacaggcagatgctatgtcaacaatcatagagagacgttcgacgtccactccatcgtccctcgcagactggacataggtctgaagattagttgcaaccaatactgagtgctgaagcggaggcttcccactgataagttcaaggaggaggatgccgaaagcatatatgtctgactttggagttagccttctgttggacttcatgttttctggtgctctataagcagcatcgtctttgacttctgatgattccaaaaggaatgccaagcaattgtccgtaagacaagcctcaaagtcagaaccaagcaggacattggaagacttgatgtttccatgaacaagtcgggatgcttggtgaatgtaagcaaggccctgcccgatgtcttcagctatctttaggcaggaagtccagtgaagtggttttgctcgagatgaccttgaacctgcagtgcacacaatatcaatacaacctacatctacaaagtatggctctaaggtacagtaatgtacagaggaatgtatttcaacatcatcgaatccgtaaattacttccatttatcatgccttaaaggaaacatgctattacttggaaaataatatgtccttgctccaacaccaacatatcaaataaatcttagtaacaactatatttgagctccaaactttcactaatgtttgtgcgacagcttaacttataagaatacccacattgacaaaagactcgaatttgagcaggccctaaattctacaacaaattggcaacaatcacatttcaagtagctagcattgctatttggtcatatcatagcctttgatgaactaagttcacagaggaaaatacagttttccttttgtaaactccatttgaccacccatttcgtgaattcaattgatatttagtactatagaacagtgaccacatataataccattggtccactctagaggctaggcacttggtgagaggctccaccgacgttcaatcccacccaacccggtagctagcatgatagatcaatgagcacttaagtatggctattcactatgtttactcagtccataaagaaaagagtccaatagatcatccccaaaagggtaaaataaagcatcacatgcatatgttcaatacaggcaaatagtcattctcctgccagatttatattcacgtggcccaagttctctaaattttaattccatcccatgttagttgggatgaagagaatgtctggttcaaaaaggtaatgctatcctagcacccaactagtataatccaatggaatttgcattagagtagatgtaacggcaataaccagaattgctcctagcacaaatgataatcacacaacctatcaaatttccagatagagaacaacaaaggctgcagggtacgcaccatggatgagagagtagaggctgccattgggctggtagtcatagacgagcagccgctcctccttcgcctggaagaacgcccggagcgagacgaggttgggatgccgcagccggccaacggcgtccatgttctgctcgaacgcctctgcctccagcgccgcggcgccgatcttggccgcgtccagcctcttcacgatgaccacgaggcggccgtcgagcaccgccttgtacgtcgtccccacgctcccgcggccgagcacctccgccgacgcgcgcatcagctgctcgaggctgtagctcgcgccctcgcccgcgcagaacgttaggcagccgctccgctccagccgccgcgccttctcctccggcatcatcatcgccgccgtctcctcgtccggcacgcactccacatagccgagatcggtgttgtccctgctcacctccgacatggccgcgctcttcttggggctcgggtatgccgcggagctcggccgccgacgcttcttgccccttttcattgcaatcatggcacaaagtagaagcacggccacgaacgctgcggcggtagccgcaacggcgatggcggcccgcctcctcagtttccgcgaacgcggcgtggatgaatcgggcaagctgatgtcgtcgcgttgcggtccgtcgccggtggccgcggcgctctgcaccgggggagcagcggagccgttgttgccaggaccgtgaaagaagaggaggtgggagccccggcactcacggcggagaacctcgccgcagagctctggattgcccgcgaacgcggcggcgcccatctgcgccatgacgggggtgaccggcacgggcccggagaagttgttgtacgacacgttcagcagcttgagcgaagactggttccacgccgggagggagccattaaagtggttggcgtcgagccgtaggaacgtcagatgcgggaacgcgacctcaatgccgggagggagcgcgccggagagcctgttcccggcgaggtcgatggagcggagccggcggagcgacgcgaccgaggcggggaacggcccggagaagcggttgccggcgaggaagagcgccttgaggttctcgagcggggagaggtccgggatggggccgtggagcgcgttgctcttgaggctgagcacccggagctcgacgaggcgggagagcgtggcgggcgcgaacgtcccgttcagcccggacgactcgagcaccaggcgggtgatctggccgtcggcgctgcaggagacggccgggtgcgaacacggcgacaccgccagagggaaccgcagatgcgcggagggatccgccttggcgaggaatgccgcaagcagcgcccccggggtcgccgtcgagaccagcgtggcgggcggtggcacggcccgcaccggcgcgcgaggagggaacgtgggctgcgagtgcgacccgccgcctaccgccgcgggcggcggccgtacggcctgcaccgggggaacagcgggcagcgtaggctgcgagtacgacgaggcgacgtcgccggcggcataggcggcggcgacgagcacgacgaggaggaggcggaggcggtgccgcatcgtggtgggcgcttgggttggggggttttcgggggggttgggtgagcggtgggtttcagtggagtgcggccgcgtgatgtggagtggagtgaagtggcggaagcggccggggtggtgtggtgggtgtgtgtgtgtgtgaggctcgggaagggagaggaggggtcagagagcggtcgccacggcacgtgggtggtcactgcagcttagtttcccgtgcttcttttggcacttgatcggttgatcgtttggagagcctgcaacgctgcaacgggtggataaagaggcacactttcgagtttaaactcagatcacggcaaccaattgcacgcactcatgctcaaagttcaaacattcaaattctaggaaagaaaaaaaaaacaaatccattgcaggtaacatatcaggctctacagaaagttagtactccatactccagtagtgctaatattcaggagcattttggttatccatctctggatctaaacaaagtttgagtacctacctcctcacctgaaaaacattctaatgtgctaatggtaggaatgtaggattcgccggaaaataaaaatactcgggagaatgtttgaaaaagagccgttgatagcgagcagccatccagtactataccgaagtcgacgtagcggtccattgttaatttgactgtgctgctgctgcctcctgctgctgctgcatgggtgtgagggcccgatcgcagttgatacctggggccacgaaattcaatcagcccgtgggacccacgtgcctgtcctgctcctcctccccctcccacggtggagtaaaagttacagtgttcttttgtcggttgatgggagcttcgctgtgtttcttcggggggctactgtgcccaccacacgttatcacatcaccactcgccaaggttccgggcctacagctcgatcggaaaggcccacagcttcaggcccaaataattagggagaaaaaaaactgtacaaattggggaataagttcaccggagatccctcaacttaacagcgagattttttgaggtcccttaaccacaaaatcagaaatgtgtacccctaaactcactcaaaccgttcaccggaggtccctcggcagtattttcgtccggttttgctgatgtggcatcctagtcagcaaaaattttttaaaaaaacaccgtagagcccacatgtcagttgcacatcttttttttcctcttttcttctccttctctcctcttctcttttcttttctctctcctcttctccttcaggctgtgggcggagcagccacgcgccgtggccgtcatcgtcgtcgccgtgggcgaggctacgcggcgtagcggagggcgagcgtggcaacgaagcaacggaaggtgcgagcgcggcggcgggccgagcagtggagcgcgagcaggccgcggacagtgtagcggagcgcgagcgcggtggcggagcggcggccagcgagtttgggagggagggggaggcggccggcgaccaataaacaatctcttcctctgcctcttccccttctcccgccggtgatgcctctcctagcatcgtcggccacccgcgggggcacagcggtggtggcggccgagcacgggggagctcctcgtcccatccactgtcttccgcttcgcctagctcgccttccgctgctttgcccaccgccgcgctcgcccgccgccgctcttccgccgcgctcgccttccgctgcaccccccgcatccgcactcctccgctgcacgtaatggcatatatacatgtgagtgtgctcagccatatacacatgcttggctaatatatacgtctgcatgttatcgggcggcaaaccaacaagaagctagctaggctatagctggtcgtctccatgcatgcatatatatgctcgtacgaagacgcatgtacatgcggccgtctgtacccagcgtatatgcgtatgagctacgacgtcaagtgctaccgcgaagtcggcgaagacggcgagggacaccgcgcccacgccgaccaccgtccacgacgccgatgacacgctgagtgtggacatgctcctgctgcagctgcgcgagctgagcgtccgggaggaccatgggatcaggccggcgacgctgccgccgccaccactgtcgctgccgcggcacaggaggagcgcgagcgactgtggtgcatcgtcagccggcacttcgacccacctatgcacggccactgcaacgcctggccgatgccgccgaatggccgcgccgtgtagcctcgcccacggcgacgacgacggtggagagccgacgacgacgacggccacggcgcgcggctgctccgcccatagcctccgctccgccgccgggctcgcctgccgtccactccgcccacagcccgccaccgctccgctgccgcgctcaccggcgcccgccgccagcctgaaggagaagagagaggagagaagcgaaaagagaagagaatgagaagaaaagagaagaaaaaagatgtgcagctgacatgtgggccccacgtacttttttaattttttttgctgactaggatgccacgtccgtaaaaccgggtaaaaatactgccgagggacctccggtgaacggtttgagtaagtttaggggtagacatttctggttttatgattaagggatctcaaaaaatctcgttgttaaattgagggacctccggtgaacttattcctacaaattggtagacgatcctgtttagaataagttcattttaggtacccacgtcttaacacgagtttggaaaacgtcagtgaaccgcaatatcagatctaacttgttcttaatcttgcaaagccaaggtagatagggttcgaagttaatatcgagggtagttttggctgacgtaaaactaacagcaaaagtttaaaattaaaagccatgttagacctagatgtcagtgctggactccaacgagactgccgccgagcatacccgcggagtcacaactccaatggaaggtggagcgtaagagaggttccatgttgactcaacctggttgactaaagtaagctcatcacgttagctaaaaccgagagcaatactatcttgggtcttgggatctaatgtgacccaattttataagattagggatgtgttgtatgtggtattttggttcagagacgattttaaaactcaacggcaagcgaggaacttcaagtgaacttttgatgggcagatgggccgcgagagatagttctgggccattttctgaccagaccttttgaagcccaccgatgtttgggcctcactgatgtttagtgggcaaaccgtcagatttcatgcccctctccatctggattctggaccagttggactcttctccttgtacttgcgacatcacaccgacgccgctggcgattcgtgttgccaccgtgcaatgcccaaatgtccgtgcatcgccgtcaactgtaaagcacaacgctgccgtggccaccatggaaagaagcgacgcttcacgtgctccggcatttgacaaaaaagagaacgttactttccgatcgattgctgttgatcgttgaagctatcaaattatcactagcatttcacgatctgcagcaatctacaaagtccaaacgtcgacctatatatatatggggcctattcagattggagaaattaaactgtttcatgttaaaatttcgtaaaattcctatgttctgaaggaggcaatagggcaattttgtttggatctttggggcactgcagcttgcttgctttggccgttgccgccaattcatcctatgtgaagtggccagcttcatgtttcagctaacacaatacagaccacgcaatttaactagtagtactccagaaaacacatcatttgccacgtgcgcttaattaataagtccatcatagtgggtaatacccgcatttccgcaactaaactgtttataccatgtgaaggaacagtgctgcttgggatgtgattgggcactaatctgactctaatgcggtctctgttgcgtgcgaaagcagcagagctgcaggtcaagaagaaacgactcgatcaaaaccagcgccccgtgcaaagtcgtagtagcacatggggggcccagtttggtggattgacgacgtgggccttcaatatgggcttaccgaccgggcctcctccatggcacagtcgtgggccagaatgcctatggtcggttacttcaccagactaatcagtgtgtgtgaagatgctgactgacgtctcagtgttaggcgcaccaagttgtaattttgcattggttagatatagggtgtttgttgttaagtttggtgcccctaacagccatgtaatcctttaaaaaaatacgcaagcacacaagtatattgggatgatcctactgtatactaagagctaattgtacaactaataaaatccaagtgcgctcatggtcttactaccaaatttcaggcaacctataaattagaacgttgttaaacaaatgcaaagtggagtgacaaatcaaaagcaccactgtttagcttatgcttatgcatataagtcaaaattaaacattaatacttattcttgaagttgattttaaggttttttcattataatttattttatagtgtttgctttttaaatcactaaagatgcatatttaaaagtttcatctaaaaattatgttttggttgctaataaacggtatcaataagtataagtataaacgaaaagataagaaataaaatcatgcttttctctctacttttctttttcttttttcctttaggagtatgatgggttttccttttccgttttgatattgggttatgttggttggtctgtactagaaaacaaaactggccctagccattttattcattcactcattcactcgctcactcggatcccattcaatcattcattcatgtcggattgatgccgtatactgacttgatgagctctgactgctcatgccataatccataccatgccataagagtagggtaacgagcagttgaccactgagccagactgcctcttacccgccaaaatataattactgtacggcccacttgttacgcggtagattttgaactgacgaagtccagaaagcaagcaaggacagatagcaacaaccctcttctctccagtctacagcctacactaccagttgagaaagaaaaaaaaaatctcagctcccagctcggcacgagcacgagcacgagacgacctgacctttctcttctccatctccaccccgtcccctgctcgattcccacctcttctctccagcccacgcgcccccgcctcgccacgacccgaatcgccgtgagatcgagccgatcgagcgtcgagcaccttgcgcgcgcgcgcggggatgaaatcccatggcagccgagacaagctacaggcggccgcgtcgtcgagccaccgccgcgtcctcctcctcctcttcgccacctgcttcgcgctagccacgttcgtcaccttcgtctacaacacctcccacttcgcctccgcctcgggctcgggcgcggcggcggactcctccggtggcggcgcaagcgccggctccggcaccggcgccgtctccgcgctgccgctcccggtgttcgacgcgctggtccacttcgcctccatctccaacgccacgcaccgcatgtccgacaccgacatccgcgccatctccgccgtgctccgcgccaggggcccctgcaacctcctcgtgttcggcctcggcgccgagtccccgctctggctggcgctcaaccacggcggccgcaccgtcttcctcgaggagaacgagttctacgtcaagtacctggagccgcgccacccggggctcgaggcctacgacgtctcctacaccaccaaggtgcgcgacttccgcgacctcctcgacgcggcgcgggcgtcgcgcgccgccgagtgccgccccatccagaacctcctcttctccgagtgccgcctcgccatcaacgacctccccaacgacctctacgacgtcgcgtgggacatcgtgctcatcgacgggccgtccgggtggaacccgacctcgccggggcggatgccgtccatcttcaccaccgccgtcctcgcgcgcaccggcgccaccgccgccaagggccccaccgacgttctggtccacgacttccagttcgagctggagcaggtcctcagcaaggagttcctctgcgacgagaaccgcgtcgccggcagcggcacgccgtcgctcggccacttcgtcgtccgcccagacggccggcgcgacgccttctgctccggccaagacagcacggcggcgggcacatcgtcggagaagtccggcaagtaaaaacctggccaagaattactcttccctcctctgctaattttttctctctctcctctcctctcacttgttaattatttcctgttacatatattttttttactgttttttgggggacaataatttgtaacacagtgatgatatcattgcatcaatagagaaaggaaaatgcaaatagaggttttacacaatttactacacttttcacaacaaccaaaccggcaaaaagatcttggatttgatgacatatctgggggttgatttggtaaaagggtttgtgatggctggcaggagagcgatgctacagtagatggtgcgtggtgggtggttggatcccatcgttttcgctttcttttctccttcgtgttggttgcgtgtgttgcttggtcaggtgagcaaaaagtggatcagctcatctcctcgtcgtattaacggcactattagtataggagtacaagtagtagcaaactagtcgtctgattgatctgacgaagatgtatttgtttgtttttggttgagtcatctgatcatcagatccgagagggagaaatctactaggcgttggcactaattagctgatgtcgtaaccgtggtgtgcttgtgggtttagctccgtcgtttcgtttaaagttaagttaaccgtattttgcagcaacgtccgatcgacctctcaacaactcttgtgtccgatcttgatcggcttctccggtaatggaaaaacaagtgtcgcctacgtggcaatgatcactttgataagccactgaccttagctggctagctggcaaccaatatagtcatgtgtatactctgtgtttgagcacatagagtatctgatttctgctggatcaattttgatagggtagcaatatctggtcagattgaccatcacacaaacaatgggacatcatttcagatctcccagcgagcaacctgcctgggagcgtaaataaccaaaatgtgtcaggcattgtgaacgtggtttgggacttggatattcatcatcaaaatactgcgcgccaaccggatagtgagtacgaaacagaagtctgaacattggacattggaggccgaatcagcattcgtactaaaccggttatttgtccgtccgggatctttcatatggatcgatttaactatttaatagcgactttgatatcccaccgttagaaattagaaaaaaataattaaaaaaaaataaaaaatttaaattaaatttttatattaatgtgtaattcttctgcgcgtttgcaagaaaaaataaattttatgtatgactagaattgaaaacagttgaaaattgtacctttttaaggagatgatacttcttggtcgggaatttctgcaacttttttatccctattgagggtttattcggttcggaggaattttacgaaaatttgaaagaagtgaactgctttacgtgaaaatcctataaaatccctgcgttttcagggagccttggacattgtagaccaaatagccatgcacgttaacatgctctcaaaacctttttatctcatgaaggcgacggaccacgttgcgagctgcatatcacgtaccatccgtttgcggttagtcgtcagatcagatatcggcgctgctcgtcttctcgctctcggtgcccttttgggatgagaacgaacgaaccactcgtaggacaattataaattggattaggctgcactgcagggtacaaatcgaacggaccaacagcgttacagcctttgcccccacatgccgtccatttcaggactttctttctggtgacattccaacaaccgcgaccctctctccaaacaggatgtcatttcaggctttcaggtaagagggttgagcaagccaatcccaagctttagtgatcaaccaggtccgtagcaaacttaataaatggattaccagctagtgatagggtcgttgcaacgatgtcattgtcaggatagtttaccatgttactgtcactaccttaataaatgaggaaatatcacaggtagaattttatatttatggagatgtaaaacattttcattatcttaaaacaattatattcagtagtaactttagcttgaaatggacgtgttggatttaccctatcaagtaatgactgtatttgcgttacagggtttgttaaactgtcaagcttcgcaaccccccgaaccgaatttccgttctaattaggttaggaagcaccagcttaaatatattgacctcgtaggcagatataaaatcgtactactccatattttaatgtataacaccgttgactttttattcaacgtttgaccattcgtcttatttaaaaaatttatacaattatcatctattttattgtgactcgattcatcattaaatgttctttaagtatgatataaatactttcatatttacatgaaaattttgaataaaacaaatggtcaaacgttggtcgaaaagttaacggcgttatacattaaaatacggagtaagtaccagtagaaaacaccacctgcttctggatggatgtaacggagatgtgttcttcattgctaattaggatatctccaaaacgggttcaacaaaactagaaaacgggttgagcgacccaccatggtcctgacaggaataagttagacatcatgtgcttggcgccacccagctctggagaataatagcatatggttccccttacctctgtgggtccttgatttgtattctgatacctgtagtatttgtaatcgcgtttcatgtgtgtactggctttgtgatacggagtactagtatagtaggactagttgttggatactactactactcctgttcaatagttaggcatggacccgggcggattcgacgtgacggccggacgagtggcgtaaccgcatggttgacctctcatcactcgctgttccgcctcatgtcacgcgttgggttgcctctgcatttccaaagcctttgaccgtgaatagcaaatgcatcactgcgttaggccccatttgcaccgacgggtcacaatacggcaatcggctgatcgacgacagcgtagaccggccgaagccgaaacaggcaaggcacgctcggcatcctctggccgcggcagcagggaagctgaacccatcttccgctggcgcgcgcacgtggttggaaccggtgtcatcaaacacaaactactaataacatttttcatgcaatcaaccaatttttatagctatcgataattatcgatatggagacagtaacggtgtcaaacacaaacgacaaataacgtttttatgtaatcaactaatttttataggtgttgatagttattatcggcagtgaagaaggtaacggtggacgtggtgagtggtgaccgtgcctggcctacccgggagctggctcgctgctgcacgtggtgaggaccgtgccatccgcccaccccacgctaggccgtttagcggcaaaacgtccgggcgtgcttgg

SEQ ID NO: 42215 - DNA, 1619 bp, Oryza sativa
ctgctcgccttgatgttgcgctccatacggacgtagccggactcaccccagctcttgccccacgagttcctcacgatccagtagtccttgccattctctgtgccgtacccaacagcagcgacgccgtggtctagtgctgttccacatttacccgtgaagataccctaagaatgatatcaggaaatggcaatcagtgcaagcccaagtcatggaaataacaacataattgaaaagaacaaggaatttaggattaacttatttaacaaaagcagagtacaatgcatgtttcaaattttgagtattgctttatgggaaaaacaatcataatctttttccctatctaattgggtttcgaagtggatgacactggatgatggctcataccactccactacggacctgggaacacatcaaaagctactcgttccattaaaagtgtttcacaaagcaggggcaggaaagcaacaaatgaacatggtttatggtctatgaataaatggtgtgcactgaggtactaatttagtggaaagctgaaatgggattagattatctggatgataacaaattaacaaagtatgccaggactggacaaaatgataataagatttgcttagtagttgcgacttgcaactgacaacacaatcatttcttttagtgcaataaccgtgattaaagcaaagtaaagcaggcaagggcaaaagcaatcagtgagcctgcctatttgtttctctatcaaagatagcaaaacttactaccgactacacattgttagaacttagcaaaggatcaccaaacgaatttgaacaataacgttaaatcgacttaccgatgagtagagctggaatgctctgccaccggcttcaattgcaacactgacgggctggtttgctaccgccttctgcagactcgtctcactgtttggtgttacatcttcgtagctgtcaattgtgacaacctttgcgtttttctgtgagtatagcagcacaagtgagcaatagcatatcaaaattatgctactacctgaaaaaccaagggagcaaagaagacgaaagataccctgtttacgtcacaccgttcgtccttgcctttgtaagggtagtcatcctcggtgtcgattccaccattgttgatgatgaaatcaaatgcatagtccatcagacctccattgcatccctcgttatatgaagtgtcacagtcaactagctcctgctcagacaaagatatcaggtcgccagtaacaatctggttgatgccttctacagctgctattgctgagaaagcccagcaacttcctgcaatataggagaattggaggttatatttccatattattgtgtcaaaggatgacatgaaacattgtttgactctcaaatatacaagtaaataatgaggcaatacaaaacaaatgcagccaattatgaattagatagaccatgtggagcaacaacatttttttttaaacgacctacatcagacagtgcgaagtttcttttttcttttttaagcaacaacatgatgaagaactttagcaatgcaaaggaggaccttctaccaataggattgtgaaacgtctgcaagagacgtgaatgaaaggtgtttccaagggctcttttggagcc

SEQ ID NO: 42216 - DNA, 2808 bp, Oryza sativa
caacggatgcttaccgcaacctccctggtccttgatctcagccacggcccccttggtcctccagtcaacggactccggcagcgcctgttgtcggcggcgaggtacctgtcgctgaccttcctctccctccgcggcttgttcctgaggccgaggtaggtgtcccggtactcctcgttggtgaggtcggcgaagcggttgaggccgaggcggaaggagtggaccccggcgtcggcggcggcgttgtgctcgtcgatgtaccggaggttgtccctgaacgccgcgtaccgccgctcctcctcgccgacggcgttgtagctcttgccgtgctcggccttccactccgcgtacagccgccgcgcctcctcctcgctcctctccccgtacgacacgatcgacatgtccgccgctgccagcgacagcagcagcagcagcgcggccgccgcgagagccatggaaatcctcatcttggcgagctaggagaagacgaccaagaagaggaggaggaggagaggtagaagaggagtagatggatttgatggtggtatcgggggtcgctttatagaattggagaggacgagtggtgggcccagattccattatattcgtgcaattttcttccaatattaatctagtcgaccaccagtaggatattttttttttttggtttcgaatttgtattgggatcgtttaataaaggtgccactgaggtggacaggttggattgggttggggttaatttcaacttaatctattttttaaaacacatactctctcctctagaaaaaaaacccaaactaatattatctccgtacttaaaaacccaatctaatattaaatgagatgtttctaagtacaatgaatctggacatattactgcccagatttattgtactgaaaaaaatcatagcaacctatatctttttataaaactggttctaatcacatttgcacgtccatccccttctaatgagaggtttcatttttatttttcaaaaagtgttgcccacacaaacaaaacacttaatcgattgctaaaatagcccatacgacacatttttatttttttaatcttataagcaacacatgtagagacaagtcacattaaaaacagtgtaaactcatttcatctctttctttattaattacttatcatattaacaaaaatattgacatgataccctattcaatgaaaataaaactctcattgaaaatgaccttataaagattccacacgtacacactacgtagcacctctggaaactgggctgccatattttaaaacggaatcattataaacatattcttatcaacgatatgttgtttgtcacgaaaaaataattactagtaaatacggtgacatcttcctgtattagtctatctagcctgtagcctaggcaattatagtgggttgtttatttggaagattggggtaccgtgtcaatcgagacatgtagaaggaggtgacgagagaggttacgtggagctgcaagattttgactgttatgtttttttgctcctgtttaagctgcgatagttaattgcgccccggttgaattacgatcggtgatgcatcacggtgaaagagagagtttaccgtatcgtgtcgttttaaaggccgcgctgcagcgaaaagcgaggtgtttcacgaggcgattatattaaaagcactagcagtatgcatctgttcgtacaaacggagctttcagccgtgccaaagctaatcacgatttcccttcacgagagtggtagcaaactggcccaaagcagcagctggtgactactccttccgtctaaaaaaaataaatataagactgaatataatatattcatagtacaataaatctgtatagatgtatatctaaatttattatattatgatgtgtcacttttagtatcttttagtattttagtatctggttggttttttatggaacggaggaagtagctacaccatgtttagttacaaacttttttttttcaaacttccaactttcccattacatcaaaacatttttacacatataaacttttaattttttcgtcacacgtttcaatttcaaccaaactttttaattttagcttaaactaaacacagttctttgtttcttgcagacatgaagcatatcccacgatcggcagatcgggcggtggtcatgcagtggcgccgtcagtagtcatggtcccttgcctcccccagttgcctggaatttactgggaacgcgacgagatgggctggacgtacgcaggcaggaggggatggaaagggaaggcggccaataaagtggacggacgcaggatcgccaagcaaccggcggccagttcgtcctcgcgaccccaaaccgatccagagagacgcgccggatccatctggtagttgggatttgggaagatgacgatgataaggcgatggatgggagagatcgaaggggttcgcggtttcatggaatcctccgctagtttcgcgtgccaaaacgccgccgatacgcacggtagtaggtatctctatatgccctatgtctcctcgggtatgtttggagtagctatagattctgagaagcagctgtttgatacccagtttctgagaatctggaaaatgtttgaaacctagcttctccagcttctgacttcttagttcatttttcagaatctataactatatattctcaaaagctatgaattgtttggggcagcttctagcagaagcatcttcagctaggacaagctccccaaacagggccttcgtgacttcaccgatggaacgaggtggaattatcggcgtaatttaggattaaactgttcgaggaacgt

SEQ ID NO: 42217 - DNA, 22244 bp, Oryza sativa
  unsure (1)..(22244): unsure at all n locations
caaaacgatctgataaaccctaattattcgtcaacgagttgtgttttttttcctagttatatccaaaatcggagcttagcaagcggggaaccaaaaatcccacattccggtgacgcacgcagcgagtccaatgggaggaatcttttggcccgcaaaaggaaagagcgcggctgcggccgcatcggtggacggggatagcagcggaggagggcgttggaatctctcgcggcggccatggcccatgggttggttggttggttggttgggtggctggcgtggaggccccgcacaccggaatcgtacaacaaaatcgtcgcgcggaaggatggatgagtgacgagacggacgacgagatgcgcgcggaaggcgacgggcgcgacccggcgagacagtgagtcggcagcgcacgccaccccgccggattggctagccgcagcctgcgctacagtggcagactgcatatccaagcgatgcacggaacaaaaattggcagaaactgtaacaagaattacaccaagacagaagaaaaaacatttcctagggtgatgaaatcgtcgatctttggtttggtttagttaatatctaccataagggtcggagtatttgattccaatgtatttaaaaactataaatgtattcaaaacttccagtgtatttaaaaattataaatgtatttaaacacgtgactgaatcatatcatttccatcaaaattcatatggaatgaatgatcatatagagattttgaataaaagttaacccaagcttcaatcttttaaaaaaatttcttcgagtttatctttctcctatgattcatgtgatctattcaaacgatcgtacatgtttcatcattctctgttgctcttgattcttataaaaatcttgtgttttttctattgctctaatttttcaatccggtgtttcaaaggtgtcctaagcattttctttggatgaagattgtgaatgagtttggatcaactactaggataggtaactttttcattttcatccatgctttccaaactcataaaatagtgtgcttcgtacagaaactttataaatagattttttctaaacaaataaatttattttttaactttgtaatagttaatgcttaattaatcactcgttactgatttatctcaattacaacgtgcaatagattatagctaggttcaaatgcaaccaaatgtatcttagggtctgtttgagtggaacttaatattttgataagtagatgtttggtagtcaatttataataatatgtagattctacagctataacttatcagaatctagataaaaaaatactaaactgtttagaagagcttctaattctaagagaaattggagtagttagaagcttccctaaacagattattaagctattgctaaatttgattttgtggcacgattgctaatcaccttgcgataagcggtcggcggtagcggcattggcttatcatttctcatgggatttctggaggaagagtatatttaggcagataattgtctctttcaacttgagaaacaagctaccactggagtaatgtactagcactacatacccgtagtaatgcttgtcacggtaccgcggctatctccttggtccatagtgcggatgtcgtagcagcacttgtgaccgctcactccggctaataatagcctgagaaaactaagccccatgtggacccacccacttgatgctgctgcctatagtaatctatttggccatggtgacgagaaccaggcaaaaactttataaaactagcgccgattgccgactaaatcaatcaaatgtaaaaaaaaaggatgaattttgatctagttaaatcagttatcagttcatcctgcccatagttaggagtgacgacaagcatgtgccagggataatacagcaacataaagtattgagacaggaaagaaaggccatgttagtatgttactgctacctcgatcatgcagagtacgttcataaacatgtgatgcgagatcactaaaaaaacatcaagaaatccgtcctgtgtcaagcactgctctgctggttcccctcccttgcacaactcttttttgtcagtggagtatttttacttgtgaagcacatgcatccactctcgtttttcttcccctgaattctcattgccatgtcgttcgtatcaactgcccagcacgcaaccatgcatcgacgtgccatcgaatagttctttagtttatgagttctttgttacggcactccagtcgatcggtcaaatagttctttggataaccatattgaatagttttgcactctttggataaccgtattgaattatagaagtagacgggttcagattgatgcccaccatggaatggacatggtcagtttctgagtttgtttgcttcacaactctgataaaaaaaaactctgaagccgtgggtcaaactttaaactctctaatttgagctcggagtgccacatacttaattggaattctgcagctattatgtaaccctaaactgtaacttcagattgaaggattcctgaatctatattttccaatagcgctttttccaataattgaagtcatggtccaataatgtgaactcagctgattcctgtatcatggccaagatagagccaacaaagaataagagaaaaaagatatcttcctatcttgaaaggaaattccaattagttaaacagtcaacgatctccttgttgctttcatttattatgtgctgaggcttacaatttcactgatatttcttctgcccttttgttgacgttgatggaatcattacaaaaaaaaaaaacagagaggtgacgttgatgaactgctgtctctgttcctgtggccattaattcggcctataatctagcaattcatttcggaaagtacagcccaacagtgaacagatagaagtatcagatacgtgggccaaattcacatgttcggtcgatatagtcccagcccagctagtataataataaactaacaaaggactgacgaaacgagatgttcaataaaacacgagctaaacaaaatatccaccgatcaagccaatcgggatctttacctaatttactaacatatataactaactctcacaaactgatagtaaaaaattaaccctaaaccaaaacactctaaacctaattaacgcccatctcaatttctagttgattcgaaggaatttcttgattggaccttccagctgctgcatgacggccttccatccagcctccgtggggtgcacatcgtcccagtagaagtacttctccggatcgttgcacacgctgaacaggtccttgccatcgtgtcccttctgcccgcagaagccgttcgggtccaagctctcgcagcacggctgcatcttgtgctcgaactggctcgacaccttgtgcttcgaacctacatatcaaattcgtcaatggacacatgtacgttgtaaacagaaaaatgaaagttcatcaagaaattaagacgaatcaacaatgcgtagtaattatatattaccttggtcgggattgacgatgttggagaaggcagtgttgaggtcgacatggtggacgtagtcgaggtgcgagagcttctgttggaggttgctgccgtggaggtaggcgcccatgttgccggtggagctgcagccggagtagttgcccggcctggttacccacggcgtgcagccgacggggtgcaggttgttcaccaggatcttcctcgccccgttgttcttcagcctgtgcacctgcttcgcgatctcgctcgtcacctcnnnnnnnnnnnnnnnnnnnnnnnnacacaaagaacatgcaatatcgatcgatcagaaagactgttaactaggacgtactccagtagctaatgtgtgtgaaggctgatttagatgactatttaggtagcatgcacgaaacgagaatcattttccccgatctgtgtactgaccttgctagtgtcgttgacgttggcgaggcgggcgtagtcgttgccggagacggcgacgagggcgatggagttacggaggttccggcgggtgatggtgccgtcctgcaccaggtccctgaagtggtcgacctgcttgtcgagcgtcggcgcgccgctcggcagcttgaacacgccggagccgccggcggcgaagttcatgccgtgcgggtgcacgtagttgtccaccctcctgtacgtcggaggcgcctcatgacgccccagcatccgtgctgcaaaatgtacagccaaattattaagtacgcagtaacattttcaatctgagattgaatctgaaaatggatgctgttgaaaatttccttcaagatagattattcaatctgaaaatggataattaggttatagttagttagttaattaccgatgagatcggactggaccatggcgttggagaagcggccggttgggcggttgttgccacggtcacggccgtaggggtagtaccattcgcgcgactgctcgctcagtcggcgcttggggagattgccggtgtcggcgaacgaatcgccgaacacgaacagcgtgtagaacccgttgtcggagtcgccgaaagcggcaggatcgggacgcgcctccacatgaacagctgttatatatacgcacacgcattatcgatctcattaattcgtcagaaatgaatatttgatttgatcaattaatattaaattgataattgaacacataatcaagaacaagaatgaaggcgctgcagatggcacgtaccatgcagaacgaagaggatgaagcaggtgacgggaagtagcaaggagagcttcgccgccatggccggcaacaactgaaagctcctcggttgacggtggaaggtgtaactcgttgaattgcttgtggctttgcatgcatgggtgtttaccaccctatttatagacacgacgaggctgcaaatctgttccgaatatactattctcaaggtgattttgcgaggtgattggatcacgcggcgctggcgcccttaacttccgagtaacagttgggattaggaagtactccaacgacgtgcagcgagcagctgtgattttccaatgtgatcgcgtactcctatctaccagggccggccaaaatgctcccacacgaccagcccaatcatgtgggccgaatcacgccggccgctcagctcctacgcttatccatgtgataaagcagttcaatcttatcttcctgcttatatattataagaaaatctaattgtcaggagttttacactaaactaaactttatatactttttatctctatatatgccaataaaaatacgagactacccattgatatttcaatagatttgaagcttcaaattttacagaacttccaaccaatacatatagccatttttgaatgaaataaaagaaaagggacaaacatatagaaaatcataaatcttgagaaagaagctgttgtaaaatatgtttttttaatgtaagagtgtagttgctctgtaattaagtgtaaatactctataaccaaatataagtactttgtaactaaatgtaattgcaactttgcaagttgaattcataggaacacaaatcttgatacaagatcgtacgggtgaaaagtcagagtataagaactcaaaattctatcgcaagtgaaatagcaaaacctcaaagatcatactctgtactagttttgtaagttgggggatacgttttatccagttttacggttgaaaagcacgattttgtatctcgtgacatgatgagaggaacctcaggtataccttttccatctgactgattactgtagtcttctgtaattctgttcgcagttacaaaactttttttcaaacaagtttacgtactacgatgctcgttttgtttctctcttaaccgtgaacagcatgatattgaattttgagtaaagtgcattagcagtacttaaacttgtagggttgtgtcatataggtctataaactctcaaaatgtatatccggatcgcataacttgtcaaagtgcatcatctaggtcccaaattagcacatcccctctaagatcctatgtggcgctgatatggcaatgccacatggacgtgacgtgtccttttccttttttttcttctttttccttttctttttcgttttcttctcattcttatttttttccttttttctgcacgggtcacagagaaaggagaagaaaggggaaaaagataaaagaaaaggaaaaaggaaaaaaaattaaatgggtcccatttgtcagtcaaaataattctatatcatgtccgtgaggcatacacatcaacgtcacgtaagaacctgaagaggttttagtgatttgggacctagatggcacactatgacaagttatgggacttggatatgcattttgagagtttagggatctagaagacatacccctacaagtttaaagactgcccgtacactttactcttgaattttttatcgtcctatgatagatgcctagaatccaagaactgcattatttttttaagtttataacttattcttctcattttccacacgcacgttcttaaactgttaaatggtttgtttattttttaaaaaaacaaaagttgcttttaaaaaatcatattaatctattttttttaaaaaaaactaatacttagttatgttaatgagttgctccgttttgcgtgcgagaaaaattagtttccaacggcaaggaaggaacgaagtgttaaattgacgagtagaagatgtttctctgtgggcggaaagacgatagaggttgtgtttagttccctttaaatttctaaaaattccgtcacatcaaatgtttatacacatacatggagtattagatgtggacgaaaaaaatcaattacacagtttgcatgtaaattgcgagacgaatcttttaagtctaattacgtcatgatttgacaatgtggtgctacagtaaacatttgctaatgatggattaattagacttaataaattcgtctcgaagtttacgggcggaatttttgttttgttattagtatacgtttaatattttaaatgtgtgtctgtatacttaaaaaaaattagctgtgtaattaaacacggccagaattgtagtccaagcttcgaaagctactctctcccgccccctttcttctcaccattcataatggcacagtgctagttgtgctcgtcccttatagtgatgtactcccatgtttattattttcaatggaagattcagtgggaaagctctctcctccagtgatttctccaaaaaaagaaaaagaaaatcacgagtagctctctctaaaaaaatcacgagtagcgacaaatactaaaaacagttcatccaagaagctgccatagcctatgatccaagaggcgaagaccaatttacaaagttaggaatacgacagcttccacctaaccataatgttcctcacaatcttatagacacatcagacaagaacagacacattatggatataggctgtgttcggatgcctgagttctcaactctaacagtgcgcacggaaaacggagcgatccattagcacgtgattaattaagtattagctaatttatttttcaaaaatggatcaatatgtttttttaggcaacttacgtatagaaactttttataaaaaacgatccgtttaacagtttgaaaagcgtgcacgcgaaaaacgagaggtgagtattgggaacttggagttccgaacacagccataggaggagaatgaaaaatggattgttattatttcagacgagtatacaaccaatggtttaactcccagttacccacaccacatcaattcgtttttaaaagtccctgctctgatctatattacacaaaaacaatatgcctaatttgctatctaccagacaagggacagatggcacatataattaaacttttatctattttacacggtggtacaaaatatgcgcggtgatttatccccaagattacatgtactgtctatggtttctgtagagtccagagaaataatctgagctgagttacattatgttacttgagagcgtttggcaccgacgaggcatagatgcatcagtgaagtacttggggcagatctagtgagccatatagaggtatggtttcgatctgatttctattttccaacaaaaaatggcctctagtgctgaccttcagtattcaatagcgtggtccgcttgagtggtgtttctggtttggcatcctgttggcgggaagcgatggttaccagaggagggtcaattttccatctgcacaaaaatgaaggataaatttagtactgtggtttaagagaaacatcagggttaatctgatagatcttcaaactcaagcaaacaagaagggggtattcttttgattcttatgccatgcaaatcacaaaagacatataatgaatttataaacaccaaaggttacagtgacaggacatacatttcatattcaaatcaccacacaacagggtaaggttgattcaggaaagaggtttcatcattgataggaatgatgtgttaatggaagtgataagtatggccaattagagttgtctgcctctaccttttattgacacaacgcatgggacagctagatcaggccagaaagtggaagaaaataaagagccttttggtgaaagtaaggcgaatgtggtatcatatccccttccggtcctccacagattaaacaagttaactcaccacaaacatcatgaaacgatggcaagaaaaataacagttttaaatactcgtactccatcttaaatgatactccactcactactagattgttgacatactaaagaaaacccaatatcctggcacaatttgaggagtaccagcatatactagtaccatatgtataataattaatatactagtacaagaagacagacgtatttggtatatcagatgagttgcccaagactcggagactgagataggctggtcacaatatatgaacactgttgctaagaaaaaattggccctgttctagtgttgtgtctggtcggcacatgtgcttgagacctacacggatcgctttcagcgatcgtccccaccccaccgaacatattaggaacacaatgaccatcgtcgcctcgccaaccataatctgctcgacctaacgtaccttaccttgccatggtgtcgggatcaaatcctagatctgacccatgcaatttcgagctaactgctaacgtgctaatcaaatcacccgtaatcacgcggtaacatagtactagcatttggagatttattaaatttgggaggagtaatctggtgatgtagagagagggcaccgacgaaacttactcgtgtgggaatttgacctcgtggagggcatccgaccggtgggaccatgccagggcggcctggccgcagctggcgagcggctcgacgcgggcggcgtcggtgaccagcgagagcgggctggcggcggcgccgtcgtcgatggcgtcgatgtcgctcacccactcggggcgcgacgccgcgccgccgccctcccagagcgcctgcgcgttcaccacgaacccggcccactccagcctgctcgacagcagcatgtcgccacggttcgccggcagcatggtctcctccgacacgtggtagcccaccagcttcccctccgcgtcgcacgacggcgcctggaggaacgtctcgctggtgccctcgtcctcgcccagcacgccgacgggcacggcgcccaccgacttcaccttctgcgcctcgtcgaacagctccgtccggaggatgctgttctcgtcggcgaacaccacgacgccgtccatcttcctcttccgtatctccctgcatttggtggcaccagagagatctcaattgcaacatccgaggtcgcgaatcgagagcgagatctagctgcggtgattacctcagggcgtgcattcgcaggcgcgaggtggaggagtcgggtcccgtgatgtggaggaagttgaggttggagcgggacagcacggcggcgacggcgtcggtgtggtgctcaggctcgacgacgatccacgtgagagggccgtcgacgaggcggagggtgtgcgccatcgacgtgagggagggcacctggagcgcggaggtggtggtaggggtgacggcaatgacgggcctcggcggcccagccccgcggcgacggctgctgcgctgcgcgttctggacggcggcgaggatgtggtgcgccttgaggagctcgttggggtcagggtgcggccacgggcggacgcggatcgggtggcggccgacgaacaccggtccgtggtggtggtgctgcgggtgtgccccgacctcggcggccaccgtggtggtcgtcacggtcgtcgtggtggtggtcgtcgtcgtcgtgatggtggtcgtcgcgttggcggcggcgagcatgacgggcggggagacgagcgagacgaggtgggcggtggggttgatcggcgtggggaggaacagcaggtagacgatgaggcgcgagaacctgaacccgaccgccatggaggtggcgcagaagagcgcgtgcagcagcagccacgcggcgggcagcgacggcttggacggctcgggcggggagtccggcgaccccgccgccggcgacagcatcggccacagcggccgcagcagcgggagcttcatggtcacagcttattagctcggcaaatcgcttagaggcaagaaagcggcggtggggaagtggcaagtggtgaggtataagagagcagctggtggtcgccgccgcggctcgggtgggtgaataattgtgtggaattattaggaggaggagagggggaaaagggcaagcagctggtggtggatggtgaggtgaggtgttggggttccaccgcgaactcggcaattggagaagagaagaagaagcgagagagatgacacgaacacgaggtgaggttggggttggggttgggctggcggtggcggtggcggttgaggcgtgggattgggggagaaaacacgcccgaacgctgggaatatttcggccgttggcggccacgcggtggcagccagacacggttccccgttttcacgctttttaaaaagctcggttgcttttacctctctgacggcggtgtgggtatcttgttcactttggttggtgaagctgtctactccgtatggttatctgaagtaaacgcgagctgacctaaacagttgacagtaaaagtcgcctagtaaaatacatactgctatgaagagggagcagtattcattcatcttcctgtttccacgcaataaatcaccgctcaattatcttcccctcgcatctttcatccattattaatactcccccctacggtacagtaccactgtcgctgtgaacagaactattgcactccaagcaattctcaaccatccagatccttttgcaggaactctatggacagtagacatgagctctctcgctgccgatcagatccttgaacagtctgcagcgaccgatgtttccctgtttttttttctcttgcaggaatttcactgtgttgtcacaagccggggtgctgcctggctagtttgttgtactgccgttaataacatggcaagggacagtagtactacagtaagcttcctgtcgttggctaaaccaagatgtgtttgattaacaacaaaaggggttggctgttgcctaatgcacgcactgcctgtacagatttatttaagctaccaatagtacagcatcttcttgcagcgttaaaactgctacaggatttttctagtcggcgccctgaactttcatcagggatggtgctcacgtgcaggcaaagggcaggcagcccatgctggctgccgtaattctgaactgatccaacgtatggccaatttggccatggatggattggatgcttggctgcttgctcgttctggagttctgacctgtaatgtcattttcttaatcctttctttttctccccaaattttgttttcctgccaatgtcagtgtcaatcccggattggagtagaaccggcactcgatcatagttccatactcttgtcttgcattctgcattgccatgtgtgtcagatttcttgttcattctgaagaaagtagctttatgagcagtaagacactgtcccattcagtccagaacacaatacggtgaatctgtgaatctcttgcacgaaacaactgcaagaacgggcagtacaggataagttgataatatgatctgaaaagtgattaggagagtgtacaaccaatcatgttttgaactaagcttgaagaaacaataatccgattggtacaggttgggttgaatctgctacagttttattcaggtatgcttgtcctcgtgttcgacctgatgggtactgaactatctacctagatgcctacacatataaacaaattacagagattacacgaggaggaagaagtgcatgcaatgcaatgaaaatggacatgaaagcttagagctagctaaaccaggatgttgtcacataattatgaattgaaaggaacatgacataggcagtgttagatacttaatatacttggatacatactagtatatcatttccatacctacgcagcttggtggtgtgagtgtgacgctcaccggccattgctgaagactgcacttgaactaccagctagtgtgcattttaattcctggggctgcattcttaataattcagtacgattgccttttcgtctctctatataactttagttaaaatgttctttaaagaaaaaggataactttaaaatggacttcacactctgaagtctgaatatttctttctggcaacgaagtctgaatgtttgttgtgcctggtctgccgtactggccgttcggtgaaacatgcacataaacagcgattgcataacagtatacagtagcattatgctcctccttttttcatcagctttaaaaattgttaatgatggccgattaagccacatgtaattataattaccgcgtaacaggtggctacttaattatcagctcatgaggttaatcatttcctgacgctaaatcggcaatagcgacgtataggttgcagttaggtggagtccttttctttcgcggcgtttaagtattgattagcacctgctttatgtagtttaatcgtcagtggatggagtagtagttgcaacgttgtcgtttacactagaagccatccgtgcccagccaaattaagcacgaatgcatgcatgctttcagctcaagcgaaacagagcgaatcacagcctctcctgtgagactgtgactgaatctctgggttgttacttgttcaaagttacaacggtgactgtactgtaagctactcctaaaagttggagggaagtgaacaagcaaagcaatggcaggtgatgaaaggctgaaagcatctgcaggcatgcgttgcccgggcgtgaattctgtcagaaaggtaatataaagttttggagacgatttcacaataattcatgtggtcaggggagtaatcatgatcataggagaggttccattcaactaacagaaaaggcagagcggaatctgcactactttcttcagcactttgtggttgttcctccttttgccggtctctgcaatttgcatccgggtatgatttgctactgttgtttgctttgctccgtactactgtctactggtagtagttcactgctccactcttcacatgcagacatgctctgattgatctggcacatgcatcaaattggaaaagaagaaatggcatgcacaaatgaccaagatgcgtgctggtagtacacaagaaaccaaagaatttgggtcttcatagttaataccgggcctagttaactagcagttttgcaaagtttctagctcaaccaactggtagtctttcggacctcggatcatgctctctatgatttgtttttgaaaagaatggaatgatgaaagcttaatcttcaatccaccattttggtccagtttcatttcatgcagtccgaccaaaaatggcaactgaagatttgatcaaacatgattgcacattgatctgtgtcataaaataagacactagcactagctaaaacgaatgcaggattgagtcctttgcttagaagcgacatcagagatgacactcactcagttcattacaagaaattgcccataatcggtgcttctgataaaaatatccatggcttcctttgctgaatcagttatgtttgtacagattttcaaggagcacaagcgctagctactggattttctctaatttgtctctactaacactaggtgcacttgcattaatttgttgctagtaacactgatacctatcgattcaaccaaaaaagtaccatgtgacagcatctatagcaccaagaccagttgtgctatgaacttataagctaacaatctgaattagtatcagtattaaatcagataattgcacctaactaactcgatttttggtcatagtacatatgagaacttatgcattgtgacgccgaacgaccaaaacaaccaattctccaaatgaatgtgctccatttgttccagcgacagtccacctgcacaacaatggaggacaccaatcatttggggtcctagtacgccccatgcaaatgccataacaaacttcttttgacttaatgggcacctcaggccaaacctccagctatgcacaaacagttcccctagtttggctgtcccatagaagaattgaaggttttcagttcacgtttcatgttcttcttttgttcgacatctcattgtaatcagttgacgttacacaatttggggccattccataattgtagtaccttgacttgcagagagatatatcagaagatcctataggagagatttttgtcagtaagcagacaatggtagaacgctacaggaagcaatgtcaagaatatagagcaacgattcacccttgtaactatcatacatttcaaactgaagacagaaaattttagcagcagaaatatgattagtttgctaacaccacatggttctaccagcaaaaactggtgcttctaagttttaacaagtaataacaattctcccacatggttcacaactcaaggccagcagaaaaacgttctgcagagaaacgaagctatcccagctgtgcttttcagaccaggaaaggctctttgctttggtttcaaacaatggcaagaaaaggtcacagctacatgcaactgtagtactagtgatcaatgctcatgaacagatgcttaaagcagaggaatggaagattcctccctccagaaatccggcacatgggttgttgtctttgtttttattttatgaaaatgaaacaagaacaggttaggttagtcgaacgtcggcgtatgggaatcggacatctcctctgctgagagggcacctcccactgttttttttcacaagtcacaaaggtcagtaggaatcagggagctagcagttggaggcttggagcagagcccagtcaattagatttggtttggtcagattatgacaccgactcttcaatttccaatttgatactagcatggaaatcaagctgaaaactatgtgtatgctgctactaacacgcaaaagctagcatcctagcacatggcatatgaagcatatgcaacgcaatgccgtggaatctgttcaaagggaaagagcacttacgatagagtagtttgttcaatcagaaggtgacagaaagtttcagtctttcaggtgcttcctgcaaacgctgcagtggaaaggggaggcacatcaacttctcatctactgttgagctgaaatagccgcctgatctaaatttcaagtacgaaatgatcataccttgcataagtagactggtagttgcatgccatgcgcggtttgttcagctatgcaacagacaccgaaagctgagcctccatttcgaacgagaaattctcacacgaattcaaccgtttactgcaaatttcaatacaaccaagttaaaagaacaccaaaacaatcgttatttatttctcatttctaattgctttgcttattgatgaagctgatcaggtgtatgatttagcatttgatacaatgttcagaacagacaagtgaagaccaatcaaccaaccacgtgcagtcaaagcttctgaatctcctgcacaaaccgctccagatcctcgtaggagctcccaccgctcctcaccgcgatcgcggcatcggcggcgagctccttggcgcgcgcccgggcgccgctccccttctccccgaccgcgtcggccagcacggccgcgagctcgccggcgtcgggcgcgacgccggccccgcccgcgcacgcgcgcagcgccacgcccgcgtcctccacgagcagccgcgcgttcacgaactggtcggccgccatgggccacgccagcatcggcaccccggcggccaccgcctccagcaccgagttccagccgcagtgcgtcatgaaccaccccaccgccgcgtgccgcagcgccgccacctgcggcgcccacccgcgcaccaccatcccgcgcgccgccgccgccgcccgcgcctcgaacccttcagggaccacgccgtcgccgctcacgacccacacgaacgggacggcgctccgctccagcgcctctgccagtgccgccgccatggccggcgtcagcaccgcctggctaccgaagcacacgtacacgaccgaaccttccgggaaggcgtccagccacgcgctgagatcgccggctgcgacggccgcttccccaccgcgctcgccggcggcgtccgtgtccggcgccaccgggcccaccgcccacacgcgcttgaaccccaggtcctccagcggcgcgtccaggtacctcccctcgagtgcccggaaggtgttcgacacgaatccccagccctccagattccagagacaattctgcttcagcgactcgccgacctgctcttctacgaggccttctatgtaggccttgtacaacatggagatctctctccactcaaacgccggctcgccggggatcgccgggaacgcgaccggaaacccatcgtcgcaccccacgggccgcttcaccaagcggcgaaagagcgagtgcggcacggcggtgccgagcacgccggagggcgtgaagacgaccctcgggacgccgatctcggcggcgagaggttgcatccacccgcagaagaagtcggatacgacggcgacgacggggtgcgcgggctgcgacctggcccacgcgaggatggggcggtggagcgcggcgagcgcgtggatgaacacggcgatgtagacgggagggcagttcatcgtgttctcgaggccggcggggagggaagggtgggaggggaaggggaggacgagcgggcggacggagtcggggtgcgcggcgaggagaggggcgagctgggcggcgttgcccggcgtggtgacgacggtgaggcggagcccccgcgccgcgaggagcgcggcgaggtcgtagagcggcagcgcgtggccctgcgccgggaaggggacaaggaggacgtgaggcgtggcggtcggcggcgccattgctgcggtggtgaggaacggaggcggcgtcggcggcgagctcctgatttataccgtacagttaagaattttttaaattttattaaaatatttaaaactatttttttaaaagttttacaaatctgacctctcatgccctgtgaaagggcggatggcgtcccgttctcctcactcatcggccatgttttacaaacggcttaacaatgtattttttaaaataaatttctacaggaaaattgttttaaaaattcacactaacccactttttaagtgtttttacctaatgcttaaccaattgtgcactgatctaatatttcatttttggtgcgaaaggtgagagtttccaacccgcggtcggtcaccttgcagatagcccttttaccggcctcccaaagggctaggccgtctgcaaaacaatcgggtctaaccagtttacaggcagtcacttgtcgccgatgggtagatttgtaaaacactgaaaaaaatattgttaaatattttaataagtaaacttaaaactgaaaaaagtttctagttagtgggatcggaatgggctgggcctgagaagactactacatgggccggtggttcggcccagaagaaatcaggtagccgacgagtcatccacagcgacggcgagtggccaccggccgttctacatctcgcgcgcggcctccggtcgtcgtcgcgactccgctgccgccgtcgcccggcgccgccggtgatcccgctcatgtgctagtagaaggcgttcggagctctttgggagtgtcgcacgcatggagatgaccagaagccttacgctcgtgccgctcccggcgacgctccggccggcatccgcggcctgtcgccggcggcggaggcggcgagggcttcccttcggtgcactcttctcaccatcgcctccttcgaacgtatgtttcttcctcccccagctaattctgttccctgcttgaatgattcagtagttcgcaattcttcttcagcagcagcagcaggaaatgcacatcagggcgctgcagccgcggcaggattgggtgggggagtgggtccggagcaacgacacgctagtccgcggcctgcccatcctcggcggcggcgcctccctgctcgccgtcctcctcaaccgtgcggtttccggcattgcagctgtcgccgacgcctccaggtcatcctgtgggtgcagagccaccccaagaaatgcccccattttgcgctcgtcttggattggatttatgattactgaccaattggttaatttgatcttcatctcaatagttcgcagtcaagggctgacatactgactcttgctctctccgtaactgatattcttgctggccttgtttggttgtccatccggccgaaatccatttctcctgtgagttttttatcctttgcggcatattactgtagtaaattttttacaataattcctcattttgaaatgatcttaggttgttcctcgaggtgtcgagtgcaaacgggtaggaacgggtgtattggactcggctcttcgtgaactactttggtaaccattttactgatacacttcctgcttatttcaatcttaagatcttattttaattcatagagatcatggaagctcaaataatgaaatattattacttaaaaacctcgctaggtgttccataccgtgattctatataattactagtgctatgatcttccatgaacataactaaacaaatctttcagttttatgcatacacaatcccatccatgtacttcatgtcaaggaaattatgttgtgaggctggctgtgacttcaacttctcacaaataggacatgggattcccttacaactgcaacttgttgcaaatccttggttgttgtgtatggaggtaattgtgttcttcaaattggggttgctgctggctctccagaggatggtaatgcagttatggtggatgcacagaagttcatgcaaggttccctttatagaagtgccatggaatccaagaagcgtgagtgtcttttgttacttataaagttctttttttctgtttgatttcattcagaaacttcactttggtcttcttgcagaatcttacctagcaaatcttgccttatatcctggaaggactgaactaccattcttgccagctaacacgcaggtactaaaaaattctttcatcttagagaaattacatgtaagcacgcattggtgtgtttgtcaacttgttatacttcacgaaagctgatcataccatctttaaactaggaaactccagaatgcatcctctcttttgtttcattgaaaaagaagggggaaatcttattaagtctaaagatgactgcattcaacattcagatgaattaattgtatgaatgtttaaaaccaaagcttttgatatcttccctgatatacaggccctaatattgcaaccaattggtgataaaggaattgcagttattggtggtgacactataagggggttcactaatcttgatcaggtgctatttctaatctacagcctcctaacatatatagtaccacgttttgttttgggtgattcgcacagataatacagagaaaaacaatctatatgtgtaagctaaagatcacagtttttaaaaacaaacacaagccaaaactaggtcaactaaatgcttaacattggttttatgctcacttttgctgaagcatacaatctctacggtgtgtgtttgcattggagcatttgaagtattgacggtgagatcttgcattatttgcattgcagctacattattgcttttgagagcacaaaagaccgaatgtaatgaaaagcctgttggttgtaggttgcacacttgcactgttttaaattcagtatgacggttactgtaaaaaaaaaatcagtatgacagtagagagacaaccattatcctgttgattttccttgcaggcatggattgcaatgatagcagataaactggatgctacattgtcaaagtcgtaagaacgcgtagtttgttggatattgtttgtatcttgcaattggccaaactgtcacgagagatgatcatctgtcactgtacatgttcaagttacaggtagagtttgcaaaaccaacggataaaacagtacagggctggggttgaccaattgttttaagccaggctgtatgattaggcttgattaagtttgaccagcatgaattgattacaatgttagttacttcttgtaaccagtcactgttggctgaatgaatcacattactgatgctttcatttgtaagatctcatcacatttcaaagagtttgcagtgaatttacgttaagaatatcctcctggaccctctctaatactcgtgatcaacagtcgataaaatggaggaataaaatgagccctaacaactttctacagttaatgcctagcaatctaaagcgcacaaaccgctgaacaagaagagcgtctagagatcaaaattgttcctctcatgactcatggtgagatcaaaactgctcctagccgaatggtctcaacatccttctccagcttcattcatccaatctctctgcatctcaaaatcatccctccaaagatcttcattcagccactgatatctttgctttcttcttctcatgctttttaccagtttttcgctttttttgcttatccccatcattatcttcttttgttggttctacatgctcggtaggtggcggtctcttgtttgaaagttctgacttgtttagttgagcgccatacgccatctttcgtacatagaagcttgccacatccccattgtcgcgtttcagcagcacatttttttgaagtcgcccgctagagtcctgtgtgtttcagcatagtatagaactgagaaatttaacagcacattgatgcaattcaaccaatcaaatgataagcacaagggcaaaacccaattagtggaaaatcaaatggtataacgtaccttggcctcttggccatccagttcatcaaatgccttctctacctcatctctgtctccaaatgaaatacatgtagaataataatcaccccgaacccttgaatcaatctattgagaaggaaataaaaccattagactataaaagtacatgtgtattgagcaaatcataattagtatgcaaaaaccttctcatcaatactgggatttccagaaaataatttgagcagctcctgacaaggcaggtagactggaattttgtgagcaagcaacttcatcatatcagattcaggtacctaagaaatggaaataaacaagtcagttggcaactccctaacaatgctgaggtttaagataattgtttactcttacactatctcttgcaatttcaatgggatcattaaatccatgcttaagcttggcgagaactagattcatcgcagcttctgcatccttcaagcagttatgtggctccccttcttctcgaacagcatagcccaaaacagactagaagcacaaaaatcaacaaaaaaatttcagcatgcatagattcagagcatggggttcttcaggccttgtatgcattgtttttcttaagcagaacatcattcataaggaaacaaggctacgagtaaataagatgctatgcagtatccctttaactgtaccttgcacaggctgtttaaagaggctgatgcagtagtaggcaaatttgcatacttaaagatgtatgctgtatcaataacccgagagtagtcaaacttaagagctgcaaacgaatcaaaaaaatgataaaagctgagttacatactgagtaacaaaataaagcctgccaataaacatgatggatgcatagaatgactatatcaaatagattggaccgcattaatcacagattaccatgtaaatcttttgataggctatgaccaatcaagatctttcctttggacaagagcttcttcaac

SEQ ID NO: 42218 - DNA, 3863 bp, Oryza sativa
aagaagaaagatggaaaattatggcatgattaatgattacaagtcaaaggacattgcatcaaatatacatgtgtctaatgtttaaaagatttggcataaactttatctaaccagcattaaaacatgtttttttgttgaaattatgtagtgttaggaaagttctgcttgttgaggcacgcagcagaagacaattcaatgcgtccaaatataatacctctagattgctgttgacaacacatactcggaccaaggcttccgtaccatcatggcaaaggaccatctcacagtcaattgccaacatagttgacttcataaaattggtaattttgccttcacgcagcactttccatccctgtcaacatgtcagtaaatctggagttatagaaaaccatagacatctctaatcttcgcaatgggtgacatgaagtcagagaaattctcctgtattaaacactactgaagtacagtagatagacaatactccctacatgtttttgttaacatttaatacagcggtagaagtgcgggcggaaaagaataaaatcatacactttgaattaatgaaagaacaattcagcttgtacctctttgtaagatgggaaattataatttttcctgtactccgggtgttctgctgtcagttgaacaagcttctgcattttgcagaatatacatcaaaacaattgttaaccaagttttgacacctttgtcttggttataaccagaacaatccagaaactacacaatcatgagatagcataaataataccagctgaggagaaatcttgtcaggaaattccttcaggaactgctcaaaagcacttcgttcgttcagacgccttatcaattttccgaagtactgtaatcaaaaaggagaaagacacaaattgtcagtatctctactcaaagagaaatttaaggatgcctgacgaaattcgtggaacgaaacccatcgaactgaatcaaaataccaccttctggaaatctttggagaaggttagcaggaaagcaagcagcacatccttggaccgcttcttggggtcactcacggaagctccgaacttcttgtcgttccgagccaagaaatccttccatcccccctcggcgcccttgagcccgttcttctgggtgaacctgacgatctcaacgagcacctgacaacgaacacagcaacgcagaatcaggggagaataactcacgccaggtttccgcttgctgctgccttgcttttacctctttctcggcgccggcgagccgcttgcccattagacgaccacgtggaaacaagcaaggaagagcaggggaagggagtaggaagcaaggggaccgcgggttgcggcggccgctcgttctcgtgggcggcggcggcggcggtcgggaagtggcggcacggagaaaaccgccggaaaaaaataaaacaaaacccttctctttgctgccgcaagcgaagatcggtgggtaagtagaaaatacggcccagcacgttaactgggccgctttggctaaatttgtgaaatcgatcagtgggttcagcccacataaggtccatgtagtaaatgagattttcttctttaaaagcctatctttttatgtaaaacaggtccatatagttaggtctgcaaattaattaagttattattagtatatgaaaaaaggccaaatggccccgagtgacaatctttatatttgttgattttagtattatatccactgagttagcaaaatgggatcgaattggttagtttaatgcagtgatccaatgcaaattgagttcacgttccggccgatccatttctttcgcgtgtcgattgcttcgaaccggctgaaatgaatcgacgagtcagcattctagggaggtcggaagcaggcaggctgcaggcatacgcgttgaactgagctggcctccaaaacctaacctagtaatagtaagatcatcgatgacgccatggacctgatcagatcgcacaacccaaaagctgaggcgtatctggaggctggagcccagcattctcgcaatctcgcccgtgccaatcgcctaatccacgcgtgcacttgcatttcttaatgcgattgatatccatcctgtcatggccaggttcttcgtagcttagctgctcgtgtcaacgctgacattgtcacagttcaaagtcagatacacgctcaattacacagccagtacacaaatcaaaccttccatctgacagagtagcaaaaaaacaagtactgtatgctgtactacgagcatgcgtggcaatctggtctggatgggtgcggacaatctgaagcatatccctgacgtgtcacagccaagtaagtgccagcctcatcgcaaattcgcagagcgatcggcttgtccgtgctcgatcccgtgtcgcaaaacgcgattactttgtctgacgaagtgagtgttacctccagcttattagccttatctccggctttgctattggtcaacacgatgaggtagcatgctcagctccaaccaaatggcggcacaaagaaataatttaacgactcgtgcacgcgcattatatttcttactcgtgccgataactacgttgatgcatgctaatgcttgtgtgtgacgtattcttccccggttatagcatgtgtgcccatgcgaaggtacgtgtttggttcatatgtaactgatcgattatccatcaccggttaattaagcataactgcaaaaataaagggattgggaaataacatgcccaaagatgtttctctcggccacagttacacggtggttgcttttttttccccctccaaacagtgaaaaagaccgatactatttgcagactatgacttgcaaggaacaaaagataaatgagaaaaaaaatatcttttcggttaagatttttaacggcaagtaaaacgatattcaatagtatatgattaattgagtataaattattataaatttgaaagatgaatttgtttatcttttaaaagaaatttctatatagaaagtttttgtaaaaaaaacaccattcagcagcttgaaaaacgtgctcgcttgaatcgaggaatttactaagtccaaaaatcaaatagaacacaacttgaggccccctttgattcaaaggaaattcatagaaattttaaaggatttcattcctataggaattttttctatatagccctttgaatcaaaggaatgaattctctgtaatcccatgaacttcctatggaatgtctcttctcatgcaagttttggaggaaatttagcatgaggttctacctcgtgttaagaatcctttgagtctttatctctccttaaattcctgtgtttttcctgcagctaaattaaacggtcattcttatatttttcctgtgttttgcaatcctctgttttacacttgtattcctgtcagaatcctatgtttttcctattcctctgttttttcattcctatgattaaaaggggccctgattgtttaatatcgtgaatgggctgttcgtactccttctctctcaaagtaaaagcatttctagaatggaattgccaaatcacgtttgacagaaaaatacagttaaaaatcttgtaaatttctgatcttcaaattcacttcacagcatgtgtcaagcctcctcctcgacatcgacaaactctggcgataggagatggcctgacgagttaaggtttaggttggcgttggggttagggtgagaggggagtaagggggaggaggaagagatggtcgtgagaagcaacaactattgattagcttaattaattagatgatcttcaaaaaaatattggaggggtcctagcctctgcatgttcctctgtttttgccttagcactgctcaagtcgcgagatagatagtgggtgatagatcagcgttgacagcaa

SEQ ID NO: 42219 - DNA, 1839 bp, Oryza sativa
aaaaaaaacaaaccttatgtttatgtgtcaacgtttaactgtctattttatatgaatttttttataattagtatttttattgttgttagatgataaaatataattaatactttatacgttatttgttttttaaattttttatattattttaattttaaataagaaggacagtcaaacgtcggagtcgtcttttttggaagggtgggagtagatcgtttaaacgtttgaggtttcagctggctggtagctagagagatcgaggacggggactggcagagcaacgagcacagctagcggaggttgagttatggctgggctggacgagcgggccatcgagtcgcaaaagtagcggacgttcgtacggggtggatctgggaggatcttggcactggggcacaagaccttcttggggagccgtgcgtgcgggtcatcaggtcaggtccaccaacgacgccgggccgccttgtccgacgcgaaaagtgggggaatccaccgcgccgcgcggccccccggccgaccacaactggagggaaacggacggccgttgcttggttggtttctgacgcctctgcctctgcttcctgctcgcctgcgcccccgcgtcatgtgcggtcgaaaagcgcggcttgcctgctgcctcgttgtcctcctcgtgcatcccgatgctcacggccgccatggctttcagcgctcggtacactttcgcatgagatggagtcgtggaggcccaggtgtgtacaccgagcaattctacacaaacttcaatcgcgatttctaaaaacctgtgtaacaacatggttaacatggagaattaagcaggggacctttgtctgcttgagttaaggtctttgtactttgctccccgtttcttgccttcaaaaatggcttgctatggctggtgaaattccgggggacaccagccgcatgacaaattgacaataggcagagggacaaacaactcaaaacaagtcgaccattgttctatagctcgtgcatgctctaagagcaggtacaatagcagactattagccggctgtaaatatattttaatgaaataaaagatgagagagaagaacagcgggctacagatctgtagccagctgcagcgcaaactccaagacgcaatgtgcgtatgacaggtgggaccatatattaattacatataaaaagcaattattgtatgaattaactattaaattggctatagataaattagagctagtaatgggctatactattaaacttgctctaatctctatagtcaaatcaaccatttttctatgcagcctgcactttgtagcagtgtgcaatttgcaaatagacaatggcagtactaccactagtactggaatgaatctgcgtgagagtcagtgttcactgcaccctccactcgacagccgtttcaaaacttgcatattcctccagttagcttacatacatgcgcgcgcgtacgtgtggaaccaactcagcctagtacgtttccttaattcttaatccaaccagatcagattaaataatcttctccatgctagctgctcggcgccaaggcggctgtctgtcttgtctttcctccctaatttgattcattgattcttagctccagataattaggatctgtctgtctgccattcgtgtgtggtgctgcacgagtacttgagtggtaattgctactctcgctttccattgcactgcaaagttactgtgatgaaaaggaagggtttaacccaagtaaattttggttttaatctctggctcatcgagtgctcaaaagctttgcatcagactggcctctcggctcatgaagtgcccggcagggctgcgcgtggcggcccgtccatc

SEQ ID NO: 42220 - DNA, 1825 bp, Oryza sativa
cttttaattttgacgtggaattaaacacagcctaagcttctctctcttttttttcttttgatattcatggctaccgcactcgagtacagagcagtttgttgatggagtccaaagattcggatcttggagggaccctgaagacgacagcttttgcctccgtttcaacatcagattccaagatgcacattggcagagatagatgccggtccaggacgcaacgatcgaatcaaggctcgccacaaacaaaggattccagcaggataagcagtggtccagccccgggggttgatagtggctcttcgccttgttttcctagtgaaattgctcacgtcttcagacaaaaagagtgaaattgctccagaaaatggccgatccattttgaaagtgcaatagtgtcaaaactcaggtctgtgacttgattgcatgagaacagtagtgttagtgaaagcgaaataactaaaatgaatatatgtagagacatgcttatgtgcaactttttaatctcagccactgatgatctttaatttccgtgtaatttttttttcgagcacataagcacatctcgtatctcgtgtatgtattaacttcgaaacccgataaataaatctttatattgtcacttttgtggaatagtatgcgcttactgttgtatggtgatgacatgtaggtttgaggttttcaactacagtggcagtcactctagaaatgtcagtgtcttgtggaaaatgaacatgtctcggaacttctaaaatttttagggttgttcagattgataccgttttcaatcatattattttttagtaaagttgtcaaaaaaatctacgtttaatttgttgctaattttggtaaatacataagaaatcatgctaaaattttagcaatattaccatcttgctaaaattttggtaaaatttattttggctacaatctaaacatgccctttactccctccgtcccaaaaaaagacaaaccctggtttccgtatccaacgtttgaccgtccgtcttatttgaaaaaattatgaaaaaattaaaaagagaagtcacgcataaaacattaatcatgttttatcatctaacaacaatgaaaatacgaattataaaaaaatcatataagacggatagtcaaagttgtacacggaaattcagggtttgtctttttttaggacggagggagtatgtcatatgtgtgttgcttgctggagagaactgataccagcatccactcctttgggacgcaggtgaaaatacgaggcatctctcactgtccctgatcaggacatacacctggatttaaatggttattagatcagatttaacatgcaacatgcacacatattcaaaaataaaactaaaaagacgaaagggcactaaaagcatcctttatgtgggacaggccaattactatcatgctggagatggaaagcaacggattacagttttaactcatagtgtgcctaactttgacatgaatttgcgggtattttatcctacgcgttaacccctagccagtaaaatctgctaagtgctaacgtaatccttgaggacaggatattctgagagttttcaaggaaagtacgatgctaatgtcaccaatacgtggaatattcatagtaaactaaactactattggtagtggaatcctgaagattcacttaataatgctcatggaatgacatcattcgtggaaagaaaccagacatcatcgcgcagtatccttcctttcaggtttggagggattgcagtagctaatttcattttgctgactaaccttgactaaaagagttatttaatttgtaaagcacaattgaagtactgaaagattg

SEQ ID NO: 42221 - DNA, 9874 bp, Oryza sativa
tggtctgaaactatattttgcttccgaggagattaaaacgaatctgggaagaacatgttcttgtttatgcctcgttccaccggatcagctactattgttcgtccaaaaagaatgcaagtagcagattaattacactccacgcccttaagaattcgatcaaaatcacgcacgtaattactctgcagtttccacggaatccttgtttacactttcctcattgtgacagatacgaatcagggtgctaaaattaaacccgagattacagcggagtatattccgaagaacaggaatcttctgagtttactccagatataagcatttattccttgcctttaaaggcctgatatctcacagaatccattagtttcattttgagagtggaacggctgccatttgtaaacaaccttccacaatatttcgctgtgtactagtactatactactatacacagaaatctaatatgcgtcacaaacaggaaagaactggcagaaaaatatacgcctcccactttccttgcaaaactgtaggatatccaaatgcatcgcgaatcgcagcaaaccgagaaatcccacgggaaactattttaatccctcgagagaatatcccctcgttctttgtatgtcactcaaatggtcatgaaaaaaattgaaaaaaaatgagaatgtgtattaacatgtgatataatactctacaaacatgtaagttcaaattcaactcctatatatcgtaacgaaagaaacaaattaaactgtagctagttaacatatatttagagtcaaatttgtttttttcattgtgagatgtagaagttaatttttttacttgcctgtttgtacagtgatatatcacatgttaatatattttcttaaatttttaaaatttttttcataaccatttaagtgacaggcaagcaacgagaggatatccgtccgagggatcaaaatcctcttccgaaatcccacccaaatttcattcctgctgaaggaactagaagctttataaccgcgataaaaaatacaagcgacagcgatttaggcagtagaatcccccgcgacccgaggagattagtctaattaacaagtgcagattccctagcatctcgtgctgtgtttaactgcgtgagtgcgcatccgcccctgattcccaacttgcgcctgcttgtctggattccacagaatcacgcctcggatcttctgcgccaacgccgccccccttcccaaaagaaagaaaaacaaacaaacaacggcgttggctacagttgggtgtcgcccagcctggctcgaaaacacacacgcgacgcggtcgcggtcacgcacaaaatacacgacccatgcggtgccccctcccggactcgagttctccataacccaacccagcggcggaaacccctcacgtccgacccctataaatacccaccatctgccgcgccatcccatcgcaacgcacgcacaattcacagcaacacaagcagaagcacagtagaacgcctaggaaatactacgtcgatggcgaggtgggccattgcgatccacggcggcgccggggtggacccgaacctgccggagcacaggcaggaggaggcgaagcgcgtgctggcgcggtgcctgcaggtgggcgtggacgcgctgcgctccggcgcggcggcgctggacgtcgtggaggccgtggtgcgggagctggagagcgaccccttcttcaactccgggaggggctccgcgctcacccgcctcggcaccgtcgagatggaggccagcatcatggacggccgcggccgccgctgcggcgccgtctccggcgtctccaccgtcaagaaccccgtctccctcgcccgcctcgtcatggacaagtccccccactcctacctcgccttcgacggcgccgagcagttcgcgcgcgaccaggtaaattatctttcgctaattaacccacacccaactaataaatcccttccaattaattatgctaatttcctggttaatctaacctgcctctgcacgctaattaacaaaacatttttaatgtggaattattctgtggacatggcacgagggaacgacggatattaataccggacagccaaaatctaatggtggtaggaaataattaaaaactgggacatgttcgacacgtgtaaatgacgtccgggaagccatgtacaagtgtgcaacatgaacctccaaacagtaaacagagcagcaacagctctgcattaccaaaaatggctccttgtttccttgcacagttcaatccagcaagattccattccaacacgacaacacatgcatgtgaatcctactacggctttacatgaaaaaaaaaagtaaccttttttctgttagcttatttgtaggatataagtgcaagaaatctttagtttcgtttttttctatatcccttaatcctattgagtcatttgggtgaacatgtcatctaactatgtgagttgcatgcttatctagctttacgtgatttagtgggaaatacaattgatgtgatagaggtttaattcaataggccaacaagttaagcaatcttgcttaacaatttctatgtttttgctgcatgtgcatacaaatacatccacgcatctgaaaatttttctgtgtttttgctcacgagttttaccattttcctttttgtttatgcttgtgcacaccttcacgtgctgtcgccttttcgtccccgggtctttggagaaagctgtggaccaaaaacgagctggtttctagtagtatcaatgaaagcaacagcggcgcaactgcctcctgctgtgcttgaatttccctatcaatcgctagagcggccattagcttgtaggtgtagtaatttcttcgttagtgttggcgaaggtattcatttctttcccttacatcaagtgctgagaaaaaagaaaactaaaaaagtgccacccaacatgcatcaatagccgccatgcaggtttgcacctaccaaatcctttttttttcatttatttggtcgacacgattcgtgttaaaccttcctgcggtattttgtatcgcctagtagtatagtcgttcgagtcctcaagtcaagattgtgtagcacccagccacccacaccaagcaaagcctaggagcactgaaaatgaaatgaccagtccgatgcatgtgccggaaaaaacatttttcttcactaaacaaaagtaaacactagaaccaactactccgtggcactgtagcaactactagcatgtactaggatggattctatgcacagctaggcaggctctccactgtgccagattcggcgctgctcctgtttctttctgcccggtcgaattttggcaggaccagcagctgcaggaggaatccgtcctaccagcgtggtccacccgaatcctgcagatctcacggtgtagtggtggctgcgtagccaagtacaggagtattagtagttaagaaacgtttttaagatagatttgattataatcaaaatggatttggactggtctgattttttttctctgtggtcactgtttgcagggtctagaggtcgtcgacaacagctacttcatcaccgaggacaacgtcggcatgctgaagctcgccaaggaggccaacagcatcttggtccgtcgatcattacatttcattgactcatgtacattacttgaaaattgctgacatctaacggtgattaatttggtacgagcagtttgactaccgtatcccgctgtccgggtcggagacgtgcggcgcacaggccgtgtcgtcggacaacagccacggcaacggcatggtgatgaacggcctccccatcagcatctacgcgccagagacggtggggtgcgcggtggtggactccagcggccacaccgcggcggccacgtccacgggcgggctgatgaataagatgacggggcgcatcggcgactcgccgctgatcgggtcggggacctacgcgtgcggcgcgtgcgcggtgtcgtgcacgggggaaggcgaggccatcatccgctccacgctcgcgcgcgacgtcgccgccgtgatggagtacaggggcgccgggctgcaggaggccgtcgactactgcgtcaagaagcggctcgacgaagggttcgcggggctcatcgccgtgtccagcacgggcgaggtggcgtacgggttcaactgcaccggcatgttcagagggtgcgccaccgaggacggattcatggaggtcggcatctgggagtgaggtgggcagcctttgtgcgtgcgtgcgtgggcctgtggccatcatgcgattgccatagagtggtgtcttggggtcatgggccgcctcccgtgtgttcgtgggctagaattagtgggtattaattagtggattggggagattggaggtgggcttgaataatgacgatgatggcgataattcgtctggaaataataatgtgaaaagttatattgctaccgaggtgtgacatgttttctgttctgtagctatttcctcactgtctctctcaattctgtacatcaaatcgctctaaactggagttagcgtgtgttgcgctagtttaggatatgttcggttaatcctgaaagggaggaaggaattggaggggatttattccacatctattatggtgtggatttatttcccctcagacaccttcaatccccttcaaccccttccgaaccgaagaaggtcttagggagaagtttactgtagagcaaagggtttctttggttggacttcctgctattgattcctggactgtgatcttgtataggctttccaattgctccggcccataattggttgtcgcacatagatataaggcccatctatcttacctgctctgactttcaagctctcatcatttccttattcagcatcagttgccaacatttaaattttttaaaaataaattagagttgatatcaaagttttctcatcaaagtttattttttgacattagaatttaaaccgctaagagcatatatatatatatatatatatactcacaaattattattactttgctaatattatccgtattaggctaaacgatgggggcctcaatctttttctcatctccatttttctggccccactttgcctctggcatctacgcaccatttaaactgtaagttgttcgtggcagtggcaatttctgtgaatgtcccaaccggttcttgcgttagttcaacttttctttttgttatccaaggaataccatatgatcatatgatcgtacctattccgacagttcgactgagcacggcatgcatgttgttagttggatgaaataccaaagggcaagttggtgctcaagtgatgtcatcacttaggtggcgaaaggatttgatgaattgcagacagcacaccttgccagcctcatcctccctctggattagtcacgtacttgttggccgcccgtgtactactccactaaatcccctaatcagtagagcatccgatcagggcagatcagccatcaggccatcaggtgtattggatcacggattctacgactaagccatattactgtagtgtttagtgtagcaatcagaaccgacaaactggtagctatagctttagctaatgcggcgctaaacaaaaaattagtcggaccgaagattccaacacgactctttgcttgtttattgtatatggccacttgaggcagacaacaacaatcgcgtccatgtgcaatgtaactgtgccactccgcagtgagcccgaaacctctccttttcggcgtgcagatgtaatgcgaaatcgcgaatcgatcagccattcagccaagccggccgtcagattcccgtcttccaacggctccgcggccaccagcttgcgctgcgcggctgcggcgatcgcgatcgcccggcgcttctgtgttttgaccccgtgctgcgattcgcgaagcgatgcgtttgttgttgtgttatgtcgtcgcgcccccgcgcgcgcatcggcatcgggccgtggccgccgtcggtccagccagccaccaaccgcccacttaagaatatctcgtctactttcttcgtcacataaaaaacgaatataaaacagatataacatattatatatatttagatttataatattaagatacgtcatattcgatacttgattgtttttttaaaggaatggaggcagtactcggctagggtgcgtgtgcgcgcgcgtggcccaccgttttttttttcctcttgagcacactgacgtggtggaccagaagtggtgctatttctcagagggaccggaccacctgcgtccgggcctcctgccattacgtgatgatgtgtaaaggacgaggctttttgagcacacaggggaggaaaaaacctcggcaaagtaggcggcgctgggtgcagatcttttccgttttgttggtaggagaagaatttgccttgcacggtttgcgcctcgctcgttcagcatagtagcataccacctaccgcagcaatggacgtaccaacaagcgtacgagtgttgctcaccagagctactactaccggtctgtcacgctcaccctagtataaggatcaatgagacttttcatcctcccaggagacttttccccttgccaatgtagcagcagctcagcaaatttgatcgtgtttgtgtgtatgtccaatctatcactgctaagccaaaatattacaatactacactactatgcagtaccctttttttgttacgaaatataataatttataattagatgaaacgtactttggtaccatgaaactagatagatcatctgttttgttatagtactacgatgatttgcaataccaactaggcagttttaaatttgccattttgctagtacttgaccagccaagcgagtgaccccaaatcggcctcctcaatcaaggttaggtaggtgccaatcaatttgatctctcacctcactctcgtgggctcaccacctcacctcgctataagtaaaagcgccgcacgcaacccaccaaagcccacccacatcgccgcctcctcctccttcctcggtttcccccaaaaaccccaaacccctcctcctcgccatggcggcgccgtcccagaccaccgccaccaccacccaccaccgcgtcctcctcccgtcccaccaccaccaccgagcggtgcctccctcgctcctccgcctcccgctccgcgccgcgcgccggggccgcctctccgccgccgccgcggccgcggcgcccgccgcgtcgaccgcggcgccgtcggagcccgccgcgggtgccgtaccggggaagccgacggtgctcgtggccgagaagctcggcgccgcggggctcgagctgctccgggggttcgccaacgtggactgctcctacggcctctcccccgaggagctccgcgccaagatcccgctctgcgacgcgctcatcgtgcggtcggggaccaaggtggggcgcgacgtgttcgaggcatccgggggaaggctccgcgtcgtggggcgcgccggggtcgggatcgacaacgtcgatctcgccgccgccaccgagcacgggtgcctcgtcgtcaacgcacccacggcgaacaccgtcgccgcggccgagcacggcatcgcgctgctcaccgctatgtccaggaacatcgcccaggccgacgcgtcgctcaaggctggtgagtgcgcacaccctcctcaagtctggaaaagacacctctttaaaaaatgatactgtacttgtctcgatctctgtttaaagcattaaaaaaatcttgcatcaacgtggcacctgtaacagtggatcgtgctagaacgtctgtttgatgaattgctagcaaatcgagaaacacgaatgggtgctttttcactagaagcagtcctcagagattactttcgttacttcattcaatttgacataatcagaaaaagttaatatctgcttcagttgacaaagctagatgcatgaagatgtgaaaatgtggagtaagggtagtcttagatgaagcatctgccatgcaatcttcgaatggcatcttcggaagaagggcaacataccttttcaattatgatgagttcccatgttcttaacaatgtgtcttgtataggtaaatggcagcgcaacaagtatgtgggtgtatctctcgttggtaaaactattgcaattcttggatttggaaaggttgggtcagaagtcgctcgtcgtgctaaaggtttgggaatgcatgtgattgcacacgatccgtatgcttctgctgatcgtgcccatgcaattggagttgagctagtgagcatggaagacgctttgacaactgctgactttatctcgttgcatatgcctcttacccctgcaacaaacaagatgctcaatgatgaaactttcgctaagatgaagaagggtgttagaattataaatgttgcgcgtggtggtgtaattgatgaagatgctctagtcagggctcttgattcaggaatagttgcacaggtatgtttgattctcttagtctacatccttttttcatttcatgctgacatccggtgaattatttttgaacagcttgtttcccagagtcatgctaatttttttgtttatccctctgctttaggctgctcttgatgtgttcactaaagagccaccggcaccagacagcaaattagtgctgcatgagaatgttactgtaacaccacaccttggtgccagcacagttgaagcacaggtatgcgaattagctcagaatgctatccctttgtgttctgttatactagataccaaaatgataaatatctgaaaatcccaggaaggagtggctattgaaatagctgaagctgttattggagctctgaaaggggaacttgcagcttcagcagtcaacgcaccaatggttcctgctgaggtatgaatctattgttttctgctaaatccaacttattccacatggcatttgatttttatcttacatccttgtgatttgttcaggtgctgtcagagcttgcaccttatgttgtgctcgcagagaagcttgggcgcctggctgtgcagctagtggctggtggcggtggtatcaagtccgtgaaagtgacctatgcttctgcaagggctcctgatgatcttgacacgagacttcttcgtgcaatgatcaccaaggggttgatcgaaccaatctccagtgttttcgtcaatctggtcaatgctgacttcactgcgaaacagaggggagttcgtatcactgaggagagaatcttgttggatggctcacccgagacacctattgactacatccaagttcatattgcccatgttgagtccaaatttcccagtgcaatatcggagagtggagagatcactgttgaggggaaggtgaaggatggcatcccccatctgacaaaggttggatcattccaggttgatgtgagcttggaaggaagcctgatcctttgcaggcaggtcgatcaacctggtatgatcggcgcagtaggaagtgtccttggtgaggagaatgttaatgtcagtttcatgagtgttggaagaatcgctcctcgcaagcatgccgtcatggcgattggtgttgatgaggaacctaaaaagagcacactgacaaagattggggagattccggcgattgaagaattcgttttcctcaagctctagattcatgcgttgtatgtttgaagctgcaaacatggtgtgcaattttgatgtagctagctatttaatcaggatctagaggactgatggttctcgttggaataagccttttttgggttatggtgctgtttgtcgagtttgatgcagtgtcttgattaatctggcttaggtttgaacatggtgcttattaataagaagccctctgttaatctatgtttactgtgttctatgtgatatattttttgcttgccatttctgcttttaggctttgtgaccggataatctgttgatagttttaagtaagcctagcttatagcctgctt

SEQ ID NO: 42222 - DNA, 1282 bp, Oryza sativa
acaaatgaccatgaaagccatggtgctaatgtctcaggagagaatagttagtgtgtatgttttctaattttgtaataaatgttgaagagagcaggaaagataaatgagggtgtgcgcgcacaagagagagcctaattctccatgcatgccttatattttgaaatatgtttgcaaaaactatgggccttatatttctaaatagatagagtaatatttattttattgatgaatgatacaaagatgcgcctgtagtgaaatgagatgacctagaatatatgccgttatgaatctgaagtacaactgtttctgggaagaaaacaataatttgttgaatgattcaagattgatttaatcaacaattaaaagcactcagatgtgcaagacatgcagaatattgaatggaaatttattatggcatattgaaaatatcaccaaaagacaatgttggtgaatagcgatatactgtaaaacttatatgagcagatgtgctaggaattgagcagtaatacataaatccaaaactgcaagtataactttatatgattaacaatcatttcaatacaacaaaattcaaatcaagaacttttagttaggaaaccattctcaccagttcccaaggtgagtaactttagctgaaggaaattttgatcttagtgcggccgggatgttaccagaaaaggctggaagaactgcaatcatgtaagatattagacaacttaaaatgtaaaatgaacaggggtcagcgtttaacaactagaaagggcaaactgcatacttgtttatttaaattatctgattttagcagagaagttctgaaagaaatggcaggagagaaatccaaaccactatattttcatgagatcacataatattaactatgctaaataatctactgtaaaacatatgcatgcttatgtaatcacaataccacataaagaccatgcactaaaaaaatgcaactgttttgcatcacctgggaacatgccaaaagcatacatcctagaaaggattttcttctgaagagctagctgatcatcaagccagctttgaggaagaggtccgccccatctgataaatcaatttgtcactacatgttctttgagctacagttccttgcaacaaaaattgaactcatagcaaaacactaatatgaaacatcaatataagtcatattatcaacatggtggcttgtataaatctctcataaaaaagggacttataagttcatcttacaaccgataagctaactgtttccagcaactacccccttattcgggggggg

SEQ ID NO: 42223 - DNA, 14391 bp, Oryza sativa
acagagtttaaacattttttgatctaagaacacacggacattgcatagatcaaaatattcagtatcagtgaacagcaagcttttttaataaaagagcagaacacacacgcacctgaaaaactttctgccatatagcttcttgaccagtgaaagcaagaggcaaattgataccttgaagagccatccagtcaatttccttctcccagcgctcccaatcccaccaagcaaaagaatcttataagagaaaagtagtctttaagaaaatcatttccactttccataaaaagtaacagctgagaaaaattgctcaaagttagcatggtataaaattcaataaaacaaaagatcgacaccgaaggcaccctaaaagtcacaccggacagtacaacacaaagagatacaatcaggaaatatctcattcaaacacaaacatgggtagcaaacaattgaatccaggacatcaatttgggagatggaaatgcagcactattcctgacctgaatattttcaaatagaatctgaaaatgttgcttagtacataacagtgggaaaataaaacgtttttaagaaggcatgcatatccaccataagaattcggcaatatagcaggataaagtgttaaaactgtacataaagtaaaaacaagcttacaactggatgtaactgcattctggtagtagctccagccaacaggtctttgaatcaaaatgccaccagaaggaagacgaggtagtgagccaggacgtggcactgatgataattgtgcaccaccagttttatcccatgatacatgtgctgcacagtagtgcttcaagtaccaatgaagaccagcagagatttctaccccacttgttccaagtaaactggcaaaaatacatgaaaggaatgtatagctcatgatttcagtatgtagaaatagtagcagaatcttataaaaaggggaaccactataatgtgtaggtaagcctcaactagtatagcataatggcatgtaacctctgcaccgcacagtggacctaactagttaaatgagaagctggtgcatgattctagcagaacatgctgtggccagaatagtcagcatcactttggatgcacaaaagaacgcaaatcagaagagtggtgaaaaactagacattcgaaaatattgggaaatttgatttcaggcaagtcagttttcagtgcatctaacatctctacaaatggatattttactaatagtaaacttaataggcttgtagtgagctaaaacaaagtatggttgtcatgtccataatttacatgaagactcctctacattctgcttctgcaaaatagatttcacctagaacccatacaaacacaatagttggaaaaacgattcaaaatgaatgctaaaatggagaaattcagaaacatacagtacttgtggagtcccttctccatcaaacaatggatggttgtccacaatgaagcatgcctttccaccacattggtcctgtggattccatggaacagattgtgagtccttgcagataagtactactactgtaccggggagtgggaaatcctaaccattacaggataccagatgcaaattttaccaacgcaaaataatttaggcattaatttgtccaataaacacgatttacagtcgaaataagcaaatgacccattccaacaaccactccacgatcacgcgacaggctccatcaactggcttcagattctcgccgatcgatcactacacacgatcctccgggtagcctactacgcaacgccacgcccagttacccacccctaaaactactcaccgcggagatgaccctgaaatcgaagctcccggagtgcgacggaaggaggagcgctaggagcccgcgcgccgcggcctcctgctcggccgcggggcgaccctccccgcggtggagctcccggacgcggccgaggtgcgggaaccgcgggtcggagcacccgacccccgacgtggcgcaggctagcgcgacgagcagcaggagcacccggagtaagcggggagccggcatcgcggcggccggcggcggcggcggcgggcgcggccggggagaagagggtgggagtgggacgacactgtggtgaggcggccggcatggtgtggggagggattaactagaggggagaaggaggaaggcggtggcggtggtggtggttgggttggggatttgaaaaatgcaaggcgaaagcgagagcggcgagagagacagcgagggattggaaggtggagcgtcgcgggcggcgaggcggcgacgggggaggaggcgcagcgaagacgacaaggggttgcaggccgcgcgctgctggagatgacgagcggtctggtgggcccttgacgtcagtctctttgtacgtgatcaggaggggtcggagactcggagttttcttctccgaaccctcttggatcgccatttcttgcagaatccagtgcggcccattaattacggcccaagtagtaagaagatggcgaaggtgagaagggccgcctaatttaatagcctgatagggcccaaatcgacaccgagccgttttaacacgtacatgtaggatattcaatttgtaatctgcaattttgacagtactaattagtgattcccattcccatgcaactgtgtcatctcatttctagttatctctatttgattacaaacataataattccagtaaaacaaggtcttgtgcaacacgatttttcagtaggaaccagtctttgttccttcatcagattatttttgcgtatagtagtgctacaaccgttcgaagcagactacatcgctgaaggaaagaagaacacttgtacaaaccacattaacactgatcacggtattaagaaacctgacactaaccaaccacattaacactgatcacggtatcaaccactttaattgaccttcctgcagttaaccctgacctggccaccggagccggtgacgacgccgatgccgcccatcttcaccatggcgccacggaagtcgtcgaagaagccggccatgtcggtggcgtaggcggtggtctgcgcgtcggcggagccgccgctgaacagctgctggtccgagtgcagaaggcccttgttcctcaggaggttcctgtagtagaagttgtcgaacacgtaggaggtggccgggtcgagcggcgccgtgttgtcgtcgccgccggtggggttggggcaactcggcttcagcgaggtggcgagggtggcgtcgaggttggtctcgttgtagaggcggccgcgaaagttggtgcacctggcttgcccgatggtgtgcgcgcccgacagcgcgatcatgtcgctcgccgtcaggcccttgtcggagaaggacttgatcaggtcggcgaggtcggacgtcggcggcgggaggtcgttgttcgccgcgtccaggctcgccgtcgtcccgtctcgccggcccagctcgacgtcccacgtcggcccgcccagctgcacacagttcgttcgttcccgatcaattcatcaaaaatacagggatcggagtggtgatcggccggtctggtgcttacggcgacgacggagtcgcgggcggcgacggcgaggatgtcggcgcaggagacgacctgctcgcaggcgtcctcgagctgcgacttgatgtcgtcgacgacctcgaagccgcggagggagttcttgttcggcttcgcgttcttctcgccggtgatggccgccgtgtcgtcgagcagcactgacccgtcacacccctgcacgcgcgcgccgtttttgaggtcaatggttagtccttcgaatttgaaaaggttaacttttaagtagacttttcgcgcgctttctgcatgcacaccacttgcttaactgacccgtcagcatccactctgaacttctgaattatatctattatgatttatgaacacgggaaaaatcatctgaatataaaatgtttggcgactagtaactaagtaagtaaactgtagcgactagcgaatttcgaaattgaaacatctacttcaaaggtcggactagaaaacgagaaggaaaactgaacttaaaagggtgagttgtgtgagacttgcattgacaaagcagtcgtggaaatggaggcgcagcagcgaagctcccatgcgagactccttggaaacggcgtctctgacggcagattcgatgatgtcgagcgcgtcggggcatgtctcgtcgtagaaatcagtggagagctgcgccgaaacaacagcagagaagagcaacgcagccatggcagagcagacgaagatttgcctggaataagccattgcttaaccgcaagctaagcacacaattaagtatccagatactctctctctgtaggctgtagcttcagtgtctttgttacactgaactctgcaatgcaaggagagctacatgagcggcgggatttataggctagtgctgatgaggttactggatgcttctccaatctgtcagtttctgtcaagctaccgattggatattgtcgagtgcgtcggctttccttgtcttccattgtttttaactcagtggactacaaccagaaagcacggaatgagaagtgtgatgaaaacttagtttacatgcagaatgctgctacgatctgcaacatacttgcactttttacctggcgtgactatcatacacaaaaatataaaactttacactgttatgtagcttagttccacatgtctagcagactagcactaaggaagttcagtacatgccaaattcactttgtataattctgtataacaagaaaaaacaactaaacataactaaataagttttatagccatggcagagcagacgaagatatgccttgaatttgagaagttcacaattgtactactgacctactatgcggaacaacaggtttgaaaaggctgtattggtcatacgtacgtacatgattattcatggtgataattgagacaatcatgctgctgctactcccttgttgcctggtatctagtagatcagaatcaagcaagatccagccacttgcatagttgcatttctctagtccaactttggtcgtggtttcaaaaggtgcaacccacatatgcgggtccaggtttgcaaaatggggtttaacgtgcgactttgcgacttcagaaaccaataaggcgataatttacaaaattatgagacctaaatctccatctgctagtccttaactcaggtgtgaacagcagtgccgttcgtcgtagcgagtctgaccgatgtcaacaaattaggcatgctgcatgtttgcttggagtgtggagtaaatactccaattaaacatgagctataagcaaagcaaagctcatagttgtttcacaatactctatgcatggcttcggatctcccaaactttgtgtctgtctgtaattccaatgccatttttttgccttcacttattccatctgaaattttttttgaacattcttttggaaactgaaacctgtttcacttaaatgtttactgaactctgatacaatggtactgataggtgatagtagtagcagcctaactagaggagaacccatgaaggagatgcagataaccactaaaccagacactttcatctgaaattgaaaccatttctgcgtcactgtatccttttttaatccacatttaagtactaggcagaggagcactatcgtccatggaatcaaatatggttaaactgaaattcagttaaatattggatttggcggttgcaaagtcttgatggaaaactattctggcactgatcacggcgcttcagtctgtaatggcacatgcacttgccgaactttggcctggagttccaagactagtaaacagcacgaggccggtcagctccactgctgcaatcgacgtgcatgcttccatggcgcatgatcacgacagcgtccggtgtttatgctagtctataggcagtggcgactgattgattctgatgagagaactttaatgttcttctactacgtgcaagttgtaaaaagagcaggcagtggccaaatcacttggaggctggagtgctggacccctttaattctcatgcacaattctgactgcttttgcactgaaacagtgaaactgtttgattagtttggggactctgttcggctagcgagtagcgatggtaaacttgatccggataagagtttgtacctactactactactagttttgtgaagcactgaactagttgcatctgattgagagcttacatgtcaaacggagtaccaaagggcggtaaaactgccactgttttaacagccaagttggagctgaaattcactgaatcagaacgagagtcgccgttgaggtaaatgagttactgatgaagaaaacaagatgacttttattaccactgcagaattacagataccttttaccgtcgcttggatgattgtggaaaacgtggatagagcactgaaagatgagctaaatgggttggtgagctcgctctactctacagtagtatattgcagcagtttcaaaggtttatatgtgcagcttaaaaataaaatatatgtgcagcttaaaaataaaatatttcaaggaactgtttcttagccacacataaatatggcattgttttcagtattttaaaagcattaaatagaaatgcacgtaactttcaccgtgaaatggatttgtcgatggtttatacccgatcacagtatttagagacgtagggtacgagtgatatatattcaagtataggtaataaagatagcagtttatataggttcaaactcttaatgtagataatagccttacttgtgttgtgtttatatgtattgatctggtgtatctcacaccgagtagaaaagaggtgcaagttagctagtctagcgtaccaaactaatcttgacagaccaagcggcaaattgtagtcagcggctagcagaagggtttcctcccgatgtagccgggtgtaagtcttattgatccgatgcccctccccttgtctatatcatcctcatgaatatctttctatataaggatataaatgcgatattctaggtgatagcaagtgcaggcaaacggggtatgccatactaacactgatagtttaaaaataataaaagtaacataattcccttttttatgttttaataatataatatattttaagcggctaaaaaatatagttctcctaatttcttgtgatatttggtaaaacttgacgtgatattctattttggaacatctacaagggcaaatgacatcgccaacctctcgtcggcgcgtacgcaccgatcgaacggcgactacatcagcgtctgcgccggcgcgcgctgcgtcgtccgctccgcactgccgtggaccgctccggcttcggctgctgccagacgccgcagaagcaacaaatgtaccaagcccacaaagccacaaaggcctgagaagtacgaggctcggcctaacccttcatgtaccaagctagagagtactttaatttccggccccaacacaaaaggcgagcctactttgtaccaagcccaagacgccagcaccatataaaggcaatcttcttgccttctgttaaaaaaaaataaaattttaaaagaatgacgccaacaccaagcccaaagcgatttcttatttactttattgaccttttagccaaagcgattttgtgtcttgcttgcaagttatacatggaatatgtggtggaaattacatagttaaaacctgaaaactaccgttggattaaaaaaagacgtatcagatttgtccacgtcattatgagtaaaacttttactcacaaatttacttgtgagagaaaattttttactcagggtgacgtggacgaatatttgacgtttatttttcgatccaaatgaaaattttcatgttttcactatatttgtggtttgcactgtatatttttccagttatacatgttatctttttctttcttcaaccaatcttatgtggtatttttagggacaacacatgagcccttataatacttgctctaaggcaatcttcttgccttgtgttaaaaaataaattttttaaaaaatgacgccaacaccaagcccaaagcgatttcttttgattttcttgaccttttagtccaaagtgatttatgtcttgcttgcaagttatacgtgccgtctttgtctatcttcaaccagggaatcgaatttctgaaattagcggccgatcaaatttcggcacatcatcgccggcgacttgacttcgaaccgaaaccttacttatttactacagcaagtcagcgctaagtgggactattttggaatatcatacgctgctcaaataagctaccatatcccgaaaacaaaaaaaagctagcatatcctgatcagcacagcagcaccactaccagcacgtcgtgtaatggtcgtgtcgtctgtccattccaggggaaatggaaggcatccagatcatttgctaatctaaaccgtgaagccaactaattaatattaatgaattccccgagataccctttcaagtttattttttataacatctcatttgaaaaatgaatataggtcaaccatcttatgatgttaccctcttatctttatctcacatgggacacgcacctgcgcccaaaactcttcgaaagattaaacaaaacagaacaatttcagacaagttcagtacgaggtttctcgttcatctggctgtttaatgatatcatggttatatatgaagaggtatttctccacgcaaagacaccaaataccgaatcgaatagctagctcgatctctgcaagagcaagatgaagcagctttcctcctcatgccctgcaaagattggcaccatggttgttgttgttgttggggctctgctgtttcatctcgtagtgacagcattggccgcgccggtagccttgcctggctgccccgagacctgcggcaacgtcaccgtcccttaccctttcggcattggccacggctgcttccgcgatggcttcgagctcgcctgcgacgagacgcaccctgctgcaccaccgaagctgcgtttcgcaagaaacggcgtggaagtgatcgacatctccctgccgtccggcacggtgagagtcgccaccaggatgctgggcacggactcctcgtcgtcgctgccgcggcagctcaacggctcgtggccggccggcctgccggcaaatggctccctggcggtgtcgaccaggcacaaccggttcgtcgccatgggctgcaacctcctcgccaacctcgtcgccaacgacgacgacgactacatcagcgtctgcgccgcgctgtgcgtggtccgatccgcgctgccgagggacgccgccgccgcctcaagctgctccggcttcggctgctgccagacgccggtggcgaggggcctcccgtcctacggcgtccacctcaacgacctgacccagaggtcggtcaccgtggggtcgtacggggcggcgttcatcgccgacggcgagtggttcgccggcgagcaacgctccctgcagctcggcttcgtcgctgacccgcggaagctggccgactcgacggcggtcccgacggtgctggagtggtcgctggacatggaccgcgatcaggacatgttctggtacgacaccagggtctctcaatggacgcgatgtgtcagcgtgcacagcgccatcgacgacgctgttgacgggaacctttacggccgagcacggtgcaattgctccaaaggatacgagggaaacccttacctagccaatggatgccaaggtatgtacagactacagttcagcgattaattacccgacgattagttagttaaatatacaatctgaaagtttttcaaccaaaaaactgttgtgtactatagttactcttttgatggaccagattgtggtccatgtgtggatgggccagattgtgaataagctgggactttggcccgtccagataagcttacgtgggctgggcctttgcttaaccagctggtttaaactgggaaatacgagctactggattttggtcccttatgaaagaaaaactttaattacatattcctcgccagggcccaaaaacctcaagcatacttccttcgttttgttttccaaaaaggaaaaagtacacctagggtccctcaacttgtcatcgagttacaaaatcgtcccccaaccgaaaaaatatatgacatccctcaagttatgaaaaccgttcactttagattctttggtggtttttatcccggttttatcctacatggccccacatgtcaggatgccacgtcatctcttctttattccctttttctctcttcttcagcgggtaggcgacgccgcgacgggccgagacgggcgcgcgggcgaagcaggggcggcggccgaagcggagcagggggcgggcgccgccggatttgggcggcgacggggcgccaccagcagccgccgccgcgctcgcccaccgccaccgcgctcgcctgccatagctgctctcgcccgccgccgctctcgcccgatccgccgcctgtcacgctcgtcaactgcgccgagcggatctggaggaagagtgaggggagagccaaatgtgcgcgcgcgtagccggcaatggcgtcgtcgtgtgacccaaactcccctcgcccggaggaatagcgacatcagccgtacgtcgccgaggactgccgcggcgcactgcagctgctcagcgacgacacgaacggtcgtccgtgcagcggcgccgtctttcgcccacgacgagtcgacgacaacaacgccgacgattggattggctagcttgtactgcatcgtcatggcgtcctcttcttcggcggctgaggcggcggcgagatgggtccgtcagcgagatcaactgcatccatgtccatgcgtgcaagcttgctactactagctaaaactcacaggacttcaatggcggggcgttgccaccagaggtagaagtaaaaagacgaagacgtcggcgtgggtccagtgggcggcgggcttgttgatggaggcggcgcagacgatccggtcggcgatgcggtggcgcagcgggtggtcggagttggattccacctgcaacggcgaccaatagaaatccaccgacgcgttgtattgacatggcgtacagtcccagcattctctcgccgccgcaacgcgccttcctgaataggaagtaattatattaaataggaagtaattaatactttgatcaatgcaaaaagcagcaaatgacggagcatgagagatgatgtaactaagtagtagcgttggtgactggatatccgatgccatggcgagtggtggggaagacgacgaagagaaggctgaacatgacgccgacgcccagtggcacgatgcccagcaccgattggatggcgatggtggccggcgatggtggtggcgacacgtggccgaagggggtggcgcggcgtcgagcggcggtggcgaaacggtgggcgacggcagcaagaatggtgggcggcggtagctatacaacggccggcggcggcagcggaaatgcagcagctgctgcccgcgcccagctccgccccgccggccgagccccgttccgcccccgacggccgcgccaagctcctcccccggtggcggcggcgtgggagggcgggcgcgggaggccgtgccgcgccgccgccgcctcgtcgcccgtcgccggtctcccgcctcccccaccggtctgctgccctgcgcccctgcccactgccgagccgaactgtggaggaaagggagagaggaagatggtgctgacacgtgggttctacgctgactcagctgccacgtcggacaaaactagggtcaaaactaccaagggatctaatttacactggttttgtaagttgggggatgtgttgtatccggttttgtggttggaggacgattttataattcgatgacaagttgagggaccttggtgtactttttccttccaaaaactaccaattatgactttcaaaaatggttattagactagagtgaagaaaagttagagtattatcgatcgctcatatttcctaataagtcaaaatggtttattatggaatataaattaatttataagtacaactttatatatcaagctaatactaaaagaaaattacattgaaaatatcttaaatttaactttaaaattagatttaaaaatataaattttagcttttgctttaagtcaatcaatggggctattagtctttgtattattctttcccggcaatcgcgacagtgagcctttcagctgagctggtgagcggagacgagtcgacggcgagagtaccgtgcgcgaatgcctgatttgaccaacagcccttacggcatgaatgcctgatttgaccacagttcacgcatgatcgacgtgtcgtgcatttatttccccctccattatgttccattatgtttggatgaaagactaaacagtgagattcagttttgagaaatatttttaaaggtttattaattgaattaaaaaaataaaaaaaatcacttatgtggacagtggcttcgatcctctcctccttgccacgtgggtgcggctctgatgaagttccgttactcaagatctgcttcccgcacctatgccgagcaccctagtgcaccgtctccatcgagctccacctccatgagcgcctcgatctcggggaggagtaggggggccattcctccatgccggtggtgagcggccgctcattggcacacgccatgcgagttcaccgaggcaatgcgcctaccaggtgcgcccgtgcgagagagtaagaagagaagagaagaaagttagccctgagtccctgatatgtggcatcctacggtaccaaaactagcctataaaccgctcagaaatgtaatttaccaagtatcgatagttggacggtgttaaatgcttggttcgggagcttgaggatgaatttgaaacaaaatgaagagttaaagggtgtaaaatggacttatccccgcatatgcttccttcgttttgttttccaaaagccaatcacttttaaatggttattagattaaagtgaagaaaagttaaggctgtgttcgctggtgctttttttttcgcgaacgcgtaaaaggattgcacgtcaatatattagaagaaaaaaatgcgctggtgctcgttccagcaggaacagtgcgtacgaaaaacgaaacaatacattagcgcttgattaattaagtattagctatttttttaaaaaaataaattaatataatttttaagcaacttttgtatataaattttttttaaaaaatacactgtttaactgtttgaaaagcgtaggtgtagaaaatgagagagatggttaggaacctagaggtccgaacaccgcctctttgttgttctttccaggcaatcacgggagcgagcctgtgaggctgtgagctgagctgatgagcggagacgagtggacgacgagagtaccgtacgacgagcggcatgaatgcatgattgaccacagattccaagatattgactggtcgtggcgtgcatttatatctaggttataaagttttgtcgtgtcatatcgaatattatatagtgttgtatagagtgtttggacactaataaaaaactaaggctgtatttagttcatactgaagtttggaagtttggttgaaattgaaacgatgtgactgaaaagttgtgtgtgtgtatgaaatgtttgatgtgatggaaagttgaaagtttggaaaaaaaactttggaactaaacagggcctaattacagattccgtcggtaaaccgcgagacaaatttattaagcataattaatccgccattaacaaatatttactgtagtaccacattatcgaatcatggagcaattaggctcaaaagattcgtctcgcaaattagtcgcaatctgtgcaattatttattttttagcctatatttaatacttcatataggtgtttaaacgtttaatgtgatatggtataaaatttttgtgtaggaactaaacatggccttattcccaatattattaaatataagcatctttagtttgtttagcaaagcttaaaatttaaaggttaattggctaaattttagtagattctaaattgtttcaattccctttctaagctttttttttacaattgtttcaattctaaattgtttagaataaaagaattttatatgttggaatcagtgaccaaaaattttatattatatataaaatgcttgtatttgaaaacggatggagtacgtcaattgtacctgtctgtgcgctgcgcgttcgtgtccatctattctcaccgtctcaaatttaaaagattttggaaagatgagatatttttctagtttatgatgtggtactagaaaatatctcatccgtctaaaatctcttatattttagaacggagggagtatatacttttgtcaatggtacatcatcagtcgcatcgatttaggccttgtttagtttccaaattttttttcccaaaaacgtcacattgaatctttagacacatgcctggagcgttaaatata

SEQ ID NO: 42224 - DNA, 3389 bp, Oryza sativa
attcctgcagcccaaatgtggagctagaaggcctcgtcaaagcctaggactgaagttcgaagccaatgcatagatcaatgacaatatccttgcacgaagaggtttctccaaagcggtgcccccaaggaggatgcgacgtggatcaccgccaccgctcgttcggaaccgaagcaaggttttcacccggagaatatggtagggaaaagaaaggggtatgctaaacaacgcctataaggaggggaacgacgccaaacggcgtcgccgttgtcagtcggccaaatggctcggcaaggctttcgcccgcgattccctgtccaaacccacaccaccaatccgcatgacggattaattaggcttaataaattcgtctcgcgattttcaggtgagttatgaaattagttttttcattcgtgttcgaaaacttcttccgacatccggtcaaataaaatgtttgatgtgacatctaaattttttttcgcgaactaaaaaaaaggccctagtcactagtgtgggaggcgttgactggacttcgaagcatatgagatcaggataaaaacctttgctatatatattcctcatcagctgctgtaacggactgaatagaggaggctgctctactagcctagtagtagtactgtagtatagagataacttgcacgccgtctttagcgacgattggagcagtcgtgtttcagcttctggtgacgacgacgacactgtcagcagcagccccgaccccgatagccctgcctggttgcccggaaagctgcggcggcatacaagtgccgtaccctttcggcatcggcgacgggtgctcctaccatggcttcaacctcacatgcgacgacgaggcgcaccaccaccagacgccgcccaagctgttcatggccacagacaacggcaccgtcgtccaagtgctcaacatctccttgccggacggcactgtacgcgtccgcagcaagctttcgcagtcatctattgccggctcctcctcctcctcgtctaatgcctcgtcgtcacggtccgacctaccggccgacgggccgttcacggtgtcctccgcgtataactggctggttgccttcggctgcaacatcgtggccgaccttaccccgtacggcaatatcgccgacggcagcagctgcgccgccacatgtatagatggatggcaaaatttcgcaggcccctcgtgctccggcatcgcgcgctgccgtacgtccgttgggaggggtgtccactcgtacacgatccaggtcacgtctctgatagaccgaaattccatgggtgcctcgacatcgacgacatgggcagctgcgttcgtagctgagcagggctggttcagcgcgaatgagaatgccatgttgtacaacttcaccaattggctgccgttcacggtcgagagtgttccggtggtgctggaatggtggctggatttgatccgtgatggagccatactgccgttgtcagttgggcccaatactaccgactttagatgcctaagcttgcatagttcaagctattacaacgatctaaactacgaccgaagacggtgcaactgttcccaaggatacgaaggcaatccttacatccgtgatggatgccgaggtatttttttctttcctgctttattgtgtttgttgcagcgaaggctccaattttcatgtaaaagaaaagttatacatatggcccgttcttttctcatgaagttagagattttatctcgtttttcattagaggaattttacggtccttgaaaaaaataccttaaggtacctaaattttacactaaaatttttggtaccttgaagtacttagtacctagaggtatcaaattttacactagaaaaatatggtacctctagtaacttcttaaggatggtaaaattaaccttttcattagcacgttttttaaactactaaagacgcatttggtgcgaaaactttctatatagaagttgcttaaaaatcaaatatatctatttgttaaatttgtaataattaaacttaattaattatgcgctaatagctttctcgtttttcgtgcccatatttaatcttaatccacatcagattcaacaccaccatatatagtatcacttgatataattatatagaacatgtaattatatcatactatcagttgatagaagctacttacctcgtcccaaactatagcaacctaagatgaaatgagactcatcctatgataacgaatctggacatgatgcatccaatcatgaattgcattctttaattttcactcccatatatttgttccccttttcagatatcgatgagtgccagcagccagatgtttatccgtgtcatggaacatgcatcaatatgcctgggacgtaccgatgcttagcaaagaaaagtgtcaaaagcctcccaggtacaaatgcaattcctcgcaaaaaaagaaaagaaaaaagaagaagcaatcgatcacttgctcgattctattagcggagttttcgattttagaactgtatttgtagccttccaggtacaaatacagttcatttggatccattctatacattataaaccctatgttcctgacgtttattctctgcaggtttaataaccattatagcagttagtgctggttttgggctactgttttcacttcttggtgttgccaaaatcacaaataaaatcaaacaacgcagagccaagaagttgagacggaagtttttcaagaagaatcatggactgcttcttcaacaattaatatcttcaaacaaggatatagctgaaaggatgaagattttcagtttagaagaattagaccaggcaaccaacaaatttgatcaaaatcgcattcttgggggcggtggccatggcacagtctacaaaggtatattatctgaccaacgtgtggtggccatcaaaaagtcaaaaattgtggttcaaagggagattgatgatttcataaatgaggttgtcatactttcacaaactaaccataggaatgtggtgaagctatatggttgttgccttgagacagaagttcctttattagtttatgagtttatatcgaatggaactctttcatttcatcttcatggccaaatgagaatcctttgaagtggaaagatagattgagaatcgcactagaaactgcaagggctattgcatatcttcactcggcagcttctatatcagtgttacatagagatatcaaatctacaaatatactactcactgatactatgacggctaaagtatcggactttggagcttcaaggtcaatttcaattgacgagacaggaatactcaccatcatccagggcacttatggttatctagatcctgaatattattactctagtcgactgactgagaaaagcgatatttatagtttcggtgtcatcctagctgaa

SEQ ID NO: 42225 - DNA, 2256 bp, Oryza sativa
acggtggcacaatgtcagcgccagtcccgttggcgctgacacagccaacgtcagcgccaatgtgtttggcgctgaggcgacggcctatttttggttgaagtttttggcaggggttagtttcgaaataagttttccaaaagggtcaatttgtcaaaaaaacgggtaatttttacctgagcatagtagagcaagtctaataatacagccgacctgctggctataaggttttttatagttttctcttagcttatccaaataatagtagctctttataactaatacaaggtccacttgtcactctcaaagtttattggttcttgtgtttaagccgactgtaaatttatagcctgcttcttcttctctctcctccatctcaacatttagcctatttatagcctactattatactctctccgtcctataatataagagattttgactttttacttgcactgtttgactactcgtcttattaaaaaaatgtgtgcaaatataaaaaacgaaaagttatgtttaaagtactttggataataaagtaagtcataaataaaataaataataattccaaaattttttgaataagacgaatggtcaaaaagtgcaagaaaaaaagtcaaaatcccttatactccctccatccctaaatgtttgacgccgttgacttttttaaacatgtttgaccattcgtcttattcaaaaaatttaagtaattattaattcttttctatcatttgattcattattaaatatacttttagatatacatatagttttacatatttcacaaaattttttgaataaaacgaatagtcaaacatatttagaaaagtcaacggcctcaaacatttagagaaggagggagtattatggggcggagggagtatacattgtaaaactgtaaaaccggcgtgacgggaggaggacagacacgcggcagcttttgtggcgacaagtgtgtttgttttcttttctgaaatcccagcgaaggcggcggcactcgcgccatgccagcgggagcaaagcagcgcggagtgcggggaaagagcgatcgacagacaatattgtgaggccccttcccctagccttgcgccggcggcagcgccggcaccggctttttttatcgggcgccacgtcgaccgcgactgccaagccacgtatagtaatgtactgcatctcctcgtccccgcgacgcgaatcgctcgtgcgccgcgcgcggtgcggagcgggcgggcggcccgcccgccgcctcacgttttcgcgtggttgcgctgcgtcgcgccgtgatttgctaggccgtgtgcgagtggtgtggtcgcggcgcccggcgcgcatggtggattcaaccgagagccgctgagccggggaggcgccgagccgtgaggtgaggagagagtgatggatatcacgccaacgccatcacgcccggcccaccatactaggggaggggcccacgcacccctccacgtatgcacgcacccccttttagagcaggtacaatagcaggctataagccagctgcaaacatattttaaagagataaatgaatagagagaagggcaacaagctacaaatatatagccagctgtagcacggactccaagacacagtgtgtgtatgatagatgggactatgtattaatagtgtagtatgtaactattgtataaatgagctattagactggctatagttgaattgaagatagtagttggctgtactattgaacttgctcttaccccaccggagcagcagcacatccccgcttacaggtgggccccccgtatttgcacctttcagtttcacccacgcggtaactctaccgtgccggcttcctgttgttgttgctcgccgagagcgaccgagtccccacctatatattgctccgtcccgtcgcgccttgccgcttcaagtttcccaaggaaaaagctcagagtcgcagccgcacagggagatcgcggagcgaataggggggagagagagtggaggaggaggagaggttgttgcccttcgagaagctctcctagggatggcagtgctgctgcggccggcggcggcgatcgccggcgggcggcaagtgtggccggtggcggaggaccaccaccggcagctgcgggacgaggcggaggcggaggccgcgtcgcagcggctggtggaggcggtggcgcgcggggacgcgagggaagccggggagctgctcgcgtccggccgcgcggacgtgaactacgccggggtggtgtggctcaaagcgcggcgggtggc

SEQ ID NO: 42226 - DNA, 6081 bp, Oryza sativa
atgctctgttcgtcgcatgttgaatgctctcgtttggtgcggtttgaatgcttagccattctcgtttttgtgcattcgaactgaatacgtcgcattccccccataaaattagcgtctggtgtcggtggcgaaatggcataaaatttgcagagctcgagcacatttaccatcaatttagttctcggaaggaagcactgaacactcatgcttctcgaaattcacttaacactagtttcatttctcctgaagcattcgagttggtggaaaccttggacgacatttcaaatgggcctagcgggcactgccaagtgccatctccacacccaataggtgctagataaaagttgcccactgttcagtctaatgatctcttttttttttcatggttgctcaggtagtagtattgtttttctatgtgcccatgatgattttaatgtactgtataaatgcacgcgctagacaaatatcatccttttttaaaaagttttatcgccatttttaataagcccaaattatgagtagaagtaggacttgttggaaagaaaaaataagtatacttccaaacttcgctaacttttattgtcgctctctatgatattggaacttcttttcatttttttggtgggaaaccataacggaaaaagttactcatcatgagatattttccaaagttttagaccgaattatgtgcttctttagcaaagtttttttttataggcattagcaaaatatttttatgaacttgtatttttacagttatactactattagtttctagaaggtaagttaccaagtaccagccccgcatggctgcaaatctgcaatgggaccatgctttgcattgcagatttgcagttcgtttttaatgcgtacggacatatttgttctatataccgatgataaaaatctggaattgggacaagcaaataggcagggaagcttcctgggcactctttattgtctagaaatacgtgtacgcattgatcaaggtgtacacgcatacatacggtatagtatgcctgtattttagtaccagtaccatcaaaagcatctcctattagcaaatgtggtttccaagcatttcctataagcaaatgtaccatcaaaatgcatttcctataagcaaggatacgatgctgtgcgcgcatttcctattggcgaatgtggtttccaagcatttcctataagcaaatataccatcaaacgcatttcctataagcaaggatacgatactgtgcgcaagtaccctgctaaagattctgatttccagtaacttctccctgctgcttccagcatcatgcatgctgcgactagaaggtaagcctaattatatacactgcgtgagtgagagtgtttttagctcgagaggactggtgcttgggggacaggggtagatgggtttgactttacctgaccaaagcctctttgtttactgctgctgataatataatgaatcattcctttagcaaaattgataatgtaatgaatctgtgtaagcatcagagggcactggtgttaagtactcctccatagtgtaccgggcttaagtacttaagtaccagctcaacgctttggtagaaaccaatatattcccctcgtgagcttggtcgggggtgggatcacgtgatctgcttggctctgctcttccggtctcccctcgtttgatctctcctgttgatgcaggagtacttactcccggtaatcttgagagtgtagttacgctttggtgctggatcctatggtactttgcattgggccctgtcaccctaatcacactcacgactcattcaaccccctcggggtcccacatgcccgtcactcttgtgatcctgatcgcgtcaccgcgatcggacggctaggggtactttctgaccatcggagaagtagtgttggtggatgatggctgacgagtggagaggtgtggtgcgcggaccgggtgatccgccgatgtcatggggcagcattgaattgaatgggagtggcaagggactaggggagtggtttgcgctgcgacggggcgtaggggagcagccgggcacggccatgcgtgtacttcttcttcttgtttttttttttgccttgcaggcagatgagctcgcacgggccacggccatgagggcctctgtacgactgtaccggcgcgttccatggcctctgcaaaagatcaataaatgccattgccaaggacggcagccaccatagccgtggcttttatcccaaaacgcataggaggtgaaaatgtggaggatctttttttttcacagaggaaaaaaggattgaagaacccgtttggtgagcatgaaatgcatgcatgcatgtcatgctagctgtccatcactaatcattgctccatgcactctctgatcttcattttgcggggcctcctcttcttcttggaacgtcaccctgactcccacaggccacagactgtggaatcagccatgaactgctcatcaataatcacctctcaatgcactctttgtctgcattttgcggggtcttccatcctcttttctgcattttgcgccggggtcttccatcctctacactggaatatctccctgtctacccacagtccatagactgaactgactccgagagtccgaggtcaggtggccatccaaaggccagcgtcgctcggcagctcagctcatgtcatgtctcccgggctctggccatgcgcaacatcatcagtgagttcacatgttctgcacctgggtacacagccaagtaaccggatccgatgtccgccgcttccaatacgtccaagccgcaccagctgtatttgatcacgccttagaaatgaaaaacccaactcctcaccggagtatagccccgatctggccgcggcctcctccacggcaggcagcgccaagggcctccctattaactgacagcaacgcgcacgtcgccgcccaggtgcgacgcatcgatgtgtgcccccacaccggcgcctgatcgatcggctgggccgacgcgggtacggatggatggctgctccttcgctcgctctcctcgcgcaccccgtatgtgtggacggtgtcgtgttcttctttgccctgtagccattctgcttcccctgccaccggccggccgcgcggccagctgtatcctcccttgctgctgcacgcacctggcgcccatgcaacgcacagcgcctctcgcgtacggcccgtgggggcttcgccgatcgggcatctgcgtatgccggccgctgctcagccccgcgtgtgctcatggcctgatggcccccggtggaatattgatggtggcatggggatgccagtgtgccacgtaagtgctgtttgagaacatcacctcggttcagagttttcagagtggtaaatagcagcatgcacagcactgtactcgtggtggtgcgacgaatttattgtgtgatgagaatcctggatgtggaattgaatgcgtctcttgtcttgttgtccgatggatcttgataaaatgccaagggttggttaagcaggagtttacaatttgtatgatgtgtcctgatggtgggatcatcagaatcagaatgtaggagtagcaaggaccaaaggactagcatcttttatttctgagcctgcattgttcatttcttgctccatttgtctttccgtgaacttcattttctctaagagcaaatgttcaaggatgggtagttaaatattcttatatatgatgttgaaagagataaatggttccagtttagataattttcagttagctgtggccaactactgtattcagcgaggctgagctgacattgcggtgaaaccacacatcaagatttcatatatcgatggatagcatcaccctgcagaattttgaccagattccttcttccagtaggaggccccttctgtctcttgctatatgaatcatggcacagtgccattgccacaggacttgcacagactggctagccagtccattggttaccaagtctccacatcaccgacctgaccagacatagtagtaacagcgacatttgttactcggccagctatgtttccaagtcccgatggctgttgttgtgccctgttctgtgctactgtgttggtccatcctgatggtaccccttatcccgcggtgtgtggagcaatgtaggtgaaagagagagcatgcggtaaaaggagaaactgtactaggcatatcagttcttgtttgctgagttactgtccaaaatctgagaaaattgtttgatcaacttgtgctaacattatcgttttggctatgttcatatcattacaagcagaaacttgtgtctagagcaaccagaagtacattctttagcacagtctaatgtttggcgcaaatgtgcatcgctcctgcaggcgaagggggcggacgtgaacggcaaggtgttccgtgggtacccggcgacggccgcggcgcgggaggggcgcgcggaggtggcggcgttgctggtgcgcgccggggcgtcgcagccggcgtgcgaggaggccgtcgtggaggcggcgctgcaggggcaggccgccctcgccgtcatcttcatgggctccgacctcgtccgccctcgcgtcgctgtgcacgcgctcgtgtcggccgccgcccgcggcttcgtggacgtggtggactcgctcatcaaggtaagtgtgtactttgctccatggcttcatagccttcatgcatctgtagagacatcgttctcgttccatgagattgcgcgattaaagatgtgcaggacgatttgatccccgatagcgagcgttgcgggtggtgttgtactgttttgcagagtccagatgctgtcgagcccagtgtgcctagtcacatgggccgtggcccatagggagaagcagatagccgtgttgtggtttagtcccacctcgcttattcttgctcgtttgcactggtttataagacgaagcggtaacccatctagcgtgttcgtagaaaggagagacggttggcatctcccctgacagggacgggaacagtcttcggactttcctctagcacattgcggttaaggctacccgcttcggcggatcttacccaaatttttttgcatccgtgcccttcaattttttttccatttgcacttgggtccttcaaacatactacttttgcacttcgtagttcgtacacggtacacctgtggcattcacatgttttacatttgcatctgggttctttaacttgtacacctgtgcccttctcccttcatatgtttcacatttgcaattcgtttagagtacaattgtgccggcgttcttgcttgaattagtacacgactaaattgctgcagctaatatcgtctgatcttttcgcagtgtggagctgacccaaatgctacttctcgggtgctcctgcgctctctgaagccttctctgcatgccaatgtcgactgcacggcactcttcgccgcgatcgtcagccggcaaatcgccgtcgttcgtcagctacttcaggtatgcaccactccactggtggcgggctggcagcacacgcacttgctcttcagcagccggagctatactaacaccatcttttgatctcatgtccaggccggagtaaagagggacaccaaggtgaggctgggagcgtggtcatgggacacggccaccggcgaggagctgcgcgtcggcgccggcctcgcggacccctacgacgcggtctggtgcgccgtggagtactacgagtccaccggcgccatcctccgcatgctcctccagaacgggtactcgtcgggcgccacccatctcggccggaatctcctccaccacgccgtcctctgcggcagcgccggcgcggtgcagacgctgctggcgtccggcgtggaccacgaggtggccgtgaagacgtccaggagctccaggtccaggcctgttcacatggccgcgcgcctcggccagccggagatcctggagatgctgataggcaagggatgcgacgtgaacgcgagggcggagggcggcgacgttgcggccatactcgccgcgcgccacaagcgcgaggattgcctgaggatcctcgtgtccgccggagcggacgtcgcgctgttgaactcggccggcgagtcccggcttccgtcgcttgttccgggggctggaa

SEQ ID NO: 42227 - DNA, 16084 bp, Oryza sativa
cgcggcaagccgcacggcaagtccctgcggatggtcgccgcggcgggcgtgctccggtggggcgggtcggggcggcgcaacgtggtgtgccgggaggccgagctcggtggcagctcggcgttccagctgcaccggcagaggcggggctgcgacgcgtacgagcccgggctgttccgcgtggcgacggcgacggggagggaggtgcacttcgtgtgccagggcggcgaggaggaggcggagctgtgggtgaggggcatccgggcggtgaccagggcggtgtacggcaagagagggaaggagtgagacgcccctgtgttttgttgctccccgtaggctttggtagttcgcagcgagcgtgcctgtaaagagtaggggcgtagagggagtgggagaccgcgaagagtgtagtgggtgtgcccagctgctggccttcagctcgaaggctgggttgggtacttgggttggcttgccatgatgtctttttggttcaggggcctggagtttgtatagcctttggtggttgtttgcttggctaaagttgttttagctgactgcttgtagttgctttccctctgaaatatcagtatcatttccaaaatttcacggtgcgtctcaccactttatctactgagaattggacatatagaacatataagcactgtcaatgtgattgatcaccccaagaaaggatagaagaaattctaatgatttaaggtaaacaaactcatcaatgcgcagttgcacacattagggtaaactcattctcgattcgtgaattcatgagtgccttgcaaccgaatcaatgttttgtcacaagctgggcaggccgcccttggtatcacactgtttcgaatttctaacatcatagttagaacgggcacaaacaaaaaagatatatcttcccggctgctgcagaattgcaacccgtgaactcgttggcatcaaagttgtgtaagtaaaagaaaaaacttctgccagattaacgtcctcagtttccagagatttccttctccttagccttgcacatatcatctgctgactttatgaacttcttggtcaattcttcaacctggtacataacaggtacatgtttgttaccatgtggacttctttatttccaggacaccaaaattcagttactcacctccttctcaagtcgttttacatcatccttcggcataccagacgcagatttctttatcgtatcaagtgcctagaaacaaagaataatacagaattcagatatagtacaatgcatcatctactccatcagcattgatgcacctaatccaattatgatatgatagtccaagaataagtgtttattctacataatgtaggatgttgaagaaactatatttggtgtcaacaatcagaagctataggaaattctatcttcagaactctacaatgagagttgaaccgattttataagataaatagatcagatgaaccttaactactcaatctaaacttgttaaagtaaagtaatacttcccattttaatggatggcaaaatgctatagagaagagggtatacaataatacaccaaaaattatgttgcaccacacttgtctattagatgtcaatttcaaatggaaataaatatctgtggttgtattaacaaaatgtatgcctcacacctagaaatgccaactaaaggcttgaaaacattaatcaactaaaaattctgaacatagcataatagtaatccagatccaccacaagttatcgttttattaccttttggcgcgctcgtctaatactttgtttgaaatcctcggcagatttagtgacaaccttacacagtgcctatattgtggatgcagaaaataatcagcatttcagctatataaaagaagttcaagtttagaatctcacctgtatattctcctttgtcaacctgggagtgcacaaaaatcaaattagcaaaagaaagaaaatttaagagtagaggaatatgcatatcatatactggaaacagaagaaaagtgctactgaatattaagtccagcaattttttgggccatagttaaccaacagattaatcgttgaaccatttctacgagtacaaaatgaccatggaaattaactacattctcacatgctggtctacaagatccaagttgctgatttatcaggtggtcagcactcagcagaacatcactagcatggttgataagaaacaatccaacagcaatacatgtggagtagaaaaccacaataaataatagttagaaacagtataggcgtcacttacggtgggatgtttgctatgatcctgttgccatcaggtgttggattgatgcccaatggagatgagatgatcgcatgctcaatagacttcattgactacacgagtatactagaacaagtcaaaggaagccccaacagaaacctaagtacaaacagcgatccaatgtaacgctgttcctccagagagaaaacatataataaacacatttgtacgaaggctagtatattggacttctgtataacttgtgattaaaatgacaacgaccaagcatgatattttgagaaaattagtcacaatcctctacatataaaatatggataaaaaagaagtgacaacaaaatctattggtttgtcaaagcaacaattaaggaagcaagaaaaactcttacactcggatcataaggcatcactgatagggtatgtgcatcaaggacagaaacaacggccaagcgattcaacgcaaccttaacacctgtagtctccaccatgatgtgatcaagcatacctgcagaagaaattcgtcgcatcttctgttcaagagatagaactatccgaagaaacaatgacatggtaaagattgagattacgacgatacggtaccaggagaagctcttcccgttcgcaatttactaagctcccgtgacaatgcaacaacggctgcctccatctgctgagttgcagcagatttgacagtcggtccaatgtcaggagcatcctgaactgtatcgcctcgaccatcatcctctaatcacatacaacaaaacaaatatgggtgattcatcagagtgaatgctttcatttaagccctacaaagctatgttgcaaatcccacgtcaactgcattaacctaatttgaaaattattaactcaataaaactacatctaatacaagtagtaatcgacaggcaggaaagatttttttttcaacaaaaatctaatgaggaatggggagtggggagtacacgaggagagcggatgaatatcttactcgatttcttccccttcgcgaagcctctccgggcctccaggaggaacagcttcgtgggggccaactccctcgcgccggcgagggatccgacggacggtaggcggtggacggaggtggaagcggaggatgcggcggctgcgcggatggagcgggcagcaagggccgcgcctcggcgcaggaagagcgccatgagattaggtactcggtttctaactaccagggcttaccggagggttcaggggttcttcgccggcgagcggcggcggcggcggcgaacgagggttttgatgggttttgttcttcctttgcggtctcgcagtttttttttttttttagaactcggtcgcagacttgacacttgagagatggggttcatctcatagaaagacaattaaaagatagccaagtacccagggttctttctgcaaatatccctcgcctgtcaatcctagtcgcccacttctctatccaacgggtaacggctgctcgacgtcccgtactggaactttgcaaatgagtcccttattctgggaattaatttggatcgcggtctgtgtttgagatccaaaacttcatgataaaagagtccatgatgtacgaagaactttctataatttgaactgaaatcactagaagaaccctaaagctggattcatggatgtctaggagctagactgctaggagttgtgccaaacaaaggtgtcgacaattgaatttaggccttgtttgtttcagcttaagattattgtaatctgaattattaaatcagattactctaagctggattataataagctgatataaaataagctactagttgtttgtttttctggattattagaggcatctaagggtagtaggtctttagccactcaataatctggaaaaagctcctctagaggagattattggattatagtaatctggcttatacattgtaataatctagcataataatctacttgtttgtttcagcttgctcataataatgcagattataataatcctaagcttaatcaaacaggaccttagtactagtatatacaccctccgttccaaaaaagtccaatcctagctatgaatctggacacatgtgtgttcagattcatgtgtccagattcatagccagagtttgttttttttgacagactagtatgtagtatttgttcaacaaggacacaattcttttttgctatttttgatttgaatagtccgctgcaacacacaaatatttggccagtatagtactccactactccctccgttttcaaatatttgataccgttgactttttagcacatgtttaaacgttcgtcttattcaaaaacttttgtgaaatatgtaaaactatatgtatacatataagtatatttaacaatgaatcaaatgatagaaaaagaattactccatccgtcctaaaataagtgcagttttgcactggtcacatccaatgtttgactgctcgtcttatttgaaatttttcaatgattagtatttttgttgttagtagatgataaaacataaatagtactttatgtgtgactaactttttttaatattttcataaatcctatcttactataaagttatcccccactaactccttaagcttaacatgcaaatatgccacattatcatccactaacaatcatcacatttaaacatcatgcaaacatattatatctttatagtttttataatttaagagcatttcaaatacaaacatgttaaattatcatccaatataattcacgtaatgtttcaacgtatatctttattatgttttatgatatcctatatacttatatagttcatcctcactgatacttagtgcttaaatgattaatctatggtacaaattatatttctattttttctctaattaagtcatatcatatcaattgtccaaactatctccctacttttcttcttctataaagtcataccaccttactttttacatttgaatcaccattctacatactatttaaatttaaattagcataaaccacattaatttacttaatctgatgttatctagttatctgacacgttattttttctattgttatcatattaaattcccgcagcaatgcgcggggtttcacctagtttttcaaataagacggacggtcaaaccttcgacacggattctcacggctgcacttattttgggactgaggtagtaataattacttaaattttttgggtgttgctataattatgtcgacacattttgtgagtaatcacagttgatttcttgttcaatttgatctcccttgagattcatgctatgattgcaataccatgtgcattgaacgtctttatgtgtttcgtgttgcatcgtgaagccaatcaattcaaatttcttatctcgtcagcatgtgttttcatgaaaaaaattacatatctaatttcaggacttacatatgtaattttagaacttacactgtaaatatactaaaattacatatgtaatttagggacttgcaatgtaaatacatgctgactattttttggtgaaaaatatggcgccataaatatagttactctcaatttttttaataagatgaacggtcaaatatattgaaaaaaagccaatggcttcaaatatttaagaaacggaggaagtaaaatttataagatatgaaactgaatccactcaaaatttaatcatggattcttgattctttgtggcatctcaaccttgtttccgaggattctgatactgatgacgaaactcgtccgcgtgtctaatctgccgctggccggtttccatgcaacgtgggatatgaaataccccttgttggaaaggaattaagttgccgatacgttgattgtccagcacattggaatatggacagtgctcctaactcctaatacttgtcctcatctttcgagtgttagtcaactaccgtgagacatacacaggacccaaattaaactttacaacaaataggaatggtcggtataagtaggcgtgttagtccacctggctgatcgtagcctgccgtgcgttcggagttcagatcaccggcgctgcctggaaagtcacataccagtacagaatagtactccggtagctggtataccgtacgataccgtctacggagtggactattccatgtctccgtcaaaaaaaaaaaacgcgtacctatcgtagatcctggctgattcggccagtgaagcccccaaaaaaccgagacgtttacgacggcttcgcgtacgcgccggagagacgggctccacaccacaccaccgcccaccgcgtcacgccgtcgcgtgagattggcttacattccctggccgccgcacgactgacgcccgtgccgtgcagcagcgtgcgcttccgcgacgacaagggctcacgcgcggggagctggggaggcaggtggaaccaacgaacctgcatgcgggggggttgtggtcgatcgatccgccacccgcgtgcggtgccgcaccgccgccacgaggccgttgatagagatatggcccgcgcgttgctacgaacgtttgccgtgccggtgccccgctgcggcgtgttggccgcggctagctctgcctggcgacgcgcacgcacgcatacgcagacgcaggccgaaataacgtgcaaccgcacgcaaaagcgacggtgaaacggtaacaagctaggccccagaccgggaccggacgacgtacgggtggatggaagcagcgccagcgagcgaagcacacgcttttcccctcctctgaaacgctacgcgtcaatgtagtcatcaaagtctatcgatcgatcgggataacataaaaggggtaaggtaattcccaacccaatgaatattgttcatagcattaaataaactgtcacctagaataaaaaatgatgtggcaagtgaataaatgagaaaagagaaggaaaccatatcttgcatatcatagtttctacacaacatccaagacatcatgtgagataagtagtattaaatttaagtatggaatagtggtgtttgtattggaaggataatgtctcgtactagtttttcaatgatgtggagtttataaaaatcatatctagtgtgttgggttaggaataacgtaagatcgagtaggacgaatcccggtgtcccacctagcaaacagcgacgctaccgcgccaacgacagcgtactacgtaccgggcggttcagggcttcaggctgcagtgcaagcctatcgagagctaatttgcccgagacttggtcgttcaactccaacgactgtagtagagctgatagccgggccccgctacaagggcgggaagcagaagaagaagaagtccgcggcgagatgtcacggcggctgggacgactaaatatcgccggttcacttcaaagtctcggaaatttgtctacttcctctcgccctggcctcccttgcagcgatatcgtccacaggctaggcacgaaacttcagcaacgcgatcaatcgatagatttccgtgcaatacataagcaggcgactactttccgcagcttagccgccctctcgagctcgtgcaaacctaccccagaggagttaattatagatagttaactcgtgctgcttgctagctgatcatcagttgatgccggcgatggggttgtgggagagcgtgaggagcttgttcggggagggaggcaacggctgcctacctcggattgggaagaaagagtccgaggatctttactcttatccagtggatcatggtatgtaattttgtttttgtctctctgtgtgtgttgttgttgttgtttctttctccattttgttgacaattggaccacgttgcttttggtgctgaattctcaactgtttctctactccggttagctgtaatttgattagctcaattctgggattctcatcgtgtctgtcagcaggtagacaggccctcgatatattcttttgcgttcttgtgttctttctagctctgctttgataagtgatagtcgacagtgattaaacaggagacaatcgaccatttctactagcatgcgtgaaggattaacagcgaaatctttgcttttttccactgtgttcagataaacggaaaggagcggaccgtgcggccgcggaggaggtggtgacagtggaggtgccggaggtgcccgtgcgcgagctgaacgagatcaccaactccttctcgaacgagaacctcatcgggcagggctcctacgcgaaggtgtacagggtcctcatgcgcggcgcgaggcccgccgtcgtcaagaagctcgagaagccgtccaagcacgcgtccaacgtcgtcttcctcaagcaggtgcgtagctcttctcggtgctttttaccaatgctcactctgctactacttaccatatatatctgcagctgtcggtggcgtcgcggctgaagcacgagaacttcgtcaggctgttggggtacacgatcagcggcgacctccgcgtgctggtctacgagtacgccgccatgggcaccctccacgacgtcctgcacggtacaatctctacttctaaggatcagtcactccctctcatttttttttacaactacgcttgccgaactgctaaacggtgtgatcagcctgggactgaaccattggtgtgtcgtcgtgtgcagggccgagggacggacaggggtggggcggggaggcgaagccggtggtgagctgggagcagcgggtgcggatcgcgctggacgcggcgcgcgggctggagtacctgcacgagaaggtgcagccggcggtgacgcacaaggacgtgcgttccaccaacgtgctgctgttcgaggggttcagggccaagatcgccgactacaacatgttcagccaggccgccgacatggctcgcttcaaccgctccactcacaccctcggctccttcggataccaggcgccggagtacgtgcacgcacgcacacacacaagcccagctgatctctgtctggccatggctgatcgatctcgtcatggctttcttgttgttggattgggtcgtcgaacgattttgctgaaattttcgttggtttggggatgttccaggtatgccatgactggtcagatgaacgataagagcgacgtttacagttttgggattgttctgctggagctcttgacggggaggaagccgctggaccggacgttgccgcagggtcagagaagcctggttaactgggtaagcatttttcttttctggttttcacatttccttttctttgtcttaatcactgcatttccctctcagttgtaccagctaacccaaagaacattaatatattggtcacctacctcgtctattttcatccttggtcttcctttctcacctaagaagcagctgaaaagctttttagtgaaagatttatctgatagctaagctgtggaataccgaacacgtacttatcaattatcaaactgcaattcgtctgccaaatttcaataaacctcaaaccagaagcttctagccccttgattaaaattttatggaggtcactttccaaaggcgataagacagtaggagatgcatttgtgctatgacgcaagaaacaaattgcatcagtttctttcctaaataaacaacacaatccaacgaaaacaaaaacaatggcagtacgagcatagtactagtatatcttgaaacaaagatgatgctatcacacaatgttcagactctgacctggcgtatctcctgccccatttgatatgctaggcaactccaattttgactgaagacagggtccaggactgcatcgaccccaatcttggcgacaagtatcctcctaccggagctctcaaggtttctctcttaactattcacctgcattgcatttttgcacccaaccattaccatctctatctatgtatctctagtaggtttctacttctaaccgtcagggtgtggcaatgtcacaatgcagctggggagaatcgcggtgcagtgcctgcagtacgaccctacgttccggccatcgatgggcaccgttgcccgcgtcatcaactacgccgtcgtgcgagaccagcaaggcgtggtctgatgatccacgaggattttttttttttttgcacttgttcattttgatttgttcgtgtgaatcaaccgtgtatatgccttgcgttgtgcaggctagttagacatgcaagagatacaattcttgcagtaatagttgaagagagactatatccaaaaagcctctggttgatataaactggtaccggtaaaactttcccaaagcttaggagtccatagggggaaaaaaacagaacagaaggccttattaaggccatgtgtgcaagctagttagacgtgcaagagtatgctagtagtacagtaaatcgctcaattttggatggagttgtttctcttctttttttttctcctgaagatgcatcatctaaggaaaaaaaatgtactgagcagaacactgagcttgttaggaaaaaaacagttcagtagtataaatggtacgaatgttcagtacaattgtgtcccgttaacatacatcgattttgccaaaagaacaaagggaactttgtatagtatgagtgtatttgtatagggtcggaagtcttgccatccgaatgtttgccccaaaaatgttggggtaaaaaaaagagaagagaaaataggataacctgaaacggagctatgaatatttcgtttcattctatagtttacaactgtttattttactcatcatgctacataaattctgtgtgattcatggcaaaaagaatttcttctatacctacctgcagaatcaaatggaagagtttatcagagctattgagaatgaacgtcttacaaagctgttgattgtaataccaacaaacaggaatagaaattgtttgcaacaaaaaataggtagttttgggttgctgtaagcctaggctctcaaatagttttctttggtgctaagggcttctattccatgcccatgagagtacctgttgttttacaaccatgaactggcttactagtagtgatagatagtaccaatcttagtagtagtcatataactaagatgaactctgattccaactatgttacacccaactgattatgcactccttgccttcaaagtcacaagcatctgctctaacatccatctctactctaagcaaaagagaagctactgacaatagtacataacaccaaatcatcaactgtctctgtcagtctcactgatggcagctgcaggttgccgcaaccaggtctataaaatcacctcctaccatcatagtctaaactttctaataggtgacccctcacccacccaacccatgttttgaatttcaatctgaggtaactaacgctaacagtaatacagaaactgatcgtaagcagttccttgcgaatgcagtttcactgacagatagcttacagttgtaacaaagtgacattttcatccaacaaacactgaaatgacacagcaacatatttgtccatgagaaaagtgtgtgagattcacctcaaacagaaggctaaataggcaacaatggttttctctcatcggttgcagtaagatggcttgcctgaaaacatagtcagcacaagagataagtccatgagaaataaagttgtcattcttggttttattcaacaaaacaatgagtcacttacatcatcagcagcgccagcagtcatatttacaaaagaagagtcggatgacctgccacacaaaattgttttatgagattagatgttctgaaatatttcataaaatcatgacactttcacttcaaatgtcattaatatgaagtataaatgcaagggacaagcgatgtttacctatgattctgtgcatcttccggttctaatgctccagctggtttgtcatctttgacctttgccagtggggagaaaaactgaacaagaacagcacttagccacttacatatgttcaactaagacacaataagtagtaggctaaagaatagacaataaaaaatcacctggtgcatcgaaataaacactattgagatgcctaggagaaagttaactgtcaaggtatgtcccaaaaatgcagcagatgctagaccggtaaatattgtggccacggttgatgaatacttcttcaaaattgtgtctgcattacgattttagtcaattgttactaaagcatgggaaatcataacatcatgtaactgaaacacagaaacaaagaattggaaactcaagattgtgtaagagagtaaatcaggtataccatcctttacctgcatacttaaagaagaatgaagagagaatgccttgtgcagcattgttacaaatgagaaacattgtggcccttgaatgacctcgaaggatgtcaaaactctctggccctgcaaacaatggggcaaagttatatcatagacatatagccaatagtccaaaacaaaacataagacacggtacgacactaatggaaggtagtaagatttggccaactcgacagtttgtgagacacagagtattaaacacgaaatacaaagtaatgcccgtctggctgcttggaagaggtgatgcatgcataggctatatgggttcccctcttgaacggtactttaaatataataacaaaacatgctacagtgcatgattttcagtttctgactggtagcgctataaaaatttgcaggatgaaaagacgcactgatttcaaagtacatattcaaccatataccaagctctaaacagacatccaatttcctttgctttgcaacacaaaagacacaagagtcctcgggtaccacatctgttgtttgcaacacctgaaatactaatgagaatattgcatgcatgccattttccatcaggcctaagtcaccccacatgttgactttcaaatactgaaatacattataatgcataacagcatattcatcaccttagaatctaagttgcttaccttgaaatatgacagtccccaggatgccaaggaagttgaaaattgcaccataaccatatagaaacaaattctgcatgttgtgccaagagttagtgtgaatgaagggagagagaagtcaaggaaaaaaaatgtgaacaggtaagcatcaaaaaccaagggactagatcttatcagtttattgttttcagtattatatgcgtgtgttataagtaatttgaaagagttgtaaggcaaacttttttagtgcaaatcacctgaagatagatgcttgtgtcgaactggcttttcaaagcatactcattgtagactgaggcaagtgatgggacagtaacctacaatctcaaatgaacataaatatgaacatctcgattcaaaatttgttcaggtggctgaaaaaatagtgaaaactacacagatcaagatactatgtaggtgagtaaaacttacaaatataagtgtatatatgtatgcaatagtggtgactgcaagaccaaaagatttggttccatcaggtatggagcttagttgattgacactgattccaataagcaacagagcaagggcttcccactgatagccataaaaaaagaacagggtcatagatcagcattgttggaaacatttgaagaacatataattgctctacattttccctaggatttgattcagtttaagttgttgtaccattctagacttcaagtccatttttaattaatttggcactgcatctaaaagtgtcaactactcaaccatcattgctagttacgattctgcattggtactaacagagtttgtgaaaaattcaaaaatatagtcagcaaaaggcaaggcaaaaaccttgagaaaagaggcgaatggtgcctattgatttctaaaatcctagcagtagtaaaacatggaaactgcatgcactatattcacaataacaaaccaatagcctaataggaaaaaacatctaaatgagagaaattcttagctgaattatagagactgcatgcactgtgcagtttaacatgtaatggctaattgtgttttttttttccacaaggaagattcaggaataaaaggaccacaatactaatctcagtctcacctgaattatagagaatttccttctcattatgaattttaggaggatagctatgacgagtaccttgatcaggaataaaagaatatgatattagtaaatcttgcttcttgccaaacatagggaaaatacacactcgcatcttgcaaaaccacatgaataaagcatgggaaaaatggcgaaagagggtaccttcaggttgcttagcatcttcacagttgcagggctgaagtataactgcatgtgcagtacagcagattaaattaaaaccaagaccaaaagctatatcagattggaagactccaaatccgaactctagaaaaaaatcttaaaacatcattggtctctcattagatagattcctactgcaatggcttggaaacattgataagtattaaaattcatattaactaactcaaatgattggacaagttgcaatgacaattaaacagttcaagaggccttgagaaacacttaaggccatctcttttgcattcatattaactaaaagtttctaaatagtttactagtagctgaataattatatctttttgaacattagcttatcatcatatgctataaactccttttcagcattatttcacagcattgtatttcccttgaaacacatgtatttaacataagcataaaatactgatacactgcaggaaaacaagatttcataaagttcaatgaacatttacctgcatgatgaactttaggtagttgttgatggcatataggagagcaggaacagctaagagtgcattattacgtgctgcctaaaaagagaaggattcaagaatcaaatgataagttgccataactagaaagctggaattagagcaatttgatgcataaagttataaataaataaaggaaagctgaaggcaagtcattaaggaataaaaactacaaatgagcttcttctaaggaattaaaaacaaatagacaaaaacaatttgtggttaacactataaacataagtcatatatctaatctgtgtgcatgttgagcacagtcaacaaagagtgcatgctgtgctagcattgacaagataaatcacctgtacaaaggttgaaagtgacagaagtggcttctccccaaccttttgttttctagactgtcaaacacaaataacaacattagggcgaaatactaaaacaacaagactacaagagccaggaaggctgccaatagtaaatccatgactacactgttggtctactgaaaatggtgaattatgtgtgcaaaacaaatgctttgattagccattccagaaattatgtgtgcaaaacattgatattacatagaaggatcatgcatgctaacaagagatggaacatttaaaaaaaaacacttgtagaaagcacggatcagctagaactaacctggattattagcattacaatagcaaatataacttttgtaacctctgtcaaaaagttgacactgataggactgaactgaaacttcccatcaaccttggacataaatactagaataggctgcatatacaaagtaaaaaattagcatggtttgaaaaggttggcaatcagatatgtccaataatttggcagcatattggcattgaagtcaaacactttcaagtagagtggagtacctggaggccaaccaaaatgcagtcccctgacacaagaaggaagttaagcgcgcggtacttggacgatatcttgctgcggtgcttgtcatatgccctcgacacactcctggggctcggagccaccaccttggagtggcatacactgcattccatcactccgttcctctgcatctcctctaactaagcaggaccggaggccccaaaagcacagcagcaagatatatgtatcactctatacccgtggcctctgatccctttgcatgcctgca

SEQ ID NO: 42228 - DNA, 15322 bp, Oryza sativa
cagctagataatccatatcagatcactagaagctaacttcgccaataaacatccaaaataaatcacgaccaaatgcagcaagcgcgtgcttctatatactagatcacacaatcagcaccacacacaacaacaaccaaaaaaaaaagtagcacaatcacaggtgagcttgaacgacggagagatccgagaggacctcgtatcagcgaccgtaccacgggggagggtgggggggccgggcggcgggatctaacgccgcctgggcgctcggcgccggcacacgcgcggggcgaatctggtggcccctgtccggatcggcgcggtcgaggctcccgctccgcacccccccgcccggcgccgcacggggagatcgggcggtggcggcggggttctcctccccctcctccttggctcgcttcccagatttcgtcaagttccggcgggaggaaggtggaagagggagaggagcaggaggacggcgaaggcggggcgtgcgcttcgcgtgtattttattcacgtttctttctttctctttttttttttgtttgagatgttcgtgatttctcttgttcacgtttgtatttgtagtaactttttttccttgcagctgtctgtgatgaaaaattggtaagtttggtcattttacgccagaatttttttatctgtaaaatgaataatgccatgctataactgcaccatcacactataatgtgtttccatgtgcaagctatggagtaatactctcccctaaaaaagatataaaatggagtaatactttactaacttccattctcaaaaatagcacattcaagttatgtatacatgtatttgtttatgtatctggacctacataatgtctaggtaaaattcttatatatatttgcggacaggtgcattatctatttactcaagtgaataattatcattgttacaatataaaatcaccatatgtgttgctatttcattattgaaagagaagtcatcataggtgttgttacttatccatgttactgtaaatgttctgaactatatttgcgattgattacataaacggtggatacgcaaattatattcaaacgaatcctacaaaatatgtgcgagggagagaggcccaaaacagatctcactcatattcgaagttcgctccatatgaattgggaggtggcgactagtctgaaggaatagtctctcactctgttgaccatttcctttgcgattcgtgctacagtgataatagtaacttgttgtgtgtcatttactcgcttcctattggagcacgttgccagcgtgtatattcaaatctttccattcgacgcatgttaggtccaggtccaaacacactggcaaattctcaggcgaatattctaattgattcccgtctctttcgcaaggaagagcagctgacacgatcacaccagctagccatcgttacagtggcattttgagtttattctttttctctatgagagctcgttgaattgagcctttagcgttgcttttgatagagagtggtcatgagcaatttgcttggaccactgtccaccaaaattttcattagtgaaagtagatgcaaaatcctatctacaaaaggtaataatcactgctatatagtgtaatacttactgaatttgttgtaagagccatattcttctactcatatttgtgtcgtcctggtatgaaaatggtgcgattttttttgcggggaaaagcactcaattactcagacatggggtcatcactgacaacccatgataaaaaaatacaactgttccctggctacaggcctgacaaatactcacaccgagctttattcgctaacctacgactagctcggttttggctccgatgagctttatacaggaggatctcccctatcaccgctgaattaattcttgatttccctgagaataaacgccatctccgacaactccctctcctttcactgaatcattgcatcgctacctgacagtcagtttcaaccacaatcggcctgagaaaccattaaagaggaagagccagtccttccttgagagcaaggatctccgactctagtgcatgacatgtgtccggaattcagttatggttactaatatgtgtccgtactttgaacaaatctattttcggaattgatcccagtacatgacatctccggtaccctttcattgcatttatacaactacagctgctatagcagctgtgtttcttataccatagttgtactataggtgcatcttcagcaatttgagctgaacatgttcacaattttgagcggattctttataatatatcgattaacttcttatgtcgtgcgatcaaattttgaccttctaagtagagttattttccactgtttttggtgaccccatataccagctatagaaagatacaaatccaaaagacctagtaagatgactttttgagtggacaaaggtactaataaaagttttagattgcatctttgttggagttgtttgcagtgggatgtaggttgggcaagagtgcacacaactattggcttatcatttgctcttatattattgtttcatatccttttgtaaaagctaggtgaaaccctacgcgttgatgcgggcatttagtatgataacaaatataaataatgtgtaatatagctagatgacgtaagcttacataagttgatgtgatttacaataatttaaatagtatataaaataacgattcaaatgtaaaattaaagtgatgtagctttgtaagagaagaaaataagggagataatttgcatcatagattaattatctatgggcaaaaaacaattgaggtgatatgacttaataagagaaaaaaaaggaaggagataatttggaccatagattaattatataagggctacaaacaattgatatgatgaactcaagtaagtttttagggttttcttaaacaaattttactgttttaggatctattagatagagtttgccttttgtacatagaggtagatttatttcgagtttgtcttttctatctcttcgttgatgtctatttgttaggtggatcctccacggagacctataaaggtttgtctattgggttgctgatgattcaatccgtggcactggtagtattgattgctaacatgtcacaggaacggagatgtcagatgatgcttagtcatgttctttgtgtgtgcttgcgtttttcaacggtgttattgtgcttgtctattcacgttgcagcaatccaacatatggagctctttatcttttttgtgaggttttatacttcttgttcttgtgacaacaaggttatagttatatttcttattccatccgtcccacatagaccttgtttctagaaattctagaacaaatcagtagtgcggcgaattgatcaaatgtttctcattaattcatggttacaattcttatgttctagtttaaatgtgtatctggagcatgtataacttagaattaaacacctcgtggacggcggccagcgggggaggccacgcgctgctcctccgccgcccaccgacagctcctcccccaccactgccgcgttgcccgttgccgccttcatcgctgacgcctgccaccgaggctggtgcctcgcagagaagggacatagaagggagagagagaagaggggaaaagagagaggaggttgatgtggcctcgctgacatgtagggtccatgtggatcgcacgttgactcagccgccacatcggataaatcgggttcaaaaccaccgaatgacctaatgtgaacggttttgtaaattgagagataccatatatctagttttacggttgaggttaactcaataacaagttgaggcatcttgggtgtactttttacctttagcataatcgaacaaggatgctaacatggcatacaaacctttccgggctccacatatgtccacgggccgacttgtgacttggagcacgtacgagtgcacgacacggaccgagcctgaactctgatgaagtcgactctcaaaaagggtccgtctcctccggaaaacagaacacggctcggtggagaaaaccgaaaagaggaaaaagaaaaaaagaaagaaaaagaagaaaaatcctagggctagcctccgcagacacacgccatccgaaattcccgtatcctctcgagtctcgtcttcctcggcgccgccccatctcagccggacaccgcggcggcggcggcggcggacaggctgttcgcgcagaaccggccgggacgcattgttccgtcggtcgcgcgatccaggccggaggagaggggaggaaggagggggtgggtgagtcaacccctctctctctctgatcggaggtggtagccctcctcctcgtcgccgggaggcggctgatgcggcgcccatggccacggcggtgctcacctacctgcagagcctgtggccgctctccgctctcctgagggaggacgacctgcgggcgtccgcgcggctgctgcggggcgtccccgtgccggaggagacgaagcagttcgtgctcgcgctccgcgaccgcgagcccggctccggctcgcgcgggggcgtgatctacatcctcgcggcgcagaacctgtccgagcggtcggcctccgacgccgactccctgatcaggcgggtgcgccccgccgccgtggtcacgcagctcgcgcacacggcggccgacgacgtccgggccgaggaggagtgcctcgagggcggcggggccggcggcgtcccggcgtccccgttccaggtgatcaagaggtgcgtcacggagaagaggagcaaggatcagtacgtcaaggcggcggcgtgccaggtcttgcaggagattttcggggtcgggttctacggccatgtcttggccgcgaagagagccgcggaggagacgggctcgtgttttcttttgctcgagtctccgtatgagaggaattgcaatggcggcgcatcgggtggccaatctaccatggaagaaggctcaggtcagcaattggcgagtcgctgctcgctcgctcaaagttcaacggatgatggcacgggtggacagtcacagggtagctgcttgctcactcagagcaccagttcaatcgtaagctcgcatgtcaggaagatatgccttgtggatgacattgggggacaactcgtgaagtcgctagcgccgaccgttaatttgttgatgtcccaggctatctcttctgatggtgtttcagagtgcaaactggctgaatgcaagccatcggacagatacgaggctccaccttttgcacagactgtttatccgttgcttgctgatctttatgatatatttgtggacattccgtcaattggaaaagctatggcttctgctcaggaattgctcagacaagttcatgatgggaagccaatttccactgaaatgctgtctgatgtgtatgtatttaggatcgcaatagaagccctcaggataggtttaaacaacgcaggaagaagccacattgacaccagagataatcatggttcaaaaaaattggatttttcagaactcaactctgaggagaaatgccatattcttcttgtgcaagccctcagaagccaggttagggagtttggttctgtggtggctgtagtcgatgccagttgcttagctggaataaggagacactgggatacccctgttccttcagagattgcacaattagccagcagttgcttcaagcaatacggcaataaaaatgacagtgaggacaatgagctgccatcatcagttgacagcacagataaaaagagttgggtagctgagaaacctgtggtcgtagttggtgcaggaggaacagcgattctgggcttttcatctttatcaaaaactgtacaggcatctgcctttcttaagctggctccctataaaacaccggtggtcctgaagtatggcttaatacagctgcaaaggcatgcttccatcgtgttaagcaaggtcctatcgaatggggtttttagtgctagttcaaacgcatccgttttacaattcacagcttcatcggagaagattcgagcagttactcacactgtaatttcatcagcaaagagaactagcttgatggctatgcgaacttcgttctacgaaataatgcagaagaggcaaaaacaacctttcaggatcactccttgggcaacatttggttgcagcatggctgcatgcgctggtctcctgatgcatggagacgggattgagtgtgctgctgaggtcgcaccttctgttcccatgattgccactctgggacgtggtcttgagatcctgcgcctcacatcgcaggaagtgaggcaaacaaggggccaacatataaaggaagctttgggcgcgctgatgagcaacttaaagaaaacagcaaaataaagacataacaaaaaaataactgagactgtatagatttccatcatgcaattttgttgttagatagatttttttttgttacctctgtacagtgcattcttcttgcttttactgaggtaatcgaattcctacaatgtgttttggggcggttctacttctggagcatttcatccatatcagcccaccaaccttctgtacatacatgtatacaacatatgcctaattgacatctctaatgctttcttcgggatcatctttaatgctttagtaactcttattgaatcagtgctgataccgataagaatgtgatgcagctatctgtaatgttctaagtgaaataccacctggagatactgccacatggacagtaatgcttatcttttgtgaatcatcgtcttggctgttctatttgtgtttatattttcccaggcctggttcagccttgtgaatttgcatatctctgattgccccattcatttgctcactcaatgttgtcttcaagcttatctgtgtacttgactgcccttttctttattataaacaattatggttgctcattgttgattttgagctaaggacaagtggtcaatagtatccattgtgatatgcacttgtgttacatataatagtgtataaacatttgtctcatggttacaaaacaatgtggaaagaaaaagcatccttgtgaccttagttgctaaaaattggcggatgccgcctatacaaaagtaaggggcctcgcccatctgtaacacatttacttcccatttcttcagacagttgctgctttgagggtgagaaaatcagaaatttggtttgtgtagaaatctggctggatcgagttgtcagggctctgaagcatctgtacagaagtgacacctgcaaaatgcatccaacacttggtgcttgtactaacataaaatcagcagagcatgcatagttcagaaggagaggaggatcaaggaacctgaaaggaccagaagagttttgcaacctccgttttggccaaacaagatgtcggtatccaaacggtcaccaaccatgcatatctgggatgttgtgatcccaaacctgccacagaggtaaacgagaagaaaggtaagaatctgaaaccatccatccagctacatttctgataccgatggatgaaacatgactgctgctgagacagttggcctctcacttctttgccaggtagtccatcatgaatgttgacggcttcccgacaacgagcggttcttgtttagttgaaccaagaattgcaccaaccattgaccctccacctggtgaaggcaaaatcttcatcatcttaagcatttatccatcatattctaatgtaggaagagctggaatgcctgactaacctgcccactcttgggcatcagtaagatgggtgacggcgtcccggtttgtggcaatgaaaaggcaccctggattctcacgaatgcacagtgtcccgtaccttcagaagttgattagttgtaacttgtaagttagcaaatcttttgtattggttttggttaatgccaaacttatttacatgaacacgagagctaagatgtgatttggcaacacaggcagacagcattggtcaacattggtaaagaactgcaatcatcaattcatcatctgaggcatcttgcatgcatcaattatcaaatggatgcatgattatgatagaactactaatctgattctgcttgccttacatatatgttcatgtcttcttgacaatggaggaaagaagaagaaacttactgtactttgtagtagttaaaatagcgatcgaatcccacaacaactgctccaacctgtgacaaatccaaatggttctcagtgcaatgatcgcattttactgcaaaccaaagtagggatcgtagttacatctttgtcatgttccatgtaaaatccaggcttcagctctatcttcttgtctccatcagactgcaagatgattgttatgtgtgttaatctgtcccaggaatgcagcactgaacatgggttcagaaattttataacttactggcccgccgaggtactgaaatccagccagctccagctccttcagaatcccgtcctctccaatcacataaacctgaacaataaaaatgttaaccttgcgcaaatattatttgccaaaattgctgaacatgaacagtaaaaatggtaacgttgtgcgcgtatctttgcaccaaaacatgttaaaacttctgaagatgatgatatagattagataccttcttgtctttggggaaatcgatggactgcaggtacgcggcagctgcgaacgacgaagcgaagatctcttcctgcgtagagcgttccaggctcatcagaccagattggttggacaagaaaatttggcaaagaaaaattggcagttcatggcatgaatcctacctcattgacgtttagtcccagcgtctcaaacttcttcccgtattgcttcctcgacttggtcgagttgttcgtcacgaacaccagcctcttgccctgcaacgccacaaccccatcatcatcagcttcaactccagcagattgctaatgctaagttggactcggagttcgagaagatcattgcagtttgcgacggacctttgatctgagcatgtcgagcgtctccggcactccgtcgatcagcttgtcgcccttccaaatcacacctacgcaaacaaaaagaacgcgaaattcataacaaaatcacaatcaatcaaaccatcgagcgatcagtgtgccatctcaccgtcgcaatcgaatatgaacgtctcgacggagtcgatgagcgcgtcggcgttctccagcttcgccgcggggaccgcgccggccgccgccatcacggacctcctcctggcagcacagcgctgaccggccaccggagaagaaacggagaccaatccacctccccggcggtactggctcctcccgaaggtcggggaggacggcgcctgctgcggcgagggcgaggcggcggaggtggaggggaggaaggtgggggaggcgcgcgtcaggagcatcgcggctgctgctgctgctgctgctacgtgcgtttttgtttatccggtggcgtctgtttggttggttggtgtcgtttcggtttcggcgaatgtaacggtcacgtaggagtatgtgtagtgtagcaagggaggctgctgctgctcatgtggcgacgatgatttgtggctgggagcagagggaggagggatcagggatttggggtgtggccggctagtgttgtggctgtcaataggcacattggcacggcgtctgtgaggctcaggtgagaccgtgaggagaggaagcaatcaagcaacatgtccggtccggcatatcaatgtaccaaatggtctgttcgatagaactttaacttttttaaatttagcttcagaagttaagtctgtagtggaatcgtacagcagtctaaactcctaaactcagctccatttctttagttcattttgtaagaacgctccacctagctccattttcattttaggtgaagctaaaactgtttgactgtgttttagttctaggagagttgaagctgaaactgtgctaaacaggcacttattgttacttgggatttagcatttgaaagaagctcacgtactccctttgtaaaaaaaaagataagatatcccaatacaaagaactggacatgaacaaatttttcatttttcgtgcgcatacttcttaacgaactaaactatacatttttttttaaaaaaaaactaccgaaaaattgctttaagtaatcatattaatctatttttaagtttaaaataattaatactcaattaatctaaattaatggctcacgatactatttttgtctcccctcaaacacactttaatgctctctttggaacataaatttttggtgagagataatatgatgccaccaaattcttactcataggtacaagtaggtacttctagaaattgtacagaatttacttgtgctaggttagatgacaaacagggactacaaaagcctgctacatgtacaaataaatttctgctaattttattggtgtagttttcatgctatgtttggaatagatgaattttagtaagagccgatatgccttcttacctgcaggttacacgtgaaatcggaggtgttatataatatacttgctccgtccctaaatatttgacgccgttgacttttttaaatatgtttgaccgtttgtcttatttaaaaacttttgtgaaatatgtaaaactatacgtatacataaaagtatatttaacaatgaatcaaatgataggaaaagaattaatccttacttaaatttttttgaataagacgaatagtcaaacatgttttaaaaagtcaacaacgtcaaatatttagggaaggagggagtactattttgtttgttcaacaaaaaaaattttcatgtataacaacatgtgggtttgcaattaaaagattttgtaagcctgctttggtatagttttcatattggtttgtatacgtcaggtgttgcttatgatgaatttaatttactaataaacagtagaccttttgacataaaaatacagtagatcgatcatttgtgtatttgtttttaaaaaatatttatataattcaattagacgttgaatggtagttaatgccacactgtgtgccattttctaacccttttgtgttataaattattatattatgatttttctacttataaatattgcattatgtttcatttggcttaatttacttacatggttggggcttggaagccaacaagtgttggctaaacttctctgcagtttgcactcgatatgtttgagaggaataagatgtgatccacacgattaatctttttgaaactcatcatcacaatatcggtgaatattctcgatttctcctttggctctatccccatttctctatattttttaatcgtaatttgaggtatcttttattattgtgtgtacacacaccccttatcagtctgtcttctgtttcgtaacttctgctagttttttcgttgcttttaatttgtttgtagttgcttcatggaagagttttttcgttgcttttaatttgtttgtagttgcttttctagtctttgtagtcgtctcccatttgtagatgagaaagatgaactgtggttggtttctcattatattagttggatgtttgacttgtaaatcctgaatttgttgtgctccagtcgtttacttatgttcagttgtcattattgtaagctcttctgaattttgttgagtcttgacttttttcaccagtactttggtgtaaaaggttatccttttatatcatccttaattttttgttgcttctttgtacgcgtcatgtgcttttttcatgagttgaatattaatttgagcccctctccgccgccccctaaggcttttgattgtggttttgttcttttcctccctctgttagaccattgcttttgaactcttcttagtttcttcacagtattgttcaacctttttgaatttctttcgattgggtcaatggagtaattcaaccaggagctaactatccataccttgccgtcttcaatttatatagcattttatttgttcttgttctttttatttcattatctatgccaactattgtatttatttgaggtgcacctgacgcccaagaggttgaacctgaacgacatgcatctccaccaaagctatttacctagtgagtgtcgctcaacttttgctctaccaaattcttcattcgatgaaaatgcatgatgttggtggtttgaaggtttctgtgctagggaaaaccataagggaaaaaaattaccgtaagagagcgcggcaacaagtgttgggtatattgagctgggaagtcatgacagtggatgttggaaatatgaggtgttttgccatgctatctagctactactagtagaaccattctagatcattgttttttaatccaatggatcatatttattatattactggtagtagaatattatttttctactggtggtagaatttataaatcaatgttggatatcatttttctagcacgaaaatactggtagtataaaattaccactattttttgatttttttttgaaaaagattacctccactattatcactagcttgttcctattctctggaaaaagagcaccgtaaaatattagttgttcttgttctcttggttgggacgtggagagttgtttgtagatcgagttgaaagttggatcatccatgaagtttttttatgtgtaaatcattggagtatgcttttgtgttgcaacttgtttatacatatactccatatggaatgttgaacgcaaggccatggccaccgtacctggcaaaggcctgcccgtcaaatataatcaaaggtaactgtaatattattcaatttaaagcaccagggcacatatagtttaggatcggatgctccccactttctgctagaataggtccttcaatgtattatgtatagaatctattctacgttgaaaagagatttcctcataacaaaaaataatcactacactatgctaaaaatgcgttttttttcccagccacacttagtgctctaatagtaataattacgtacttagccaactatagcaatatatggctgtacatattgagctatacagtggtgtatagtatatgtacagaatctattctacgttgacactagacaagttttatctcataaccaaaaaaaaaatcactacattatgttaaaacatgtgttatttttctcagccacacttagtgctctagtacacctcataattacgttagccaactttagcaatatggctgtacacgttgagctatagtgatatacaataatgtcaaacttgctgcatccaagtatggcaaggtattgctatacattgccacatacgataggcttttactccttcattaaatgcgtccacctagtaccaaatcactttcagctttcaaatctcaaactctttaaattcccagccttgaatccacctgacctgtgcctcgtactcccataatcccatttcgcatccggttctagctttccttggcttcccatttcctcgatctccagcgatgtcgctcgccgacgacctggccgccgtcgagcgcggcggccacatggtgccatcgaaggcggcgggtgtcgacggcgacggggagccgcggcggacgggcaccatgtggacggcgagcgcgcacatcatcacggcggtgatcgggtccggcgtgctgtcgctggcgtggggcgtcgcgcagctggggtgggtggccggccccgcggtgatgctgctgttcggcgccgtcatctactgctgctccgtgctcctcgtcgagtgctaccgcaccggcgacccgtacaccggccagcgcaaccgcacctacatggacgccgtccgcgccaacctcggcgggaccaaggtgaggctctgcggcgtgctgcagttcgccaacttcttcggcgtctgcgtcggcatcaccatcgcctcctccatcagcatgctgtacagtaaaccaaaaccctttctctgatctctctccgccgccggcgccgcgcgccacatctcgccgtgaatctttacgctttctttcttcgcttcttgtgcgtgcgcgcgcgcgcgcgcgacgcggcgaacggcggcgagcagggcgatcaagagggcggggtgcttccacgtgagagggcacgaccagagggaggcgtgcggcggctcgagccggccgtacatggtggtgtacggcgcgctgcaggtcgtgttctcgcagatccccaacctccacaagatgtggtggctctccacgctcgcctccgccatgtcgctgtcctactccgccatcggcatcgccctcggcgtcgcgcagatcgtaggtgagtgaggagcgaggggctcgttgtttcgttgtggtttttttgaagtgcttgacatgtttgagatcgagtttgcagcgaacgggggaatcaggggcaccatcacgggcgtcttcgtcggcgccggcgccggcgtcacctcgatgcagaaggtttggcggagcttccaggcgttcgggaacatcgcgttcgcatacggcttctcgttcatcctcctcgagatccatgcaagtcaccgttcatccggatatcactaattcagtatcccgtttgatctttcttgattgcttattactatgcatgtgtgtttgtgttcgatatgttccattcaggacacggtgaagccggtggcgccgccgtcgacggagacgaaggtgatgaggaaagcggtggcggtgagcgtggcgacgacgacggcggtgtacctgatgtgcgggtgcgtcgggtacgcggcgttcgggaacgactcgccggacaacctcctcaccgggttcgggttcttcgagcccttctggctgctcgacctcgccaacgccggcgtcgtggtgcacctcgtaggcacgtaccaggtggtggcgcagccggtgttcgcgttcctcgacgggcgcgccgcggcgggcgcgtggcccgggagcgcggcgctgggcaagaggaggcgggtgctccgcgtgggctccctggccgagatcgaggtgagcccgttccgtctggcgtggcgcacggcgttcgtgtgcgtgaccacggcggcgtccacgctgctcccgttcttcggctccatggtggggctcatcggcgcggcgtcgttctggccgctcaccgtctacttccccgtggagatgtacatcgcgcagcgccgggtgccgcgggggagcgcgcagtggctgtccctccaggcgctcagcgccgggtgcctcgtcgtgtccgtcgccgcctcggcgggatccatcgccggcgtcgtggaggcgttcaaggcgcacaacccgttctgctggacgtgctgaatcatctgaggccttgttcgtttaattctaagaaaaaaagagaggttggaggaactgaaaggaagtaatttcacatcacaatacatatgaaatactccctccgtcccacaatataaggaattttgattttttgtttgtaacgtttg

SEQ ID NO: 42229 - DNA, 4421 bp, Oryza sativa
caaactgaacatgtcgctaatgttgtagcaaactgatagttttgtttgcagttttaaatttactcttttccattttactctctcctcgaacactctcgatggctcgatctgaacatcaggcacgagagacgagagcgtcatggcatcactctcaagcaccacctctctctccgccatgcagtggcggagcggcgaggcggcatccgctccgggcaagacggcggatggaggtgcgtccttttatacttccgtgtacgagaggagagagagagagagttgggggcattgaggtgaggtgggtgctgtctggactctcgggcacagggggcgtcgcgccacgcacgcttggtgtttgaggaaatgcccgcgctgaccaatagatgactggtcaatcggcgacgtgatctgatggagactaatggagttcgcaatctatttcagacttgcaaagtctgcatttttgcgattactgtgtcagtaactccaatggccgtagcaaaattacccataaagtgcggctgtttgattttaggcataatgacgaaagaactgggggggggggatgggttgactttttcttccttacaggctactgcagattctatcctcttcttttacctggagtgtggaagaactctgtgggtgcctgggtggcgttcagctgagctagtacgttaatgttctgtatgtttgtatttcagcttctgggtctcggcacacccagaaggttgtacgtttttgtttagaagttttgattgtgtcgtgtttgtactgttttatccttcgttcttagtaaaattctaatgcaaaaaaagtacgaggtaccatgcgcctccaatatttggaaaaatataaacttcctctatccaaagtccaaacttgtataggtctgtttcatctggcaataggacaaggaggcattgaaaatgatttaatcatcccctgattatatatcaaagtgttccaaaaaatctctatcttgcttaaaatttctctaaatctaggattaatcaaatgcatgtatttgtatgtacaaagtaaagatgggcatttctcagggcctcggcatatggagggaagaacacacttattttactttgaatataaatgaggtgtacactgatagacaagactattatcaaaaacaaaggaggggtactccattaaatatacaagttaggacatatttgcacatgttccataaataggaacacgatcaattagaaccagacagaagcatgatatctcaaagaaatttgtctgcaaaaatgcagaagctatgactggtactaacaatgttatgtattcattgtgtatatattttgttacatttgttgcataaacatttctgtccaaaagtggaactgagggccttcactctagactaatctcgagattcgacagattattcaaactcttgggtatgtgcagctttggacaactagatatgtgcaaggatctcagagaggtgaaattcttcaaccattctgggaaagtttccaaatttgtgcactctgttattgtcaaggttcggaggaatgacaaatgctgcatgccatggggcaaagaaatcaattctgtgcaccttgaaatatgaagttcctcaatacctcgaagttctctcagcccctcacattctgaacactctaatagcccgtcacacagggaaaccgacagagatttcaggttttgagagaaaccttccagtgctcctctagatccaatcaatttatcgttgttcaacaacatgattaagcttttgacaactgggagtttcacatgcactgctctaaattttgggcattgggtgatagtcaattcttgaaggtttgggaaaattgcttctctctgtgatggaagccatatttctaggttgcgcatgtgaaagaacgagagtttctccagtgaggcgaatgtgccatcatccccatagaattcgtcacctacacgtgtgacagcatttattccacttaattcaacaatcttgagaagaggtaattgccccagtggaggtaggcattcacatgccaaattaactagcttgatctcagtaagtgattttaagtatgctggcatgcttgttatccatgatggaagcttctttgctggacatgagaaaatgcataacactttcaaaccacggtttggcttaagaagttcaagtatttgctgtgcttttgaactaatcataggatctgtacagcttcctgtccaacttaatgccaaagacacaagcctatttttcttttgcagagattacattccttgcgtcatcaaaagaagcattttccatattgcaaatactgagttccttcaaactaactaagggacgcaactctgagatggtgtgctcgtgattttccgctgcaatgtaccttggcaatatctcgaggtttctaagttggttcatctgacagggcatttgagttagtaaaggacattcaagaacgtttaggtaggcaagacttttcaagtttttcatgcttcttggtaaaatagcaaggtaatgacagccttcaaggtttaggatttgaagattcacaagattgcttacagattcatgcaaatgaagaagtttttcacaatgagatagatccaaaacttgcaaagcttgcatctttccaactgattctggcaattcagcaatctcagttcgtgaaaggttgaaattcttcaagaactgaaggttgcatattgaatctggtataatctctatatcattgtgggagagattaagataggctaattttttaagcataccaattaacttaggtactcttttgatcctgcaagattgcatgtgtagtacacgcatatctatcagacatttgcagaattcttctgggatgtctgtgattgagcacttcttgtcagacaaaagcatcttttcatctctgagcaagattagtgtcctcagatttcccatttcaaacaattctgttggaagctcagttgtcttcgagtcaacgagtaaggagaggcaccgagcacttttttttgcattttctacaggccaaactaattccttcctggcatctattgctaagtgaaatcccctgctaatcatttgtgcaagaagttgcatcccagggtgcatcttgtaaatagcgtatgctttgtgtcgaggtttctgcattacatcatagtagtgttctgtcattatcttggagaagtacatatgcatgtcagatttgctgcttgacagttttatgagatcatcagcaacaaacatgccagtcaactgttcgggagtaaagctatgaactgggaacagtgaacagtatagaaagcattgctggatattggaagggagttgttgataactgacgtaagttgcatccaacagaagtgggtctgcgtagaaaactaggtcaaatctgctcaggacatgctgccatgcaacttcagtcttccgtatgctcttgagcttgtttgatgcactgagtagtagtgagggcacgccacaacatgtgtcagcgatcatttttcttattggaattagccgcggcggcaactctgcagaattttgcatccattgtgtgagaaggtttgaagaatcgattggtaagagacgcttcaaagtgtatggtctgagagagttggtcattgttacaacatctggaacgcgactagtcacaatcatcttgcttcctgacttggcactctcaaggacctcaatcaatagcttccatttctgcagattctgaccccaaacatcatccaagacaataagaaactttcgcccgcatagtcgctgcttgacaaggcactgaaggctctcagagtccactgtgttgcattgcctggtgtttagaaattctgctagtctgctcaatattatcatatcatcgaaactactagacaccacgacccaaattcggtcatcaccaaatgtcttgacagcccatggatgtgagaacactaactgagcaagggttgtcttcccaattccagccattccggttatgggaagcactgacaggccagctttgccatgatcagcttgcatcattgttagaacatcatccacttccttttcccttcctagtatcccttctggtcgtatgctatgtgctccttggcaaaccataggtgtgctgatatctctatgtttggctgggaatcggattctatatgtctgtgcatagcattcttgcaattcaactattgattgtttgatcttatggacaatgcggcgtcgaaaagggagccttctaaggatgaatgagctgtgtacctgaattgagaggacccttgtttttgttagatagcaagagaccttgttgagcatgtcatcaatgtcaagtgtgagagaccagagcctctgtagaagctggtggtactgctcgttgttggcgctgatcatgagaagtgcactgtcgttgatgccactgatcttcctatggaccatcctgaaaagt

SEQ ID NO: 42230 - DNA, 9217 bp, Oryza sativa
  unsure (1)..(9217): unsure at all n locations
tgctcctgcgcagactcagcgtaaagcttttccaccattgcttgcagttgatgttccactgacatgggttttttcttccttttcctttgagagatatgatcaccatggattatgcgcaaacttgaagggagcttgttcatgttaaagaatgaagaacatcgtttgatgggaacttaatgcagccttggttttctctgccaaactattttatttggctcggttaggtgcattacataggaaacttcttagtgaagacaaagtctatatggttgttgtgctgtgacttttcttcctagataggatcattttcatactttattgaaaagtcatagttgtaccacactttccagagttcccaatggtcctttgtcatatctcatagtactgagtaaaagacgaacagtattggaatattattggtggattatttcgtgattgtaggaacctgcagagcaccttcctggtttccctcatgaaatttcagtttatgaacctgctaacttgttcttcaaaaacagatgacactgcattctcaactatctatggttcagagaacaataggtttgagtggtctggactctggagcactgtaaaataacagaggtactgtaatattcaagcttttagctgttcatcactttccaatatacataattgctctgttaaccagtttttgttttcaagcagaacagttttcagctgaactctcctttctctaccatactggcttgatccatatttagatctttggtatttgtgttgttgatcagcatgcttgtccatagaagcattgagaaagatgtatttgagccacttgtgatgcgtatttctgaaattgcgcaacactattttgggacagtgggctcatctgaaactggtgagaagggtcctacagtgcctgaatttccagagaagatcaaatgggaagtgcaacatctcgaagaattgtttgagggcattaaagaagacaaggaggaggtctatgagggttttaagtctgttagccttgcaatctccgagtggcagagaagattggctatagcataccaaaatgcagctagagatcctcgaccttttgagggaatgaaatgggcaatggagtatcatgagatgtgggttgaagacaataatataataggagctggtgatgagatattggattttgatgaacatgagctttttgaatcacttagatatgtcaagactgcacaaggtggttcagaagctcatctcctggaaagtatcaagagtgggatgcagtgcataaagaatgtgttagccaccattcgatcaagaaaggaagcagacaacaggagctggtgcattgtggaacaggtcttctccccgctactgaaacttttgaaaactatcaatcatctagtatcagaagcggctgcccgcaacaacaagtctgagaactataagatccttgtcaagatcgatgctgaagtcaactgcttacaggatgcactagatttgattgatagaaataagaatgaggtttatgagaacttcagattaatagaagatctcatactaccattattaacattccttaaggccacatacaatgatcaatcagaatctttgagcttcctagatgcagtcaaacacggagtgaattacttggaaggtgtacttgacaagattgagcagaagcagcgggatggaaatgataatttccacattgtcaaagcagccttctcaccattgttgacatgcatgtacaccttcaggcgcatctcgttggaaaccttagcccatgaagataaatcagatgcttttattctgttggacaggatcagagatgatttgtcacagctcaaagatgtacttcagatggttcaagagaaagagaacggaatatacagtaactttgatgcaattgaagaacatattgatgagatttatgacggacatatgaatgttgaaggttccttaaaacttaaccagatgggtggtctgcgagacaagctccagttgattcatgaagagataacaaatatacggggaaaggtggatgactctttcaaggtccaggaggtctcatgccatgtcatgcgcatggctgcagcacatgaagcttcatcttctcatcagttgtcagcatcaaataccttctgcattaccatggaaagtgcgcagatgtggcagctcaaagttataattgatgaactagagacaagattgagacactgccttctatgccttgctgtgttcccagtggatgccatcatcaagaagagactgttaattcactggtggattggagaatgttttgtaacttcggtttctgaaggcaagagcttctttaataaattgctgctgtccaatgggttcattacgccagtaaagaaataccactgtgacaaagtccactcgtgcaaggtgcaaccttggatccgtgggctactgattgaagctgcaaagagcaaagcatttgttgagctcagttcagatggcagctccaggaatgactttaccaggacccgccgtgcatgcttgcatgctggaaagatccttacaaacttccatcctgatgttttgacgatttacaatatcaagcaacagtatgtagagttaaacaagacatggttttctgaaaagaaccgtttgaccactttgcagttaggacaatggcacgatgcaagttatgaccctcgggcacatcacgttgagattaacaatgccaagttcctaaagcaggtcaaatcctgcaagcagttgaagtacctgagtttgagaggcatatcaagaattgaggcccttccgaactcaattggaaagctctcaagacttgtcattcttgatctcaaagcgtgccataatctagaggatcttcctaaagaaatagtaaaactagtgaagctggagtacttggacgtttctgattgttacctgctctcaggtatgcctaaaggactaggcaagctttttcaacttgaagttctgaagggatttgttctatcaaacgccaagagcaaagatctatgccatctcaatgaacttgtcatgctaaaaaagttacgaaagctgagcattagaattggttatagcatagatagcggtcagtttgcgaattttggtgagctctgtgctctccggtcgcttacacttatttggggggcacacccaatatctacacacgggagttctccaagtcatgctgctcctcatgcaatgccttgtgttctccccttaggtcttgagaagctggagctccgttgttttccccttgtagaattgcctcactgggttagtcctgaaaagctgagaaaattgaagaagctctacatcagcggaggtaacatcagtgacctgggtgatttgaagtcctgggaggtgactgtacttcggctaaggttcctcaaacatatgaactattcatggactgccctgcatgattcattcaggaaactcgatgttttggaggcacatgaatgtgaaaatctacagccctggccttcctgcggaaaagggttatggcggaaagaaccgaatggaacgattgcacctgtgttgacctgaagtattgagctgggtccaatagggtgcagaattactgcctggaaatgggaatattgaaggatatatttgatcagcagtatatctgaattctgaagacattgccaatcactgtctggtaagatggcaattggcaattgtcctgcagcatatataaagatattaaacttctaactgtgttacatttctaagcacaaatccttgcatactttcacattgtcgaatgtttatagacttattgggcaacataagtcaaaaaataaaatgtactcgtcgattggttgcataggcttgaaagctgcaagtaacaagtgatcaacttgttttgaagttggctccatgactccatacagccatcctctcccgtcttcctggcatcttgttgtaaacctcctactgatgagtgatgagttgaaagaagatgcacacggatattagagtaccagtctgatcaggccagactgtgttgcaatcaacttcatcctgctgcagtctgcagatgttgcagatagtgaaattcaactccatttttctgaacccttgtaggatgttgaatttcatttcttgagcaaattgcccgatttataaactcatcagattatactagtatctacggttcgggatcggactgtatcctgccggtaccgtacacaaatcgaattcgttagaacctccacaaatattagtgccaccaagaactcagaaggcccggaacacgatggcaacgaaatccctccagcggccaaggcgattcatcatggcgccgatcgcctcttgcggcagcggcggcatcagcagatgctacaccgcagccaccaccgccgcgacgatggccagcggcggcgtccggctccgcaggagaggcttcgtgctgtgcgccgtggaccaccacggcgtgaggcgcgccgtcgtcggcggccagtttgtgaggaagtccgagctgaggcggcaggacgagctgctcgtctccctccacgagctcgtcggcgtcttccgagagctgcagcgcaagctcgggttccggcagtgggacgagttcaggcgcgcgcagcctgagctcgacgtgctgtaccagcaggctgcgcttccagggcaagcggtacaggagccgcatctatggcgagcccatgcccgatttcgacgacgccgtgcacgccgcagttcgggctccccgcattggtgatcgccgtgtctgcagccgttgcagcagctgcgactgttggtacagcgatctggctaacttgcattgcctcgttcgcaagtttgtgtagagatgaagcccttgttttactctcttgtatatgaaactccgatatgtcttgctacaacaatgcttatccatgtttaaatcagatcttacatagctttgccacggacaaccatacgtacatgctatgatgctaaacacagcacacacgacggctaccttctcataacatctcgctactgcaaattactaggagggataaaatggatggaatccaacagatcatcactaccaaatcaccaggattgctatttagcgcacaccttttcatatgaaagttttcatatatttttttttcgattaaagttttttttggacgaaaatttttagaaaaaagtgtgtgctagtaacggacgtttgactaataatagcactataggcaaaatcacatctacgcaaaacttgactaatcctttggcacggtttgaccaacactacaggcgcggtatttttcaaggtgaatcgtgatccgccgatggctcgacgtcgacgacgacgcgtgggtcttgccggtatatgtacctgctcgcccagtagaggtagttgacgaagccaagcagcccgacggcggcgacgacccagtagaagaggtcgaggcggctggtgttgagggtggcgccctcgagccacccgccgccgccgccgccgccgtgccgcctcgtggccctgttcaccacctgcaccagcagcgtggcgagccacgacgagaggccgagctcgcaccagaacagcgccgacgcgatggacttcatgccacggggcgcctcgctgctgaagagctcgaggaggcccgggaacgacgtcacgtcggagacgccgagcaggaagaactgtggcgccagccagaacagcgacatctgccccgccgccgcggcgtcggcccgccgcttcctctccacgacggcggcgatggccgacgccaggatcacggcggcgaacccggcgccgacgcgctgcaggtgggtgacgccgctggcgtagcccgtgcgccgccgcaggagcggcacgaggaagcggtcgtacaccgggagcagcgccatctggaacgcgctggggatgatgaagagcgtcgccggcgagacgtggatcctccccagccgggtgttggtcaagccgccctgctgcacggtgaaggtgaagaggagcgggttcgacatgtagccgatcagggagctgatgaagacggggagcacgcggagcacggcctttgtctcctccacgttcttcgtgctgcagactgaccaggccccgtctttgcctccattgatgcaagctttgtcaaggaatctgccaagatgcatgcaaagacaaaattttagtattgcactctgccaagaggacaatgctcaattgccaatattttctgctttgtattcaaagtagtctagaaaaagtactcagtatttcgttgaacatacttcagactactgtttgtttgagaagctatttcagttacttcagtagagcctccttgctcagtgcttctttcttcctgtgcttcttccagcttctcaggaagttgaagcttcctgttcttgaatgcaaccacaagaacctgggatagatagatcagaatgcagtcaactaacatgcacaggatctcttttcttgagaattgatgttgacatcatgttttgacccaacaaggagcacaacctacctggagtatccgagttagcggacttccttcgggtacatggttgcggtacaaagggagaccagcagcaaccacaagcagcccaagcaggatcaggaacgcgcacaccccaaacccgacatcccaccctttgctgttctccagccaaactatgaggatcaatcctatgaaacccccaaaggagattccgaaggtgtaccagttgaagaagctggactgctggcgggactcggaggggtcttcatggtcgaactggtctgctccgaggggcggcatacaagcacgcatgaagccatcgccaaaagcgctgatgtacagcgctgcgtaaagtaggacggcattcctgccatggacttctctgcagctgcttgcctctgcttccgcgttgcaaggcggtggacggagagagggaaggtaagcttgcagtgcgagcaaaccgtagccctgcatatatgattgccaataattcgttagatggttgaatagaccaagaagcagattaccagaaaaaaatgccaatttctttattattggtaggtttgcgcacagtaattggcaacggagaattaaacaaaaatagtttcctttgatcatattaggcttgatgtagatagttgagtaaaccaaaaagcgaattaccaaaaattccaatggaccaaagaggagtattgttctagctcgagttatgtaagagtctgagaggaaagctcctaacagagcaaacccagatgtggcaccaagaacattagtgactgtagttgaagagcttgagattcccatatgcattgttccatagagataggtaaccatattcagcatgtttgggacattgactgtgcttgtcaccacagtcagaactgtaagagatcgaaacatgtataaaatgcttcagcgatttaaagaaagaaaagaagcttgaaatggaaagagtaactcgtcacatgtctgcatattactagtaactagacaaaatcacataattcaggaaacatggataaagcaagtcaactggcaatcacttacaatatacaaaccatgctgctctgactcctccatgcacctttctattaataggatttcccctccagtccaaaaagcctccgactgccatggtttttctgatgagttcaaatatttctgatgagttcaaatatttctctcttgattactgcctggccattgcagcataagggggtataaatcatagtagatagacagttgaagtcagggactcaggacccaggggtattgatcacagatggataagtcaaatttgaagaagtcagaaaaacaaaatgacaaaaaaatattcttgaatagtatagccgtcacctaccacttgcaagcaccaacagtccaacactaaagttgactatcagattcagagttcctactccctactaaccaaaatatggaggtgtatcctgacaatttttttaagcaatctgtcactggcatgcattgacactgatgtacaaatatcttagataaaatgcatgtcttcaagtccaagccatcattctggactatcttgaaactaagctcttaatttattaattggtctgagaagtcgtctttaaagacgcttcctatgagaatcattgctgctcaaattatgagcacgaaatgcttatgcatgagttacataataaactctaccaattaggttaacctactattactcttgattatcagtccaaaactcaggtttgtaacttacagttgatttcctccatattaaccatcatggaacaacccaattgtggtctttaccttttaatctaagcatccactactctacaatgcgtcttcaaggagatggcatcagctcgaacaggatacgcatatgaaaagtataaacaagagaaattaaaacctaaaaccctaaaaattattggttaaaaaagataaccaaaacatatttgctactcccattattcccttttacttgacactgtttacaagtttgattttatctttgaccaataaaaacttttaagttatgatgttttgatgaatgcaagtagttaattatatttaacatgcaaagtactttgataatataatatctccttaaatatttttaaatattttttataaaaaagacgaatggtcaaagtttgtacatgaatagtatctagtgtcaagtgaaagggagcatagggagtagctattatttttaatcatgggccgatgcaattaatacagattgtctgaaatgcacatcagtagcaaaaagaaaaggtttcaaattcaaccacacccttaaccatactagatagagaggtcatggtggctaaaacaatgatttacttgtccattggcagctgaatgggtgattgtccaaaagcaattaaatttcatcaagctgaacttcgagcatgcaacacatatacagagaaaatcaacttctttgtattgttgattggtttcaatttgaaagaaacaaatataattttctgctaaggtttgtggtgtcctgctgacatccttgtttcattggaaggcattcattgagcacaatgttttcaacttttcattcttagtataaaattacatatttttattatgacatgacataattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 42231 - DNA, 842 bp, Oryza sativa
atctattgctacatatggcctgcaaccatctcgaaaaccatctatgcaaggttttagtgtaaagaatagtcttctgaatctcaacttattcagcactgtgtggtgatcaattacaacaaggcttccagggcattctctttcaattattgccttgtaactgtacaatttgtcaaaactgtcctcccatttaccatacaacttttcaagagccaattccttcccagcatataccctcttgtagttaatcagaactttgtgagtttcaaggatccttctttgcaattcttttgctcccacggttgcatcctctaacaaccaatccttaaccttttcacatatccaagccttacttgcaggtttaatcttttcacttcttcttgcacttgaacaagagtgaggcacactattggtcttcacctgtcaaaacaacaaaggaacaaaaacattgtttcattagcaactgcaaaactatgaaacctgttgaaaaaacaatagaaattaagttataacctgcattgtaacaccgtcttgcatagttgaggcatgaattctccacccacatccctcagcagcacacttggcaatgaacctccctgggtcagtcttaacaatgttatactcgaattcatgtttaatagcatgctgagctattgccaatctgaattgcacaatgttttcatacacactattttctgtcatcggtggatcattactatcatatgccacctctggatctttaacaggaatagcatcttcgcccacccactcctcctccccttcctcctcctcctccccctcctccacccactcctcatccccttcctcctcctcccccttctcct

SEQ ID NO: 42232 - DNA, 3714 bp, Oryza sativa
tctcccgtgtgtacatagcgcgcgcgacgcggagcggaggtgggtgtgggtgcagtggctagctgctgatgctttggttcggggagacgcatgtttctctcctccgtgcgatcaccggcgccgcgcgctagcttgaataatgaacggatggtatgtgctcgtctcatgaacggggtggacatctagccatttatcgcatataaaataaaagggtaatttggaaccataccattataattttgcaaagtttaagatatgtcatcggtatctcaatgacaagtaggacccatatgagtcgatgacatgtgggtcaggatggcatatatcaaattttgtaaaattataataacacggtttcaattttccatggttaatgaaaattgaagataaaatagtatgtaatatatgactccacaagtattcaagttcaaatttgatttatacaagttgtaacgaaaacaacaaattaaaatctaattagtttacgtatattcacaattaattttgttgtttttgttaaaatttgtagatgtcaaatttgaatttatatatttatgaagtgatatatttcatattaatatatcttgtcttttttttgaattttttttcatagatatttagttgacatgcaataaataggtaaacgtccacccgggtgattaaaatccctctctgacgttacctagctagctataacactatctatatactctctccaaccaaaagtttaagacttattttattttctatttttttcaaatgaattaggcatatttatagcctccaatgctaaattaaattattgatcgaaattcaagtacctatcttaatatttactgttgcgtgtctttggtcttcgttatatgcaagctaagtgagctatttcttttcttgattttggtgatagaaaaataagtcttagatttttggatggagggattatgacacagtggcatcggcttgcataattgcagtcgcataggttggccctgtccaactaggtcacagggttagcgttcatcgtcgtaggtcggagatggattagaaaacgatataagtagccggtaagaatgattcctagtagcatgcactctgcgtgcatcatagaaattccatgcatgtgagggggtgtttagatcaggggtgtaaagttttggcatgtcgcatcgggtattatatagagtgtcgtatgagggtgttcggacactaataaaaaactaattacagaattcgtcagtaaaccgcgagacgaatttattaagcctaattaatccgttattagcaaatgtttactgcagcatcacattgtcaaatcatgaagcaattaggcttaaaagattcgtcttgcaaattagtcacaatttgtgcaattaattattttttagcctatatttaatacatcatgcaggtgttcaaatgtttgatgtgacaggatgaaaaattttgaggtgggatctaaacaggacctgagacgcatatatagtctttttggtgagtttaaagtaagatttttttcacataaaacgagagaaagtttattagtatataattaattaaaatttaataattacaaactttaaaaataatttgtttgattttagtgaaacattttctatatagaatgtttttgaaaaaatcatatcagcagtttgaaatgtgtgctaatgaaaaatgcactggtggagaaaccatcattgatcggtcgacccaaatctacaatagtcccagtttcattaaaaaccgggactaaaaacgatttttagtcccggtttataagaacaacaggactagatgatttttagtcccggttggttccatgtcagaccgtgtcaggcgcctaggatctttagtcctggtttgtaacaccaaccgggactaaagatctaactttagtcccgattggtgttactaaccgggaataaaaatcaacacgtactatataatccctattacttatcctcttctctcgttcacgcaacaaactctgtctctttctttctttcttcctctctaactcctgccttatctctttcttccttcctctcttttttttttgatcgaacgagtgttaacagtgaaatttggtaagcccggagtagtcatcggcttagagtcagcatcggcttggaagtcctgagattagccgatgagagttgtcaagtcgtcagttgtcggattcttgctatattcggttaaggaaattgatctactaaaggaagcttatccagaagagaccgagttcaaagagaatgcggcatggtaagttatctattaattaggaatagtttgttagtttccttttatctctaggaaagtgtgtttagtgtcttataaggactttatctttttcttttatctttagaaaagtttctttcttgtccgacaaggacttgtatcaacccatgggtataaatatgtacacccggggtctatgtaatctatctccacgatcaatacaactcagcgcatcgccaccatctttcccgaggtttttacttatcttccggcgggatttgggcacctgacgcggggctgcattggttcagttcgatctccggcgaaagggtaagtcctacgttctgtcgggccctggtgaatctgtcatctacgtcggcatcgttcaaggctgcatcgcttcgatctcttggatcgctctggtttggttgattgatttgcctacctgatatctcaagtctatctctaattccattgtgtttagagacgcatcggtttagttgggactgtctcggttaggtccgatcttctgtcttagccgatatatctctacaattacaatgctgttctaaatagatttgttatatccatcacattagacagatctatcggctcatcgagtattagattatcatatacaatctcgtgctgcatcggttaggttcgacctactagattgtgttgataatataagtcttgctaagctaataggttcatgctaatattttatcggggtgctagccgataagttatcgggacgttgcatcggcttataaggattacatatatatacaagttggatttagccgatgacaacaaaggtttcactgtttaatctaatcttgtggatttcatgacattggacctccagccgatgtgtgctttaaccttcggatcagtgcttattctatcatatcaatgctagccgattggtttatactggattatattgttattttattacatcatcaacaaccgattgccattataccattatctacattggacatatagccgagttcttacaccctatcggcatcggctattatcggcatcggctagaatcactacatcggcttgtcagctgatcggctgttttgatctactatttgcatatcctgtcagttgcagaatcaaaccgactggcacgcccgcatctcatcaagatttggacatgcacaagatttggaccggcacggcgggccgtggggcggggcggcggcctgtgcgacggccggcgtggcggcgcggtggggcggcggccggcatggcggcgtgtagcgcccgttccgtcgtggcgcctagcgggaaaattatctcttaaaaaccctaattgcgaaatttgtttctttgcttgttgtctagtgtccgtgccatcttaagatctcaatccccgatctatcgtcgagtccaatcccgaatccaatccttccaaatcaaattcctccgcaaaagtctattttgcctcccccgggggtc

SEQ ID NO: 42233 - DNA, 5427 bp, Oryza sativa
cctttttccccttttcccccgccggcgtcatcctccctgtcgccgctttggccgcgaccgccgagcgcagctcgcgccttgaccgccctaagtcggttcccaaaccgacattgccgccccctttaaaccccagctccttcccctccaatctccctcgttttcgcctcctcgccatagctgccgcccccgtgctctgttcgccgtcgccgttcgttgttgcgcgtgtcgaaggagtcggcacgagcaaggacgcggaaggggacttcggccgcgccctctccttcctcttccccggcccgaggccggagagattactcccgcgccgtcggcctctcgtcacagcgcccctcctcatctcggtgatgcctccctccgttcttcctcctcgctccatctccccccctagctttcggtagtagctcgagtagactccccgtagttagccggcgccgccccgaccgttgtcgtcgctcgccgcgtgctcgccgctcgagctccgtagcacccacacgtcgccagcctcgctcggcgtagctccgtccaatccgacgctagcatcgagttcccgaaaccgcgtagatgctctcaccgccgggaatcgacccctcgtggcctcgccgccgtttccctcttccctccccgccggttgtcgccgccgcgattcaccgccgtcaagcttcctctggcaaatccgagccgttggctcgtctcccctcatcacgagcaaccgcccgatgtgctcgcttttgtccgtatcgccgtggttcgctccgccgctcgccgccgccgcccgccgtccattcgcggccgggtcgtcgtctacctcccgccggcccgcgtggcagccacgtaggcgccacgtcggcgccagctcagcctagaccgggtcgagccgaccccggtcagtccctccccatgcgcgcgttccaccgcgagccgtgaggctgcgcgtgggcccgccgcatccgcgtccaccgcgaaccgcgcgcgtgcaccgcgtccctcccccacccgcgcgcatgagccgcgtactccctccgcacggtgagccgagccgctgacaagcgggtcccacccgggaccgcgcatggtgagcccggtccaccggctctctctctcctccctcccgcgcgcgcgcgtcttgggccgctctgggccgccttcttgggccagccggcccgttaagctcggccgagccgccctttctctcgggccgcgccctagccgcccgagggaagtctatattccctccctctccccttttcttttctttttcttttccaaaaaaaaggatttaattaaatccttttcctttagaccaaaaatccaataatcttagaaattcaatatcttcccaaccgtaaatccgtttgactccgttcaaattccaaaatttctcaaatctcgagatctatctaatggcacgcttagaggtcattaatagggctttattttcgccatttgttgagttgtcccgttttgcgtatagtttccgagcccgaagacccgcagtgcgaggatttcgaggatcaagctccagatctcgagcaaggcaagccacctttgaacatcttgagcctatatttgaaatctaattatattgcttgcaaaatattatgcattgataggattgcacttaatctgttgttccgtctgcaaggcagattggcagacctacctaacttgttgcatttgatccttccattgttaattgctataccatgtccccttgtaaccatccagttgcgcctcgatattcgtgcaccctgtgccagtatcgacggtcgccttcaaacttaaaatctgagtaataacttgggtaaaactggagttttacaaaagacttggaaaacccgacacctgggtcggcgcttgcgaactaaatgaatttccaaaaccgcggaccgggaaacgtaccgggtgtacggtttcccgctctcgcacttaaggaccgattccttggaatttcatccaaacataagacaagtatgaccacatgggtggaatgggacacccctggctgagtaactagcttatcaggggagccttgatgccgagagacatgtggattcgccggggtggtgtcggggaggacccctgggcttcctagcacagtatggtctgggacctaacctgttgttggtctgggacccctctcgtcggcatatggtaaacctgtgtcggctttggaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagttttgtttgactactgcttgtgaaattgctgtgtgaaaaggggttcggtgtttgaaaaatctgcagctgatgggatgagctaggcccgggtggccgtttgaaaagttgttggcccgggtggccgttgaaaaagctgttggccgggtgccaaccttgtttaaattctaaagactgatacattacacatactccgaccggacgagacgcactgtctcatccgtgtcgtttgagaagcactcacttagttgtttcagaaaagagttcaaataaaattaattgcaaaaacaccagcctttccttgaagcctgcattaaacacttatttcccatggcttgctgagtactcccgtactcacccttgctctgtataaataattcccccccagttgctgaagaagatgaagcggatcctgctgatgaggagttcttccaggagcaagccggctacgatgagttttagggtttcggcctagttcccaagtcgcgcctgtgttgattggtccaagtcctggcttccgctttccttttgtaatgcagttgtgagctcgggatctgtccgcagcccaacatgactgtacatctactctataataaagagacctctgttgctgtgatattctgtctccctgtgataccagcactgtttcctgggactggtatcgattaacaggttaatttggagcgtcacgggctagttccggtcgggactagttcggggcgtgacacggcggcctgcgcggcggcgggcggcggtgcggagaggaggcgacagcgaccggccgagcggcgcctctgtggctttttttcttttttttttaaaatttgtgatttattgcatgattctgtgatctatttgatttgtgtgcgatgtgaacttgtgatgtatttgcgatgaattttgtagaacttgtgatgtaatttgatttgtgtattttttttaggatttgcgatgtatttgatttatgtgtataagtaacttaaagatttgtgatgtggatttgggatgttaatttgatttgggatttggggatatgcatgccacttaattcgggagaaaataaaaaagaaaaaaaagaaagatgaccatctgtactgctgttattccctctttagtctcggttggtagaccttatctttagttccggttggagttaccaaccgggactaaagatcgatcttttgtcccggttatttcacccgggactaaagatagcgatctttagtcccggattcgtagtcccggttgtccggggttacgaaccgggactaaaaagcatttctccaccagtgatggaaaagttaaagttcggagaactgggccaagcagcatatggaggcgtcgtcctcgaacgtcctaggatatgtgattggtacgccggaatcatggctcactgaaagatgcaaaccttaaattctaagccaagcaaatgaaagaaagcttgggccagagatcgaatattatttgtttgcactttgtagagaagaggggaggggggggggagtaagggaaaagggtacgagattgatcggagctgacggagacaagcatcagcatgcacgtaacctagcaaacgcatgcaaagaaaggaaatatatagattatgcgaattcagctgaaagaatcccttacgaaagttacccttgcgtgccatctgaaaaggcagatcaacaaagaacgacaccggctagtataatactatatccccttttctatgacggaatgcgcaaagattattattatatcatgatggcacagccgaacttcaaactgttttgctcttaattaggttgacgagaccttgaaagcgacgcaactggattaatagatccataagcagagattcgcaagctaccgacgtgtcacacaaaaagaaaataatttgtgtagctgccatcagctaatggcatcgacaccctaattttaacttgccagtattggagaatttgcagagttagatctttttggtatcagtgtcttaatttatctatttttgatcaatgtatcagtgttcttccaagttccgacgtagatcaagtggtcagcaccagcccttttcaatggtgacgtttgtttttttagaaaccttttcaatggcgaagtgattcgattccaacagttcgttatgattttggtagtactaggagtaatctcaataggtttttgggccaaatgggctgctcaagtcgtccatctgtggataacgggctgtgtttttggtagtactaggactatttcaatggaataggcaggcgggctggcccatccatctattgtattaaaccggtatggtcctaaaccgctaaaccggcatggatctaactaaactggggctaacatgtcagcgtctcctcggccccgaggccccaacggagataaagaaagacgcttcctccttttctttccagcttttgtggcgacactgcgcggtagaatagatgcctcacttcccgcgactccgcgagctccaagcagcctccaaccaccgacgcgaagcccgggcagctgccagtgccaggctgccagccacgccctcccagcatctcctgcctgcctggacgtaccggtgccaagagtgcactgcacacactgccacaccctccggcttggcatttacgttggccaatgcatcatggcatgcagtcatgcatgcaatgcacccctgatcaagcaaacgcctcgtccaattggcagggccaaaacaatgtacagtacgtgatactaatattctattctgcctcggcgtcgcccaagcaaagaaccgtcgtcctactggcctggctggcctggctgatgccgctcgcacgcctcgcacccccgcgcggcgcgcgcgccgctacaaaaacgtcgcccggccgcgcccgcacatgcacgcgtgcactcagagaacggcgccgcgcgcgcccggcctgcctctcctcgatctcgcggcgcgtgcgccaaaccatgcggcccccgttccggatccgcggggtgcgccgcatgtccgcggcgctggcggccgtgaacgtggcggtcgcggcggccagggcggcggccgagtgggtgggtgtgactgagcgctg

SEQ ID NO: 42234 - DNA, 32574 bp, Oryza sativa
atgaacgtcaagtactcacgtggtccacgaatatttaaggctagatctaaaaaagcgaattccgaaggacagcttcagaaggagaaaaaaaaaggaggagatttaaaccagttgtcacatgccagtcatcacatcagctcgcgcaccagaacaaacagcgggcggcggacgccgcgcgactcctctagtcgtctcgtccgcccccgaatccacctcccgcgaccgcgacccgaaagccttccccgtttctatttccgcggccgcctccaaccacccgcgaggccgcgaccctctccgctttccatggccgccgcggccgggtgagagagatgcctagaaagcccctcctccccatcctcgccacccgcgggcctcgtcccccgctcctcctcccccacattcgtcgcctcctcttccccctcctcccccgcggcagccgggcacccctccttgctgcggccgccgcctgcatcccgacggagggccgccgcggcagccgccatggcgggcgccggcgaccccgtggccgctgctgcggtggcggcggcgtcgtcgtcggctggcgcggccgccgcctccttccggctcgggatggtgcgggtggtctcgttcctcgtcgggggcctcaacgtggccgtgctgctgctcgggctctacctcatcgacggcgtgctcccaccggggtgcggcggggggctcgcgctcgccgcggcgcccgcgctggcggggatccgcgtgctcgccatgatcggcaccgcgcgcgcgcagcacgccacggcggatgccatcgcgaggcgccacctcgacgaggccgcagcgtcggtcgccgctgacgccgttgcgcgccacgagatcagggtgagaactcgagctccttgccggctagcttaggccactttagttgggtgatttgctcggcttaactctgacgtatcgtaaagtcgtgataaattgtgctttgatttcagttggttcaaccgttcaaggataaaccaacgcatttttttgtttgtttgtctaggtatggttacaatacgggattatttgagacacgatcaatctgaacaagtggacttgatttcaccatttatcagaattttgaggcgagttaatgcaaatgcgtgtaactgacgggagttgtcaatggtgctaagatacagcgtattaagcttagatgaactgcgaatacatcttattaagagcttttatctgatgcatatggctggaggacaatgtgcttatagccaaacactatgaagcgactcagtgttacactgtgaccgtgagcttgagcacctttttattagatcacagagacctgacatgagggtttagggttaagatttcgaattggaatctaatatcatatttgtggatttgaattgttttcctgccacttgttggcattctgcattgttcaaattgagttcattaactttgtaatcatatttaatctattgatataggtaatcataaactttttacaataaacaacacgcattaatatcattataaatctggagaatattgttgacgatatatcagtgaggatcatggattcatagttcttaactctctagcatagcattataaatctgtaatctggataccatcctttaagatgtatcagtgaggagggctcagaatattctttatgggtactgatgggatatttgaattctgccatagaagctagagtaggtgtaagaagagtagaatttctactgagcacttatttatcatactgctatttctgttttgttttgctcaacaggtgaggtataaacgctggttgtggtggactagattcggcatggcagtgggtgcaatgcaattggttggggcaatttatctcatgcttgtcattgtcagagatatttcaaatgaaagaagagccacttcctgtttctttggtatgtttgagtcagatgatcagatcctgtcatatatctgtagtgcatttcagctgtgaatggtgaacctttgttagatgaaatctttctgccaagtaaactttatacataaacattactggagccttctccccttagagtttccaaatgaaaaaaaaatatgggtaaaaagtgtcaataacttttgcctttacttaatatagtactaaattatgataggttttgatggcactagtattttatccactgcctacttgcttatgattttttgtcctgctccatcaattctgttcaataattggcctgccttgctcgcaatctaggacaggatgaagctgatcatgtctcgaaacgagcattaattgctttgtttcttattctttcctgggttgtggtcgttgtccaatgcttcacgggttctgatatattaaggtggaggtcgttctatgcaacacatgacatggcatggaaagctcattacagggaagtgttcgatcatggaattcgagaagctttatgctgcctagggcgtgcaaagtatctgtaggtcactacctattctttttatgctgagaaatatcactatttatttacctatatgagctagttgtcttacatactgatgcagaaccgtattggaagaggatgaggtttactctgtggcaagacttctgggtgatttggttgcatatcgtgcttctgggacaggacatttggaacttttagcaggtcagttttctgtttcattgctttcacattgaatatgttctgtgtcctatttggactttcaaaattaaatttgatgccaacacacatgatgacatgaatattctaaattttgtcacttaccttctaaagacgtgcacagctatgtaggtgtttaggttttcaataagcagtgagtaaattctactaggctcaattgtaccattcagaactccaacataaacttccgtttttgttaccacctacttgtagtcatatgtgtgcaatctgtccacctcctaaaaacatgacttatgtacaaaatctagagaggaatctatttagcacagaaaattggaggtgagtaaattgtaagacagtaatacagtgttcccgatgaaacccctctcattgcaaaaatctataatacatatattgtgaattcagatgtttaaatgaatatgtataagttacattcttcataggatatagatgggtttggtgcaatttacttgatagaccacggaaatttcaatattgcaaaaagagtacagagcttaaagtgctgctctgtttggagttaaattacatagcaccatgctttcatcttttctactttgagtagttgcctgctagcggttaggttaccatggatagttgactaaacaggaccagattctccgcatgggttgtattgccgtgtcactttatgacaaactattttatcagtataatgtagactgttatgagtgtacaagcatcacatatgatttttttatggaattccttgttattgtcactatattgagagcatactaaggatccatttttacggtgcatgttttagggcttgcactattacagaaaaatgaaaatttgcctcatttgcaaactgaccttacggaagcgccactgaaccttatgcaagaagctgctatccttcatccctttgctgaagcatgttacacggttggaaacactatctaactggaacaagtttaatacctcccttccttgtataattgcatttgacgtggtattatttcagggacctctccttgatgttgggagaaaccctattttgtttccatgtgcatgggtttacagacaaggtgttttaactccatggtcgcgcagaaggtatatctcctgaactctcttatacttctcagttgtgtgtttattgccaaatacccctatggttgatgatcctctttttggccagttcagctggagattttgttcggtaaaatgtgaagcaagctaaatttgatttttattttgcttaatcctccttgaactggaccaactgttacattgagataagtttgaacatcttatgctgttcttgccttatatgacatccacatattggtcttcatgcaggcgccctgcacttgatggtgacaactggtggcgagggcatgctgccgctttccttcgatttgttcacataccagctgcagcacttctacggggccgtgtttgccaggtaacacgagtttggataaaattggaatttataaactaaaattgcaatgatgaaaaatatatttcagccaattatgcaatcgttccaagtgacatttgtaacctgccacatgttaatgttactttagctcatagttgatatctactttatggatcccgcctgtacctaattatgtacatttcgacgttatttggtgaattggttaaagtaagccatcctttaggttgcagtaatgtacttcacataccttaagtagctgtgtcatgtgcggcacatgtatacatgccatgcttggtgacccaggcaaatgggcctgcataaatagaggttaagagataagcatccctatgttttagtcaatagaggcaaatcatgtattgaaggctctatcatgctttaccacctttgcagccctcgtgctcattctcctccctagccatgttattaccagttcactatctatggctcctggctggtgaggcctttgcccaacgcacacattgccacatttacctcatacatgccctctgggaatgcaacgaactgagagcctgagagtaatgtggatgaccaaatatgtttgccgtactgtgctgattttgttgttacattagacatgcttacagttgaagggaggcattgaaacccagccatacttgataaagagcatagcacggttggtttttcagtaaaatcattgaacttgatttgattctttttatgtatgcagagcaagagggaagctgcttactttgtcgtggtcctccatgacaaaaagacagttgttattggagttcgtggaactgaaacaccagaagatctcataaccgatggattatgcagagaatgtgcatttactatggaggatttggatggactagtaaagtaattccctcttgatagccatctcgtctattcttatctaatctttctactcttgtggtcaaaattagtctttttttttcctcacggactacttgctgcaagccatttgctgatagttaaataccaatggtcaaccctgtggtgctctgattagcattcacatgattagaagaacatgaacaatcacaaaatgatttaacctgaaatttcaaaattaattattctgatccttaaactcctgctcttctgaacttattatactaattttcttatttacttctacttgccagttttgattatttttgccatcatatgatcagttttctcaatggaacacgatgcaatgcaagttgttttgtaccgttcaattgcatattatagggtttattgtgttaatcaattggagtttatgtggtaaatatgattataatggcgaggttctattgaaggctcataggaaaatacatctgaaatatcaccatttgtcaaagtccacaacatgtacacccaagctttatgttactggtaatcaaatcagataatttgatcttagtgatggacgtaagttgtccagttgatctaccttacttaattgtctgttcacattccatttaatttggcagtccactttgtttacatcctcgaattgtttgtgaagtaaatggcctaggatgggtaaatgggtcagccaaaccagatactcttgcatccctatttgacctactttagtacagtgtatgagtgtataatatcttgaagtaaaactgatagaaggatgagaattaattagttcatgaggttgagggaccactttagaaactgtgcaacgttttcagggagcaaacctatatgctggccattttattgtgctatctactgtccacaatctgttttgttgacactgctaattcttcagatgtgaacagttacctgcaactacaagggagagagttatttctacctttccgcattatggacatggtggaattctagagtccgccagggagcttttcatgcaactcaacgactgcacaggaggtgctagtctagttactgtttgttgtctgatattgcaatatttgactgtttgcagcagaatatgtactctttgtttttaggaaactagtacctcatattagaagattagatgcaatgtgtgtgttaatattgttaatttaagtacaataaatgactatagtggctaatctgctcttctcttgtcacaatgccaacccagataattcgtcatccctaacagttggatttcttcctgcactggtgggggaaggcagtgaatgccatggatataaaattcgagttgttgggcattctttagggggttctgttgctacagttcttggaatgatggtaatgctggctgaatcttcaccttttatctttagcatagcatgttgttattaatcatattctttctgcagcctgacattacctttttctgatttccctattgaccaacatccttctgcaccgctataaaagtgggttactgtagtataggcattatatacgacaacataaagaacatctatgactatcccattaagcttgtctgaactacgggaacagcagagtcatctgtgtgtgtgtgttcgcgtgtgcgcatctgacgtattgcccaaaaggccaaaacttctcagtgaactttgtctggaccaggtcatcgtatgattgttgatttgtatttttgtttttgactttctttaattccctgcctataattcctaatgagtgttacttttgtttggagtgtatggtgtccatggttctccatagtttaactttgttctctcacagctttttggcaggtatccaaacgtgcatgtatatgcatacggaccactaccttgtgtggactttgtaatagctgaagcctgttcgcaatttgttacaacgtaagactaaactaagaatcaattacaaaattcatttatcaatggttttcaattcatggtgtgttgccctcttgacaatttattaacttctttgagtattcgtttcctcttcctttccagcattgtgtgcaatgatgagttttcttctcgcctttcaatcaactcaattctgaggctgcggtctgctgcaataagggctctttcagataactctccagctgatacagcaatgatacagaaacttgctcgcagaattttgaatgttaacaagtatcatgataatggtcctgatggtggcataatggaggactatagtgctaggcaccacacatttgaaggaaattattttatcttacccttttgttccttttggacaaatatagaagaactgatgactcgaatcaatcttctatgctgttcagaacctttttttaatctcatttgaattttcaacaagtttctttctgaattcattttcactattacagggagggcagtatctactgaacgacggtttcctcaccaggatgcaccttgtacttctgagccagacctcccaattttgcaaaatggcatcaatgggtataatgggtctaattcatccatagatgttatgagctctcagggtctacatactgattgtgatgcccagacaatttcccttcatgggctcgattctggttcagaacagcgtcacacatcttatagggatataccagttgagcctcctgaaatgtttcttccaggcctagttgttcatatagagcggcaaagaagaagcctcttccctctttggaaatgctggagcttgcagggaagtgaaccaccatataaagctttttttgcaaaaagggagaacttcactgatcttgccgttactccttcgatgtttacggatcacctaccatggaggtaagattcgaacagtatttaattataagaaatgcacacataatacagcatattttataggtactacctccatcccataatataaaaagttttagagttggacacagttattaaaaaaataggtagaattaaatggggagatgttatgattgattgagaagtagaagtagatgggaaaagtgaatggtggaagggttgtgattgtttgggtagagaatgttgatagagaagttgttatattttgggacaaattccgagtgctaaaagttgttatattttgggacggagggagtaccttgtatagtagccaatgtactgttgctagtaccttttccatggctatgttgctaagaatttgttggaccatatgacaacaaaacaacacacaaagaatgaatgaagaactgatggttagtccctattgtgttcttatgtttaatgtgcatctcagtcaagtatgcgtgtttgtctgtcatgtcaaatataattttgttgatttctcgtgtgaagtattcatactctgaataggaactccatttctagactggggttttcttgtaatgtcacgttgatttgagttagtaaccttttttgaaaaatgattcctttggagtgcggtagtaaccatttattttcaacagctgttgacaattcaatggtatgcctttgctagttggcttttggcaaactcgccttttatctgcgcacaagaaagttgcatgctcactcagttgccgttacatttgcattgatttatcctaaaaacctagagctattctaatgtactgttctttttaaattttaggtgtcactatgcaatgcagagagttctggaagcgcaaacggcagcaagttgtcctgattcaccggtagaacgtttggtctgaccaggagtccaggatagagttgttctcagtacagctgaaagcaaatagagagaatgtatatgaatgccactttaggagcaatgcagcttcactgaagactgaaggagcaaaattttcacatgctgccagcatatttctatggaaagcagttatgtctgtttacatgagatctctgtgacgacagctctacattccgctgagcttactgacagtcctagactggctaggcaggcaccggacgcatggatcaaaagaaatctgacgacttcatatacagcaaagcaacatcttatttctatctacctacctaccttggcaatgccttgtgcgtgtacattgatcatctagtgcaggcctacaccctgatagtagcggtttgttctcattctttattctgcagccattcctgcttgttcatatccattttttaatttgtgcaagttaacatgatgtacatattcacacgtgttagctagattgactgattgacaggtgaaaatttaaatgtgaatatttaacaccgagatcaactaagatggttacgacattttttttccactgtccagcattttcttatccaatactgcattcattcagagatgtaaaggtatacagtctgatgatgtttgttgattaatatatggcttgtgcgcaaacttattaggattttccaaccgtgtgcccctgtttattcaagcttatgtgcatttatttgttacctccacatgatgccaattgcctaaccctttaaatcctccaattttcctgctaattgccaatcgacaatcgcctaccttggcaatgccttgtgagtagtactttttttttttgtccttccagaacaatatccattctctcccttgcccttctaagctcatctttccgatccttacgaaaaagttcggatattcgttctgttaatagttcatgattgttgtggtaatcacagagtccaactggtttatggtgtggcgatctgtttggatcttatcacgcgcaccaacacgaattatgtaagataccaacggcacgatttttgtaaaacatttttatagatcaaattatcaactttataatatttaattcatttgtttgcacgatcaaataattgtcatataaactcagtttcattcatcatctatcgcgaaaaaaaaaaacactcacctttagcgtttctcgcttatcctatttgaatgattcgtgcacactgagacagttgcgagagtaaatggttgtttggttggttgccacactttgccacgccacactttagtgattccacagtttttacgcatgtgtttggtttgctgccgtaattgtgttatgccacactttcttaactttgagacccatatgttatgctctcaaatttagaactaagtataccacacttgtggtcaactatttctaagtcacacttgtgccaccataccacaactagcctaaacttagttatggcaaggttaggcatcaattaaacatccccttagtgccacatatacacagtgctgattcatggtactgcttgctttccatgtagctaccagcttggccacaatactgtcggttaggttgctaaatgaataccatctggtgctaaccataaaagctaatccggacacacgcattaatcctcttcacccaaacacgcacgcacacaattggttcaaacttgatagaagtggtggtcagtcatagagctaggacgacatcgtggccagacacagattagctttcgtctcccgttgcttgatgctgctacttacctggaacatggacgtgttgttaggcactaaatgcatcgttccaacgacagcggtgcaccaggacttagcggatcggaatcaggaacagtttggaacgacacttgggcattgatgatctgtagctggacgtacgctccagctacagtgtgcaactaagtactccctccggctccatattaattaacattttggataagattgagatcaaacttttataacttaaaccatcaataactttaaaaatatttagtttaaaggaactagaacaacatatatatatttgtcttttaaagtactataataaaagtaaacatgcatttatttattatatatattataatagaaaaataaggtaaaagatgtatcttgtagaccgtgttattgtccaaaacgtcaattaaaataaaaccgagggagtacacacagcatgtctcccccatttgcctgctgttacctcttatagcatgtatacatgtgtggagccggaaacgggccagcgtctagagatgctttatatctcaaaaatatttatcacatgctggtaggagttcaatgagtttaaggacctaactttagtcctcgagccccaagccggcaagccccaattgccatcaagtctcacccctgcttgtctatagttagttttttagtatcatattgaaatcgcgtagatggttcatgatatgaccatcctaagatttattgacttgatttcatatgtgcttcttccatttctaaatataatcatttataagatccaaatttatcccggattacaagacaaaaaaatctaagtatttttcaaccaatcaggtatttaggagaatctaatcaatttaaaaattcaaccaatgaggtgattgaaaagaaatcttccctcttaacctatttctttgtacagatatagtataaacatagacgctcacaacacgtgcacgctcactcttataaacatatatctatgagcgcattcgaaataatggatcaatataaattaagattaacgaagtcactacagacacctccaccaaaataactagtattgataactaaatcgaaataatttatctttggcttaaatagtagacattcttatatttagcgaggcaggaagtatccctaatttcttattagcacagagatgacaagttactatattagagaacgggatatagcatgtcctctctcatgaaaccaaacaagttgtttcaactcaaagtggaataggggtcggtggtccatacacccctgattcctccgaccaagcgggccatttccatcaaaaatctcaatggtgtactccgaagggcgtcgatcgatatatcactccgctcacgcagtcacgctgctcgcgtgccagaatccacagtgacgcgtagcgatccgcagcgacggacgctgccacgcgagagggggacggcacgacggaacgtacgcgcccctgtgcgcgcttgcgctttccaagagtcaatccgattatcgatcgtcgtgacgtcgtcaagccaaaatccacgaggagaggaccacccgctgcgatcgccgacgccgccaaccaaccaacgagccaaacatggctccccgaacccgctcaatcatcgtcgacctcggcggctggaaaaggagttagtacacgtagctccctgttgctctccaccgatcaatcgtgtaatcaacgcctccaaagtcgaagccgcgcgagcggctaatcaatggaaccgtgagccacacccgcccgcctcgcctcgcctcacctcactctccctcccgtgcgttcgctctctggctcgggaatcggttgaggcgcgcgcacacgggcacaccgctcggtcggtgtggttagcggttagccgaatcgcccgcgcgcgtcgcgtggggttgcaactcagcgtctcagcgtgagatcgatcctgcggtgcggtttggcggtttggcggtttggcctttgtcacccggggcgcgggccacacagttagttgtagcagtggtggtttggtggtgaccagtgtgcggatttcggtggagtctctttcgccgtcgccttttttcctcctgcgagatgggggcagggcaggttgcagtttatgggtgactttggagatgacaacgtgaactcaccggccaccgctacgtttgggcagtgcagatcgctgccctgctgacgggatgcggtgatatgctagggaggaaacctgccatggcctggctactttggccaagttgacctgctcacccatatggtgccttcaagaccacccatgcctcatatttctactcagaaattccacactgcaagatgcaaaatgccatttcagttttcgttcatttcaaggttgacatgaccatgtttaactttgggtgtgtttagtttacgctaaaattagaagtttgaatgaaattggaacgatgtaatggaaaagttaaaaatttatatgtgtaggaaagttttgatgtgataaaaatgatagaagtttgaaaaaaaaaagttcagaacaaaccacggctttacttgagtacaatcctgcatgtacaaaaacgggatcatcatgcgcctgatggccattgacaagtccttgtcattcatagagaggctgagttggccctgcatccaacttgagcatcaagggtcgctttccatctccacaattggtttccgatgtaagtataggatagccagtcaagaatgcagacgtctcttgtctcctccttttccaccctctctacttttgtaaatgtctagcatttgtcacgagctgatcatcttctcctccccagccaaaagattattttaagtcaagaaaaagatggatataagtattgtcgtagtacaattaagacatgtacaatgaaaaccactgatatatggtgtcaacgtgtcacataggataagatcacacaaaaaccactctagccacaatggagaccacaatcaattgtattttatgtttcagcccataagtatttgtgtatcggtccttgtgattttttactattgaactaactagaacttttataatttagaacctacaacaacgaaaaaaagtactacatatatgtacccctagcctccatacggtcccactgtcagcccctcccactttattttcccctttttttcaccatttctctgcccactggttattttgctcaacgcatccatcaccttgccactccattgcccacctccacccctctcctcctcagctctctgtccaacgctcacctcttccaccgccacactgctctccttttccacctccaacatatcccccatctcctttctccttctctctaggtgttggcgacagatttggccgagtttgccgaatccagcgccgcctctcctttctctagtcgagtttggcggatatggtcacgagttcgctagatctgatcatgagccccgcggctaccgtagcttgaggacagcgacgagtccggtggccacagtggctcaagtatggacaagcgcgcagagcggaggaactcgtcggcatggaagagctcgctagcgttagatctgatcttgtcaatgcgaacgagctcgttggcaattgacttagtccctgcctggtaggccctcctctcctctccttcaccatttctctttcttctcgtgaccaatcgcatcgcagggatttggactcccccaatgtgtgaccccaaccatgtcttcgagctaaggcgcgtggagaaaactataacctctataggtcacgttcggtaccgtgagaccacgctccaatcgggaggcttgatatcactcttcatggtgatgcattggacatgaccttatacatcttctatcactaaaaaaaagagagaaaaatatctccaaggctttcaagtgatttgtacctcctttgtaaagaatctcattggtttgtgggggagataaagctattgccaatgtgcgatcagtgcgtcaactgttgagtcataggtctggtttagttcccaactttttctttaaactttcaacttttccatcacatcaaaatttttctgcacacataaactttcaacttttttctttaaacttccaattttagcgtggaactaaacacacccatagaatggccactgttcaatttgcgggcacaacacaagcgcaatacgaaaaagaaatgcaaggaaaggagcgtacactgatagggcaaagcgaaactttagatcgccacttccggaggagtgtactgtgtacaatatcttgccgatcgatctagtaacaaaagttggcacttttccacttgtaattaccttttctattttacaatttatttttgttaggcacacgatccatcagtgctccatggaataatttgaccgagcagaaaagcaagtgagatgctcaatattgtaaaggccatcttgatcttgttatccagccacatgatagaaatgaagaacgtgaatatttttttgatcatgaggaatccatgatttccctcttgttgccgagggacgaacccaagtacatgagttaaataagaagcaaaccaactttgtgcactttttaaattttctcgtcaggaatatgcccctttttaaaatttgcttacgaggacaattaaaaatgcaatcacacactcagatcggatattctggcagacgagaagcactgaactgcttttggaccatctgatgatcacgcactgctattgtacagggcacgcatgtctttcagtgaatttaaaataaagagggataatgccagtggccgctgacctatttggaccatcaaactgatactccctccgtcccaatatattaaaacctaggaccggataaaacatgtctgtccagatttgtagtactaggaaatgtctcatccgatcctaggttttaatatattgggatggagggagtagtattttttttagcttgaattatatctcatcgcgctatctataaaagattagttatttctactcctcaacatgacaacatgcataacaagaaaaaaaaaagaacttttttagtctccatcgaacagagtcaccaacccacaacgaaatacagtatatatatgcgtaatcttgccctcatctctgacgtaaaacgagcaccacgtagtgcttccgacgcaaaagtctttctctcttattattttttctctctcaaaggattacttcattcgttctaaaataatattatatttacactctcttatttgttctaaaataatttgaattttaaacaatcgttttattgaagtttttaaaattaggagataaacacacaaaaactagataaagtaggaaataattatattagaatttggtaaaattgagggtactctactaatttttttattgatttatgtagaatggatgaaaaatgaatttattctgagaaagagtttgtagatttcagtgagacaaaaaaaattatcattggtctcgtttctttaaagatgggttaggggagcatttgtgtgagtttcagtggggttaatgcacttgtgtagtagtacgtgtctttgtgaaatcgaaaaagaaatttataaaggtatatagtataattcttttttttgagaccaaacacagagctttcattaattgttcataggagtacaatcaatagaaactaatccctctagccaatccgggatatcatcaaaccagaacatggagcgctcagcagaagacacaaggctcgaacaacagtgagccactgagttagcctccctaggcacccattctactttgaaatcaacaaaactcctagcaagctctgtgatgtcgaaacagatcccggcaatgcatgatttaaaaccttcactgtcctccagaataaccttcaactcagcacagttgacttcaagtatcacacgatcacagccgacttccatcgctagctctagagcttccttcgccgccaaagcttcagcagtcagggcatccgggacacgttccatccatcgagcggcagctgcctgtacaacaccagaatggtctcgtatcaccaccccactgctccctgttgacgtgagcttgtcaaaccccgcgtccgaattcaccttcacccagtatatatggtcctgtttagatcctccggactattaaatagctctttagaatcttgctatttaagagtattaaacgtagattactaagaaaactcattccataacccctaagctattttgtgagatgaatctaacgaggtatattaatctatgatttgctaccgtgatgctacagtaatcagccactaattatggattaatatagattattagattcgtctcgcaaaatagtctaggggttatggaatcggttttatcggtaatatacgtttaataatcctaaatagcaagattcttgggggctatttaatagcccggaggatccaaacaaggccatagtataattcgctctttcttgtttatatgctttttttttactaattttttcaagtgtagtactagtgctattaaaagcaaaagttatttccggaagagaaaagtcaggaaaaagtagcacacgcgtactgtcggtgcttaatttaccggcgtaattaaacaagaatggtacacgagaaaataccatatcgctgctctgggattgttctctgctagttcgtgcattttgctttaatttgcatgttcagacagatattttacggagaatgcaacgccggtattgctgaaatgtctcaaaatccattcgctttaaggcaaaggcctacaattccacaaacgacgtactgtcgtgccggccaccctgcacgtacaaagtactcaccaacaaaccccttgtttcaattcattcacctattataaacagtactccctccgtatttcgtattttaatgtattacgccgttgactttttgacaaacgtttgacctttcgtcttattcaaaaaatttatgtaattataatttattttattgtgacttgatttatcatcaaatgttctttaagcatgacataagtatttttatatttacataaaatttttgaataagacgagtggtcaaatgttggaaaaagtcaacggtgtcatacattaaaattaaaatatgaaggggtacaaattacatttttctttccgtcatgggtggtaatctaatttacgaattgatagtccttttacacttcttttactattgcaaaacttgtggatcagtggatgtgagtggatttaacgatgtgtatcctaactaggtagaaataaaaattatttttttgaaaggacggtaaaagctttgcctcatatattaatagaaaaagaataaaagaattacacaaagttacgtacgggacccgtcaaaagaaattagaaattatgagtgttctcaatagaataaaacgcattgttgattatattggcatcgtgctttagttaccaacagtgacgaattgagctaaccaattaaccttataagaaaaatgagtagtacacaaaggccgtagtaatgctgggacgtatgacatccaacttcgaactgtatccacattccacagtataaccagtcacccaatgcaacaagcgtggccaatttggcacctgtttcttctacttcttccgtttcataatgtaagactttctagcattacccatattcatattaatgttaatgaatctatatagatatatatgtttagattcattaacatcaatattaatgtgggaaatactaaaatgacttacattgtgaaacggagggagtagtctaaattgtgggttagtgaggcttaatccgcatcattggttcggtcaagctgttcctatcagatcataaatatatcaacaaatttttgcagctagccaacaagaaactgaacttatgggacatgtgcatttttctcccccatttttctgggagcactgttcagaacttaatggagttctttgctggaaaactttattagtccctcaaagggaacgcccgtttttacgtatcatctaaaaaatatttaaaagattagtatgatatattaatatgtgatatatcactttacaaaatacaatttcaaatttaacttgtacaaacagaaataaaaataatgaatttgactataaatataacacataatttatggttaaatttgttgctttctctaattgtataggtcgaattcaaacttatatgttgttggtgatatatcatatattaatctatcttaatattttttagaatttattatatgcacataaaccttcacgtgcacacaccgtacatgctaactaacaaatatcactaaaaattctataaaaattatatgaaaagttatagtacttttagtagtattacatctatatgtaaggttttatcttcaaatttatcatatatatagaacaaaaaaaaatttcaataggatatactcttaaaattgtcaaaaaaaattattttcttaccgttaaaatatagtgagttgaaagttaagactatatatatgtgtgtgtgtgtgtgtgtgtgtgtgtgtttttgcgggggaagggaacgctttattgattactcatcaatgtgattagaatcatttgccagagccccaaaaacacaagaaggagcctgcatacgccaaacagctgaatggttcgtacgcatggcaaatttagctaaatcatgggctactctattgcattcccttctaatcctctgcacacgaaaatcaggcaaagcttggagtaataacttaatactccggaggacatggcagagctgcgctcgatcaaatccagagctcgtaagcatagataccaagttggcacagtctgtctcaagaattaacggttttttcacccactcagctgcgagattcaccccttcccaacatgcagtcgcttccgcctcttccgctgatccacaatggctgataattctccaggaagtgagcagtactgagccagtgtggtcacgaatgacaaatccagcactagcaggttccgaactctgaatgaaggagccatccacatttactttaacccagcccatcggccggggggggggggggggtccatcccatagtcgtagtgtgattcctttcatggctgtccggaaaactgatccgagactgcatcacaggttttttgcctttatcgtctaccttcccttggcttgtactcataaacagggactcccaaaggctctggaggaataacaaactccctagtactgaagctttcccagaacaatgcacactatcattcctgagaaaccaggctctccataagagtaaaagaaattttgccctgctttcagcgtttattgagtccaggataatgagcagccagtccggtcctgaccgaatcaaaaaacgctcgtcagggagctcccaaacctcccggatcagcgatcgcagtgccgcggctttagtacaggatatgacagcatgaaaaccatcctcaccgccaaggccacaaatacggcaagttgagtcaatttccagttttcgcttttttcggttctccatagtggcaaggcattctctagctaatctccaagcaaaaatttttaccttctgtggaacaggagctgtccaaaggcttgcccatattttgcgttctccacttgtcgacgaactggacgaacccagttcattagccttcagttggttgtgcaaagctagatggtaggcactgcgaactgtgaatactccagtcttctcaaaatgccaagccaggaagtcctccattccacgatgtggcaatttaatctttaagatttcatttacatcaaggggagagcaaacatttttaattaggtcagcatcccaagagtttgtatcctgattgatcagctgatgaacccacctaagcctgcatcttccattctgtggcgacaatttgagggacgactggcgaggtatccactgatccttccaaatccgaactttcctcccatctccaatcctccatattaaccccttcttaagcagctccaaaccatgctcaacagctttccaagttggggaaacatctgccggaaacactgcatcaataagctcacagttggggtaatatttagccttcaggattcttgcacacagactgtcatgatactgaataagacgccatgcttgcctgctcaacaacgcttgattaaaaaggcgaaggtccctgaaacctaagcctcccatgtattttggtaaaattagattctcccaagaaatccaatgaacccttcgtttattttccacgtcaccccaccagaaattccttatcattaatatcacgagtatacctttttataatttttttttgatatttgttatttgttatgcacatgggcgtacatgaaaagcttgggcacacgtaatatgttatattttctctatttttttaaactttttatatagcatacctaaaacaaaagaatgtgtctcttaaggaacgaaaatcgatctcattctttgctatccatggatgttagaatttcccggaaggcaccgaagctgcaggctatggagaactggaagacgcgaataatgttgacgtaaagattcttaagcacattttatttttctactgaacagcaggtctgctgcctggtcagtttgggtacaaagtttgttgtgcaagaaacacatgaaaagtttaaataaaccttgtttggattttcaaccaatgataaggaaattttagttagaaaaatgagtgttcacacttcaaaccagtacgagtttattgctactaaagatgttgacgtagcttcacgtgtgctcacgattagctagagtctagaggagcaagctcacacgcaaaacaaatcggtgtgaatgacgcctttctcctttctagattttcctttttcataacattattttttcttctttgtagattcttttttacattattgttgatccattcttttacatgttataaaagtttagtggtattcttattattagctccgtgctctagttctagcgaattagaggctaaccaaacggttttggctctgattgctgaaatgctataacgtcactagtaaaaactgtgcgccaaaacctagcacatatgaagcaaacacattcagttttccaaaaaaaaagagagcaaatacattcatgtgatttattgcattgaaacatggatagctctataattacccgtcaggtgcaacccacacaaaacaattatagctatacctgtaaaaaaaaagaaaacacattcttccatcttttgaatgaacacttaggagtaacttagttaattctaacctccattacaaaatcgttataatcggatatcactgatacccttcaacttttaacacaatgattgtttcgcttatactcataataagccgtaacgactattcaacaaacaactaaatgtaattcgtaaacaaaatttttatatatgtgttcttagcaatttaaaaaataaatatcgaaaaataaagtaaacaacttaagtgcgatttataaaatttgaatccaatttaagctttaaaaattaaattttatgtgcgatttacaagctgaataaattttgggtgcagtaagctaatttaaacgggttcgacgaccgcccttctagagtgaaaagaatgtacggagcagtaaaagtttctgggcactgtagtcgtgcctctgaccaaacggcccttctagaagccgtacaaagaccaacaaaatccgcgcaagacgaggcccccaaccgcagtcccaggtagacctgacgaaatccacccgatttcccccaatttcctccccttttctattgcaaacatcacaaacccctgtactacttcgcatcgcaccagacgatgattccggtccacgcgacacagcgccctcaatggcctcaaaaccgtaacaccaccactaaaaaatccaagtaaaacgcggccattcaaaaattttctcaaccacaccgtgaccgtgcgcttctcgcctttcgccttcgcctccaaggaagccggcggccgcataaaatcccctcgaatcaaaccgcaaataatcccccccaatatctcacgctcccccctcccctgctttccctcgcgcaccgaccccactcggatcctctcctcccctcctcactgcctctctcccgtccacgagcggttggtcgatcgatcgatcgatcggcgcggtccttcgccagccatggcggcggcggcgatggcgccctcgcctccggagccggcgttgccgcgggagctcagcctgggggacctcagggcggtgtccatgctcggccggggcgccaagggcgtcgtgttccacgtcgtgcccgcggcggcgggggaggaggaggcctccatggcgctcaaggcggtctcgcgggaggcggcgcggcacaagaagaacgggagcggcggcgaggacgggcaccggcggatctggttcgagcgggacgtgctcatgtcgctgcgacacccgctgctcccctccctccgcggcgtcctcgccaccaacaccgtagtcgggttcgccatagaccgatgccgcggcggagacctcaactcgctccggtgccgccagactgagaagatgttatcacactccgtcatcaggtacgcttctcgcatcccccccgtttggccatcgcagattatccgccacccacccgcgcacgaatgggttaactaaccacctcgccgttgttgattgttgcttctgattgcagcttctacgccgcggagttggtgctggcgctcgactatctgcacagcctcggcatcgtgtaccgcgacctcaagccggagaacgtcctgatacaggacagcggccacatcatgctcgtcgacttcgacctctccacgaggctcccgacgccgccgccgccaccggaggagcaggacgcaacgattgctgattccatgccggagcctccgcccagttcaccgtccccgaaccgcgcgaagggcaagaggcaaccgggggcggcctcgtgcttcccgttctgttcggtcggcgccacgaagccggccgcgtcggcggactcgccgtcgccaacgtccacctcgcgcacggcctcggcgtcgtcctcgtcctcatcctcgacggccaccaccgcgtcgtcctccaccgccgctggcgtgcggtcgccagcgaagtcgaactcgttcgtgggcacggaggactacgtggcgccggagatcatcgccggcagcgggcacgacttctccgtggactggtggggcctgggcgtggtgctctacgagatgctctacggccgcacgccgttccgggggctgaacaggaaggagacgttctaccgcgtcctctccaagcagccggagctcgtcggcgagaagacgccgctgcgcgacctcatcgcccgcctcctggagaaggaccccgagaagcgcatcggcgcgcgcgggatcaaggcgcacccgttcttcaacggcgtcgactgggaccgcatcctccgcgtggcgcgcccgccgttcatcccgcccccgccggaggacgaggacgaggccggcgaggtgctcgacgtcgagaaggtcgtcaacgaggtgttcgcggccaatgacggcggggccgcagcgggtgtggtggagaagccttcgccggaggcaggtggaactctggccgtcggcgatggcgagcagaggagagatccgtccaaagaaggcgatttctccgtatttttctgagcgtatttattgagttcttttttagcgttctctctcttaaaaatggaaaattacatagctattttggttttttctatggactagaattattatgggggtctctattagtaatagacataattaagacaaagtacggcgcggtggagtacataaatcgactttgctcttgtgtttaatggagtacagtctgtatagtatttttcccctttcccttttattttcttctttgttggatacatttccccgtgcaacgatgcaagctaggggattactgaagagtgtacataaggaatgatgaacagcaaaattggcctaatgttgtgtccatccatgtgttccatttcgctttgggtagccattgatgttaatacctgttacttcctttcagtgggagtaatagaaatggtcacggttttgtacatttttctgcaacattctctcaaagtagtaaatgctttgaagtgcccttgcgccatcaatgaggtacctatgcaaacagaaaacataatccatggctggaaatgaggtactggggtcgcttgattgatggttaactttgttaaacccagataaggtgtgacttactgacttgtcacaagaagtatggatagccacccttacacaagcttaagagaaaaagaaaaggtgtatttaacacgtgggtcacatgaaaaatatggttagccatacgttaactcaaacaactgattaagaaagtgtaccatgtctaaagtttggtttggcaagttaaggcttatactcactatctttaaaaggtcaaggtttataccgttctatatcgacgtggttctggcaaaaaaaaaggtttatataaactcttttttactcctgcaaaatgcaccgtagtaaaatccctctgggacaccatagctgtgctccatgtggctgacaaatgcgtttgagctgcccacgcagtgaaagttttccgggactcagggagggtgcccacttggccaaccaccgtccctctctccattggcacgccgagagaggagccctcggattcactcatcagcacccactccactggtcgctgctccagtaccaaatgcgtgatggtaccaagcttgaatgcattctcaatttctcatcaggcttccataaactgacatcgtactggggatcccaagtgttttggggcagtagtaaagtggtgactgcgcggccgcacatgcgcggatgcccgcgcggttggtggcgtcgtaaattttggctcctccaccaccgttcgctcgatcaccgcctgcgctgcagcttccgcgcgtgaaacatcgcccggccaccggggcggcgtgagcggctgaaatggggatcgacctgctacacaatgcagcttgtccgagattgacggggttagttgttcgcttgtgtgtgtgtgtgtgtgtgggggggggggggggggttagcagcgttagcatctgtggaagttgttggtgcctttggtgtggtggtggcctggtagggtggtggagatcgatgtggaatcgaatacgtactcggttccgacgccaccaactattctttctttgcccgcagcaccgattccaatggcgtttttggattggattggatgcatccgcctgcgtgtggacgagattaccgtgccatgtttgcttttgtcgttctcgtgtcgtgtgtgctacctgaattgccggggccgatttattcgctgttttgagcccggggatgcggggaacgtacgtgcgtgcgtgctttagctccaaatcatctatagttaatataatagttaattcatacaatagttgcttactatactattaatatttagtcccacttgtcatacacacattatattttggagcccgtgctgcagctggctacagttctgtagcccactgctcttctctctcttcctttatctttttaaaatatgtttatagctggcttatatagcctgctattgtacctgctcttattacggattacggtgatgcttatgctgtgatccgcgggcaatactgaaaagagtgcacggcaacatccggctatatatcctcttgtgggaggggcgacggccaagcctccgggcaaatccttgcgtgtaggcccggtcttcacctggtaattgctgtggattattatttttttgttgtgttacaacttacaagcatgtgatcttgtgcgaaagttgatgattttgccacagaagcttaccacattgcttgtattactgctctaggacaatgacacattgtttcttttgggtaaatgttacatggaccatgatgtcaaataataattggacctcaatttacgcatatgtggttcagaaatgaaaataatctggaatttcctagccagatcacctgctgtttatttttttatttctaccattatttattctgatatagtaatgtctgtaaatggaaacggaaatagtggagagtttattctatttccgtgatatactgttttcacccaaatattcgaaaaaaaggctatatcaatacgcataataatgaaatgaacattaagtttaatccttgtatattgtcagtgttgatgctagaacattgtcatgaagtacttaaattattatacttttttactttgaatcatctctgatagttacatatattgatacaaatttataataccataacgagactatttgactgacaatattatggtttagcatatctggtgttcggttccaatagtacaactatcacgggagtggattctaatccctcgaggggatatcccctaatatacctttttctttcaaattcgatgcaaatagttgtgaaaaaatctaaaaaaaaattgacaatatagagtataatgatacctactagtccaccaaaattcatgttcaaattcgatctacacatcgagaaacaaaaaaagacaaatttagatataaacagtacgctaatattcatacgctgaatttgtcttttttatatctcgacgtgtgagttgagtttggacttaagattttgtgaagttgtatatatgtgttgtatgaatgttgtcaaatttttccagaatttttcataaccgtttagatagtttttgagcaaacgagggaacatcccctcgagggattagaatagttttccaactatcacttccttttattactctacaccggttccggttctaagtactctataagtagaggatcacatccaaatttccattccatcttccaagggaaaaaatacatcctatccagcggcggacccagaaaaattacagtgggtgtatccattctaacgatcgctccactatatatattttttaaaagaaaacatctaattctgatggaagaattttggccccattgtttctcttcatttagtcctttcctcttccctgatttgatttctttacgattacaagatctccagacaaaccatgataattttctgataagattctatttttatatcctttgattgcatactacgtctagtgttttttcaaaaaaaattgcatatgccagtgccaacctggcacaccccgtaggtccgcccctgatcctatctgatatgatatataaaaatcagaacttattttttgagcgaatagaatgatactcttactaggctactatggctcatggactatacggagggagtaccagcaagcatagtacactgcacggttgtttcttcaatcctttaagcagcaggacatgcatgtaagcccatcacactgttgcagagtcgcaatgctgcaagcctgcaacggagacgggcctacaactccacgcgacgtagtaccacgaacggtatccaccaaacaccggacggatcgatctctctactccggtactactccctggtccctaccaacgttcgcaacagacgtttcgtcggttcgcatcgcgcacggcggccggtgaatctaatgggctcgttttcgtcggctactcgactccgtccccgtgacagaaaaattcccctactccactccgtgacatccgcgtgaaagccatcgcgcgacgggccgacggccggccggccggccgatgtgttgtcacctgccgcgcgcgccatctctagcggcgcacgctccaagcaccgatcgtgactttgtgagcctcccaagaaaaaaagaacgtacaaggtcgtgtgtgagcttaatttcgtcccgttgtttttgcgcgcgggcgtgggggaccggccgacccgacccgagcggcgggcggcggttctttcctcctcgggaagtagtagtacctttttttttttttaatgtccgggtgggtataaaggttgtgtttagttcagcgtaaagtttaaatttggattaaaattagagatgatgtgactgaaaagtcatgtgtgtatggcaggttgatataataaaaagacttaagcttggatccaaactttagatctaaacacagccaaatttaaaacagcgtatcacgaaatcaatgattcagacaggatgctaatcatcccacacgtagtagtcacgtacgtactcctactggtaaagactgaccaatatgatttgttgctgaaagttcaaccgctagctataggtggggagggaaacggcaaaccagaaaacgagtgcgtgcagtttccctgatactgtaactagcacaatcgtcacgtgaactcgaaatcctattttctcgtcattctttgaaccattcaacacctgaagaaccgaagaataactaatcaatcatctctaccagcagcatgagtttgttttttcttgttcgcctaggagaagtaatttccttgcactgcgcgcaagcttgttaattgcttggtggccaaggcgatagagggagatcaaacctacaagtccatgatgtatgcggaagtgttccttcatggaatattcgggatagaaaattttattaacgcaggtcaaactacggttacgcgaattgaatagcgccgcaacttctagaagggtaggcaatataactactgatccagtacagcatgtcgtacgtactgacgatagcaactgaccaaattaaccgtatatgaaggtactctccgtataaattaaccgtatctagagtatatagcatttcgtatatatacaacggtagaaattgattgtgcctaagtatataactgtagctgtacgataactgcacatgttttgaaaaaaaaaagtaaaataaaagagtgtatgggaatctgtctatgatagcccaagctccaatagcgagtagcagataaatccttttagttgattcggccagggaatagatgtacagacgcaagttatggtcgcgtgagacaaagagaggcaagcagtttatacatgtccgagtccactcaaaacgtaatatcctattcatgttatgtttttctctcgatctccttttatgactctcttacagggtatgaaactttttctcgctagagctattgaagttcgatcccctcatctgtcgccttggtcatgcccttatagttgacttcgctgggaataccgtagtgttcgtcacttacaaatgggacacccgaagaaattagacctgtgaagtcttatcacatgcttacaaatagtgcccgcaatgaatctctctagctcccacctgagctcccttggtggagctagcattgagtgtgacagggtcgtcccgggcacctcctcctcatgtcgatgcgtggcctagctagggtaggtgactaggacgctggtgacgcttggtggattcacttgcctgctacagtgtgctggacgcaccgtgtcttctcgggcccggccaagcgacgtgacaatcaatcccatttcttgacagcccatgccccggtaattcaggagtgttgatggcttgtttcacgggcattatgcgtagtcttgtcatccaccccacgtatagctgccggattcgtatcctttgcattaaatacgagatcaaccgtgcgacgtgagggaatgacggttcaagtctaattgcaattatggtatgccagaggccctgagcagtcaacagaagaccgagcttggggccttttttgggcttacacccgatcttagggcgcagcctacaaaattaagagactgaactcttagtcccgcttgtgactagcgggatgcagccccacgtggcctgttttggagatctttagagccctgagcagttggaggtgggaacccgggctcccacttctccaatagtatcctacccacacaacctttaaatgcatttttatgcacaacgaactagcaaatatcaccgaaaattaaaaggaaaacttgtgtacgtacttctaatagtattaaacacctatgtgtgaagtcccatgttcaaattcaactacagaaatagcaaaacgaaaaatccgatgaaattatgcccttacgaattgaatgacatatttttatgtttttatggctaaaaaaatactccataatgaatattgaattgcagattattactttaatcatccggtggcttcgcatctgggctatcctccataaaccgggtcttcgggatactattgtagtggtatcgcgatgttggaccaggtggcacaagagttttttttttactcaagagtatggttggcgatctagtctacggattgatagccactaatatttctgttttgtcataggggtcttcgtaggtctttctttgtgtgtggctatatgcatcttatgcagaggccgggagcgggcttaattgaaatgtattatcttggtgtatttgactgagttttaataaagtttccataataaaaaaaaatgaagacaaaacttttgacatacgtataatgcgaaatcttttgcctcttactatggccctgtttagatccactggcaaaaattttcactctgtcacattgaatgtttaaacacatgcatgaagtattaaatataaacgaaaaaataactaattacatagattacgtgtaaattgtgagacgaatcttttaagtctaattgctccataatttgataatatgatgttacaataaatatttgctaatgatggattaattaggcttaataaattcgtctcgtagtttacaggcgaaatctgtaatttgttttgttattagtccacgtttaatactttaaatatatatccgtatatctaatgtgacacgctaaaactttataccaatagataaacacccccgctgtgcctctatgaccggccgaatattatagttttgcctcctgaaaatgctttctttctctctcttttggcgcgtacgtgtgcaaaaacgctggatcgatcatggctgcctggctggggacgacgggatcgacgtcatcgcgtgtgtcacatacaccgccctgtcggcctgcccacaccgcacgtctctccatcgatatatatcgaaaaagccgtgtctaataagtcaacaaaggacgcatacgggagcgtttgtatgtagagttgtggtgtcacgttcggcatttgcacttagtacgtgtctaaagcctgcgctaaaatgcacgagctttctttgctttcttttgaacttttgttgcattatatttcaacgaagttacgagtaccttggtttctttgtcctagctactcgtagtacgttgtaaagataattagcatagtctctatttggagtacgtttttggaccattactacgctgaatgcctgcacaaatttctcgcaatttgacaagagtactctgtcgtcaattcaccgttaggatttggagggccacacatccttgtcgccctcagcctagattctgcccatacacaaacaagcaaactgtttaaggtcgatatcttgatgtgatctgactctgacgctgacgctgacccaatttcacacgaagaccaacctagctcaaatcaacggcaaggttgtgtttagatttaaagtttggatctaaacttcagtccttttctatcacatcaatctgtcatacacatacaatttttcagtcatatcatctttaatttcaattaaaattcaaactttgcactgaactaaatacagtccaagttggttcacagctgcacataaaatcaaatccccctttttaaaacaaggggaaaattcgggcgtgcctttcacactcgcgttttctagctactcgttggctaccgcagcataaaacgtttcgttggcctaaacctcgtgtcggtttctattttgcgagcataataattctgtcaatttgtattcaaattcggggagatagctactttaaacttgtaagcctccttaagaaagggagaagttttataggatttgagctagatcacgtgaaaatcatataaaatttcactgttcaaaaggagcggctatagtgataacttgcgtaagatcagcaatagagccacctgaacctgcctgggctccgccgctgccttttcctctatcgatagccgttgacacataaaaattagtctattatcgaaaaacgctattagttacccaggccatttgcttccccgttggctaggttgatgtctcccgtggcccttttgcttacctagcagagatataaacaactgcagtaaaaatgtctaatctagtatagaataacagagttgaactgagttttatatca

SEQ ID NO: 42235 - DNA, 877 bp, Oryza sativa
ccaattcatgcttgatgcgagacattaactcctcaaaggtaggcttcgcaaaaaacactaattgtctaactgtcattccctcaaattggcttccatgtgtactttcatctaccacacaaccaccataatgaagccggaccaatctatccatctacaatttttaacccatgcataaacattaattacttgaaaataatatgtaattaccattgcaataccaatacttcaaaagctaacaacatgtctaatttttccaataaataagtacattactcaaatactacacattattgataaaaaaaactctactcctacaaattacctacccttcaccacacatcaacccctttcaaaccctctcaatcaccacaaatccatcccacatcctaggccatcaccacacatccatctcccatcaaaccctagtgcatcaccaaacatccatcccaaatatattttgtcaaatgtatcaataacaaccaaatggataaagatatgccacctccacacttcatccccgcccatattatccatctaataatccatccttagccaactattatcaaaccacgtctacaaccaaaacaatgcaaaatatccaataaaactttggggaacttagggtttatagaggggtttaccttctcttccgatcccaaactcaatgccgcacaaatcaccttcgattagagaggtttttgggggagattgggcgaggagaacgcggtggcgaccgaaccctaggcgggcggctggggaaaaaacggaggaagaactggctggggcggcctcggccgggctctaagtagccaaggtcagcgccaacttacttggcgctgaggttgggcacctcagcgcccaagcggttggcgctgag

SEQ ID NO: 42236 - DNA, 12438 bp, Oryza sativa
tactctctctcgtcgtgtactcctgctgacatttttctttcttcttcggtctctttgttcttgacagttgacaccaacttcgtttgctactctgaatttagagcgttttgctcatcagcaaagttgaataatgcacaccaacacggtgcctgcatttctcaggtggaagtgtaacccgggccggttaattacaggtcgagtagtaaaatggcacccagttgccatgtgtgctgatctagctatacattactcctacgtgtctggctctacgtacgtacagctaggccattttgcctttgtcgtttccgatgggaaactacacgacctacttgcagttgtcaacttgtcaagtactccatacacgcacttgccggtgttcgacggcatggcgacggcaagggtgtatcgaggcgccccaaaaaaacaagcctcggagagctcgccctttgcccgatcgaaccaaatacttgtatagctgcattttatactgtactgatctctattatactcgtgcattgatgcgtagtaagctggagtgttaatgtagcatcaagtgccggccacttgtttagtaggagtaactaaattagtactccgtagtactctacgtggttagagatcacaatctgaggaggaacgtgcatgcaaatagtgtgagagctaggagacaagcgctggctgcgccgtaccggtaacccatctggtcgatccgtgcatggcgcaacttctttctttcttttttttttttttaccctttcgctttctctctgcttcttttccggtgaagattttctcggcctctcttcctgaccaagatcaacacatacaagtgtgctataccaacgagaggaaaaagaaaagaggaaacgaaaagaaaaggggaaaaaaataaagggagaaaggctgtcgagtgtctaggcaattcatcacgtatttcgatctggttggttgctctgtttccttggttttgtgtgaaatggaagagatgataggtcgccactcagcaatgcacacacactatggtagtagtactagtaactgccgagtacggagagtcagtagaaagtgaaaaaaggagtgcagattatgtgatggaacagaagggtgattttgtgcaggtttttttgcagcgtggcagaaactggcacgagtcaactcttgctaggggaaggatcataatcgtctgcttgcttgtgtccggagtcacgcagcattcaacgatcgattactgggtctccaattggaaggccgtgatttacgagaattgttcaagtgcttgcacggataaataaaaatagtattaacaatgtagtgatgaatggttagagcaaaaaagaaatgcataataggtgtggccaatgcatggattgcgtgctttagctactcaaatttttctgttaagtcaagtggtattcatgtgtattaggccaaaatccttagctagctagctcatgggtggatcgaatcatcatgagcatgactgcatccatgcattttgacatgttgcagcggctatcaggtagcatttacagtttgttaatctgccacgaccgcatagttgcattaggtgcacgatcgatagatacggtccgaatcttcgaggaagcaacgttgaaagggcaggcttaaggctgactgagaaatcggtccaattgttgggaaaatccagtgttttaagctgcaggtacttggcgtatcgttattatttatttattggatcctttccagccaagcataccaaatgctagcatgactatacttttctttcttctccatttttttaataaaaaaacatcataccctaacaatctcacattttctttcaagataccttgtactactgttgtatgaaatacatggagtatggtttttcaactggatgaaaatattggcagcgcatatatattggattgcaagcaggcaggattgataggactacacgtgcgaccaagagatgcatatgcacatttcagcgcactgtctagacaggagcaagaggggataacagtgagaaacctgtacaaggagtcgaggatgcttcagtccaaaaacaaccaaaccatgcatataccaacaaattgctcgcagatacatataacaagaactgctagtcctcgagcacatacccaattattatgtgtgcaacaaacagttcaaaggccttatctccttgtcattggcaagatggctaggtagctactactctctaggcaatagagcatcgatcctagctgccgttttctagggttttagctggggtgttgtgcattttttgggaggctacattacttgtagccatgtgccacaaggagcttggggctgaggatattcatgcacataatcacacatagtacatttttgggatatataggacggtgatgatgtgttcactaaccaattcaagtcatgtgtagcttgatattataactgataggcattgcttgtcctctccaactagccatgttcgaaatggttagccaccaagctcaactcctgtcgagacccgtttgttgctaggcaggcgctagcctctgagacctaagctgttcttggtcattgccattgagctaatcaaaatttgcctggataaataaaaacataggcttcgtacgcaagattacttttaagtacttctatgatgcttcgtgcttttgcttacaatatgtatcacaacagagaaggaaccatttggcacttgaccaaaacccaggccgaggacggcattgggtgagaatgagtatgaataagcttataaaagcagcatgtttatctttgtaatgtttaaatgtcaaacacaagcaggattttgtgattcaaggaaccaaaggaagtcgcaatgcaaactaaaatgcatagcttcagtttcagacaagcaacacaagtacaaaacacaccagaagcttcattctccccatggataaggtccatccattccagtccttcagacatggagaaaataaacaagggcaatgcctgcctttggctttcctatggagtagctcctttatggccagtgaccgccatgctcatacaatactaggaagggtgtgcccaaaaagaaaagtgcaacgaaggacataaagcctcaaggagtaccctactcatgtttgcttgtgccctaaagttcccaaggctaagcaaatgcccctccttttttttccttacaccaagctcaagcaaatatcatttcagacgacaaaatatttgccccaatgtctcctatcattcccactcatctctcactctctgtctcctccttttaggtggttgcactactgcaaaccttgtctcgaatgtgttctttttctgattgaactggtcggttgcactttgatatgaacatctctctcaaaaattagataaatgatgtacctattgtgcatatacatggaccaaaaccaagcttcaagcatcatataatcctgtgtggcccatggtaattatggagtactctagacttcaaaaaggacaccaaagataaaagagactacatcataataatgcacacagccagtggagcacgcatatcgtacaagtatatctttacctggattctccaaagacccagtgttgtttgcaagctgaactgaccttttcgacctttggttaattggggtgtcaaactgtggctacaagtggttatctatggcctaaagctagtagtgatatagtaatagtaacatgtagtatatgactagtactaataaagatgtatcatgacaaggaagacctctcttgcctatcccagatggattgatgagacaccaccaaagtcagtcagaaatggctattgatgtcaactggatgtagaagatgtatgttttacttcacaaacgacaatggcagggaaaaaattatacaatctggtcagtaaggcaaggatgagatgactactgttcagagggtatatgatagagtactacgtaaaagctatacaggaataataatgataaggggacgtctaagattgtgagataacaaaagtcttaagcctcaagcaatacgagaaattgtactgctaaaagaaccaacaggtcaaattgtacatgccatattctcggaaacattgagaaatttatttggttgtcaaaaaatagtacaagtcaagaatcactgttcaaaaaaacatgagcatctcaagcgaccataatgtcttttaggactatgttcccatctttacatgagtggatatactatagcaagagaaaaatatgaaactggaaatcatgtgaaccttttcaatttacataaagtgagcaaatttgtctgaaattgcttaaggtcagataccttaaatgctaattgtcctgatctgtgcaagattcaagataagagatcacaaggtcagcagccttgcttcctgaagctataacatttccaacagccaacccatccttgttatttcctacagatacagaaaaagcttcaattatttttttgaagttaatttcaaggtaaagtattacatgctgggattacagttcctggcttgctctaggaaactcatcattctcagcaaatcaaggagccccataagttgcatgagaaataccaaattgacttactagaaacagcaaattattcacgtactcaatcaacaggaatatgtttcaaatatctaagatttcttttgtacaataggggtgccttcattgacttgcctgcgtaaaagaaccctggaagattgttctccatttttgctatagcttccagtaccagatcataattctggccatataaaggaaaagcatttctccaatgtacatgcctgtgtaaaagaacatcatattgaattcgcaagtggtagtgcaaaaacctgaatgaatcctcaaaactccatagtgatggaaaaccataacacaagcacaacaagagaaaacatatagatactctaaaccatggcagtagtttcttatcacttacttcacaaaagtaggttgtccctcaacacccaagagctttcttaggtcagaggtcacaagttgtttcagaatagccctacataagtatatatatcagaaaaatctagcaagaaaagaaaaaacaaccaaaacataaatgatcataatatggaagtatacgttggagccccagcgaggtctctattatggctccccccaatgaaagatgtatatagatattgatcattaggagctcgatctggaaacatcatcgaggagaagagggtccctgtacaagacgacatgtatagattagaataaatagaaatcagagtaaataagacctgagaaaaagtagagcaatgtagcaaggttgatttgtatattgagttcaatacagctagcagggtgacctgcgcaattgcgcggtgcaccaaattatctaaatttttatatacgttattctctttaaattttattaaatagtcatcttgttgtaatagtattttagaaaatcgaaccttatcatcatggaaccctagtcaggcagtaagcgtgtagtccgcgagcaattacaaccaagtgctcaattggtctgatcaacagttcagatccatgttgaattagtactatctatttatgtatctggtatttgttcatactgagtccaaatatgatatatattcaatccatcaatctcaaccattaaaacttgcacttgccaaaatcatagggtgtaaatatttctctttccccaattaatgtgggaatttctagtctccacagcgaacatggtttcttctttcaaggctgttttaataatttttaattcgcaaatcaaaatataagcagctacaagctggataaaatataagtgtaaagctgaattaacctaccaagggttttgagaccatgcttttgctgttccttatagggtatcaaggcaccaaatccttccaatggttttttgacatcttccttcttaaaagctgttaccatgagagatagtggtagataatcgacctgcatataataaataaatatggattaagatttctatgcatacttgataattctaaggagcccagctaggagctgcatagtttcaagtttgagtacatcaaatagatatggattaagagtagacttctatgcatactcgataaattctaaggataccagctaggagctgcatagtttgagtatatcaagttagttaatcattatgacagaaatcaaagtccacctatctcataattctgtaatatggcagcatatgtaggctgtggcaggcaagcagctaacaataccagtttgctgttgtatttccaatcacgttccaaatgcacatatatctaaggaagaacacattcaaataataggggaactggtactacaaggcatcttaacatgtggaagacaatcccataaggtgcagaatatgggaaacaagaaaaggtgacgaaaggtatgtcttcacagcggagaagtaaccaagcaataataccattgttacaataattgtgtattcatgccagtaaaataaagtctggcatctccagcataaagttccatattcaattcagtacatgttcaacatataatgttacttgttttgattgggaatggaaaatttacttaaaaatcaccaggtgctgctatacaaatgactgttactttaatacactgttcaaaacagtggtgaaagtttcaaacaagtggcctttggaaacaatagtttccgttgccttctcaaataaaccatattgctgatgaactgctgatatgctcagattcaagggagtgatgattgactcctgtaaattcacaaactaagagacagtcttacatatataatagaaatctagaagataaacaaaatattttctgtgacatggatccatcgacctaatggatgaaattaaatgcaatttgaaggattaagaggaatttcccccagcacaaatttctcaagaacatgctagtgcaacactgcatttgttaaatctaaaagagtgattctaacctgaccttaggaagaaagtctagcacaaagggaactccaccttttgtaaacttcatcctctggacattagacaatggagcctaaaggggcaaaaagaaaaacacggtaaaatattttaatttgtggctgtcaaatgatcaagcttctaaagagatgaatacagataatttttttcttacagtcattataacagcatcgaaagattggttctttctgagatctttccctttagcatcttttgaatcaacagaaattgaccaaccaccagaagaagagactccatcacagcaacatgccaatgacaacacttctgtaccaagcttcacgttaccatctccaacttcattgtgaagtgcatctattagtgactgaaaagcaatgaacaacataaaacctttacacacccagatgttatgtagtataactgtgaaacttttcagcatgtttagcgtgcagggcaagtatcgcaactcccaattaataaagtatactacacgataatatttcccaaaatgtcatcttctgagattattcgctatcactaccattcacactatttagtggtgtctaaggctcttggtatgttttattcttatagcagatttggctcgtgtgatacttctgttgcatatcctgtacttatcagtagctttgagttttttgttcgatctagcttcaacctaacttatgcaacataataagctcatgtcaggctgataaaaaaaatgattatggcaggatcagggtgcagatggatggataagcttggctggatcataaatataaagcaggacatcaaatcaaaaaaaaaaaaaacaagacagttttctctggcctgtaagacttcttaaagcagcaatgaagtttcaccgactaaacatatgtcctagttgcaggaaaataacaggtcttcaattcacaacatatgaattcggcattttttagtggcatgtagaattgctcaaactaaagttcagggtttatcactgtctttgatatctttgacactgacaaaagaaactacaggacatctgtggagtacctgcattccaccatgaaatgaaaatgacacacgtttattccttcctttccctggcgaagcacctcctgtcttcactgaatcacccttagtggatagtttggacaagatggcaccagcaatgacagagccatacctgtgagcattgaaagtgcatggagcaacaaattatgaagaagatgaccaaagaacataactgggcactaatggcttgtttggcaacttgagggaaggggattgggagtttacacgagggaattgatggtgagattaagatgggaatttgatttttaatcccaatatcttgtttggcagaggtggtggaaattgacaggaagtttagttggagattaggtcattaatgaaaacggatggctgagatttgtttaggcaaagtaaaggaggaattccctcccaattaccaccccctacccaggtattgaaaaggagggagttccttcctcaattccccatctccatcccaccaaaattcccatctctcccaaccaaacaaaacagttaatagctccatccctctaaactcccaatccctcctaaaaactccctccaaccaaacggaccgtaaagaaatgttgttgaccatatttattgcaatagaagtgttgtagggtaaattaagtggaaacccaaagaagcaattatgcctattttgactctacaagctcatatagttaactatcatggcccatgaaggaaaaaaaattatatacttatgaataaatttagattctattctaggtccaatggtccacatgtaagaagcctttgaagcttgtatagttgcatgagtggtaccagaatttccttccatcgtttatcagataaatttaacttacaaattagatcatgttatgctccaacgaattgaacatatagcaattggacttatgttcaagatcttaaattcttgatacatatacccactgcattcaactgccatgattttttattttgacatcatgtttttttaatttcgattgccaaaaataagtattaatgataccatgactataaaatactaaaaatcataacattaacttcaagtaggtgcatatcaggttaacaaataataagcagtaaggactgagagcaccatctgtccaatgaaaaaatgatagaaaagaaataggtaacagcaggaaccaaaaacaagctaacagcaggagcccaaaaaagagatgcaagcaacaaggataaatgaaatcattaaaatgcactatgcagtaaattcacatggcggtgttgacatttgaatggacaggatatagcacgagcatatggacgtggacaagtgaattattgataaggtaaatcttgaatgaacatcaatgcacaaactacaaacttacttattctccaaacaaactactacaaacttacttattctccaaattccataatgctggaaatgcatgacgaatctgcacagaagaaaatattactcaaaaccagaacagttctacacaagaaggtgatatgttttgatcattatgaatgagaattgttatgacttactgatacggctcaaggagattagcccccaaaagttctagccgtatcagttatcatccccaagaacacatcacaaagtcaagcacatatgttgtttatacgcacaatttacataaaaataattatgactacaatttactgtagaaatgcaaaggtgctgatatggaaaatgcaaatagtgagacatgttataataacttactgataatgactcaggatctcctccgcttgttccagccacaaatggatcaataagataatcaacaacctgtaataaagttataaattcttaccctctactgattataatgggcatgtaagttgcaaagtgttgattgtattcacttaacaatccataaatttcttcattaaaaatgaacttgcctcttttccaaagtggcgttcaaagaaacttgcaacactgcaaaagagaaacctgattatctctacatatacacagaaaaatcacactgcaaatgtattctctctggtcagaaaacatgctgtttttgacatcaataaggtcttcaaagtgtagctttgaccactaaattctgttgcaacgtatatgaaaaaaatggtaaaatcataatattatgaaaatactttctcatgcgttcaatctaaatattgaactgattttatgtacaaagttttaaaagtttgacatgaaaaatgaccaaagggagtgtgtgatatgaagtatatatttgtatttcacaagggcatgagaatgaaggaagaacacaggaaaaaaacatataactatattatcagtggttcaagtttacaacaactcaaaataacatcagtatgaaggctcacctctcacttaaatgttcatcagacacttttcccgaggtccttctgctagatttctcatagagaaatggttccagaaatagcttgagctgcaaagataagaccatgttttactaaactcaatacagtaatataatatgacggttgcaatcagtcgatcacacagcttgaacacgaaagatcaggaaatgtacaaatttgtaatagtgaactgaaaacaagtaaatcaagtcacggtgatcagtttaatatgattgtttctacactagtgaattttaatccatcagtgacaagtggaaacaacaagcaacttgttgcaaataggtcaggaggtcatgatatgttgtagcaattagcactcaataacttacatacctttgattttgtagaaagaacagtgcttttcatgagcgcaatgggatctgagggaatcttatgtgacaaaaaaatatattcaaaagtgaggcatactataggaagaacaaaacaaaatgcatcatatcatgaaaagtctatttaccagtgttggtgctccatctttgacaatgtaacgcttgtgttgtgagttaggctaaaggatatcgaaatattaaacatatcagtgtaaattatgaaacagaagacattcaaagcagttaaccatcacagataacattagcacatacatactgctgtttgccttgtaggccaagatcgtcaataagcctgcttgcctccaattcactctctgtctggaggcaaaataattaaattacagagagaacggcaaattgaatcaagcaggcatgataagatttgcacgcaggtaaaaaaaatgcgactagtattgcacatgtgcccaagcaatgaaacaatcttaacctattttgtcagtggagtattaaaataatttatttattttactaagagtagtacaaagtaactaatatggtaagtataatagttatagatcatggtgaatgaaatcgaatcaggctatgataagttacataacggtgttcaatgatgctcatagcagaaagggttcacgtctgttgtgggatacgaatgcagaagaaaacacttctccatttgcaggaacaactgtctgcattagtgagcagcttgcatttcgttcacaaacacaagtttcctcagcctgcgcaccaaggagcactactcgctagtgtgctccagccctcaaatagccgcagcagcgccagtgcgccacaatccaaaacatacagaagcagcatttgcagcaatgcagaccaacacagcccgagattgtgatcaaacagaagcagcgaggcacaccaaagcgcgctcaccatggtgttggccccttcgtcccagatgaacccgccctcggagttggtccgtatcttcccacccgccctgtcggccgcctcgaacaccgtcacctgcacgccgcgcttcctcagcctgtacgccgccgcgagcccactgcagagaggcaaccatttcatcaatcatcaaaaaaaacaacctccccactcacacgcacacggcaccccaaacctagggcagaactgaacccacggagagcgcgcgcggctccccacccacctgacgccggcgccgacgacggcgacggacctcccgccgcgggggtcgtcggaggcggccatggcgcgcgcggggcggaaccgtgcggcgcgcgcggatgctgcgaccgcgaagcgggtgggagcgcgagcgtgggcgcgcgacggcgacgaggaggaggaggaggaggagaaggtggtggcaggagagagcatctgatttggggctcttggatagctatggatggggatttacttgttgtcttgtgcggggttcgtccttcggatcggagccggtggggaaggaaggaaggaagagaagtggactgggagtgggaggcgtggactagtcgccgaggaggcttgaggtcaaaacccacaggcttcgcacgcagttttgacctttttttttagtattgtactccacgggccaaggcccaactggtcagccagacttggcgtgcatacggcccacaatttggttcatgcgaatttccgctcaaataccagggtgcactgtttgtccgagagagaagattaaatactccctccggtttttaatagatgacg

SEQ ID NO: 42237 - DNA, 20892 bp, Oryza sativa
tttacataattataatttattttgttatgagttgttttatcacttatagtactttaagtgtgatttatatcttatacatttgcataaaatttttgaataagacgaatggtcaaacatgtgagaaaaagtcaatggcgtcatctattaaaaaacggaggtagtatataaaaaacgagataagtcattagcttataatttattagttaaatattaattatttaaaatttaaaaaatagattaatataatatttttaaagcaacatttccaaagatttttctttaaaaaaacagaaagtgtgcttggaacgaacgcacacgtacgcgactactcccgtctcgaaaaaaacgggagtagctatacaactgtcgacagtttttgggatgaaaaactttcaaatatgactactatgtaattacattgtaactactatataactactatataactaatatgtaactcaagtgtaactcaaaatagcccgatgggagaactggttaggtgaacaagcctccaagttggaggtgttgggtttgatccctactgcacgcgtgtgaattttttaagccgttttccctcactagcacaaatctcaaagcatattagacagcttaaaatttgaaagttttcacccctgaattttttaagctgttttccctcactagcacaaatctcaaagcatattagacagcttaaaatttgaaagttttcaccccctgttaactgtcgccagttgtatagcaaatccgaaaaaaaaagaaatcatgattatgtatttgaacataccctatgtttagtaaggatttggttttttttttttgacagatgaagtatgttccaaatagaattaggctaaaacgacctcaataaaatgggtttcctattcttttcttaaaaatctttaatttgggttttcttaaaaatctttaatttgggttacgtattatataattagatttatgacctgaattaatccttgttacacactttgatgatcgcacttaatccttgttaacacatcttggcttacattttggcaaaacacaataagcttaaaccctttttactaattttgccttagcacaaggttaataggtacagagagacggtcaatgcccgcataagtgagacgagtatggatatcgcggcaatgcgaaggagacgaaaacgagtgagtcaacccacacgggaagataacattgatattgcatttgccaaagttcacactagccgacgtggttctttcctctgtagtagatcagatcagcggatgccccatttcttgagcaacctagccagggccctcgtgaaccttctcaacttcgactttgaattgcgcagccgcgacatcttgtcgctgcctggctcgctgctttcttcttgttgctgctgctgctgctgctcgtgctgcgcggttgcctggctcaccacctcgtgcagctgcacccttggctgcagctgctcgacctcccgctgccgcttcccgcggaacagcaggagcagcctctgcgccttatccttcgtcttgcccgtgccgttggccgtcagggacaccagcgccgggatcacgccttcctggagcaccatctggctgccgccgtcatcgccgctgcagatgatccacaggcacgacacggccttctccttctcggcggggtccccgttctcgaggatgacgacgatggcgcccaccatgtccgagtcggccatgatctccttcttgccggcgcgggtcagcgccaagttgatcagcacggccagggccttctccgtcgtcggggaggacggcgtcaggacgtcgtggaggctctgcatgatgccggaggagatgagggtcgggatgtttgacgattgcagcgacaggttgtacagcgtcaggagagcgtcgaggcagcaggtcttgctcatccggaagccgtctccttgcaggcccttgatcaggagaggcgcggcctcgctctgcccgatgatcgcctgcgcctcggcgaggcaggaaatgttcaggtacattgcgacggcagcctcgtaggtttcaggcttctgtatcatctgctccatcaaggggaggactccacctgagagaagttgtttcttgttcctggaaaatcaaatgcagaggtggaaaatgtgagatgatggcaactaagatcaattaaatcatctacctatagagtgttactgcaagttgtacgtgtaataaactattgtaacaacatcgttagaaggaacaaagcatacgtgacattttacctatcattgctgacagcaaggttgaacagagccattgttccaaccacctggcactgaacatcatctctgcagactgccttcttcacaaagtggatgagtagctcggtaataccattagcacccgcgtatttcctaagctcgttgtcatccttcaaaaggaatctaatctgctcgatcacctcacgttgctcgtcgacacactcatcgtcgtccttgctcagcacacgcagccaaagctcacatgtcgcctctgctaccttctcggagttctcatgaggatgtttttctggtgaggcctgatcaacttcacatatctcagatggagcctctccggagttctgccgagtgcactcctccgaagcaactttaccaccatccttaatatcatcctccgcgcatgtgtcttcaaacaagaccgtgctaacgccattggtcacaagacatttgctactattcaaggatgatatcctcaggtacttgagcttgggagaatcaggcggcgccgatggaactagaaccccgttctgctcgcaccatgaagctatcaaacccttgatgcaatagttgggcgtcatggagagctgggataattcattccgagtctttgggcaggttgtgttgccgctgctaaaccatttctcaatgcaagcccgctcatatgtctgaccagatgcgataataacagggtcatgcatgagttgcaaggagatcgggcaccttagttcctcaggtggcaatggcatgctacctgataagcctttgatctgcctgagattgaaggagccaaccctagatatcgacttttcaataacatgaccatttccatggagatcaatcgagctggacaatgaacgggaagagcaagaagggcttgagcacatggatgtgttggtgaaatccgtcgtttcgctcctaaaaatgcttgagtatttcctcattaggtgcagtagataagatgcaactgattctttctttatgtcttcctctgcatgagccctctcaagaagccttctaagtgctcttctctcggtaagagctgttgccgatgacgcaacgccgacccgaaatgcagtttgtcggaaaaattcaagttcattgtcatgaagaaagccattggattttgcctcattctgaactaattgattcacatccacaccagcttgcttttcaatcagatccaaggtaaaaactgctttctccagatcttttgcgatatctagtatctgaaaatttcccaaataagtgtgaattagaggaaaaggttaaattaaatcatgcgattacaattagggtgaaagctgcaatacgtcaaactcattcattaatttagtaaactatataacactgataaagaaggatccttccgcaatattttataggtatctatttaagacagagccggcaaggacaaattcttgtataaccagtggcaacctgagaactggctgcttctggaagtgtttcttccaattggtgaagactttccagaagcgcatatcttgctttctcaaattttgccaggacattttctgctgtaaaggcctgcatgcagttaggatgtgtaagtatgaaattttgtatttctataataacaaataaatttggcagtacttgatatccatatacgatgaaacatatccaagtaccatcaattatatacagtagcacaaagacatgtatccatatttcacacatttttatttctcaaaactaggaaacataaatatgtttgcacttatgaaaactgcataccaagtatagcttgctgcactctgagcaatactgaagtagattcttggccttctcaacagctatgcgcaaggaactcaatgcaagaagtccagaactgtttccaggccttgtagcttcaaggacaggaataacatccaatacttcaagaactactttgtgaagttgcttacatagtgctccatgcagctgcacaaagaggtaggaacaaaccagcttaatctaccatcctaatactcacattattaataaatagaaatcattcctccccaaagagggggggggggggcaaaattatgatatcaaacagcggagctaaagaaaattaaaaagaaagaaagaaggtggatgagatctattatttatcacaatttaccaactaataattggtaactttatgagatcaaatatcttcatatataaaaaattatcatatatatatgatgcaactatgttatgatttcttctaactttttgttgaactagtggtagtattgtgatatttatacttttacaggaggcatttgcctttgcttttaaagggtgactatataatatgtacacaagtatcacaaaaactcaatagtattgttctgaaagttccctacattataaaatgatctcagatcaacataattaatcatattaacattgtagaacaattagcttttagtgaaatgaggtcaggtgaattaccttccaattacccgtaccaatgaagttcccatcgacctcgactttctccatggtgcctctcctagtcaaatttcatccgctgagaaataagagaagtcatagaatgaagaagttattagtcctagaagagaatagtttcggcacaagtatgtggcaagggcgatcatccacggttccgccggaaccaaccaaaaccagactaaaaaacctcaattaagctaaggattagcatagccaccagtcaattagtttgttggcttgctgcaaaattaatacaatcggtttgacctttttctttcaacccaagatgaacaacttcaagtatgtgctgcggaatcaagatagtgcattatgtgttcatgcatgaactgaagtaacccccattagaaataaagggtttaaatttctcaccgtgtgcaaaaactgatggtataatctattttcctatattgatgaaatttcacctgaaacatgcaaagtgcataagttacatatcttatcactataaaaaaaataaagatcatttaataaataaaaaaattacaatcctttatataataaattacattgatcatatagccagaaataaagcatattagcaacgaagcacaaatcaaatgatgaaaccttgacatgcaattcaaaacacacaccccaacagtaaatgaagaaccaaaagtccatgcactgctcttattggcagtttggcacatctagaaaaggagcaaatggagccaatagatagagttttaacctctagatgtgattgataaccttaacccaaaaagggggccaacacatagtaaagtgaagatggaataataactaaaagtgcaaattttatcattcgaacaactaaacatacgttaggacaactagtttccccctggaaaacatagctatagtaaatcaattgatcaagaatgaattttgtgcacattattttcttactaatgttgcgaccgcagggattattctgcatggcatggcataatcaaaccacatgttaaaggacatgtaaagtcacaaaaaaataaagaaaaaaagtatgccatgaaattcaactgaaccaacattttttcctttacatagctaagagacttggttatattgtttacaggatgatataccttgtattggtttacaggatgttgttagtaagttcatcgccggacatccctgacttgatacttatccacaaatccaagaccaaatatagtgatacttatcaattcgtgaattcaaaaactagaagggctcatttgcactgacttttggtggtgagggacgtcgagcggtgtttggttgtaccagatccaacggagggcaaacatacgtaccgtgatcaacgccccaagtgatgccatcctcaagctaaggtggcgggctgccattgccatggcaccatggacggcgaacagtgaaaatcgcaaacaaccaactgcccaaacccccaactttcgcgcggtcgctgagacaataagccatggcgaagccgtttgggggcctagattccagtggaggagaacaacggaaggggcatgggtgcagtgtgggctgcctctagagacagcgagtgaattggcattggcagaggggagagagtgggggctgggcgatacaattcaaaggcgtagggacttagatggaaattttcagaccgctaacaacattgctagcagtcctaaatgtttagttcacacaaaaattggaagtttagttgaaattggaacgatgtgacagaaaagttgaaagtttgtgtgtaggaatgttttaatgtgatggaaaagttgaaagtttgaagaattattttggaattaaacacggcgttaaatagggaccaaaatgcataatttggaaatgctaccactggcaaggagtcctaaaagggatcgctttggagatttatcaacccatcatcaggttggcggcggagggatttggcaggcggtggaggccgagcccggcgcttccggctggcggcggttggatccgctgtcctcgcggctggacctcgtcggacccttggcgacggcgacgggttctctccgcggtgcggcaccctcgccgttgcagctccatgtgaccacggagggcctcggctcagcatcctcatcgtcgcgcccccctccccctggtgccggcggtgtgggctgggcccggtgcccccagctggcggcgcctagcgatggcgggctccttcccccgttgtccccgtccccccccccacaggttgtccatgcgtgcagcgttgggtctgggacggcacacgtggagctacgagggccggcgacgtagctctaccctccagccgccgccggccggggttgtgcgtggaggggctggcttcggaagcccggacgtcctcctacgcgcgttttggctgccgacacgtccccttggttgcaacaaacctcttccccttctccctagtgccctcgatattgtgccttcttccctccccgctccaaacctgggcctattccattgttctttggtttgctggtgttattccccgttcaaaatcttctcattttcagcttgctcttgacaattggtccagatgtttgttctgggatttgtgctcctctagcaccttggctggcctctgctctgtgccctccgctgaggttgcggttgatgatctttcatcagtgaattcccccccttagccattttccttttgtctaactcctgctcatcttcacccccttccttgagaccgtccaagacctttcagcgtttctccctccttttaggcttccttcccttgaaggacgttggagtgtgttgatctaacaagcaactcgataaagtttgattgaagaaaactcattgtgggtggccttcggccacatctttcagtgccctccctcttctggggcttccttcccccagagggcgtcggcgggctttgatccaaacaacaataagatcaagttagcttcttgatgacttcatgcgggtggcctaggacttctacaacctttctttggcctttcttctattccggcatgcttgtggctgcgtgaggaaatggatgttgataagctagggtgttagctttaggttttggttttggccgggtaattttgtagatgtcgtttgtcaattgttatattttaggaggttttcctttctctgttctctcctctttgtattccccgtgtattctgttctcctatcctccagggcttctgcgtttctataggtgaagcctgccctgtgtaagctcatttggcttaatatattcaggtggggactcccccccctgccggtgatttagtcaaaaaaaaaatcatcaggttgggctgcgtgcttcccggtggcaacgcggcattgcggccgatatcgatccaagcccagatccactggccgttcaaggcctcatgctgaattgctgatgctaaacatgctggcaacgtgtaaactgaaataaattgaatactaacctactgtgaactgcttgaacaaaactagttgaattggaagatataaacagtatcgcttatgctgacgcaaaccaaatgagaatatgttttagaaaagggctgtagctgcatactctgtagaattctgttttgctgctattatggtggcctggctttcttttgcgtagcatggtgtaatcaacactaatgtttggacatatgtaatataaaatctcgcacaaaaaattcaaatactacatgaaggccaccggtgtcaaagaaggcagacgcagagagtcggaaggaaaagaaattaggcagagcaacatcagctagctaaaatgtcaacgtagaaaacaaatttgcaccgttcgcctaaaaagactctaactcaagaacagagattaaccataatgttactactgaataagctgaggaataatcatatatggcgggagatcgttcgtccgtactcgtacccgagggagacaaggcgacgaaggagcgagccttgaattcctccatggctcggtccgtagctcgtcctttcgcccccttgctcggtcgggaggaaggaaattgatttgttttgggagaggcacgaggggggcgggaggaggtggagataacacggggagaagaggaaaaacggtggcttaatttgtccagagccgccgaataatagcgtatggccatgccaaagcataggcttggcggttggcgtggcgctactattctcgtcgtcctcgtcgtcgtcgaacgcgggtcgggcaaatttagggcggcgagtgaatccgcgcgcgcgcgtggctcaaatgttggttcgttctttgccagatcgagctctggctggggtgatcgggccagcaatggagcagagcacggatggtgttttcctgtgagacatatggctgcgcttcggctgagtacagaaacggggtgcaggttttgctggcgattacggtgtctgttagtttgtggcctgattataaataccgtaatgctgcgaaaattaacgtatcagctggtttgcccgagtggttaagggggaagacttaagatcttctgcactgaagtgcgcgtgggttcgaaccccacagccagcaatatttaatttttttaaaaaaaatctcaaaatctgcatttttttaacaataatacaagtttgaaaagtagggttttgaactatttcaatttatttttctgattttctctcaaaaactgcaatattcgaacaatttcattactccaatagaaattttgttttctaaaatattttttgaagtccaatacaagtttgaaaagtagggttttgagctatttcaatttatttttctgattttatcaaaaactggattttatttttgaaatatttcgtagccccaatagaagtttagtttcttttaataatttctgcagtccaatacaagtctggaaaaaaactggatttttgaacaatattgggacccaacacaagtttatatttcaataatgaattttttggactccaatacaagtttattcattttttttcaaaaagaagtgtatctttgaataattttgggcctctaatacaagtttattgtcaaaaaatgggactccaatacaagtttatttctttaaaataaaatgtggacaattttgggaccttcatacgtctgtacaattttgggcaacattttttttttgggattctgaacaattttggaacagcaatacaagtttattttcaaaaaatgtataccaattttgggatctccatacatgtgtacggaagtatgttgaacaaaaaatttgaacattttttgggactgcaatacatgcgcgttctgaatcaatttacgctacgttctggattaaattcaaagagaaagcaatttcgggactccaatagcgctatgttatgttccggcaaatttcagttttttttcgtgaacacgcaaaagtattgcacgtcaatatattagaagaaaaagagttctagttactctacgcaatcagccagaccggctaatgctagggaaaggaagaaaaagcaaaagaaaaaaaaactgaagcttagagaaactatggtggctgaaaacagactccaagcagcgggaaggggccaagccacactagactcccaacaaatccccaaaagcgacgacgccagctaaagaccacatatgcccctccgaatggatgaactctagaaccactgagatcgaagagagagcggagtcgaaaaccctagaattccgctccttccacagacgccaagagaccaggaacactagggagtcgaagctgtcgtagaggtgctcaggtaagcaggccctgaaggacgaccaccagtcttggaaccagctgtcacggggggagagagggcagcccagccaggaggcgacaatactcgaagccagacctaccgagcgaacatgcagtcgaagaggatgtggttcgccgtgtcaagatcctgaacgcaaaaggggcagcccaagtgactatcgatgccacgcttctggatgagatcagccgtccagcagcgccgctggaatgcaaaccaaagaaagaacctgcatttggcaggaccctttgcatgccaaaaaagatcagcacaggcaaaggaatgctggccatagaagaatgcctggtatgccgaacgcgcagagtagcgctggtcagctgtccagcgccaaatgagacaatcctcgacacctggcgagagttgtacgtgaagcaccgcatcccaaataaggagaaaatgggagatgactgggatagtgagggcacctcgaatatcagagacccaggagttgttcgctagggcagaagcaactgtgcgtgaacctcaaaaacgttggggaacgacgaagaggagatctggagccaaggacgccaccgagcggccgtcgatccattggtcagatgagaagagcatagactcaccatttcccggcacaaagaaagtggatgccgcgaacatgtcggagacggtctgctagactggggcctttaggccatcctagtaggggtgccctgagcgctgaagccaaagccagcgaacacgtagggcaaaccctgccaacctgaggtcagtgatccccaactcaccaccggttttggagcgacaaacattcgtccaaaacacctgacactgcccaccatgggctgagtccgtacctgtccacaggaaggcgcgacgcttattgtcaatggccttaataacccagactgggaggccgatcgccatagattcatggactggaatggagaagagaaccgactggaccagcacagaacggccagccagagtggtaaatcgtcctttccaaggacccatgcatgttgctaccccggaccaacactgtaaattttctggataatgtctaatgatctgtatgaatcataacacatcactgaatcttgtctaatgttggccggagaataccctgaaaccagcaaccagattatttgctaaccgctgggtgaaccaatcactatttaccacagcaacaggacagctagaagcctaacatccagagcagcagagctccttgttaaaggaaggaacaattctagtctagtttcaattaattttacagctcaacaaaaggggttggtcacactgacaaaagaaaaaagactggactgatcgattcactggtaaaggtttgatcagacgacttcgacctttcgtttggaagagactgatgacctccattactttgctcttgtcacgctatatgctgcctgctatacctttaatttcctgtcgccaggcaaacatgttttgaggaccaaggagaaatgtcatcaaactagccagcactgcaatttgcttcacatcccattttagtcggctggtctgttccttgatgcttgcttgcagctgcaggtgcatttctccttgtcttccttcagagtctgcacacagggaaaaactcagtgttgtttccgggttgcgttgtgcttttatatatatatatatatatatatatatatatgttactccctcatatccgtcccaaaataaatcaacttttagctatgtctatgtttgtaatagaagttgatttattttgaaatggagggatacttgattactcatactgagctgctgttttacagtgcaatatattggtattccatctagctatatatattctgatgctaacgggggtctttgtaactggactggtacatcgacctatcaggcttctttaggcagcagtggcttcaattcagttttgccattctgaacatgcaaattagtaacacgcatacgtcattatacctgcagctggctctgcagtcccttgatgtgatcaactgctaagtccagcatgtctgaagtactcgtttgctgccacattaatttgtaagaagaacaaattagaaagatcatcaattgaactccaactcaataacctgaagattgttgtctgacgaaaaagttcagacaaggactggtatatacatgaaaagaacacacgtatggcacacaccttgtccatgttgggcaccagggcctgcaacttcctgagcttctcgctgatcctcgttcttctctcctgtcatcatcgatcgatcatatgcctgaagattaatctggcatgcacgatccaaggaggaacaacaagaatgctactggctagatgcatgcatatgaagaacatcttgaaaggttatcaatattcttatttggtaacatatcatgtgcacacaagtttcgcatgcaaattctatacacaccaacaaacaaatatcacaaaaaattctttaaaaaatacatattataatttcaaaaatgctacacctttgtgtaaaatcttaacctcaaatttgttatatcataggtgtaacaatttttttatagttttaagacaataagtatatcagaattttatcatttttgttgctctatctatgtaatgaatttgaagacatgactttatgtgtaaatataatactaaaaatacatgtatattgattttttttctaatttttttatgatatttgttaatttgatgtacggtgcatactatacacgttaaaggtctatgtatctaggatacgcttccatgctagttgacattacagtatatagttcgacccgctacgtacgtacataaaaagttggtactatgatggggcgtagaattagcaagggaaaatgtcgtctatacataccctctctgcgatgctccgtgggtgcgtcgcgcatccacgcttggcccgtactctgaatggcacctggtcgtgctgcatctgcaggtatttctctacgccagccatctccctgggcgcaacaagctgcatcgcagatgcatgtatatacaaattagacatgaaatcatccctcacattgtacacacacacactaataaatcaaactataaatacgaaaaatgaaaaataaagataaaacgcatatatatatacacctgagattcgtagttgctaagggtggcgatgatgtcgtcgttgccgtgcgctcctgatttgcccgtcgacgtggagaacacgatggagttggagtcctcccatgacccgatcgagaacccaccggaggagaaggagcggacgacgtggtcgtgggtggagacgttctcctcggagcgcccatgatgatgagcggcgccatggatgctgtcagtgaggtccgggatgccgtcctcggatatctgggagaggccgccggagccctgcctgctgctagcgaagctcagtggggccttcatcttcttgttgttgttgctgctgctgctcatggcgccatggcgaacctcaccgagtgatgatcctgctggtctagcactcgatgagaaacctattgccataagagatgttttttagataatggatgtttcattaatccgatctctatatccacaaatattgttataagaagatgtataaatcgtgagttggtgactaagcagatttttttttttttttggaaatgctaaacatgcagcagtggtccgcacatctgggaaatgaacttgttccatgcatgcatgtgttttaaatccgtttcacaaggttcatcagagagtagcacttacggttcgaagtagacgatgatactgttgtaagaaaaacacaacagcaacttattccacaatggaaaaaaaaaccctctatatactactcccgcaaaaaaaaaagtatgtttaacacttcaagcttttctttctcaaaagtaaaggaggtttgtgcttcgtttcattgagaaaaataaaaaaaagggaaaaataattacaaacataaggaacaaattaaaatggccacactcacataaactcgttacccagaaagccatcattagtcgtccaaattaattgacctacatacaaagaaagcttacagagcgctcgagtttccggctaaacaccacaaatactgtcatttgccactgcacgtgctaccaccaaaacatttagagaagctttgaaaatacaattgttacggttcttccaaatctcctatgctactagaataatcaatgagtttagtcctttgcgcatctcttttgaaacttcattgatggctttacacaccaccaacctgaaaaatgaactgtcgttggctgagatgcaaccccagcgcaaccccatctccaagagaagggaagtacacacagcttgcaaaagacacgagagacaattgtatgtgttgtatagtttcatcactttgatctcaaagatggcatgcactcggctgtggaagagactagccgatccgaagccaaccatctgttattaattaccaatcaaatgaagaacttgcatcgtaaaggagcccaacttgatagttcctaggaagtaagcattgtgtgatcatttaaaccagttgtcgcctggccctctgagctttgcaatattatctacataaccctttaagatggctatgcccgagagcaagaataatagtagagcccactttctactattagcttatcttaaaactaatatatatagtagattaactataagtttggctataattttcttcttctctctatctctcacttatatatttaatgtatttatcttggagcttgtgataagttagctcttgcatgagagccaacacccttgattttttacttcctctttcctccacctaagtatatagtaagcttatagctcactattatacttgctctgagtgacatagtacaagatattttccattatctctctccattgtaccctttttctcctgagacaactaagaaccaacacaatgcctacatgtgtgtcatgtatagtcgattcaacgatcgaagattggcaaatcactccaaagattatgcaaatggagtattgcaaagtaaaagaggctacatgcctagttttgaaattcaaggtgctagctgggcttgtgttcagttcttttatttttttatggatttttctttccacggaatcatatatatataatcacaatttgatgttaatagtattagaaatatgattgggtctttgttaaaacattgcgttttccactgcaaattgttgttttcagttatgtgtggcaaaaattaggacgaaaattgaaagttctttctaagtgtaatatgtattgtgccatattaatataatattatagtgtatgcaattaatcaacttgcacatgcgtgatgttcatcaaagacattctaatgtgtcatgctagacattctagctaaatcgtactgccgtcgaacatcgcatgcacggtggagggtgatcacacacaagtagtttaatctacgatcgatatatatatatccccccattgtcacacaaagtactcccaattcgcaagtgtgcaagaaacatttttttttatcaaaatgcagtttcttaaatagaacatgccaagttgcaggggtggagctaggtaactaggagagggatgcctagctaggaacccggttaaaaaaaaatatctataatttatcaattttcaccgtatgtgcaccccctcaatttaaactcaagcatacatatcagtctaaacttgatataaagtagagtaaaccaagcgagtgatacccttctctattttgttctacctccatccctaccaagttgccaccggatcccatcgtatagtatagtagtagaccaggtttaccgtttacgatcgatctcacggcgatggacagatatgtcaaactgttgatggctttggcgccgcgtgcaacactcttccactcaccccagccaggcaaccagcgagtgagaatgaacccagaatgaattattcctcgatcgtcgtcgtctggtgctcgcatgtatatataggaggtgacatcacctctactttggttcgctgatgtctgcacgcgagagagatcgatcaactgaacctagacgggatatgacagaacttaatttcatgtgtaaggttagcgggcctaacctagctaagctagcttaattacgcgcgttcgataatacaccatcaagcgaagaaccgtcgtccagccccttggttaatcagtctatacatcacacggcagccgtatagcagcgtgtggggcaccaattcgattaaccttcttcgggttatagcttaccgtcgtcttggccagacataacttgagacatgggaaaatctaagaaaaagcgactttgttctttttcaaggataaggaaattaaggtaacttgaattgcatataattcaacacactgttgtatatgttcacacatgaggctgtacgttgttatcctattagttcaagtgccgctgtttattacgaaagaagctataaaaatgataggtgagtagaagaaatagtctcttaaaatgtagaccaaatgtgttacaagtggacaagaagttcaataggacaataataaaaaataatatttagaaaaggtcttcgcacttttccccataggatagatgtacacaattcaaacaaggtgtacgcatagttttactagttttatatatgaagggtgcataatggacattataaacaagttgtacgtataatttattagttttatatctagtgaagggtagatgctacacgtacaccaaatagagtctaataagataaggacaacttatcctgttagttctgaaactagtggatggctgataggacacgcgtaaaggcaatgtataacggcttgaaaaccaaagaggaggaaagtagctaggtccatggtagtgatgttaggctgtcagcaaaacaaataaatattaatagcatgttaaaatagatagtttagtaaatatttcggaataaataaatatgtgcaagaagcatgtgggcgtacatatgtgtacatatgtggttatacaatcctaaggacccacccatttctcattgcccccaccagaaaaccaccgtaactgtgcagcccgtagttttccatccaattattccaagccacccggtttgaaagcaacccataagatatcacgtatataaacaaaaacaaaccgaagacaaaagtttggatatagttggtgaaatcagcagattgcagaatcagattagctaggagactatactctcaatattggtcaatgagtgaaattcttagggtacacaaagtcacctatacttatatacaaactttgattatatatcaatatatcttcatgtgtgtttgtagaccggacacacaaaaatagtatttgcatattttttgctgaagtaatttgcttacgatattgtgattttgttgcaaaagtaacccatcacaaacaaaagatttatcgatcatatttcactttgcataggtaggtaatttattttgatccgaaaaggaacttggggtttcaaataagtattttattcatggtaaacttgagtttattttgaaaacgaacacaaagatgaacgacagagcgacagtaacgaaattaagcctgcggcaaatttcccctcgaaaaaaaatcctgcggcaaataaaaagggtatggcgccggtctaccttcagatatatagagtgaactttattttaatttatcaaacctggtagcatcgaacatccgttttgtagtctaaacccttactaaaacgatcatacagccttttttttcaacataaaatggagtaaaatattgctgcccccgaaagaatattgcactaatcggtgggcggctgctaatgaacatgcatgcggcgtaaatataacagaaaaatgaaggcgctgttgcaaatgtattggatgactacattgcacagctgctgatgtacgtgtaacctgtgcagtagacccagaaacattcatcaaaagcactcaaatatcaagaaaatgagagaaaaaataaccaagatcacacttgactaaacatcgcaccataagaaaaaaaatcgcagtaaaagaagaaaaaaaagaaataaagacagagaaataaattggaatactccaatgagtcaagagaaagaagaacggtggttaattggaacattccaaactcgatagtaatggaagagacgaatcaagacggcaaatcgaaggtacacgtaattaagtgagcagagagtgcagtaaccgttgtccatgacggggctcgagaagaacccgggaggcgagctgttgtgccgcgtcagaaaccccgactggtcgccgccgccgccaccgtccttcgcctcgacgccgaactgatggaaatggtgcttgccgccgtggccgtggccgtgccccagcgagatctcggccgcaccactcccgccgccgccgtagtgctgctgcctcatcgcgcgctccggcggctgctgctcccctcccccgcccggcaccgggaagaacgtccgcgcggtcgcggcgcccccctccacccccgccggcggggcgtcagtgaagaactgcagcccgcctccgtaacgcgccgacatctcccctccgcgctgctgccgttgcggcgccctcgacggcgccgggttcatgtgctaggcttctagctatagctagctagctaaccagacaggagtacctagctagcttctccgcgcgggggcgctgcgtctgctgcgtggtgtcgcttttgaggccggtcttttcgtcgtcgcgtgccgggggagcgcagcaaagcgggcgcgggcgcagtcagccagcgagcgagcgagcgactgatcagcggagaggggtaggggggatcggacgaccggaaatattggtggtggcttcgtggaatgtgggagaaaagctggacgcccgcgcgcgctcgtgatacggtctcgggggccggggcgtgtggaggccgtgcgccgtgcgcgcgcgcgcgggtgggggatgggtagcgagatggggtgcggtgcggacgacgtggacgacaagtggatcgtactatacactcccccctcttactgtaagcggcaactggctggggcgctggcccgcgcgcgcgacgacgacgacgtcgtctctctctcgtcccgatgacgcgcgcgcgcgctcggtcatgcggggacgcgggaggcgtgcgggacccctcgcgcgctgcgcatttgggaaaccgcggccagtcggccaccaccaccaccaccacaccggcgccgcgctgctcggactatacacaaccgcgccgacggtttgggtgatccagctagtggttaatcgatcagccatcggggcccgggtgggtccgggcgttataggggatgagatcgatcggtgcctcgaatgcgcacagggttcgttgcatttggatcgacagttgctcagttgtacgtcacctgttgttatcgtatttataagcttgtaataatggaagagttgtttaagtaggtcttctcctacttgcaacccgtggtcttctgtccttgtcttgtgactctgtctagttaattaaacatacgcgcgtgcgtgtttagcggccggctttgtttgagctagatacggtttatagaatcacaaaccagcgagcatctaggaccgatgtgatgacagtagcacactagcatgtacgtactcctgtggtacaagctggtcaagtggcaagtttagcattagctatatacactccaagtccgtacatgcatgacgggaaattctgttcaatcgtctctcgagaccgtatgtactttgtatgctagttctcgtgtattacgctaactctccgtttgtgtactctcttctgttcaatctatctctttcccaaaactttcagaactacaggcgcgtgatttttccctctctttcctcggtcagcttccaaacaagctactgcgcattcaggtggtagtaccagttttggccaagaatcctcaggagtcgggtctctcgtacagtcgtactacagtactatcacagtgcacttgatgcgcttataatcgcccccatgcatactgcacatccaaaagcagaagggcccagaattcatgtcacgcacgagcgctgctcccggccgcaccacggccacatgcagtccgcacttgctacgacggcgtacaacttctagtactatttgagagatcaccggctagcttccgacgatgactgtgactgtacgagtggacgaggcagccagctcaggcaggcaggcaggcattgccatccaagcacggacagagatgaagggaagcaagcaactgcaacttggccgcgcttttggagtctccatgcatcccccctagctagccgtggtctaccggccgctccaagttggggtatagatttatgcccacttggacggaagcctcgcgataaacaacgcccaactgcccaagttggcgagcgcgagagggggacactgggacagacaggaggacgacgcccagcgcgcccgcggccaaccatccgacgccaacgtgcgcccacct

SEQ ID NO: 42238 - DNA, 1076 bp, Oryza sativa
tagacttttgccttttttttggaggtcccctgcaaacgagtagtaggttgtataacagaatttacaatgagggtaaacataaaatatatcacattattatcaattaaaaaggttacctttcagctagcattgcttggtaatcagcaggatcaccctctctgcaactatgccaatgatgaccataacccttacacaacgggcactaatgcttgcccttgttaactcctcctgggttgcccttttcactacaacctctatatcttgtcctttttggcctgcctgctacctttttagaaccggtggatgcaagaagtcatgggtaggattgggccattgagatttgtcaaccaaaggagggattacttttgaataagccatttggaacctactaacagagtagcactcatctacaaaattctcaagtttgcagcctcggatggatgtgataaaagctatagcatgtgtgcatggtttgcctgaaacctgccactctctacagctacatgtcctatctgtaagattgacaacaaacctaccaccagaacaaaagaacaaacatggtatacttaggaagtgcacaaacttggcaattaagttgcaatgaacataaaaaaaaactaacctgtggccacttcctcccttgcactccacctctgctaatgcatcatcacttcttgtaacctcatggttcaaacccctgctcttttcattcaattcattcataatgtgtggtagtatattcccttctagcttttttgaaattgatcttctcctgttccacttcaccattaacttgtgcctaatcttgtccatgaaatccaccaagtgcaatcctttatgtggcctgatccagctattgaaacattcagccaaattatttgtaacataatcaaccttgcattgcccagagaattggcttctagtccaaagcctaacatggtttttccttaaataagccaagcctctggctttgcttcatccattttctcaatgtgcttctggaaaaaatatggattatatgagtatgctgcaggccagaggttatcatcaaacacctttccatgaaacctcttttt

SEQ ID NO: 42239 - DNA, 18281 bp, Oryza sativa
agaataatatcatctctctctctctcttagctcggtcagtgtactgcatgccggccgctttctgcatcgtcttcctgtacgtgtggacgaggcgagctcggtggtcacgcatcgatggcgccctagctagagctagctagttactcctatttcgcaaagctttctcttttgagctagctagctatctagctagccggccaagctagcttgcagcagtcgacgtcgtagttggaatttacagatagatgcagcagcagctatagctaagcgtaatctagctacagtacagttagttgctatagtagtttcagtctagatcttgcagctatatagttcctcttgttcttgttgatgatgaagtgaggagagatgggatatgatcgagcatcatgcacgcacccggcagagacgggctctcttttgctgcctccaatctgtaggaattcgatgtcgtctttctaaattagccagtttgacagttgatatagcctcccatcatttgtttttttttcttatcagtcgcaatcaaaatttaaattttaaaactacattttagagattatcttgagatttttaattttattgtaatttattttcagcattgatttttaaatcgctaagaagacacatgtatacaagttttactcatatttgttgctaatttgttggtttttccgcaacttatcaacccgtaaaaaaatgaggttatatgtagtactccctctggttttcagtaagagaatttcttttatactcctaaaagtttagctaatcgctcattttttatatacctctgaattttaattttaacccgttttataccatttccgtaccgttagttaactgtttaatgcctgtaaaaaggtcattttacaattgtacatgcctagaaattttgtggatgctaacgttggaaatatagtaatttattgtgggactataatattataagtttttttctatgaggaagtattgtacttagaaaatttaatatattcatgaaaaagcttgtgcggcttttttataattgaaaaaaaacaattggtcttgtataggatttcttttagataatatatacaataggtggcaaatatgttacatcacaaaaatatgctacacatattgttttaaataaatattatttttcttgcacatctaatttctttttgtaaatagtacatcgcacaacaaactcagaaatataatagtctcgtacacaaacttctaatttttaaagggaaccggtcaactaacggaaaagatgtaaaagagatgaaatcataattaaaaggtatacaactatacaagagagtgagtaaaattcaagggcatagaaaagattgacttaaatttcaagggcatacaagaaattctcttctaataatgtatgactgatctgttgactttgaatatatgcttgatcatctgtcttatttaaaaatatatgtatttttattgtgatttgttttatctttaaaggcactttaaaagtaacatactatttcagatttgattcaaaacgaacacacatccaaaatttaagtgttgtacattaaaaaccggaggggcatatatccggaactatgcatctaagtttattttataacatttattacaccattagatttttttataatattacatgatatgtaatccgaacataaagttgaggtaaggcaattaatgattaaagtcgtatctcgaagacgaattaaaagtactatactacggtgttgcgatttgtttgaatgtctgccaattagctggtgattgattgaaaccgtgtagagaaccaacaggcaggggctgcttgctagctgcctccatgcattctctctgtctgcaattctgcgttgctgtcttaatctgatgcctgcttattatgtaaatgttcttgcttagctcgatttgtccgggcaagataagccgataccatctctagctgtgtcaataaatcaatggcataacaattataatattataattatatacagaaaggaattaattcctttcctttctatgtcggcggctggtgatgtgaaagaagaacaagatctgatcaacttcacacagagagagagaacaaaaattatttgatggggaatgcatgcatttgctgcaagctactccctccgtttttatattataattcgtttgactattttcatagtcaaatttctttaagtttgaacaagtttatagaaaaatatagtagtattttcaactcaaaacaaacatattatcaaaatgtattcaatgtaagatttgatgaaactaatttgatattttagatgtttataaacttaatcaaacttaacaaagttttgactagaaaataattaaacgacttataatatgaaacggaagaaatagaagctagtacctgatccattatagaatatagcaacctttgctatgaacatgcacacatgcatgcatggcagtgtgtggtcggaaaggttgaacaagacgggcttggcagacttgcctccaacggcatagcttacacaggacgctcgcccaaatttggttaaagcttccgatcattgtctgcaaagaatattgtggcaagtgctagctgtaattaattagattgcccatctgcaatcctcatttttaattaccatagttgggagttaaatcaggtcttttcgggcgtccgggggagaaaatttgggtgagatttctctatcgatctcaaggtaaagttaatgtcgcccagaaatattcattttgtagatgaaattaatttaaccaaaactcaaagaaatttgaattgatccaaaatattttgaccagttcaagaaaattctgagtcgcagccgagatagtgatcgtggtatcacattacaatctcaccgagaatatttttttttaacaaactagcatccgagtgtgccatttcattaaatataggaggaaaaactatatagagtgtaagggtgttattttttttaaaaaaaggaaaagctcggccttaggaggctatgcctgacaaacgttttgttctctccaaggcctaagtttttgcctcttattttatttttaccatcaagcttgttgcaaagagcttttgtgcttgaagactcgctggttctgctctttccaaatttcccaagcagctaagagggttaggcttctcaattcaacccttctttctgtacttacgggatggaggccagatccaaccaccaaccatagattgttgtaaggttgctctagttcattgggttgatctcttcatggcaggtccatgctgcaattattccccatatccacctcttgtatctgcatctcaccaattaagaatctgaaccacatggttcattaaagaacaaaaaaaattggccaaaaccacggtgagtttcattagttttctttgttgtttctctcttactaatacattatgtctttgttgtctatactttatgtgtcgcaatgaaattacggtggaatagaaaaattcttagaaaattttagggcaaatttcaaatttcaagaaatttatttacaaaaactacaaatgggggaagttcttaatcttggatctctctaacgtcgagtcgacatataagaatgaaacgccgacgatattcttattgagatgaggggagagagccacgttacaaaggaaccaaacaaagttgttgaggtaactgcctcaggctggtagtcacagaactagctaggatgagtttgattcagcttttcggtttcgctactacctcattatttttgtaaacacacttttcgatcaaactgttataaacaacacgcttttatgcaaaactttatatataagttttttttttaaaaagaaacatatctatttttaagtttgtaatagttaatacttaattttagtcgtgctctaatgattctttgtgttttgcgtgaaaaaaagcatggccattttgctgtatcgaactaggcctaataaggacctgcacaatttttttttgaatgccaggacctgcacaaattaatcttggatcgatctcttttctctctccccactgctgcacgcaaagagaatcgggcatggatggtagaaaaaattgacatggaacattggagatgccttagtgatatacatagatttatagtggaatatagtgacagcgctcagcaacgagtttcttacatagacatcctttcgaattttcattgtctgctttagagattagatactcgtatatccaattggtatatctatctatcttgtggacaagcatatatacttgccgatcgatagaattattattgagaatttttcaatcgttgaggaagctagctagatgagatgactttagcgttggtcgagggtgaaaaatgttcaacagtaactttctagctagtttctatatactgttgtgatagagaaactagctaagccttttcttttgtatatatgtgtgtttttcttgatagctctttattaattccaagggaaatagtattggtaccgtcataaaatgttacagcatttgactatcttccaataggtcaattgatatgtagctcaatatgtcttctatattacatttcaaggcattgaaagctttgcatgcggataagaatactagtacttaattaaatacccaaatgaaggccagaatagtcgaaaaaacagctgagcaataccatgttatgtccgtagcccgtaagctagcataactcagtacctatttggtagagctccaaatctctatctcttctaaagttgaaaccgaactaaatgatttcaaactttcagcttcacttaaaaagagtggggagcaggctagagtgttttcataaaatgaattaaagagataaagtggggttcaggctactcgtcctcatacacaagtataggccattggtattgctctctaagattataactcaacgctgttagttttacttgtgtcgtaaaaatgttgtgcatatttatatggattcatgtgtacttgttatgcgtcataggcttgcatccagactcaaaaagaaaattccgagattcgccactgaacaagatgatcgctaactagtatttttttctttttttttgcgaggattgctagtatatattttctcatgctttatgctctcaacttttctttttataaatcatgaaaaaggtatagagggcccctctcgtttccttaaaaaatatatgtatagaccacgcgcactgcataaagctaacaatgtgctataagatactacctccgttcataaatacaaggaagccaacatacaacaacattaatccattatatttgtggataggggtatgtagtactaacgtatataatggtagtgtgttacacaaaaaacttgtgcaataacaagcaacttaattatagccttaagaaaaaaaaagatgccacacaggcacaatattttcatgcattccatgaaaaaggaaaaacagaacaaaagaatgcacggagccgtgttgatcatcatgaacaaaaggcatttcccttttcccgtaactttaaattgacagcatgcacgtatatacatcaggtttgaccaattttacttatcccttcctttttggctgctggctggacatgtggtatattatccatcatcaattcattacttcgtgacttcatcaacacacctactccgtcactcctactgaataaagcgcaatcagacttgaaatgtaaaactaatataactttaaatttctcatataccatgtttgtagcaataaaaccataataatataaaaagaaatccaaatgtcaatataacgatactaattttatcaaataagatttaatttataataaataattaattattggtcaaatattttaagtgttgaatatgagcgtctagctactaagctcggcatgccaccaatgcaccaatatgcgtctgaggaataaattaacgttgatgtatcttatctttgtctccaaaaagaatccggccggactctcaaataacaggtcaaatcggcacaaaatgcatctacagctgaaaaacagcataaggcatgtatttcatcccttcacgcatgtcttgctccctctttttccagatgtgatatatgatctacaacgtaagtgttacgtagctgactgcaatcggtgtgtgttgttttgatggaaagggatttgagatcaagagatatatatggcctcactaatttcttatacatgtggtacgaattaatagttaaaaaatatttatagaaacacccttttaacgtttatattttttgtgaccagatatatcaaagttaaccaatttaataacctttttaggtattgtagagggctactaatcagcgcgtctacgctaggagctgagctggcgcgcaatcctcccttcgcacacgtcccgaataatgtgagctaataacgtttagcattaacgatagtataaaataattttttaaataaaaaataataaataaacatcaaggtgaaagtttttaaaaatcagtcgaaagtcgaactttaggagttcgaaatttcaaatcttgacttgaaatttaaattttttaaatttgtcgagaagttttttaaagtttgagttgaaagtttcaaaatttgtatcaaaagttttcaaatttgagttggaagtttcttaattttgagttgaacattttaaacttgatttgaaagttttcaaatcttgacttgaaagtttttaatctgagttaaaagtttactaatttgagttggaagtctttaaattggtgttgaaagtttatgatttgggatataaagtttagaatttttgggttgtgtttttactttttaattgaaagccttaaaattatatacgagaagtttttaaaaaatgcaactgtatgtagggcctgttcagattgatgacatttttaaccataccattatttggtaaattggtgattatgtggctacgtttagtttgttatcaaatattggcaatgtgtatagagttttggcaacattatgaaaccaattctaccaaaattttggcaacgttgtaaaattgccaaaattttggcattgccaaattttggtaaggtttattttggcaccaatctgaacaggctcgtagatacaaactaattactcaggaaaagaaaaaaaatataactaatcacgctaatcttcactaaatatagtgctaatcacgtacatattttggtttccggtttagatggcactgctcgcgctaccgatatgccaaaatttgaattcaaaacgatacaaaatattcattctcatctaaaaatcctctccctgaaaagttatcagaggaaactattcatgttgaacttcactccatcccttttccatgtccccggcccagttccggcccagtcgctcactcccttcctctccaacctttttttaagcccaacactgctagcccaggtcccctcctctctttcccttctaaatccagggcggcccaattctttccaattcagctcggcctgctattcttctccacttctagcccatatggttctctcctccccttgctttggaccagcctacgtctgcgtgcgtggacgcgctccgggcccacctgtcggaagcgtcgtcttcctccagccacggcatcgatcggttcctgacttccttccacctgacgaaccctagccttgaattgccttgaatcgatggcttttcatctccggcgaatcgacgccattaactcaggccaccaagcttcccggcatcgatcgatccgccctctcgttgttctccgagcgtctttgtcacgatccaacatattctccatcgaatcaacacaaatcacagcagaacaaccacaattctagagccaaatcacagcagtaatcactcgattacttggatacatgtagcagaatggaatccgagacaacgctggcgtcacgccaagcagaatctgaatccaggagtagaaatcagagttgggggtgggagaactctagagaggaggaagaagacacagagaaggaggaggaggaggaggaggccgcaaccattggttcaaaataattcattgccccctttctcttgttggagtgtgtacttatactctggatgacttgctcctgggccaagccccctttcctatgacaacccacatccggcccactgtgaagtccatgtccagcacatgacattcctctccccttgaaaatcagcttgccctcaagctggtgcaaatgaggcacaaaattcatgcccccaggatcccatggcaactccattcttccaaaactgcagtcaggtagcttgatactcatgcaaagcgtaggtttgatagtctcaagatccccaagccatgtcatcttcatctctgtggagatagtgaactggaataggctctgatcttgactgcacttgcacaattcatgaacttgatttagtacttgatctccccatcttccagaagcaggccaagagtatagtttaattaactttgtcattaaagccatgatctgcagcaatggtttcatgtccgccctcacactatcaggaaaggcattttgcagtggttgtagttgtggttgttgcctgtccttcctaacatgcaagagagtgtccaggttactgcctccagggtcccagggtgcgtgcaggtgattagcaaaggccattctaaccaccaaaggagagtacttcaggccaacaacagtgacaacatttgcacttgcttggaatgtctgcatatccacctgtccgaaattggaatcaagcaaattgattcttgccagcaaccttgtcattgtagagacgtcaaacataggagagatgtcataatctgtgtctcgtttggcagcaacatgatcccaagacttcattattgcctcattagaaaacataactttctgaattgcaaatgtttgcttgaacacaagttggacacaccaagctgacttccaaaagtcagcgttgaattgaagagatgatgcccttttgctcaccacgcacagactcagattctgctcaaggcgattctcttcattatgcgccatcaaggccatatgttctgtcagcaagagcttgcagtgactttgtgttaactcccaagcattatcacaactgaaccaagactcattccatctgtcaggtgaaagtctgggttgtaggagattcaccacaacgcctctgttatcttgttttatttgaggatcatgccacggttctagctgccgttcaacaatagaacctttgctcttggcttgtagagggggtggccatggttggagaggctgaaataccaccacacttccgttgcctgaatacaaccatggatcaggccatggcgagggccgagaacctgaaaagacctgatcgctgtaccatggaactgccactctccaaagtggtactggtggtgagctagctctacatactgagcccaatacaaagcaatggtaaggcacttccaatgtagatggaaccaacgagagattgttaacaccaaggtcatggctcagacacccaatcaagatcctggaaggaattgcattgagggctaaccatggatctctgaagcataaattcacagaagtaaacttggtatccacttcaatgagctcagttctctcatcgttagccatgtctttgccatcatcatcaaccaactgattctttcccttcattgaacactcgatggttgttcccatgccaagcttggctaagtcaacatggttagttgggccagcctcagcactgacctccaatgcaatggtagttggactagtgttggcgctcaactctgccacatctctagtggaatccttgttctcggataaatccaccttggtgtcgtgaaatgcctccaaaatccgatcgatcctggtgcacaggtcttgaatggccttgcctgcgttctccaccaccttgtccatgctagcctcagcctccatggcctcggtgagtgaaaccgacgttgttgtgactgctgatttggccgcagatagactcatggtggccggaaacacgtgttccagagtagtaggagtgctctcggtatctgattttgtggtggcacatcctggtacttgcatcaaacacttggtgggcgcagtgtcggctctgtcttcgagcgaggtcggcacatgttgcacatccaacacgcagcccccgtcgtagatattgcggccgtggagttcatcctgagcccactctgcgtcgcaggtcgtccgaaaccaaacaattgcctccacacgccatgcatcgaccgcaagcatctgcaccgccactgctccataggggttgaagacttgatgcatcacattggtagacacagggtagatgaggtggttcacttggacatggagtgcagcacctgcagcacttcctaaccggcttggcatttcatcgaacacctggcgggcgcctctgacagtgtcacctccatggctcaaatcctggccccaacagtcgtcactgcccccatgtgtcgtccactgcatctcccggatcggaatcccatgaatcgactgctctgataccatattgtcacgatccaacatattctccatcgaatcaacacaaatcacagcagaacaaccacaattctagagccaaatcacagcagtaatcactcgattacttggatacatgtagcagaatggaatccgagacaacgctggcgtcacgccaagcagaatctgaatccaggagtagaaatcagagttgggggtgggagaactctagagaggaggaagaagacacagagaaggaggaggaggaggaggaggaggaggaggaggaggccgcagccattggttcaaaataattcatcgccccctttctcttgttggagtgtgtacttatactctggatgacttgctcctgggccaagccccctttcctatgacaacccacatccggcccactgtaagtccatgtccagcacatgacagtcttctcatggttgtgtatctgattttgatcactagcatactagttgtaccatgcatagtactgaagtgaattataccttattggttttttctactccctcattcacaaattactttacattctgatagctgagtcccaagtataacatttctatggccatcgatttctgaaaattctcacaatttaaaaatgtgtaagttattttctcatgttgattataaaaaaatatatatattatgatgttcaatatataaatttttaaaaattaatggtaaaagagaaaaaaatgtttggctagcttatgagaaaactagaataattaattgtatcaatatatatagtaaaagtttcagttgcaataataattcatttgttatattagcatagaggagagataatatgataacttgatacatcgatcgatctagctaatgcatgaacgctagcatctttatatttttataattttataatagtagatatacatttatttatttatatatacacacttaagagcctgcatgcatatacagctaggcaggtctcagcttagctatagctgctgcatgcatggaggccgggtggcatgcgtagctagctaggggtagaccctcctgccgccggagccggcctcgcgctggcagttgaagtagacggtggcgaccggcgagccgaggttgtagagctcggcgaagttcctggtgctgaagttctggcgccaccccggtgcgtacaccgtctgacgccccagctgctggaacagcacgaacaccagccggtggatccccatggttggccttgggctctcgtagcacatcacctcttgccctgcatcaatttaattatctacgttattcaccatatatatatcaacagtggctgttctacaagttttgaggggatcaccaccctccattttggcatagaagaagtacagccctatccttcaaatctgacgaaaatttttgacaaaatagatactccctccgtattttaatgtatgacgacattgactttttaacaaacgtttgactttttgtcttattcaaaaaaattatgtaattatcatttattttattgtgacttgatttatcatcaaatgttctttaagcatgacataagtatttttgtatttgcataaaaaatttaaataagacgaatggtcaaatgttggttaaaaagtcaacggcgtcatacattaaaatacggagggagtataattttgtcattatgcaatttttgaagtatatatatggggtaggaccaaggtaataaaaattcatggaactgccacatatgttgctgttacatcgaaattgatatgagtactatatatatatactagtttactgaccaaatgttgctccagtggtaccaggaatatcggtgaccagcctacagacagacaaagagaatcaacgcgaatgattgagaatccggtccaaattctttatattctaggacgaatgtatacaattagctagctaacatatctgatcggtgcctaccagtgtagatactccctaaggttagggttgcttgggctcggagcatccgggtctaccatcacctgtaggtaattagattagtacgtaagccacacaaaattaacatgcatccatgtaaaaaatataatttatagtctagttttatgataattaatgaaagtaattaaataacttctggtgggtctctgcatccaagatatgatccgtacgagtgtgtagaacgtcctcatgtcattgccaccgaccacgaccctgggctgttgggtcaccatggacggcttgagctcgcagccattggagacgatccttgcaccatagctgacactgaggttagtgatccggacgaatggatccagcacatcacccacaatcctgccaaccacaagaggatcgtccctgccgctgccggccatgtcaaattaataacctctaactaaaaacgttaggatatctaatatcaaataaataaaaggattagactttgaatctaggtcagctaacccactaacttatgaagctagccggaaaaactctaggcatttctcagtaacctttaactgaacatgtaaacaaacagatcgatagagattgctagctagcttaggtatctcctgccgttcaatccagaggatagatgtcaggaaggttaagctagccaaacagtgacagggatgcactagttgtgcaagcttctctgcatctgtacagtttatatagctagccggcccctttaggcagtaccaacccaagacactacacggtagttttcataaacttcacatcatcaataaactagtattagacactactttttcaatacaaacaccactttttcatgcttaaattaaatttatctcacatgatgtcttcaatgttgtgtagaaaccatgtctcatgcaagaccttgttttcttctctttcctcatttactcacttgccacatcatttttcatattaggtagcagcttatttaatgctatggacaccatcctagttattgagctgagaatagccttactatgatgtgcccagtagaatcttttctttatgcatttacacactttgttgtgcccggtagaatcttctctttctcacacactctctctcgcatggccctttctatcttcttcatgtcgatagaagtgctgaaactgaccccatttacagaggcgatttcgagacagatacatatgtactaaccccgtccaaaataaatgaagctagcagtaaaataatgaagctaactatgggcatgtttggcagagttaagaacagctgtttggtaaccaggctctgagagtttggaaaagctggttacctagcttctggcttttagttcttttataaattctataactatagctttttagaatctggaccaacagctgaactattttgagagcttttgattctgggagaagttgatgcagctagaagctcccccaaacaggccctatagctactaatattgttgtgcacaattaaattacatactctagggtacaatgtagattctattgttacgatagaatcagatggtactgtagctgatctggcatggcaaaacttatagctggcctaacgttttacaagcttcatctctcattaatttttcaccatacctattctacaattcgcggtgtgttcggtatatttccgattccaaaactcatacaatgtttggttaagcttttaaaaattctgagatcgataacttttgaaacttctcaaaatgcttagattaaaaaaaataagaaaaaaagatagtacatatccatagatttgtcttgaaaggtgtggtggccaggccagagaagcaaagcatgcatgcatatgtggaggagaactagcttccagatcgacttgcagatatgcaaaatgcatgatgcaatacaaacagaaaggctagacattattcccggccggcggcagaaaagctaaacacaacaaaataaatgaatatttatatatattattatatatgtaaagtataagttgagattatattttgtttgatgataaaataagtaacaacaaaatactccctacgtttttattatattataagatttgacttttttccttagtcaaacttttctttaaacttgatcaagtttaaagataaatatagtaatattttaaatagaaaacaaacatattatcaaagtatatacagtgttaaatttaataaaactagtttggtatcataaatgttgctaattttttctataaacttggttaaacataattaaaaaagtttaactaagaaaaaaaacgacttataatatgaaacagagagagtaaatgatatttatatatatatttaataagacaaatggtcaaacgttatgcgaaaaattaatggtgtcgtacattttgaaatgcaaactttcaaaaaggaatatatactagatgaattgataaaggaattttcttgatggatgcatggctaagcattattggacagggatggccaccaggacagagcaagactgggtgcgagaatatcagattgcattcgcgatagccgaccggccagccaaatgttattcctgtctttttagatgatgaaaaggctagtactcattattcattatgatgtatattcactatgatgtagagcggcttgggttgatttctgttattgaaaaactaattgtttgaatgtggattaattgcatatatagccagaggagaattcataccagttacgcccaccgaatcactagcttcattgactccacaattgaatacattttagtgtagtttgtttcgagtgaaaaatgtacttcctcaaagaatgtacttcctctccaaattataagaatgtacttcctctaaaaaatattttatttgatctcaaagaatgtacttcctctctgtcccaaattataagaactatattttacacgatctcaaatgatatactttgactattaatttacttcatgttacgttaccaacgaatatgatattagcatcacataaaaatactttaaaatataaatctagtgatacaacatgcataatatttagggagtaaaactagaggggagggagtacatccaatcgcatatggctagctagcttcctattagcagtctagcagaatactccttcctgaatctctaggttacataagtatgactaacatggcatccaggctcttttagcatggaactgggtaacagaaaaggtaatgcagacgtgacaccccacgtgggctacaccaatatctaccaatagagaaatggtatcgcacggaaaagcatagtgctttctttctcgatggtttcgatttacactaaaatatgtcctatgaagagtactttatttttggattctttatattccagaaagactttacgtttaaagcaatcaatctattaaagtttgaaaataatgtgaataacattctagtctttttaggcccctttgaatcacatgattcaaaaaatgtacaaataaaaaaaagaaatatgatagaaaatcatatgcaaaacagagaattgagaacacatagatactataggaatgattatttgattggtgcataggaaaacataggaatgtgttgagtattaagtttatagtaaatcaaaatttgaatggttttgctagggtaaaccatatcttccaagggtgctttgcctcgatactatgcataggaaaagaaaaatgagctctaaggttgatgttgattttcctatcgaattctgttgaaatcatggtcgaacttttttcaatgctttttctccgttcaattcctacaattcaaagggacgaatagtaccaatccccatagaattcttgtacatatgttttttctccattattcctattaatcaaaggaggccagttttctattggtacatgtacgaatggttaaaaataaattctttttgggacagagatattagtatcaatattcggtagaaatagttcaaattattgatttataaattctattaattatgattttcttacacctcagtagaaagatattttattgttggtagtaggggtgaaaacggtacggaaacggacggaaacaacctttatcgttttcgtttccatatttttttcggaatcggaaaccccaaaaacgaaaacggaaacgaatattatcgaaaccgaaaacagagcgaaaacgaaccggcgcggatacggtaacgaaaatttatcggaatacaaaaacccctcaaactgagcttcaaacttttgtcaagttcaattctcaagtcttaacagtctacaattcatcataaaacacaattatatgaagtctaattgttaagtctcaacagcaaaatatattcttctataacttcgtataatttgcataacaaatattctaaaaaaaattacagcaaaataccatggtataaggtataaagtatacactattagcccgcagcccgcagcctctctcttcctccacgggccggcttccccttcccctcctccctcttcgggccgccggcccagcccttttgctcctccctcgccgagaagtctataatgcctccttcctctcaattcaaatattttttagggtagtaaatgatttcaaatgaaaaaaatgtcaataacaaagttgtataacttatcaagatcaacaacttttgttttggtcattttgctgtatgactttgtttcaataatttgaatttgaatttcaaattatgacaacttcaaacaacattttcaaatactaaatgatttcaaatgaaaaagtcatcaacaacaaagttgtataactcatcaatatctataacttttgttttgatcattttgctatatgactttgtttctataatttgaatttgaatttcaaataatgataacttcagacaatattttcaagtactaaatgatttcaactgaaaaggtcatcaacaataaagttgtataactcatcaatatctataacttttattttggtcattccttcatccgataaagtgatagtaacattgttcacaaaatttacatatatctcctatagtttataaactatataagagatatatacattttgtgaacgatcttataaatcactttatcggaggtccctaaactctcataaaccgttcaccggaggtccctcggcaatatttttgcccggttttgcggacgtggcatcctagtcagcaaaaaaattataaaaagtacatggggcccacatgtcagctgcacatcttttttccttctcttctcttttctccacgtcgggccggccagacagtatccagaagaaccaggtcaacgccgacgacgggcgagggcggcggctggcccgcgcggtagcggagcggcgccgggctgcaggcgaagcggaggcgggcattgaagtagagcatgggcgagtggacgcgggagggcgccgggctgcgggcagagcgcggtgggcgagctccaggtcgctccgtgcgcgccgcatcaccaggggtgcgacgactggtgggtgtgggcagccgccctcctcaggctttgccccctactccccgcacaaaaaaaacagtttgggacatcaatgcagttcaaaagtattcggatgctagcagttcaaagatcttgccgaatactctgcaaatcagcaaccatccaagaaacaggaaccagacgctcatccaagaactaaataattcaaggaatctgagggaaatctatgtgataacccgaggtggcggggagctgtctgaagaaatgactgggaggtgaacgagtatgcagaatgaagaggaatccacgcagaaaaacccaaaggggctacacatgaaagcacatcaacacaaaactgacaagcaatccaagcaactgaagttgcatttatccccctagtgggttttggtgattaatgacgaataaggttaagggactaatgattttattgagt

SEQ ID NO: 42240 - DNA, 26486 bp, Oryza sativa
ttttctgggatctttgcacaagtgaggcaaggggttaattgagacccagctctttggagcacctcaacggagagtaggattgcaagatctgaacttcaggaaaaaatcacccttgtcctctctgtgatgattctgtgcatgttgctgtgattgtatatatgctctttcatccagtagtttatttcgtgcaatttagttcaagtccctgttaaggtcttcaggtttttctgttgcccggaagttccggacagtctgagcagaccggaagttctagtgttctacatccggaggttccggtcctgctgaatttaaagctgcaaatttgtttgtaattttaaggaaagcctattcacccccctcctctatactacatctttgcgcgttcagcaatgaaaatgagcagttacctctcaaaacatcaggacaaatccccaatactaacgcctcctaatcatgaggactgggcgggcgtggactggccggccgcctctcccgccgacgcccccacctctcgtgtcggcgcgcctcctctcctcctctcctgccacctccgtcgcgtcgaccgcctccgcttgccgttgcaaccgcactcgccgatgcccgccctcgcagccacgctcgctcgccgcttgccctcgcagccgctcccgccgacaccgccgctccgcctgcctccgcccgtgcccggagagaaaaagagaacaatagaaaaatgagggtcacttacatgtgggctccgcatatttatttttattatttgtactgactaggatgtcacgttagcgaaaccagcccactatactgtcttgggacctcttttgaacggttttgtatagtttaggggtgaagatttctggttttgtggttaagggacctccggtgaacttattccttacttagacgtggttgtttctgataatctctatggccgtgtgtgccattcgatttgttctacacgtgatcgagaagtccaagccacgtggacgtgctctgtacggacggcctgcgcatgcatccagaggaaatccgaccgtacgtcgctatccacgtacgcattgctgtcagcagtaccaactccagcttgcactgcaaccagcgcggatctacgatgttagcgtcggtgttaaatgacactgatgactttcgacaaaacctataattaaactgcttatccatatattatgacacaatattctaattataatgagcatattagacaccgatatacatatcatgacttcaagtcaccaacgaatcaattttctagatccgtcactgactgcaaccaacggtttcgactttaaagaggaaaaaacaaacgaaatcgaataaaaaatactcctatatgctttgacgcatggatcgatcacttgatacgctaattaatctcgatctgcaaagatttcaccggagacgacgacgacgaccattcctgtccatagacaattccctccctgttcttcattcaacgtacggccggttcagtttgcctcagcttcttcttcttcctcctcgtcttcgtcttcctcgcgcacgcgcgcagcgaccattcttggttgattcctctcgctcttagctggctctcttttgagatctagcggaatcactggtaattaatcatgccggctagctatatataaaatcttaattagtacggatgatgagtagagtagcagtgtagatcgtcgcagtatttagctaagctagctagttcgcgtcaccgttgatgggaatccgaccagatcaaggcggcggcgagttgggggcggcggcggcgacgagaaagaggaggcgggaggaggtgaaggtgacgcacatcgtgacggcgagggtgagcgcggacgaggcgagcttcagggacgtggtgcagcggctcaccgggggcgccgccggcaatggcctcctcctcgtcggtggcgatgcggcgggggtgctcccgtcgtcggaggaggagatgaagcggtggtgggccgccggcccatgagtattcactgatcgatgggccttgatttgggccggttgcaatgcgtgcacgcatgcacacggacattgcacaccatcatagcttttgtattattatcgatttcttgtcatgttttttctctctagatatatatgaatttattttttaaaaaaaatgtgtttgcgtaatgttttggttgcgtggtcgctcttgcttgagtggtagcggaggcttggccgcttggatatggttagtaagggtggacttaggatgacatatgggtcccacttgctgactcagctagtcaatcatgatcaatgtgccacgtcagccgaacgcaccttccaaaccacttgaggagtttatttgcactggtttctagagatgcgggaggtgttatacatggttttacggttgagtgatgcgattcgattaaggcaaagatatgagggaggaaaaatagacttattctgcacctaaatgagcttcgatacccaggcctaggtggactaggcctggtctatccctgatgattagtcttgaacctttagaggtagcagaggatccctaatggtttaaaatcatgaattgttatgcttaaaatctgtaacagatcaatacaaatatatgataaattggggaaaagtccaaattacaccactgcattattgggtgagtacgaattacccccttaggtctgaaaaccagacatcgcacccacagcaggtggagcccataagaaagaagaattgctgattggagtgccacgtaggaccaaaaccactccggtttaagtgaggggggtaattcgttcgatattaatagttgatggtgaaaaatgtctgattttcgggtctgagggggtagttcatactgacctaatagttcagggatgttattcgaacttttccctaataaactgtcacatagcaggtacgacaattgtttaaaaaaatgcttaaagcgagatcatgaacagttttttatatgatattataggttaaatagtactattaaacggttagtaaccttaagtgattaaccattaggtaatgcttcctaaccaccttgccattcctctaaactagcccaccatccctaatgggtggtgtttctttagcctagttcaaacagggcatgttgtacaagctggtttaactaaagctgtcataaaagttgtaagcatacaacccaaaagactgggtcaattgttctatctgatatgagactgccatgtgatttttatttaattgaagctctagagtatatatgttgatataacgaaacaaaaggaaaaaaaaacacttcaatattttgtaggtcatgaacgggctcaccttgtattaagtgtggctaccaaatttgtgtttttaaattatccattatcatgctctgcccctccactatttaatctgttgtaaaatattcagccacttcttcgagtttgatagcacaaccagagaattctcttcttgcataatgttggcaatagttttctttttcctccacaaattttgagtgcatgttcggttggtccaacaaatattaattaattaattaattaatcccctgcctaactagctaagccaatcatcctatggttttggaggcggtggcgatctaggttaggtagactcacaaatgaaacaaaattgtttgttggcctagctagcctcctattatgttcttgttcttgtgttagttcagcattagcaggggcttaggcttggttgcaaacaagtcactctcacagccctcgtacttctgaatttcttggagataaggctctgaagatgtgccatgtagacttggatgtcagcccactaggctggcgtggccacattttaattacgtcatgtgcacatttttcagttagaaatagacatccaaaattgaaagaaatttcagagtaatgaaaaaaaaattatcatcatctgagatgtcatgaactcgggaccacgacaagtttggagtttaggatcagttttagaatatcgtctgttttggactatttgtagattaggtgctttcaatcaactggagtatgggcgccatcctagcctccctccttcggtccttccccttctctagcgtccttgttgacgaggaggggaaggggataggtagtttttcgttgttgtgtgtgttcggaacttcacttcccaacccatttttctcattttctgcgtgcacgctttttaaattgtcaaacggttcgttttttttaaaagtttatataagaaagttgttttaaaaaatcaaaataatctatttttttaaaaaaatagctaatacttaattaatcacgtgctaatggactgctccgtttttcgtgcggggagatgggttcccaaccttcaagtaacgaacgcctaagtatgtttaggatttgttctaaacaaaattgagttttagtctattatgatgtttatggagttaggtcaatttatttagattcttttgcctttttacttttgctattgttttcacgggttcttcaatggagatcttgaaagacattgatcaggttgcagattatccaatcgacagtgtcggttttaggtgggtcactgatttgtttggtgatgccgttttagagatttgccaaatgatcaaagatggtggtcgatagaaagacttttgtgcggtccagagttgattagtgttatggctgtgcttgtgtacttgtatctcttgtggcattttaagatgtatgtagatcctctttgttctgtatcggtaccttatttctcatgtactagaactatcaaggttgtgatgatttcttatatttaatataaccaccattgtttccataaaaagaagtcaactggagtgataatccaaaagcagcctagctagttcctacaaatgagaggggaaacaaatgacacatcagaataaggaacatcgtcatcagacttaatcaagaacatgacaggttcagaatttatgtgatgcaagcctagcctagtttgctgatagatgcgagttagtaaattccatagaaatatatacatatccagggccccatccttttgtacatatcgatgtggtttaatagaaacccatacgatcgatggcgaaatcaagaggtagtctcaccatgatcaaagttggttgactcataatttgtgacctgaaatcgataaatttatgaatatatatattaattatcatccaccaatgcgatggaagatgagacactgttcgactgtcgattacctgtccccgatttaagaatcgaaatctccgtttgatcattgtcgtcgtcagagatatgatgatggatggactggcctgaaatggaagaaaagaacagcatctgaagcttccacactactgatgcttaatttccctgtgttcagttgctagtgatgtgagtggttagcttaattagcagctcgatcgcgttgatctctccaattcgcatgcacaccacaacaaccgatcgatcgatcgatcgagagcactcacgtaatacgtcgccttcgccgcgagaataatttagctatagctgcaagcatatataacgattcaatacagcgactcgcacctaacctaaccccgcaacaaccactaatcaaacacggcaagaaaccccagaaaaaataaataaataaataaacaaaaataaaaaagttcagatcagcagcatgtgatttttttaaccatttaatttctaaattttaaattgaatattctcaaaacttatttacaatgctgaacattttgtcacgcgtggcgaaataacaccgctagctaatactctaacccctcgtgatgtggcgcaccgtacgtgttagcaacaactacgggtgacattgtgacgttgttttagcacgtcaggcgggataccatggtctaaaggttcagatttaaaagtaaattttaaaacagcttatttttaaaataaaaaaataaaatggttcaataataataataataataataataataataataataataataataataataataataataataataataataataataataataataataataataattcggatgaagtagtgagcaatcagcagctgcagtacgtcgtagctaattggtgtgatgagtgatgagtgatcactctcgtcgatcggaagctccagctccaatcattcacgttttgatgatgcaagatgagtggccgggcggtcgctgtcggggaaatttaagaaacgggagccgtcggcgaactcgatcgatcgatcgaggtgccgtgtgcgttgcagctggcggcgctgctgccaaccaagctggcaggagagcgatctctgctgcgtgggtgatcgacggcgacacgcactgccctgtcttcctccctcgccgtcgtccggtcccggcctcttcgtggtcgtcgccgtccgacacagctaagattgcttgtgacctccgacttccttctcgccggactttcatcttcgcttcacttactccctccattccatctcaagtgtaattataagtttccgtgcctaactttaatcgttcgctttaaattttttttataattagtatttttattgttatgagatgataaaacatgagtatgtctaactttaatcatccgtcttatttaatttttttgtaattattatttttattgttacgagattatgtgatagtttatatgtgacttatgtttttaattaaaaaattaaataagacgaagatcaaagtactatgttttcaaataattgattttttttctaaaatataagacacaactatttaactttagatatgttgttttatatatttgacaggaaactgaggagaaatttatccctttttttcagcagtttggatacgagtaaagattcacgggtggcgggagaaaaaaatctcacgtgcaggggctcgatcccatgtacgaccttacatccactgagctactacatgtgttgtgtggttttatgagtcttacacctaaaatatattgtaattactttctaattacactataattatattaattaaggttgtactgtagtcacattcgataaattttaattttgagatgatttttttcaaaagttatataactaatccctactactgtatctgtcttataatataagaaattttgggtggatatgacacattctaatacaatgaatcaggataaattaggatgtgttatatctacccaaaatccttatattataggacaaagggagtatttgacttttgacctacaattacactttaatgacgtggtttaagtgtttgtaaattatttgtaagaggacgaatggttaaagtgtgaaagtgaatgtctcctgtcagttatttaaaaacaaattgaaggtagtaccaatctgcctcgtcgtcttgcacgcggccaaagctcatcgtcttttcagacatttacagtcgacagctccactctccatgtcaatgatttagtccagaacccaaatcaaaactgctgataagttaatcatcatcttcttttctttttgtgcactcaaacaaagttgttctagctttgctctgaattttgggcaacaatcactcaatcagtagcagtagacctgattaaggataagatgagatcaacgacgtgagtgcttgggcaaagagagggcagctttaatttgtgatcacaagtgcgagttcgttatgaatgtctgtgtctgtgtccatgtgtggtggtggtgcattttcagagaaggggattctttatagttcgctaataacaatatatacagggatgcctgtggctgatggctactgtcaccaccaacatcttgttattgttcagactaaagtgttggttgctagctcaggtttagctagctccaaatacaagtcttcactcataataatggtgttgctggtccatgcttgatcaaccatgcaagtgtggtgttctttgagttgggtgttgtcccatcaaaatcctctgtatatatatacttccatttgattcgtttgtgcggtttaagcacagtgtttagctttgctttgcttagttgatgcccatgtctgaatcacactgagaatatgccctctttgcttaatggacatgtatatgcctgttgctggtgatgttggttaaggcaattcatttctttttttttctaaccatgattgattattctgctctaataagatgagagatgcatgtgtggtgttggcttccactgtttagtgatctcagttgctaaccacctatcacaattggccagctgttcactctagctcttggacaacaatgtcattgttgcagttacaacggtgaaggagatatcctccaattggcaagataaagatcagagatggaaccaataaccaacctgcagacaaaattaactgcaagttcttccaattcttcttcttctttttttatccaagcaaacacagattgtaccaatttcattgaatacttccaattctctatcaaccaccatcatggcagaagactgctagtcttgaaaggcagttagctagttgtagatgcaatctattgcagggagattgacagattattggagcccaagtttcgtcgaaccggagacgcaaggaataaagggcaaagacaccggtcaaccatgcatgaacgtaaccatgagcacacacgcaacttgtgcctacatgcatttttcatgccagaatatattaacactattttttatcctatttttaatgatactatagtgggaccaagatggtccaactgatttgatatattaaaaataaataaatagacagttgtatacagcattgcatctgaaattcaaacttaatatgacctattctcactttaattttgcatatagaaattgttaatacattaaaaaaatagaagatatatttcttccatcataaatccatattaattatatctctcactttaatttacagatagaaattgttagcatattaaaagatataaaaagcaataactgatacagggttgcatcagaaatttcatattatttctatctcttgcttttatttgcagatagaaatatatatgtagatggctagctaaaggatttatttcattatcttatactccctccattttataatgtaagacttcctagcattacccatattcatatagatattaatgaatctagacacatgtatatacctagattcattaacatttatatgaatatggataatactagaaagtcttacattatgaaacggaggaagtagaaaaaaagaaagctaagatgcaaggagaatgccggtccatcacgtttgccatctaggcagcacactctaccagaagcctgaatgcaaagtatgcaggcaacctacccatgcagagacaaatcaaacaccaaaaaggtggcaagagatttcaaagggagagacaaatccttcttggcacgggactgatcatggttagtggcggcagcagcatcagcagccagtgattggtactccggatggagtactaattaattagctggctaacaccaatatattgcttctttctcaatcatttttcttcggtttaagtctctctttttctctctctctctggtgctgattgcaaagccactcacacgcaccacccataatgtaatgcccacccgaaagtccccacaaaatcacatggaagtcgcctcttcccaatcacaaagcatgaacaaaaaaaggagattgttccacagctcacaaaatcagctaaccccccttattcctgcctccctccctccagtaaccaaccacctgtaccgggcgcgaaaggacgaatggtctctcgcgctcggttagttcgttcgatggtgtacaatggactgtccagatcatcttaagacggcatttgtattgtcctaagtcgaacaaatggtatactcccttggtctatcttgaccacaactccataccatatgcatacatgccttgaaactgtggttcgctatcctgatatcagataaaaatcgctcacgagcagtatcttcggattttgtagaaaccattgataaaccaaaagaaaaccgatgaaatccgaacaaatctggaaaaaaattaataatccatttttattttaattttttaacttcacacaaaaacccgagcggtttatgttttagacatggtccgaaaaaaccagatttcacgaaatcagaaccggttttctcccgggataataaacccctgctgggaacaaatatccatatcgtcgcaaaccgaccgacgtatcggacgatctcgaccgtccgataccgatcgggcggtgcatggtagaggacccggatccgggaggaacagtgcttgccgaataccgacggcacgaaaaggtaaagtgcacacatgatagtgcattacattgctactactacatgatatgcattacattacacctgtccccagatgcgccaggcagacgggcctcacgcctcctcacgggctcacgcggtcacgcctataaaacgcgccacccctgccctttccacgcatcatcacatcatccactgctctgcttctcctcttcttttcttggcttgtgctctgttttaatttctttgcaatgatggggaggcagagctcgtcggcggcgaggagggtggtggtggtggtgtgcgcggcgatggtggtggcggcggcggcggcgcagaagtacaatgcggtgtacaacttcggggactcgatcacggacaccggcaacctgtgcaccaatggcaggccgtcgcagatcaccttcacccagcctccctacggcgagacctacttcggctcccctacctgccgctgctgcgacggccgcgtcgtcgtcgacttcctcggtaactttgattctttctttgattccttcgtcttcttggtttgcttgctccggcgagctgacggcggcggctggtggttgttgcagcgagtaagttcgggctgccgttcctgccgccgtcgaagtcgacgagcgccgacttcaagaagggagcgaacatggcgatcaccggagccaccgccatggacgccaacttcttccgctccctcggcctctccgacaagatctggaacaacggccccatcagctttcaaatccagtggttccagcaaatctcctcctccgtctgcggccagagtaataatcactcactcactgttcttcccaccacacaatttcaaaatctctgacaagaattcaattcgattcgattcgattaaatttcagattgcaagagctacctggcgaactcgctgttcgtgttcggggagttcggcggcaacgactacaatgcgatgctgttcggagggtacagcgcggaccaggcgagcacgtacacgtcgcagatcgtggacaccatctccaacggcgtcgagaagctcatcgccatgggcgccgtcgacgtcgtcgtccccggcgtgctccccatcggctgcttccccatctacctcaccatctacggcacctcctccagctccgactacgacagcctcggctgcctcaagaagttcaacgacctctccaccaaccacaacaatcagctcaagaccaagatctccgcgctccaatccaagtacaagtccgcccgcatcatgtacgccgacttctactccggcgtctacgacatggtccgcaaccccggcaactacggtacgcacaccactccgcttacactgttacacaaaaataactaattctacggccctgtctagttccaaagtttttttctaaacttccaactttccatcacatcaaacatttcatacacacataatttttctatcacatcgtatcaattttaaccaaaacttctaaacttcagtgtgaactaaacacagtctacgtatatattgcccgtacgttgcaacgtgatttggattttttttaaaaaaatttgtgcacgagggagacagggggccatgtgagccgtagcaagattcctcagttttgtgccagtgaatgagcagtttgcttaagtagggtagtagtgtccgacatgggcaatccgagctcgtgattgccattttatatggggggaacagtagtcgtcttgctccaacgactagctagacacccaaattatgccagattaatggcagatacgcccggttaggtgtgtggacttatgtttgtacctacgaatccaactgcacgcacgttcctccgttccctcaccggaactcaccccatgttcccccaactaaacacacatgtgagacagtgtcaaacgactacccccgagcagtggcgttttggcagtgtgcatcctactcctttcgttctgaaatataagagattttaaacggacgtctaaattcgtagcactaaaaagagtcacatccattcaaaatcgtttatgttttatgacggatggagtagatgatacagagaccaaagatgattaaactgatgagctatatatattttttgacatgtaggatttagcacggtgttcgagacgtgctgcgggtcaggcggcggcaagttcaactacaacaacaacgcgaggtgtgggatgtcaggcgcatcagcgtgctccaacccggcgtcgcatcttagctgggacggcatccacctcaccgaggcagcttacaagcagatcactgacggctggctcaacggcccgtactgtagcccggccatcctccacagctaaggcaaaatgactggaaagaacgagccattagttaatttattactttattattaaggctggtgtttattaattaagcgggaattaattaaaggggaattgtttgggttcttgatttttatttgggtggcatatatggtgggtggtgtgacggtgaaatggtttacttgcgttgccaaaaaagcaaagaaagcgatggcatctgtagaataaatgttggttactgttgtaatttgataattgtttctcttccagaatcaaatgaatcatcaatggtattatactcagttattttttttcttttgctttttagaaagagacttttttgccatggcagcttatgtttggatcttttgcctggccaggggcatgtggtctgtgctttaggaaaagcaactgcagaaaattcactctgatggtcatcctgtctgagacggtcttgtcattattagtcagagactctgaaagtgaaagtgacagtgttttcttctcattgcaaacttttagctaactaaccactaggttgatgaacaaattggacactcctactggggaaggaaaacctgagcaaatttatccaaggatagatagatatgcagcatatgctccaagtacaataatgcaaaaggaaagcaagctactcttgcatagtgatgcactcgctctcctactcctgaatctagctagttgcatcaaatcgacttgaatacatgagatggagtaatatgcagggcatgtgggtgacgcaagtgggatggcctgaattattcgtagctgttggaattaaatccaacggcgacccatccttggaaggaggagacgaatcttcgtatttgattgcctaacacatctattgattatgatagtgatgcacatttgcaaactaggacagggcacacaagcaagtacaagcatgaagcatcaatcagagcggctgatttatacttacataaacgcagtaaacaaaaaaaagaaataaaaacatggcatgcgtaggattgaaacacagaaccaagcctaccatagaggttgaaggatgttacgtatagcgaaggttaaaaaaatatattcaaaagtacgaagcatagaaactgtgtgttaatttgtgatgcattctactactatacaacaaaactgcttcacaagggcacatgatgagcattcctggcaagaatatactaccaagttctgaagtcataagcaaatgagaatgtgacaagaatgtggaacaagagctctgtgatcccgtgtatctgacgcctgaaatcggcggtgttggctgcctggacggcgcgccccaggcaatgattgtgcctggtgaagtcagtgaatgctcgggcaatccattcgaggcgtcagtggtcaaccattctgtcatcatgttgcctggactgtagtccgtgtagggacgataatttatcggtcgtcagattcagacaccgcagatggaccacctgtacattccttccttcgatgaagctccagcatctttacctccgggtggcatagccctggatgatgatagatttgggaacatgttagcatgcgtcagctagactgaaagatcttaggcattagtgtccttgagaaaaacaatgctttgcaagtttcagaaccagcttctgcacaagcacatccctcacttttattcatcttcctaacaagagtttggttttttagtactatgcaatacttgtgcaggttaatgttaactttattgattctcagcttcacagacctatatgggctacggcctttgtgatgttgaagttgatcaaaaggaaagtgtgatgtgataatactttaagggccacgcaaatatatagataaggaaaaaagataattcaccaagcacttccacttcaaatgacatcaatataagagtcaagaaagtaaataacctgaacattttggaatatcccaaacagcaattgaagactctgtgcactcaggtgaacaaagtgcatgtgtgttctcatggttgacgttcatagcaagcatccaggatccaatagtaacatcctcattgctgaacatacggaaactggagaaacatatgtgagaatccattaaacaaacatataacgtgactcgatcgtggatgaagtttaacagtgatgcaaaatgaaaaacatgaatgcaacaacagtcttatgtacgaaacttctactgctgaagcccatgacataaccatgtagtatgtttactttaggctccagggcttctgagtttaatatatcgtgagcaattaatcaataaccacacactatttcccttcgctcttaatttgttgagccagaaaagggaaagttttgctgaaaagaaacaccacttcttttacatgagagggctaaaactaccaagaatagctcagaattgtgggaacaaggctaatatgaaagccagtaagacagcagtaacagtcaatacaacttctttacagaagtatatggatttgcagtgcagtagtgttgctcatgttagtcatacagtgagcggtggcctcaccatcactggccatcaaagcagggaaaccatagacccaaaccaacattgaatactatttcataggctaactggtttgagaaggcaagttgaagaatgctgcttcacaataagataggatgagtactgttaattacctgttgttcctcaaggcaaccaagcttgccaccacatcggctgataaagcgtaaataggcccatatgcatgaaggaagtattctgatccgagcaaaaaggattgtggctcatacctgcatttggaaaaagagcagaaacaatatgataagcagtcattgatgaatggtacatggaatatttttgctgtgtggaacaatagaaagtctgaagtccaaacagcatgtggtatactcagcatatatgccctcacaccatttgccacagcaacatgccttggttatagaattctgtctatactaccctaaaagctaagctaacaactgtcttaaaactataatagcaaagaggaaactgaaaatcacgttggagggaatagactcacaaactgaacactttgtgcttgcaccaacttgtaggatcacaagagtgcttgcacagctaagctagcaatattttaagcacagattcaaaaatgacagctgcactggtgaattggagggtggagcgtgtgacaaaatacaaaactgatgaaggatatatatgattttctttgatcctcgaataatactgataagatgttgaacctgacaaaagtcgttaggattcaggaatcctttatacttacatagttcatccccactaagtgtagttaatgctatttctctcctctcattaagccacatcaccccaattatttctagcctttggatgatagatctataatccaaattgtctcttctttcttctctcttaaaaacatgcaatctcaattatttttaggctcaaaattgtatcaaattgttttagttttgataatcaaattacatcttatttgtacatattatgcaacttaattttccgcagcaacgcgacggagtattcatctagtttgggatacatgcgcattaacatctgaaaaacaatcaagtaaacacgttccttgctaatcctttccttcgccttccaaccctacagatcaagtgcttgctttacacaccatatctagtgtggtctgtgcttaactttatgagaaaccatccggatattgaggtaccagcagttctggttttgtacaatataacatactccctccgtttcacaatgtaagtcattctagcatattccgcattcatattgatgttaatgaatatagacatctatatctatctagattcattaacatcaatatgaatataggaaatgctagaatgacttacattgtgaaacggaggaagtaaacacgtaattacgaatctgaaactgagttattttcagttcatatttatacagtgatgaaatattttttgacaccataaaattattaacttttttgtggaggtgtgagggtcgcatctggacgaaaaaatttctttattatctaatttacatttgcttagcatgagccacgatgctgtatgcatttcttcatagagttaaactttctcaataaaaaaaacaatatggcataaaaggggttcattatgtcatacaagactaaataacagaactgaccatttcagctttgggtcagtaaaaacaggccccttcttcatgcatccaatgtatgtttgtgtatgtgaacgctccttagccaaaagcaatgaaagtctatctgcagaatagatatcagtaatgaaagtgccagccattaaaaaaaatatgatatccaagtcaaaatctgtaagaggatatgtagggcattggtatgcacctggtctcaagtagatatcatcatcagctttaacatagaagtcagagtcatacaatgcatacgcagccttaaagtaagctaacctacaacataagaataaatcagcatctttctgaagaaataacaaaagcatatgataatagttctgctatttacgttttgtacggaagcttgctatactcctcctccagatctaaaagcacgaaatcatcgtattcttgaacctctctttctaaagctgccatcttagacttgtcattactttttccaatcacaaatctgaatgccagaccagttgcttcctccaatctgtaatacagtgaacacaaaaatacaactattgtaatggcagttagccaaaatcaccattaacggaaactgaaatacagaaacagagatggtgatgatcatctctttattaagaatggttggacttttggacaacaaaagtccacttaggctgaaaccgaagcaaaacagttaatggctgctcatctactaggcagcatggagctggtttcagctggcaggccgctttagtcaaagtttattgaacctacgaattaaatatattccggaacctccatgtgcattttcatgtacattgtagacttatagttggatctcacgacataagtactagagaaaaaaaaaactaacaaatccacatgatcaatcccttcttcaagaatagcagcataattcttcctcgaaaacaatgagaacagatggaatgaattaagagcaggtacaatagcaggctataagctagctgtaaacatattttaaagagataaaggaagagagagaagagcagcgggctacagatttgtagccagctacagcacggactccaggacataatgtgtgtatggtaggtgggacattgatagtatagtaagcaactattgtatgaattggctattagattggctatagatgaattagagctagcaatgggccataccaataagcagatctcactaaagcaaatacaaccttatagtgatgagtgatctctatctcatgtttatttgacaacgaaccgtaaaattacatctaagatcatagaaatgaacaaattagattacctacgtactaaaatctaatcagtaactatttccgctccactcccgtaattaggtaaccagcaacatcaacagttgaacacctaaaactaaagccagatctcgagcaacacaagcagacacgaactagcaaactgtgataccagcgactaaccgaaggagaccctgccgatccgcggggagccacgtccgccgcagcgcgcgtcgccgcccgacggagccgaacccggtgaagatcccgacgaaggccatcaccttgtgcctcccgcgcgacccggtggcgtgcgacgccgggagatccacggcggcgcccgccgccgccacggccccggcggacgcatccccgggccggcggtcccacgcgacggagacggagagcgggcgggaggagtccgggcagcgggcgcgcggcgcgctccccggcgaccaggagaaggagagcgcggcggcgaggaagcccgcgaggccgaagaggaggcaggcggcggagaaggccggggtggagaggatgcggcggagcgtggcgcggcgggaggtggtcgccgaggagaagaccttcggcgagctcggcatggcttcggcgaactcgccgccgcgccgccgcgtgggttgacggcgaggcgcgccggatcggagccggggggagacgaggagggggaaggggtggtggtggacgctgggtgcggccgcgtttgctgcttctcctcctttttgttttgagttggtagagagagagagaggggctgtgttgagcccaactggtagcccactaagattcagcccaagatgatttcaccggcaaattttggagggctgtaattcgaaatgggcctagaatttcgttcgaattttatttgaaactggaattgtacgtgatccttctgttgcgtattataaaacgttttcgttttgttctcaatcaagtttaatcaatgtagcaacaagttcaaaaaaaaatgtagcaactcttgtagtacaaaacagatatatctctactattataaaaattaaagttgtttttgcggtattttggtacgtcgttcgtatttgagctgattttaaattcgttcgcttttgaaaatacaaattcgtattttagtcggattttaagttcgtttccttttgaaaatacaaaagaagtcatataagaaatcccttttaaaaaacttgcatgctaacttgagatgaatgttgaactcctaattgcagctcatgattttctagaaaaaaaatatctaagcgaattcccacagtggatttcaccctagccaaaccgtataacaataataaaaaaattataatagcattcacccgttacaacacacgggcatcttttcaagttataaatatatatattattcggtcgtagatttaatgaaagtaatctggtgttctatatgttaatatatttttttttgaaaatctttggtttaataacttgaataaatttggcttgggataggaacgaagggagtatataattattttttctagttgcacacatacaactattatcttctttttttccgtttacatcaaatgcgtactcaagtgcttctcctaatacacgttcagggaaccggagatgaacaacaaatcccaacaaactgaattttattcaaatccacagcgattacaatggtaaaaccaagttacaacacaataattactgtattcgagccagagaaaattgtccgacaaatcaattgcagcacggttacatctctgctagctcttctgccgccgtcagctaagttagcttagctgcggcgcttggtcttgcggtggtggtggtggtggtcgtcgtcgtcgtcgtcgccggcggcggcggcggctttggcgagctcgcactggtcgatccactcgctgtagacgtcgatgggctcggtgagcgcgtgggcggtggtggagtagcgcgcctggcagacgaagcaggaggcctcggcgatcatgtgcttgatgtcgatgctgcactccaccgcgccgccgtggtcgcagaacgggcagctgaacgccgtctccagcttcggcgccgccttcttcgccgtcgccagcatcttcgacacccgagacttcctcttccccatctccgactccgacgccgacgatgcccttgctttcttgcttctgctcccggcggcgaatcgatcggcgaatgcgaaacgattgatcgagagagagatgcatcgtcgaggcggcgccgcgcgtgcttatatcgggagctcttcccagttcgcgtcggactcggactcggactcggactccttcacgaacacggcccgcattaagcaaattaagtgtccaattagtacggactaattaaaatcatttcttccatatcgattttgcaaatttgcagttcgttctgcggctacacttgacttggatcaagagatgatgattaattgattgattattaattaagcctagtgttttcttggtttggttcatgcatccatccatggcggcggcaggtggtgcagttgatcgatggttctagtggtgcaggatgggagggtggcagtagggtcccctgagccagccgccggcgacgagccggttcgccgcctccgtcgtgtggacgccgtcccagcacacgtgcctcgacgggtcacggcacgccgccgcgcccttcatcccgcaccgcgcctcgaactcgtagttgtactccccgccgccggcgccgcagcacgccgtcatcccgctcctgaaccctgcgccgccgccgccgccgccattgccacccccatcacatcagatcacaaccaccaactcaaaccaaacatgcctctccaagatcgattaatcgttaccgaagcgcgccggcgtgtgcagcatctgggcgaccatggtgtagtagtcggcgtacatgatcctcaccggcgccggcgccgccgccgccgccgacctgtacctggcctggagtccggcgagcctcgcctgcagcagcgcgttgtggtggatggccagatcgttgagcggccggaggcatccgtgctcgtcgtagtccgactcgttgctgctccggagcatggtcaggtagagcgggaagcaccccaccggcatcacccccggcaccacgatctccgccgcgcccatcgcaatcagcttctgcaaacgattgcaatcgcgcgcgaaagatcagatcgaccaagaaagtgaacaacattttctggatgattcattggttggttggttgattgcctcgacgccggtgatgatggtgtcgacgatcttgggcgtgtaattcctggcctgatcgacggtgaagccgaagaacagcatggcgttgtagtcgttgccgccgagcgagccgaacaggaagagtgacttggacaagtaggctctgcaacctgatgaacacttagagtaattagctcgtgagcgattgattagctgaagaaaaaatgggagtaattcgatcgatttgaattttgattcagatttagaatttgatttttaccctgtggttgtgtggcgcagatggaggggagaagatggtggaaccactggagctggacgttcatggcgccgttgttccagatcgggtagccgaggccgatggacttgaggaagtcgaagtcgagggcggtggcgccgacgatggccatgttggcgcctcgccggaagtcgccgccgccggcgctccgcttcgacggcggcagcagcggcaaccccagctcctgcgctgcattggcaatgcaggcgaatcttggcatcaatcagcaatggcggcggtggcgacggcggcggatgcgtgtgcttaccgaggaagtcgacgacgaggcggccgtcggagcagcggcaggtggggtggccgaagtaggtcatcccgtacggcggctgcgcgaacgtcagcagcagcgtcgccgccgccgacttgttcacgcagatgttccccgtgtccgccagcgagtccccgaacacgaacatggcgttgtacttgcacctcatcccaccatcgccgccgccgccgccgacgccaccggcaacgccggctgcacggcgcaccagcagaggcagcaaaccaccagcacgctgccgacgacgtcgacggcggcggcggcaagcgcgcctcctcgccgcgccatcactcgcaacgccacagctcagtgacgacgcgagacagtggcatacttacattatatacacttggtcttggttggtttaatgagcagtgacgtcacctcgccgccattgttgctgtgcttttgtacacacgtacacgtctgatatctcgtcgtcatcgttgggctaaggctaagctgcgcaacgtttgcatgttgcaaccgatagaccgggctgggccggcacgacaaggcccatgggccttactgggctatctcggccggaaagtgttctgccgtaaagtaagttcactttgactcccttaactagaggcttaatctaattcgtatccctaaaccacaataccgggatatctcgactccctaattactaaaagagaaagactacacaacggtataccgttgaatggtataccgcttatcccccatgacgcggccccgcgtgccggcttctcccgagtatgtcgcgtgctgctaggattatcatcacgcatgtttgctatgtgtatcagtgtatagtcttgttcctgacagctagctaatacccagcatgcctgtcctgcctttgatactagcctagctattaaataaaaccgaaagtactactagcttgctgtgcatgtcaaatccctgtaatagctactagtagtcccgtaccctagccatgtagggtacttattatggcagagcctagtagcctagctatgtgtttaagatgggttgcatctatttgcatgtgtcctataccatgcatggattagaccagacaaataattacctaaattatatatggatacaatgtattctaattagatatgtcatgttgggctcttggttataccacatcttagaaactctagtatgtgatatatagatgctagattatcatatctgatatccaagtactgggtcgaatacctaggtaccaagtatgaaacctataaatacaagatctgatgccgagttatcgggtctgatacctataagtaccggatccgataactaggtatcgcgtctgatacctatgagtaccagatcggatactcgggaatcgggtatctgatctgatacctatgagtatttgttctaatacctatgcgtaacgggtcgaatacccaggtaccgagtatgatacttatgaataccaagtctgatacctaagtatcgggtttgatacctatgagtaccggattcgatacctaggtcaggtttgatacctatgagtaccagatccggtatctcgtatgatacctatgagtatcggatcggatacctgggtatcgggtatctgatctgatacctatgagtatcaattctgatacctgtacgtactaggtcggatacctaggtaccgagtatgatacctatgaataccaagtctaatacctaagtattgggtttgatacctataagtaccggattcgatacctaggtcgggtttgatacctatgagtaccggatccaatacctatataccaggttaatacatattagtagcggatctgataccaaatatagggtgtgatggtaggagacttcagacgtgataccactaattctgatatttatgggttatatacttctattcaaccatcaaataaaaagatggaccatgcatagctaggccagaaagtacagccaaacttgctcatgtgccgctgagtgcttaattctaacttgctgacatgctttgtttaggctcatgctactagctctagtgcttaattctaactttgctagttgaagcaggtgtgagacccatatggacctaaagaggtgtagaagtagtgttgtattagagtatttcatagctattttgtactgtaggagaaaagagacctctcgtcagtcgtcactagtcagcagcctccatgtgaaaggacagcacacgacatgctttcagagagaaagaatcgatgagtgattggtaagtataaattataaactataccgttgagacggtacaccatcccatagtttttctcttattaaaaccggtacaatttaactcggtggttttcaagagcggtttcgttgatgtggcgtctacatgacggtattaatctggcatgtggcattgactttatgccatgtcaatgccacagaccaggtcaacagtgccacgtggacgtcacgttaatgaaagcatcctccaaaattatcgagggagttaaattacaccgatattaatagttatgagtcgagatatctagtattgtggtttaagcactggtttaagagtttaagagagtcaaagtaaacttattccttctgccgttgttgtcacgtacagccgtacaggagagaggaaattcggatggttattggtggctcatctgggtacacactacacagtattcaatggcgattcagagtactacacggcattgcatcattcaatcatatgcaacctggtagatcgatcagggagaaggcaccgcatttggaatctatatctttactcttcataaagaaactgattttaagccaaactttactctttagcatgtaacagtagtagtaagtacaggcttaaagatgcttaattttgttcttgcagaagagtttgttagccttggacagtaaggtggagaagccaaaataaaaaaaaaaaacagacagaaccaaaagggatcctgcattattttggtttggtatctaaaactggggtgcatgcatcatattcagacttaaagtttggccaaacttctttaataaagaaactgttttttttttccctgtaaataaactccaaagcaacatgcacagtcactcactctgtgtagcatagtttctgtaccagaaaaggaggtgaagcattcattcactagttccatacaagcatgtggtcatgcgatccaggattcctaacttgtattaaagtttttttctttctttttttgagatggcagcaaaccaagttgatgagcttagataagatcttgctcgcatttatgatttcatccggatccagcatgtgcgtatgtgaccatctccaaccaaaccatgcaacaaattactaagatttaattaattaattgcaacacataattaaattgcctcccaatctcatacatactacacaaatgtgcattacctaaaacaaaaacaaattaaccacccacaacgaaaatcaactaatcaccatcttattcatttcccagtcgatcgcaagatgtcttcttcttcctcttgctatccatttttcttctcttcttctgctaaacaaatcaaatcagcagcagctagccggccatcctccggccgccgtcgccgccgccggcgatgatctagggcatgatcggcgggtggcagtagggcccgttgacccacccgtcggcgatctgcttgtacgccgcctccgtgagatggatgccgtcccagctcaacgacgacgacgggttggagcacgcgtaggctcccgacatgccgcacctcgcgccgttctggtagttgtacttccctcctcccgccccgcagcacgccctcaaattcgtgctaaaccctgcgcaaattcatcacaaaaaaccgtcgaattaatcattcataaacttcaaaccatccaagaaaatccgctactatcgctttaccgttccagcagaatagctcatgcgagcatggattcagcacgatatcataggtagcagacctggtacccgtggtaccagataggtaccaagcacgatatcacgctaacgtcataattcgtaccagaaatactacaaaacgatataccgttctaatggattagctgacatcatgatgacgttaacacgatatctaggtactagatccgtacctacgataccatgctaatgtcgtgttgatgtcagctattccattacaaaagtatattgttctgtagtctccttcaattggtacgtaggtgtcatgctgatatgggctattccgttggaacgatattaccgttttgtagtgtttgtgttgaggattttttttttcttaccgtagttggagggggatttgaccatgtcgtagacgtgggagtagaagtcggcgtacatgatgcgagcccaggggtacttgctctggagggaggagaccttggcctggaggagggagttatggcgggaggagagggtgttgaagcgggtgaggcagccgtactggtcgtagtcgccggcgttggaggtgccgtacagcgtgaggtagatggggaagcagccgacggggagcacgccggggacgacgacgtacatggcgcccagcccgatcagctgctccacccccttcccgatcccgtccacgatggtgccgctctgccccgccgcctgctccggcgtgtacccgccgaacagctgcgcgttgtagtcgttgccccgaactcgccgagcacgaacagcgacttggacaggtacgttttgcaagctgcacgcaccagcagat

SEQ ID NO: 42241 - DNA, 28958 bp, Oryza sativa
ggtctcgccgtagggaggctgggtgagcgtcaggccggcgggggggccgttcacgcagaggttgccggtgtcggacatggagtcgccgaagctgaagatggcgttgaacttctggccggagacggccacgaacatggcggacgcaaccgcgaacgccacaacaacacgcgccgccattgttgcaaaggtttagattcagctcgagctcgatgaccaacttgatggatggatgaggcaatgcaagatgctgcagggactccgtgagcttatatacacctcgctaatggtaggttagcacgtagctgttcgccattagcccacctcgagcttaaacttaactactagtctactactgctagtctgctacgaccaccttcaacttactcacctggttgttgtgcatgaattgcatgcatggatgaacagcttttgatttcttttctcgttcatctctctttccctcctgtttcctactctcgtgtttgatcatatcagtatcgaatctttgcctttcttttggtttctacacacttttgatgcaacatcttaatttgtttttgatgtatgtgctttaatttcctttttgcataagatgttttctgagttctgacaatttgctgcctgatcaattgctaacagtttgattagtccctgtgtaatttagtagtactgctttagtggacgcggcaatgtggcttatattttcgtcgtcttttcattatatgcgtaataaaaactgaatgattgaatgtgtgtacaatacatctgagttggaccagcatcgctggtgctactctaggacagtatgtttcataattgaaagtttgaaaagaggcacctaatcatgtattccactgacttattttaacacttggaatagccttttggattgattatttggcaagtacaaatatactaatgcctgcagaacaattttcattttttgtcgaacttggaagtgagtgattagtaaattaagtaggagtactaatgcaacctgaggctgtcgactctgatgaagtatccatgcattctggatgtcactacatgtctacatgatgtctgcttttgcttctcagtagagaaattcatgccattactgtttgagaactgaaaaagatttaatttgggatctgaagaaacacttctccttatttactactaccagcattagtcttcctgaacattgaattgtgtacttgcaggagtggttgctattcataactgtcaatctgtcatgcatggtgttattgacttgcctgtaactgctgaaaaagctttttagtatttatcaagaactttgttaggtaatccaactctatcatccaaaacagcaccctcgctctcatctacatgctgcatgattccacaaacgcattatgattgtcagatagtcattattcatatcagtagccaaaaagttatttgcctgtgatgaaacagaaagctagtctagctaagatagttgcttcatttcagcatcatccagctaaacagcactgatcatcacctcccttgatcctttgtgtcaattagacgtcaccctacctttcttcctcctcttttccaggattgggaaactgctagcaggtcaagcagcattgtcagcaacagcatgagtctgcatctactatcccaaaattatgcgcatgatttatatagttaaaaagaaataaaaaaatatagttatatatgtataccaactctataaagatataggggatgctttaactttatagggaagaatttgaagtggtggttatatttgtagtacttgaatctccattgatgcctacacttcaacataaaaaagtagggcacaacaactccaattagttcagtattgggcaaggcagtgacatgcactggctattatttggggataggttggatgccttgtcaattctttgagctaacttggcactggatgagtggatgggccatgcagtcagttattagccaaagtgtgagaaaactatgtttcttttttcttaaaaaaagtgtaactgattaactgaagcatcagttagtcagactgtttgatctaatatcaaccatcatctgctgtcagtttgtcacagttttgtcactcataatgtgtcaacctcagagaatggattaagctgtgacatatgttgtttgttcagagttcaggctaatccagagagagaaataatatgccattgtgttaccatcattcagatcaacatcttgcaacaatatatcatgcatttgctgatttgctttgcatggatggatgcagataactccatcatgcatgtgacatgagcaaagctcaacaactactaattaatttacaagattatccacatgagacctctgtctacaagaccaatgtcaaagcacatcttttgacaacttcgattccttattcctctagctgtcacacattcccaggaggaaagctcaattagcatctaatcagtggatcactgtatttgtttaatctgtcagctgtaattatctgcctgctaactcagtactactccttctggtttcctaataccaaatcattaacttttaaatacacgtttaatcaacattctcatttaaaaatcttatacaaatatataaaaaatatatgtcacatttaaaatacgtttaattataaaaacaaatcacaacaaataaatggtaattacatattttttaataaaacaaatttttggataataaaaataaattacatcgtcggtttttattataagacatacaaacattaagtttttttaacaaataaccaatcttaaagttaatatcatcgtatattaaaaaacaaaaaatatcatcgacgaatcggatgagagaagctggcgagtgtggtgtagtactagggtactcgcagaaacgtctcgtttcgctaacggacaagcgctccagtaccacgaactgctgcagcgactcgcagcgtggacttgatgcagagcaatttgtgcaaaatggccgtcgttttctgcggcatctgatactgtgttttgcaagcgaaccttccaatgtaactaactcactctctctctctcctgctaacaactcaatttcccttttctaacgccctggtttagggtcgagttgaagcaaccaaagagctttggtactctgcctgcaatttgtggttgatgctgaaaatgagatgtctgaaactctgaatattcaggtataaatatgtttgctagctgcaatttgttcgattaagagaatttaattttaccgatctcgtgaagtagtgtttctactaccaatagatactactgtaaaacggtatacctttttggtggtttctagttgcatcgatctaatatgttttgttttccttaaaacctttagctgatgagctttcctctgtccttccatgaatcattgcttaatccaccgggtgacatgttcacatcatgagctggagaattgaattccaatggatgatgcatggatgcaaccgacgatccatcgatcgagacggtactaaatggagaatattagtgcaatacgtggttagctgcaacgacgtgcatgcataatgcattgcatcctgggagggtacagctttgtgtacattgatcataagataatccaaatgtaatccaagtgtccaatagcctcacagtttcgatcgaaattgacaggttgaaaaatagcaagagcaactcatcactcgcatgatgaacgtgtagtgctatcgatcaacagtcggcacaaattggggcggttaatgtgtcaagttcagagatgaatctggcagcaacatgttacctacctggaagcgacgtccgttgattaattaattggtttatttagctttaaggttgatcctatcttacaggacaaaaatggacggttaaccgtttgagaaaatctataaaaagcaatcgattataccagaggttcagtttatggatgcatctgagaaaatctggacggttaacagttcattttccgatcagacggcataagttcttctgcctcagatggtcgaatcagaccagaggtataaaacaaatacactagaaaacaatgttattttcgaatagctctaataatctgaaaagaactcaaatctgatgggtgcaatcaaaccctgaagaatcgaaccggacattcacgaagaagaaaaatcaatgcgagatcgcccgagaccgatcattctggtgaaagtacattgcatttacatcacatggatggatggatggatatccatcctgcagagagcctgaaacctgtagctgaaggaggtcgatctacagactacagctgaggctgcaggaccatggttagctgggtgtccggcacacagtggtttcatcacttagaaagttcacagggatgcctgaattgctgactcgataggcatcataacagctgagattaattgtagccatcatcatcatcatcatgccaggacaacccaactaactgttttacatatgtgttcttttaactctttttctttcagcatgttcagatcagtacttcagaccattgtcaacgggagaaacagggaactaatctacatcaacattgtttacacatgtgattgaatgctttgcagagagcagatgctagttgctatctcatttttagaatgtaagctggttcggttttgttataagtcaaactttttaatttaaatttaattaagtctatagaacagacgtaataatattttaacactatatttaataggaaaaattgtaaccataccattataattttgtaaaatttgagatatgacatcctgacccacatgtcattgactcatgtgggttctacatgccattgagataccgatgccatatcttaaactttgaaaaattataatggtatggttccaaattacctatttaataagtgtctgaaggaaacgatggacttaataaaactatttaagtcatgtagatgtcattacatttttcgataaattcagtatgaaaaaaacagaatatcatcttaccttctaaaccggagagaacagtagcagcaaaaacaagatgggccaagctaatgaagtaaagttatacaacgaccaaaggaaaaggattaaaaaaaagacaataattgcttactcctacatggatcatggatgcatgtaggtgactgcatttctgttggaggtttgctgctgctgattgatgacgaagtttgattcaacttcttctccttcttcattcggcagtcaacatatatatcagtcatcagtgcagacggtcggtggatgcaggtagctgtgctgacagtgtgtatagtatgtaggtgagttggatgttttcagggtcactgcaggtggtgctcgttaaggcttaaatcaataattatcgatcgcgtacacgtaaccatcagcttttgcatggcttaacatgcatgatgcattattacgggtataaatgtgtaatcagtacatgtaattagtcaacacggctagtatttagatctttgtttagatcatggaccatctatgattcagctagctaacctttggtgctctggagcagtgtgcgttgctttcagtaaaggtaggcaggatgttgattagtgaaatgtatgtatctgtctatatatactacgcatataaaatactgcatgagtttgtcggatttgtcattgtagtgcgtacgtttgattaatttgatgttaaaatcaaccatatcagattataatgccgtaatttagaagtatgcaggttatttagttgtacgcttgatttgaagaaaaacgtcgaacggagttttatcatttagtaaaaaataatttattacttactaaaaatatttcaaacagatgcaacattaaaaatactaattgcaacactaaagtaaccactgcatgcaacatcgaagaaaaccgacactacttaaaaacaaagtgtttttcctgacggctactttgcgttctctatgacggccggcgctaccgctagcaactaaaggccaatgaaaatgaaccatctttacaggcggaacttcaccacagttaggttacgctgattgttagggaaaatgatttttgatcacaaaataaaaaatcacaaatccgatgcctggccgccaggaaaatatgattttcgagcgaaaaagttccgcaaatccattgttgtgcccggctccgccgctggatgcgccggttgcaccccgagtcatcgctggatccaccaccccaagccgccggatccacagtccgagccccaagctgctgcctgttcgccatatgtgggataggggagggggtggaaaagccacgccgaagcccagacatcgcgttgtcaagcaccgctaccgccatattcgtcccctccaccgagcaccgctgctggagagaggtgaggtaggctggtgtgactggatctcagagagagagaggggggtgaggaagacattggatttagagagggttggagaagaggccgcagcagcggcggtgggtttggtggtggcgggggaaagggaggagcgagggagaggagggttggtggtggccgctgcaacgacagtggtaggacgtggtggaggagagggagctgggtcagggcggtgacggatctgccgccgaacagggtcaccgctggttgtggatgctgccacccatggggaaggaggaggagacaggcgcgctcaagctcatagtggtgccgatgaggaagaagaaaaggtaacggaggagggaggatgaagtaaaggagaggggacttaagtatcggaaattttttttaaaaaaaaaatcaatatagctatttaaaacaactgttttataatttattttacataataaaaaaatagtttagcagtttgaaaaatatatactcaaggaaaacgaagaatgaagtattgacggtaccaaccgccacaaccaagataggggtcaaatggttgcacgcccagctcagccaacccattccaaaagcagaatcgtcttgttaggcccagaccgctccactgtcgacgtaggcctcgtcggccgtttgctgttgtactcggcacaggtccaggttcacatcaacaatcgggtatacgcatctgtactggtgccattgtgtttggcaatttttttgtctaatcgtatctcgcgttccagtattaattatcagccatccgtcctcgtgtcgcaaaaacatgatagacatgcagtttaaagtgtacgattatgtttacagcttatttgaaaaaaaaatgattatgtttacactacagtgacgtccaggataatggtcaaaggcagcatttgtccagatcagcccagcccattccatggtatcttacctcaattacaaaataagttcattttaactaatctcacatatacaaatacaaaatctcaaaaactagaatattcatattttatcaaatcccaatataatttctctctgtccaaaaatatatgagattttggtcggatgtgtcccaatctaagctagactcttctgttcagactcgtagtataggatgtgtcacatccgactaattttttttattccccttaaaaaaatcttttgtattctaggatgggtggaattttgctcactttatctactcccaataaatcattccctactttcataaattcctatgcaatagttactccgaaaatacactagtgtataactttgagataagcgaaggaagctactccaagtcataagtacaaatgaacttagtatagaacgaatgatacatactgaaataaagaaccgcaccaagcgatgaatttttttaatttttaattttatttattaaaatatttacagaaataatttttgatttgaaaattttacaaaactagtcgtccatcgccctctgggagagcgattttactaacgtggcagaaagccgatggccctcctgtaacggttggccaccgagggatgggaaatttataggcggcccccttatagccctctgggagggcgactttttactgtgcagggtctgcctgcatagtagaaaatcgtccacccagagagctaaagggggccacctgcaaaatgtcacctcctcccgtacagtacaaaatagccctcctagagggcagtaagggagctgcctgcaaaaatgccaggcagccctcttagctcttttgcaagcggccctctagagcaaaaatcgccctctgggagggcgacaagggggcggcttgcaaaatttcagcgcccttggtggctgaccgttatgacaagccaacagccggctaccacgtcggaaaaacgctctctgggagtgcaatttttcccagaaagcgatgggcgactagttttgtaaaattctcaaaccgaaaattatttctgtaaatattttaataaataaaattaaaaataaaaaaaattcccaagcgatgcatagcatgacccatcagatccattttgttaggcccagatcagaccactccactcgtctacgtaggcctccttggtcacagcggccgcccacttctgcccaaatcgcatgtcccgtccaggttcaccgccacaaaccggccgggtggacgcatccgcactccactccactccactccactccactgcacgccaacgcccaagcccaccaacccaagttgagtcgtggcccccccttcgccctctcctcgggccggtccacttttgcggccgcgcccgcgcaacgcggcctctctcgtgacgcgagcccgattcccccgagccactgcacctgtacccgacgcgcgacgcggcacaatgcccgcctcacctgcacgtacgccatgcctcccacccctccgccgctccgcgcgcccatgtgtccaagattccggaaccgacgacgtacgtcgacgtacgtgagccgccgccatggattcgctgcctatatatacgcacgcgatcgagctgatcgatcagtgtagcgatctacgagatgaggccgtcgatcgtgctgttcggggactcgatcacggaggaggcgttcggggagggagggtggggcgcgcacctggccaaccactactcgcgctccgccgacgtcgtgctgcgcgggtacagcggctacaacacgcggtgggcggccatggtcgccgcgcgcgccgtcgtcgccggcgcggcgggggcggcggcgccgccggccgccgtcaccgtctgcttcggcgccaacgacgcctccctccccggccgcgccagcgcgctccagcacgtcccgctcccggagtacagggacaacctccgcgccatctgcgccctcctcgccgccgcctggccctccgtcgtcgtcatcctcatcaccccgccgcccgtccacgacgccgcccgtgtccggtatacacaatcgctctcatcttgcatcaattttattggttttctcgatcgtcgaacacaatgcaagaatggatcaccaatggcgcgccgccgcgcgcgtgcaggtaccagtacggcggcgattgcgccggcttgccggagaggacgaacgagtcggccggcgcgtacgcgcgcgcctgcgtcgaggtggcggcggagtgcgggctgagggtcatcgacatctggtccaagatgcagcgattccccggctgggagagctcattcttgaggtaatcaaatcaaagcaaatcaagcaaacacctcatcaccttgttcttgtgatgagctgctgagagcaagtttagtactgtagctaactactagcctcaaatcacgttaacaactaatttatataataattatctataaacatatactacattattaatatatgatcccacctatcatatatacattatgttttggagtccgtgtttcaaatagctacaaatctgtagtttgccttttattttctcttctattttctcttctcaatatgtgtttataattggtttatagtttactgttatacccgctctgatgaaatttggcgcgaaatttgaagggacgggctgcacctgacgccgcgcgggaacagggtggtgttcgaggaggtggtgttcgcgctcaaggacgccagccttggcctcgaagcgctccctgccgacctgccgctcttctgcgacatggatccaaacaaccccgtcaagtccttcgacgaatgactcatcatcgcaaaaaattcgcattactgatttgagaaagagaatttgaattccttttcgttgcgttttttttaatttacggtgctatttgctggagaaatgtttgaggttataaatgtctcggttattattgttttgattctttagaaagattggatgaataatacatgtatcgaccgtattgtcatgtaatgttttctttggacaatgaaattcaatacacgatcgagctgagctttttttaagataagagctcctgcttacgggccattacaacaagttcagaaacaatgatagcaacacacggctaatggtgaaggtacattgtttaatttggtggacttgcttgtaaaccgttgcaacttttgtcattctgaccatttcatggatacaaggattgttaggagaaatgaacagcccataatatgtttttttttaaataagggaggccagaggacttcgccgggcagaaacaaaccaaataaaaaaatattggtacacgctgtgaattggattaacgtccaaaatagcctaatcaaatcgtttctcaattcatacttactccctctatctcaaaatatgttaaccaagaatgtgactagtgtcagacgtaacgtagaggcggagaggtctttaagcctccactgtttgaaccatggaagcactccaaaaaatatatatatattgccacacctccattgaaaggcggggcttggaccttggagctctattttagtttcgagataattttgttcttgtctccactttgatgtctaatattgattttgcccttgttttttagggttttcgtttttacccctacttttttgaaacgaaacaactatttgccccagttccattaattcttactaatggtgttaaatgtagggttaaaaagacaattatacccttagatattttccggtacttttgacaatcaaaacacaaattgataccatactatagcagtaatttaatttgtcaaaattttgtgaaagtttgccaaaattccttatctcaaaatagggcaattgtgcaagtggtgtacagaagtatcagaatcgctctctctctctctctctctctctctctctctctcctgtcctacccaattcccaatcttgctctcaagccgtagcactcagcatcgcagcggccgggacaacggcgacgaggcagcgcaacgcaacggcggaggaggcgatgaggcgtagatcccccccaggtggaggtggtgaacgattgaccgtcgacgatagaccggcgatgcgccgaggcgcggccgagcggagccacaaggcagcagagacgacatcagggccactgtctagtgtcgaaggctccaagtccaagggggaaattaatttcaagacttcaaggtacataaaatttgaaatcaatatcaagtccagttgtgtggtaatagttaaagttcagtgctcagttaaaatttgaaatcaatttcaagtccagttgtgtggtacggagtaatagttaaagttcagtgctcagttaaaatttgaaatcaattttatgcttgatttaatgctttctgttgctactttgctgctcacatctcaccaactgagtcctataacaaacctcactcatcaaatccaatgatccagaatcatctaatccaacgctttagatcgtcccacgttacccctccccctccgcacgcacccctcctctctcagatcaatttcaatcgcgccgccctcctctctcggtcactctcctccccctcaaccgccgccgcatccgccaccgctgcctccacgtccccgatccacgctgcgccgtcttctacgccggtcgagatctccgccgtcgtcgccacgcacagccacctgagctgccccctccgaaatcgccataccctgcacctgagtcaccgaggtccgcgccgccaaaactccgtcgcgccaaccctccatccgctatccccgtcgccatcggccacctcctctacggctgtccctaccacgaagactgcctcctcctcgcttgcatcgtacatttgaaggtttccgcctcctgattctatccccgatcccccaaatctctaaccccaactctttgcagttcaacggagaaggccggtgtcttcttggtccttccgttctgatctccattcctttactccaattcccattctctgattttttttctttgttatttgcgtgtgagggtgggcccaccagtgattcaagggtattcagacgtatacccaagatttttgaaaaaaaataagtatatatactccatacctcgtatatgtattaaaaaattaaagagaaggctaaaacttctcattttgggtcctgttttaccatttcttctctattggatctaaatttcccacttccttccctcccctttcctctcagcccacactcagcttgggccgcaactagttcatttcccctccccgcttaggcacagcaaacccaaatcgggcaaaccactgaggacgtgcgcggtgcggcggcggcgtctgggcggcggcgactgcaccggctgcggcggcggctgccggctgcgtcggcggcaggcggcaccgaggcgagtaggtagcgcgtcgggtaggggtgggcagaaaaagaccgaaccgaaaagaccgagaccgagaaattcggtcattaattcggtcctaggtagtgaaagaccgaattttgttcggtcaattcggttagtctcctcggttaaccgaatggaccgaaaagaccgaattatcaaaaaaaacgtctaaatgcaacatacaatccactatgtttaataggattaaactctaattttcacatccctacttcttctaggcatgcaacctaacaagagtctttactcataagtgcttacaaattttttttttgatttttgtgttgaaaattttcattatttctttgcatatatgaaaatgttcttgaatttcggtcaagactgagaccgagacggaatttgtcggtcctaacattttttttcgctgaaattcggtttttacttttcaaagaccgaagacggagactggaattttcggttagaccgaatgaccacccctagcgtcgggcgtgcggcggtgactgcagtccagtctgcagcgtgctcgtcggcggctgcggcgtgcgtggcggcgtcggcggcaggaggcgccgaggcgtgcaggcggcgcgtcggcggctgcggccgtgcggcgtcggggttcgggccgtcaggcgtcggcgcgtcgccggcgtgcaggccgccagtccgctaggccaccacacaggtacgcgatgcggcggccgaacgaccacggctcgccggcctggcatggattgcgtgaggggcttgattcattgcattgatttgttctaggtagttcaatagtagttatgttttctggcggtgacggcttgattcattgatttgttctttagtagttcaatagttcactagcactgaaggattcaacttccttagttcctgtcttctttatttttcagtgtcaactgttaagtgtatatttattgacagattgatagtataaagctgtaaatattaggaatttagataacttagaaccataatatttaattttcggagtgtaaaatttatatatatgatgatagtatgaggctatatatgagctgctgttaggaatttagagaatttagagggggtgttttcttcgatggactatataaaaacaagaagcaagatgagcaacaatctacattcattggaagagaattctttttacaaggtaaaggatgaggacatcatcactcatttttaaaataccaagcatcgaaaagttctcctctaaactgtaagagttttttttatcattttaccattctccatcctttacatgttttatatgttgccactttcatatgtcgaataattagtacttatatatgttaaagaatttggacttatgatcaattctaccaatttataaagttatggccaattttgtgttctatatgctataatattatacaattagtaatgtgtgatattataccaattaattattggacttctggaggtaaaaagaattttgttttacccctacctattttgaatacccaacctctaaatcttaggcccaccccttagatatatgataagttcatttttgatgttcttattaaattctcaaaagtcttagcattgatctgaactctgatgaacatgttttctatatttggctttgttcaaaagattgctacctttcagaaggcatcttgttatcaggtagtgattcacctaagcatgttgctcatggtagctaagcatgttaccatcataattgtaattcagtacgctcaactgattctatgataaataatgaatccatttcagaaatatataataataatatatatctttgcttggatatttggttttcaagatatttcaacatttgtattgccaacatatatatccttttcttttaattgtttgatttacacgcattacgatattgtgtcgttgcattagcacgtgcatgttactagtattattctagtttaagaaacacaaataatgagattgcaagtcagccaaagaggctagagcagaagttagtcatttggatataattagtgacccagggattcgaaaaccaattgaagattatccacgtgagcatcgcattatctattggagaattgttttgtagggacaaaattgcttgcctatttttaattttatgtatgtgtaaatgtgtagccaatttatacatgaaacatgttaatttttttctagattcacccttgttttcagccgccatggacgcggcggaaggtggaggtggcggccgaggctggggtgacgccgtggttgcgctgccgtcgacatccgcagcagcaatggagggctgagagagggcgctcaccccgatgatagcgtacaaaggggaggaagaccttcgacttccagagcggccagggtttggttcaactggaagggaagtggttgtcaccaccaaccacttccatgttggcgtcgagaacgccacaatctatcagtataatgtaagtttcttcctcacagtcgcataatattctactcatctttagttcattttagaagcattcgcttatttcatactactactaaataaatcttgattttatattgaacattcaaagattcgttttttaataatactagttgggtgcccatgcgttgcaacgggcaaaaaaaaaaaactatacattaattttaaattacaccaattgaaatgatgggaaataatcattgagaaattttaatatagcacaaacaagaaatatgccataattttatagtcttcatatattagtaacacaaagagcaaaaatggttgaataaaacgctcgtaaggaagcacaaccatgtatgtaaatatttcaaatcatagttgtggttcaaattttattgtattggccgtaatcgtgaaactaaatagacaaaaccatccatagatatcacaaataatttttttttccaaagtcttcttaatagattgtgattttagtaccgacgaagttgactacaaatcttagtacattccacaatgtgataaattaatttttgagcatttttttccactgacttcatgattaggtttctatgaaccccgagccaaaatcaagagctaaaaaaggagaggtactttcagagatggtagagttgcatgaggagatgacttatgactgcaaagtgcttgcctaattgatccaggctgcttatgggcctctgccttctgtcccaatgcccatgacactacaccctccttttgagcagctcatcctcaagctgcaacacgatctttgttggctgagacaactccctaaacaaggcctaacatgactcaagccatgcagccgctgcacattgcttcaatccatccgcctctgaaaatcgtgccgatgcatgacgaaacaaagccatctcacctggaaatcgcgcccaaggttgtgtcagccgttgcgccgcaatcaccgcagtcgttggtgctagaggttgtgagccctaagaaacggccctgctcgtggcatcaccctgcatcgcggtcgccgacgacgacgtcgttgccaagtccaacgtcgaggttgagggcttcctggacctggccgttggtgacacgaatccacctgcctggacaacttgaagtgacgtggacacggtagtggttgctgatgccgtgtgacgatgaccttcgtcagatttgttgtgtctcctgcttcttccagaggtcagccgccatcttcgcccgaggcgatggtgccacagccggccttgtcatcattatactcagcaccatcttctgctgcactgccacctcttgctccatcgcgaaggctgccagcgggaacggctgagttgaaggtgcagtggtcagagatgttaacatcgtgtccacaacctgagtagaacttgttgccggtgccatgaagtcactagtcaagccatcgccaaacgacgtcattgctgtcctccttgccgaagaagaatgttgtccatctttgcctccaagacatccagcatctctaacttgttaaggatggccgtcagcttgtcatcgatcgacataaccacaggcgtaggagattctaggggtggggaggggggaggggtggggggaggttcttgtcaggttttgaaaattcgaggggagagatgtctggttttgagtttagaggtgttatttgtactcacctaatagttcgggtaattcgtacttttctcataatttaataatgtacatcttttgtgataaaaatgctactatatactctctccgtttctaaatatttgacgccgttaatttttttaaatatgtctgaccattcatcttattcaaagaaaacaaagaaaacaccacattaatatacatattgcggagagatacactattatcgtctgttacaaacttggtcattcttgtccttttaggccttcattactaaatacagagatgatcaaaccatttgtgtataatacgaagcatagctaatcttcttcctttttgaaaggggaagcatagctaatctgattgttcaaataatggcgaccacttggcagtggccgaaatctcaagaccgtccatacaactagaacagcctccacttgcagtagaactcccctcgttctgtggtacaaacgacatactcccaaacaacacatcctcagtgacatgctcaaggagatcattaacaccaccaccatgactaaagctcttatcatttgaagggctgttatacgtgaagaagcgaagcaacagaattccatcaccgtccacgcataatgtgaccgggggcaacttgccaacgctcaacttgccgtcaaatatcatgaattgtccccactgtacgcagtaacctgcaacaactgtaagtgaatcaaaacagttctctccgagatcgagtacctcaagctccaatgtgcccagtactgccttatcaagggcaaccatctccagagcaacagtgccacaatgaccagtgtcgatgtgccaacggtatctatgaagttctgaatagaacgatggggcatacatagaatgcccgtctatcaacactttatcgtctttcctttcttgacccttaatgacaaggtagtattcgatcaacataggcccaactgcatatatgcctctaggtggccaaattagaggccgtatcttattagagccctgtgcagtaatttgtgaaagaaacatcaaagttattagacatacgtgcatcaaatgttacaagaataaaatgaagtattaattctagtgcctaatcatctggtacataaaacacttgtcccagagataatatattggtgttttaaccactaatccctccatttatgaatataactgttggtgtctattactattttgactctgaccgcaaattactcttaaatgattagagtttgatgaatgagagcttcacgtttgtatatatttaagatgccatacactacgaaaatatggtgtacttttttttttctttttgcgacaagtggacaaagttaaaaaatgaataattcccaatgtcagttatttcaaaaaggagatagatttatgtcaaagtttaaagagcacaactacagaaaaggaggggacccttttaagacaaaaggtataaacaaaacaaacttagtcatgaaatctctcaccggccgaagcttatatggtttgtccctcgagtattgaaagacatgattacgttgttggttgtttcgtacatctctaaatgcaaatataccgtagatctccattggttcatcatggggggacgatacattcaaatcatacacctggattgcacgccgacaaggttcattcctgtggttgtatccatttacccaacgatttttccactttggcagctggggcactgcaacaggatttcaataaactagtattacagacacaaacaccgtgagtcattaacttgtatcctgcattctaaacattatacaaaatctgtaatcaatatttgtaaactatacttccacatgttatatgtaaagatatagttcaaacgtaaaaattaagttgttcactagaaataataataactaaatggacaaaggccatgtttggtgagattgagagatcctgggtagctaggtaagaatatggataaacaggggctgcctagcttttggtagctactactaagtcttagaatctccagcaagcatctggattatttgagagaactggatatgaagctctcctaaataggatctaaaaattgaaggaaaaaaaactatatatgatcatttgtgatttatacaataccttgcttatataagattaataaatactccaattatttactagaagatgtagcatgttaagacttacatagatgctccgtcgacaggatatctggatccaaatgacatggcccttcaacatgtagagacccctcaaaaataggacaaaagaaatcattttgtcgttgctttgcaattgatactgtgaacttcatttgctccataacctgattctcccatctctcctccctctcagcagcgtagtaaggatttccatcctcgtagcggaattcataccagtatccgtcgaaagaatcgcattcatctggatcaaccgagaattcactttcggactggtaattatcttctcgagggcaggcccagcctggaagtgtcccttgccattcagattcttcattcagaatagagtccatgtccttgccccagagccaagtgttgagcacctcacgctccaattcctccctcatcatccccaaatcccggtccaaatcgtcagcctctttctcctcctcctcctgctgcgaattcccgtcaattttactaaaacctactcccgacattgattcttggggggatttcagccacaaatcaacaagaatcgcgaagcgggacgggaccaaaaataatttgaatgcctaacctttcctccgtagcttgttggccccggctgctctacggattgggattgcgattggaaagaagcatagcagcatcgagtgtgtgtatgtacagtacaggagcaaatcgcttccaacacggactctgactctgagatgcattgcgaggcggctagggttttccttcctttcacggacgggaaagcagaggcttttagtgggcccagcccagcccagcccagcccaagcccgtacaagctgagctctttctcattgggctacatctcagaaaggcctgtttctgagactcggctcggctcggagccgacgtgcctccaccaccactcgtcgcacgagcttggcgaaggtggagggagtggctcgtgggcttcctccgcggccgacacggcttggcgggtgggcgggcagagccgcgtcgggtagcctcctggtggggcggagccacccccagctgcaacggccccagcctcacaaaggtgacatagggtgaatctcagccctagaaagtaaatccaatggctaagattcgtccacataatcacgagttaaaattttactcccaatacctgaaaatttactcctagtaaaatttttactcctaaataaatctgcgagtaaaattttaactcatgatgacgtggatggatctcagcagttggatttgttttggagggccgagattcacgctatgtcacattgtgacatgcctaccttatgtcacccaatcccaatccgagggagagagagcagtggaactgaggaagagataaggtggagactaaggataacatgtggggcccactttcattttttgctacatcagtgtctagtcagcacgagtggatcgggtcaaattgttacgtcaacaaaatcagatgtatatactgctataggatccaaattggatggttttgtatagtttaggggtgaagatttctggtattgaggataatggatgtcaaacaaactcagtgtaaagttgagtgacggcaggtgaacttatacctttacttgggcatcgggttgcaggaacggaagaggaggaggaccaacaacgcttcctcctcaagctcatgccttccacaaggaccatcatcagcgtcatcggtcggtgttcgcgtccgagctacatagcggcaggcaggaggcggaggctgacacccatgacgacgggttcgctggaccaccacaaatttctaaggctctctgatcaagagcccgaggagtaggttctatgtgagttttatttttttatgtcacgccatccaaaactatactcaacactgagacctaatgtgatatgattttataaggttatggatgtgttatatccgatattttgatttatgggtgattttgaaattcgacgacatggaacataaaagtgaacattttctttatcccatgtaaatagttaatatgggcagattgtcgtgaaggccgcctacattaactgggtgccaatgcaaacatcgtaaaaatggcacaacacgtgtggtcaaataatttactcgggcagtacttctctatgtctgctcaggtaataaagtatttttcctttataaaataatctccataaacttaaaaatcttgtagaaatttgaatttagatccgattgacacggtgagcacttctacgtgatccttgcggtattccctagctttaaaacggcatgctaacaacttgtcatggctacctcttttttcatttggttcttcacgggcaccggaatttccgtatgccattagctgcagttggagcaaaaaacacccatgcaaatagcacatggccttagacgccatccaacgtctagagatggtgcaaaagcaaaggcaacttacctccaccgagctgagcctaagaaccgccctaaaacacaggctgctagggctggcagtaatcgaaagagcaaggaaaagacatgcctcaagaatcaccaacatcaaagaagagggcaccaataccaggttttttcacttaaaggttaacgcgaggagatgaaagaaccacatccattgttttcacacaaggcggatgggcggtgacgcacgaggaaaaagagcgaaatgatatttgatcacttctaggggataattggaagacctagtccaagacaacggagttgaattgggaagcccaagagattcagccctcgatggaccttgctgtccaatctgaaccattcactgaagaggggatttggaaagccataaatgcaatgcagtagacaaagctcctggacccgacggcttcacggtcaatttcttcaaaacctgctggggcatagtaaagcttcactccatccatgatcagagatgcaatgatctaaaccttctcaactcggctaatactgttctattaccaaaaaaggaaggcgtggagagtagcaccgacaataggccaataagcctcatacacagcattgtgaaaattctcttcaaggtgctagccctgcgacttcacctggtcatgcaatccctaatctcggtcaaccaaagcgctttcaaccgtggcaggagcatccacgataacttccattatgtacagaacatggtgagaagatgccatcgcaacaagagcccaactctattcttcaagctagacatttccaaggcattcgactctgtgtgttaggcttatctgttggctcttctacaacagtggggcttcccgcagaaatggagggattgggtcgcagccctcctctcaacctcttgctccaagatactcctcaatggggtcccaggaagtaaaacatgtcatgggtgtggactacggcaaggagacccattatccccgcttttctttattctagcaatcagcccactacatgccttctgcccgaagccacatacctcaatttgctcagcaagcttagggctagggtcggtcaccatgcctctgaatctcaatgtacaccaacgacgcaacggtcttcatcaacccaaagaaggacgatgtagatgcattcgctggcctctgtgaatgcttcggacaagcaacagggctatgcaccaacatacaaaaatctcaggtgaagccaattaggtgtgccagcatagacctcgacgacttgttggaaagcacgccgacgaccagagcaagcttcccaatgaaatacctagggctctccctagccatgacaaggctacacaaggcagacctccagccactttttgacaaatccgcaagacacctagtaggctagcgaggaagaaacatagggatagggggggaggggaataacactagtcaagtcaatcctcacgtcagcaacctgtctactctggacaactctaaaagttacgaaggaatcccttgaggtgcttgacaaacagaggaaacggttcctttgtgcaggggccgataacatcacaggcgaaaaatgcagggccaactgggcaagaacttgtatgccaacagcttatgaagggctaggggtgttcaacctagaaaagtttgcacgagcgctgagggtaagatggctatggcatgagtggaaggccccaaatcaaggagaaagccaaaacttgggtctcagcaggagcaaaacaccttgcgcttttaattccttaggctttgccattttttacagttctttatttcttgtaaatgtaacatttactcctgtgctggttcgttaaaaaaaggtatttaaggataattcggttataatataaccacggtcatctttgcaaactttattactaccacaaccataccgatagtccacatcgtaggctccagctcgatgagaactgaacttggctcaattacaacttatacaatagctcaccacaccatacagctcgatcgattagcttagatggtgtttgggtgggaggggctaaccaatttcctaactctctatatgatagacttatggcattgcgagagggactaaaataagtcacctctccctctccaaacaccaccttaattagctgcgcacaacaacacagtgaattaattagtagttactaattgattgattccacgtagggagttggacagcctcatgcaaaattcccacaggatcaatcaatggtgctgaggatcgggccccccggggctcgacctcttcgactcggagtacggcatcgccgccgccaccgccgtctgcgagctgatcgtagtggcagtgttgctcccggcgacgacgagcattctccgcccggtgatcacggccagctggagctgcacatgatcatgatcaggctcgccgcgcgagacggcggcggacatgacgacgagcagcagcatcagcacgacggcggcgcgcaccagcggcgacctcaatgtgctggatgaggagtaggccatggaaaaagctagaggtcttcttcttcgtctaatctcctagcttagcttagcttgagagtgagctagctgtgttctcaggcgcaggttgcaatggcatgcatggtgctgaatttatagctaagctaagctgatcgagattcgaggggcagtttccggccgttaccgtgagcactatcgagctagcgacaggtgtagagagtgatgggtggtggtgatataccggaagtggatttttgtccctagaggagacattccctcgttttgtgcataatgtttaaatagttattaaaaaaatttaaaaaaattgtcaagatatagattaatatatgatatatcttttcgcaaacatgtaagttaaaattcgacttatacgattcgaaacaaaaataataaatttgactgtgaattacgctttctattcatagtcaaattttttgtttttgtttctgcttgtataagttgaatttgaatatgcatgtttgtgaaattttttcaattttttttatgactctttaagtgacaagtaaaaacgaggggatatccccttaaggatgaatagagttttccgtgatatacctctgtggcgcactgatctctgccattcatgtcgacgatgcatgcatatgacctcacacacaaaaacggctcaacttttcatttttaattctgccttaacaaggcagtgcaaaactgtgatccaatacaaaatccaatgctatgcatgctgagatatgatcgattaatgccattatcatttctgttgcatagtgatcacaataacttaagacatggatgcatgcatggtcccttcttgatatatagtaagatttttagggggaaattttatgagcatgttgcacgttttagtgggcactggcggttgtttagttttgtttggacaaaaaaggaaaaaaaaaaacacaccaggccgttagccaaagcaactgccatttatcgttatgaaatggccactatatatatctatatatgttcattaattcataagctagccaagtcagctcacacgaatcagcaagcaccgtgatcttcagccggatctcatttgcttctggttgccacaagcatcgatcatcaacttttaaatacatactccctccgtctctaaatatttaacgccgttgactttttcaaacatatttaaccgttcatcttattcaaaaacttttgtaaaagatgtaaaactatatgtatacataaaagtatatttaacaataaatcaaatgatatgaaaagaattaataattacttaaattttttgaataagacgaacggttaaacatgtttgaaaaagtcaacggagtcaaatatttaaggacggagggggtaatggagtatatggatatatatacttgatctttattactctcttcatgcccatttgtcaacgtataaattatacgagttcctccacgtacaaatccactttcaaggagtacctgcagtacacaaaaaaggccttgttaaaagccaaataaaggcatagctaaccaacctatgtggccatatataggtgtacatgcatgtaggtgatagatcagagagtacaatatgcagtacacacacattcagttacctagttggcctcttcttccttaatttttccctttaaattttcagagacccatatatgcatctccgtgtcattttccactggtcacaaacggaagcaatgggcgtacgcgaggccgccattaatcgcgtgtgtgttctagctatatttcttcttttgctcaaccaccgggctgctccaatggcggccggcccaggaggaccccatggctctgtggccacgaacttcacctgccattggaggctttaagctcgtcgacgacgacgaccctgagggcgacgagcagccacggtttgctgcatgcggcgcaaggaagaatgatgaatgcacacaatgggaaagtactctgttttctatttatctctcaaggggacatcctttttgttttttccatgccgcctaagaagtcagaaaaaaaattctgaattttgttggcaaggtatatcgatatgtttatatcacactataaatatgcaagtttaaattcaaaagtagaaaaaaagttataaatcattattcgtagttaaatttattgtctctgtttctacctgtgtaagtcagatttaaatttgcatgtttatatagtaatataatgcatacttgatacttccttcgtttcaaaatgtaactatttctaactacgaatttgaacatggctccatccaaatagctatatgttgggatgggagggagtattcatctattataattctataggaggacgacatgcgcaaatggaggacgtctcctggagggggaaaaaccatccacataattctttggtcccaactcacaatgggagatgatagtaagaatgtgtagtacaccgagctagttacatgcatgcatccgggagacatgatggtataaagaaacccggcagccaaatgtgtttaatttcacactgaaactcagcagccaaatgtgtttaattccacaccgatataagattgggccagtagcatgtgtcggcaaacattttaattgcatttacaaactcgcagcttgagctgtataataatcccaggagggaatgtgcctaacaactaatgacagtatttatcacccccagctcacaaaagttgccaaaatgatcctgtgagtcatctgaaggccgtcaggttttatttctgacttctgagtcggaaccgattctgtacttctgtatgcgtaatgctgcactatctatccaactttgtaaattacagccactttctgatggatgttgttaccatgttatcaatagcaacccagggaagtggaaactggaaaaagaattgacattcatacagctaggaacagcaggagggtaagatagtgagtgctactctgggaggaaaggcagcctgctgacaccgttctgtttatagtccatgtcatctgaattgtctgaatctgtgagctcagttgcagcttcttgcttgacagacttgccgccttcttccacgcctacgaattgcggaagaattctgaggcatgcgtttggctcctggcctatagattcccacttgagcttgaaactttcgactagatccacctgggaagcgatgatgcttggtggtctgggcagtagctgcacgctttcaccttttgggatcactacttgctcgattgccaatctagcttcctggcaacaggagatgattgtttatgttattcatgaaggtgttgatcagaataggtcaaaactgctatagcaatggcaggagagataatgtaaaggaaaatggtaatcatacctccaaagcatcagtttcctccgaagatctcacttcagtatcttcaaaatccatcaacccatccgtgtgatcatcaacaagggcacgaagtgcccttctgatttgcaccagggagtttgtctatacaaatagttagccaatatcaacattctgtcacatcaacaattaacagtgccatgaaaattaacaatgctctatacaaaccttggtgaaaaaaacaggtatatcttgagacttcacaacagcctgaatctgggtattcttcttgagcttcgattgcaatgcaatcactgcatcagcttcactgatgttataagtcaaggttacaatgtcctccagctccagctgtttaatggcttgcaaggcagtcgactccgagatctagaatagcctatccaataagttacaaactaagtataggaaacttaataaagagttgacagtgcgtgaaattcagcagtcatccgatgataagagatatccaaccaaacaaaggaaggaagttgcaaacttggaggcttcacaacgtaagccatgaaacaacttctcttccctcaccactccaacaataacagcccacagctacacttactaaacaagaactaacagggttttgtttaggtgtacaaggcttaattaatgccttggaggtttggtagctcaccattacttcaatgtgccatacctaaaagctgtaaatatattaagccatacagcacagttcataccaaataatgcaaaataaagcacaagtccaggcaaaaccttgagcaaacaaatgaaaagctgaagtacgagagagggggtgggtgtggggggtattgaagaaatgcataccccataagcatatagattgaggtctggttcagcttcagttgatctccctatatgcccttcagcaggatcaagattaaatgccgagtctaagcttcttcttgcattgctcaaagaatcagtgtccaattgagttgcaccttcagaaggaccaagatccaaccgttccttttgcacataaacttcctgtactggcccctttgaaccaactttacgaatttcaacattaggcattttgcctgcaccaaccaaatcggactaaatcatgctgatattggagttacacgttttatataagatattgtagcatcatatctaacatgataatgcagcttactaatgccataataaatgagaacctgcaagcagagcatctacagtatcttccaaactacgatggacgcgcaattcaattttggagacaatctccgcagcacatgtaaaagtcgatggacccttgcgctctaggacagttttctggacccctcttcgattagcttcttcatcaccaagggtgacgctctttcataaaaagaaagcatattgtaagagatctccatgacagaaatggcaggtacagaaattcagaaagcacatgaaagaacattagatgcttctgtgtattcccaatgaaagctgaatagatgctataacagttagtttctgaattgcccttaaccattgctttaaatatgcatagtcttcgattaaaaagcatagaagcaaccttcaacaagcaaaacatagtaactaaaaatttacaagcctacttggaacagtcacgatgaaccattaaccaatggtggaagggaagcaggactgcaacttgatttaatactcgtatacaattacatagtttgcagtaagatttcgctggctcttccattctgtataagtaaataactgtttttggaaacacacccttgttacatcaacaagcaagctggagtatactgatgatcaatatcacaatctttccatgtgtgatactatctcactttatctctcatatgggataattt

SEQ ID NO: 42242 - DNA, 1291 bp, Oryza sativa
ataaaatgcagcatatcattacctgcacacctactacaagcatatctagtgatggattcatgatcagattctctattgttattccatgggcagtggcaacaagttgtatcccccgttgtgcaatggtgctagcagccatagcctctagcttcgttccaatttcatcgatgactattgcctggggcatgtggttttccacagcttctatcaatacctgattgagattgagagaaaaaaaaaacaaataagcacaaatagacattggtgtgttaaaaagagcttcaattatcaattcacatgtaattggtttggcatatatacgatcacggaccttatgctgcatatcttggttaggcacttgtaacctgcgggcattgcctattcctgggtgaggaatatctccatctccacctatctcattggatgtgtcaacaatcatcaccctcttcctataatcatcagctagcattcgagcgatttctctgcaagtcaaggcaagcaacttgttgctacactaacactgatacatttctcgatcacaattaacaaatgcacaactctcccgatttacatcggaatcaaaatcaatactcgtcagtccaaacctaccttatgacagtcgtcttccccacacccggtggaccgatgagcagcaatgacccaccatccttcaccaaatcctgcagcaaattagcacttccaggcacggcacgcccaacccggcaagtgaggcctatgatggcgcccttccggttgcgaatcgcgctgatccggtgcagcgtccggctaattccagctcgattgtccgctccgaaatccccaacctagcacaatgcgaatcaccaattcaccataagcaaatgctgctaaattcaccatgagactaagtctagcgatcgggatcaacctgggaggtggcgtggcggaggtcgtcgaaggagatggggctctgcgagaggaggaagtcgccggaggggaagcgggcgagcggcgggcggccgaggtccatgaccacctccaccagcgccgggagctccgggtgcccctccacccgccgcctcagctccccggggagcaactccagcagcctccgcatctcctcctcgggcccctccccacctccccgcgccgcgcgcggtggggcccccaaccggcggcgccgaccgacggagaggagggggcaaacggctatccggcggggagcagcggagcggaatccatagggcgcgcggcgggggaagtggagcgggaggggtgggacgagggagacgccgaggtgcatcgccggcga

SEQ ID NO: 42243 - DNA, 27918 bp, Oryza sativa
  unsure (1)..(27918): unsure at all n locations
atctatccacctgggggagatctaacggtcaggatcaaactatagttttgttctgttcgtcctcaacgtggagtagtggcgcttgtgcttccacgtcgccaccaaccatggcgatggccacctacctcgcaccatgacgtcatccaacctcctcctcctccgcttaaacgcgtagcctccattgctctcctcctcctccccaccatggagtcgtcgccgccgccgccgccgcagatgcgtgtgcgcgtcatggagaccgtgcacctgcgtccgcctccggcggatgacgcggcgtcgttcgcgctgtccgggctggacacggaccgcaacgtgctcgacgtgacgttccgcacgctgcgcttcttcccgccgccgtcgctcgagctcgacccgctcgccgtcctcccgcgcgcgttcgccgccgccctgggcatgttcgtcccgctcgccgggaggattggggacggagggcgcgtcgtctggtcggccgccgacgccgtgccccttgttctcgccgcggcggacgacgtgtcggtggccgacgtcgacaccgacagcccgggctccgatttgctggagcggctcgtgccgggggacggcgacggcgacggcgtggcggggtcaccggcgctcgcgctccaggttacgcggttcgcctgcggcggcgtcgcgctggggatgcgggtggcgcacgcgctctgcgacggcgccggcgccaccaagttcctctccgccgcggcgcggttcgcgcgcggggcgcaggagccggcggcggtggcgccggtgtgggagcgggaggaccgtctcggcccgaggcgtccgccgcgcgtggtgaagccgttcgaacgcgtcctctcgctcgacgacgccgccgccgcggtgcacggaccgtacggcgcggccggcgacgcacaaggacagatcgcgagggagtgcttccacgtgagcgacgcgcgcgtggaggagctcagggcgcagctcgccggcgaggccggcatcaagctcacaacgttcgagttcctcgccgcgttcatctggcgcgccaggttacactgatcccgtcgaacacctgggacaacaaggtgattttatctcctctcgtttaactccgccatggaatcggtgatcgagcaggacgaaagccagaaggacgagccccgacgaggtcgtgaagatggtgtactccatgaacatcagcaagctcctcacgccgcctctcccggacggttactggggcaacgtgtgcgtcccagtgtacgtcgccctcaccgccggcgagctcgtcgcccagccgctcgcggacacagccgccatggtcaagaagagcaagcaggaggtggacgacgagtacgtccgatcctacatcgacttccacgagctccaccgcggcggcggcgtcacggcggggcgcggcgtgagcgcgttcaccgactggcgccgcctcggccactcggaggtggacttcgggtggggctcgccggcggccgtgctgccgctctcgtggaggctgctcgggagcacggagccgtgcttcttcgtgccgtacggcgcagccgacgagaggcggcggcgcgggttcaaggtgttcgtcgcggtgccggcgatggcgacgcactgcttcagagaggagatgcaggagctatcgttgcaacgccattgcctgcgttcgaaagagaagctgtaaatttcacacgaaaacagtccgttcaaattcaaaatggatagtactcattcaaataaagatcttcatacacatttccgaaccgcaatgggagtgaatcctgtttggatgggccaaaaaataaaatggtcgatcaagaaatttgaaatttccaactccgaatccgataagaaatcaaacacccctgtgtactgttggcgcatatataccggcacggctcttctcgatcacctcaacccagttgagagatcacctcgagatcatcgagcgagcctgatcgattcgagatcaagatcatgacgcgcggtggcagaggaggttagttattgccttcaatttcagtttcgctacatgttcctcaccttcccttgatctcttgacagtatcatgatcttggggactaatttggtttttttctcttttttttctgttcgatagaggatgacaatgaggtggattcatgggtgaagaaagaatctgaatgggaggaagcaggagatggagaggaagacgattattcagacgaaaccgaatatgatgatgatgatgatgaatcttcagatgaagacaacgattacttctcaatggaaaatcgggatgtccgcttcgcttcggaggagaagtgggagagccaaatcatggaacagatgaaattctctgtctccactgctgatccatttgatatcaggacgatttggaaggggtctctgcacgtcgacgggccgtgccaatctctcgatccaaacctcttatctatgaacaatttcagtaagttcatcgtttcacataccaatctttttcaagaaaagaaaaaaatatttaactttatatgttcttgaactttaccatatttactggttatttctgctgcagtgcctcagttaccactgagaatgaagaagaagaataatgaggagccttgccgtcgagccatccaggtgtttggtctgactgtatcttctcctgacaatgttgttcaggagatctatggtatgtttgcattcagagatatacgaaacagccaagaacgcaatttcatctttgaatacccaagagacagaccatttacacttaagccggtgagcactttatcaactcttctttttttatgcaatcgttttaattagtttattccttaagcattcaagtttttatctcacaggtgtaactctatatcatacatatatatgcagggttctgataaggtgcaacccctgattcagcctcctcgcggcatttacgcaatagggccagtggtaatggagtatcacctaatgatcaaaggtcaagaagaacaagaagatagagtattggtagatggttactccatctactgtccatctttctacaaagaacgttcaaggttccactggcacattgacactggccactgtggtgccattgatctgaagatggctgctgtaccaaacgccgtgctggccacagtggagatcgaggtgattcgtctcggaggaactcactacgattcgcttgccattgttgtcgcattatcgataatcaagggtatgtatttggttttcgatggcaaggttagcgtaggcaagctactgcctttcacggtgtgcatcaacagagagatgcatctgaagctgttcgtgtacggctactccagtagtcagattggacatggcgattgctctccagatggtgttgttagtgattacgacaatgatgggttcttctccgcaagcgaggatgtttattacgacgttttgaatttcataccacagtttggaacctataagaaaatgtcacacaatcttgaagatatggacgtgtctgtgacggtaacctggtctagcttgtattagtacagataaagtgaggattatattttatgttcttgtcataaacaattactgtaaatatgtggaagaacaatgtcagggaagaatggcggagtcgttaacactcatctttttatttgatatatggacctgcagccgcggctgcaaagacatgaagggatggcagcatacttatgtttataactgaatagattaatagatccaaagaaaagtttaatcaaaataataataataataataagccaacatggccaatatgaggctaactacccaggtaaagctcacctaattttaccattcgttgtgaagtcattaacaaaagaaggaacttttaactgttgttccaacaaaacccttcccttcaattcaaacatataggcaggcacatcacaagtcatattacaacagcacaacaatgaatcctagtcctaatcaaagccactctcatcagatgtgtgcaacctctcaaccaaatacattctacattggtcacttgtttgttccatgtcactgtaaaaaacaaaaagaagagagaaacaaagagtggggagaaaaaacaaaagtgaacttcacaagatgtatcatacaatgagcggtaaccatttcgcggcgaattttacacactgagcgaaggaacctctagttgttgttgcttcttctgttggccccctttcatgtccttgggctttgcctttggaggaccagctgcctttgccttctgcacccttgctaccggtttcttttgatcaggaggagatggtgttacggttttcttatgatcaggaggagacagtgctaccggtttcttctgatcaggaggagatgctgctaccggtttcttctgatcagggggagatggtgatgacttcttcttaggggcttttcgatcattgatgttgttgcttagactgattgagccttgcagcttcagagctgatgggtttgtgctggcattttccttctttgcctgtcctttcttcaggttttcggggtggaccagtgatcggggctcccatggccgtgccgctatccatcggtccatccagctccaaccccagccacccttgccaacttcatagttgaagtttccaagacttgtggcagaccttgctctccactgaaaatgtgcagaatgaatatgccgattactatgttgagtttatacatagagaaatgagcatagtgctagtctgaattaactagtaagtagcatggaaagaaactattcctaaggggaaaagacatgatgaaaattagcttaggagtctctgtcatatataagatcaaaatcatagatataatgtgctgcaatacgtaggattcttttaaaggaatgaacaatgaatgaagttgtaacacctgaatcaattgttagtacctgatgattgaatgcatatgccatagctcgttcacgctttactgcggcttcttccctttgttggatcctcccaagtatttcctccatagtatccgagcctccattccactcgacctgttaaaacatgccgatgccaaaaggaaatgcaatgtcaaagaacattagtattcttttactagtaaatttaatattattaatacaaaatatagttgatttgtttaatcagttaaaggattaagggtaggttatgaccaaaaaaatcccaacaataattaggtaggcagaaaaatttacaaggaatggtggtcctttaggagaaattcacctgcaaattttggagttttgcttcaagtttcatttgattttcttgcttcttcttcctattgcgcccttcagtgaccatgaaggcacgccggtttcttatctctgcctgcaacttgttccaagactgtatgtagttcaatgtggcagctgtctgcttgttaactggattggtctgcccaataatgtgcaatcttttaacccccttgagacatctgagagttttctttgcctgcatttgagtgacgaaacggcaagaaatgatgtgccaatttcttagcaaccgaaaactcatgtggtagccaaaatgaaggaaacaattcaaatcaatgttaccttgtagcatctaaaggcattttgaattcgagtagctgcccattcctctagtgctgcattgtcttcagggtcactactagaggaaggaccattattagacttttgatttgttgagtttggcccattgggtacctgaccggcaaccttcaatgccaaagcaaaatagaggaaaatagttggtcaatttgacgtttagttcatctaagtaaatgtacagatgtcctaagccataatgtaatcatttaaatacaaagggcagaagctatgccatttcaataagaggcagtttaaaggtacaagaagtacaatcagattatgtttatgcactgtagccggtaagacaatcccacggaaagaaaaactacactagtactacaagaaagaagctgagagataattaggccagattctgtctgtaaatcgatgtacaaaaaaaaaagctaccaaggagatcaattcaacagtcaaattactttgactgaccagtccatgttcaaaagtgactggttgactgctgaacatataacatggacagagcataacaaagatctctgaatttatgtgactaaattaacaaaatgcttactcaatgagaactttgttttcttttttctgggtgggggtggggatgggggtaacttaacacatcttctgcagtaacatagaagagaacaggcaacagtggcaatgccaaaacatttccaattttcaaaccataaaacataaaaaaaattatcgacacagaattcagcttctcaaagaaccttttatatgtgtaccatgcaaatttacaatgacaaattcagatgtcctgttgtcagtaggtggggacagttaattagcagtagctcaccaatacaccaaagatgcagaaggttgtactactactctaaaaggtatacctaactcacacatactactgttctgcaagtcagcatccaaggtaccccataattgattgctagtatgtacaaatcaagcttttcccatcagccaactttctcttatgatgaccgcaaccaacaaagacaatcaagtagcagcacagagaggctgtcctggcccttcttaatgatgggatggaattgcattgtatggcatccttttcaggttgcttagaaggcatgcaaggctatgtgtacatgaccattcaactttcaggagggacttggaagttgtgaaaaaaaaaatcagctttttttggagtacatagaaggcacatactccacatcacggatacaaatcatctgcggtactgcatgtgtcactgacatgtgggtcccacctgctccgggcccacatgtcagaggcaccaactgcatgtgcattacagccgaggatccccactcaccaacggtacatctctaaccctactaaattcttactaaattctcgcgtgtgcgtaatatttatggacatgaggatttgatttttggaaacagtgacagaaataagggggttaatggatggatggagtggatacctttgcgtgttttgacttgccacgtttagacttcttcttgctgatgatcgtcttgaaccagtccccagaccccatggcttcaatcagagtgagcctcacagattaatccttgtccaacccccttgcttagatcacagaaaaaaatcattaaaaaaacagggttaattttgtttttaagtataagatggtgcaacatgccgaaataaaaaattacacctgatgaaccaagtttattggctcattctgaatctctctgagtgttcattaaccaaatcaaaatttacatggagaaaagaagcaaatcctaatatttctgtcaattgacagaaacatgagaagcaagcatgagaaatgaacccttgtttttgtttctatcctgaagtcttctcgaatcaaatatgaatgattccccaaaacaattcgactaaaatcaaacaacaaaaggcaataaaccggaagccaagaatcagctcaaatcttacagaactgacagggctcaagcttcagacttccttcctataaccttagccaagaaaccaagaacacccagagagtcaaccccatggctcatccatccctctgctcatcatccatggcagatgaacaagtattatcttctccctccaaaacccagagcacaagaacaccagaggagccaagccaagaactctgaagaaacacacagataaacatgatgcagctgagcagtgactaagtacctgagcttcagaaggttgcagtgttggcaatctgaatctgatcagaagttgctctcagaaagagaacgggagacagcagctcaggaaaggaagacatccattggaagcaatggatctctctctctctctctcctcaacctttgagagaagaagaagagagagaaagagagagaggtgggagagaaggtggaaaggtgaagaggctggagttagatataagtccagatcaagtcctttgtctaattgctcccaagttgttttctttaatccttctttgcctccctcctcggccagccactgatgactttaattactggactttttaattacagtgcggttgctaatgatcttgcttagcagtgggagttactgtcccttaatctcgctggcgatcttgttgccattaaaaatggagacaaggagttacttctttgttgacttgtatggagatccacttgctcagagaatccacaatttgcagtgtgcaacattttttatagctcatcttcagcagtcagcacagtgaaatcgtggtagtactgaaatcacacacaaactgtcgagttaataacagaaacaaaattaatcttgccgtctcatttcgttgttttcgagtaacagtaccttttcacatagacttggggtggtcccgggaccacccaaaaaattcctaacccaatgtatatatatatacatatgcaaaagaacttttgaaaaaaaaaagaaaacaaagttcttttattaatatattatgatgtacatttgatcaatttatatttctaactttgttatatttagagtatttaaaatagttatataagttgaaccacctatataaaaatcctagacatgctactgctttttccgagcgattaagagtgtaccatacttaaataagtatcatgagttatactatactttctaacttaaaaattcgtatgctagaaattaggatgaaaaaatttacaaaaaaaaaactttgacaactcttaaagacagtaaaaaaaattattgtttctatactacataaaaaaatccgaaaatcttcttgtctgccccagtaagaaaacggttgcgcgttattgcactaacacgcgacggagcatgaaaacgtatgcgtgtctacggaagcgcaatattaaaattcacgaattacctctcgaacttctcgatattaaaaattaatttaatcttaataaataggcacatataaaatcaaattaaggttaatattccgtataaagaagataaataacacatttcatacaaaatatattcgtatttgttttagataatattacaatatttttttatctctataaaagaacaagtattcagcgagtttcacataaacacaaactgattgtatttctggtctctgccgttaggcacacgccctattgccctagtttactagtagttgatgattaattgtgagcccagacagcacggcgaagtcgagaggaagaagccaaggagggagggagggagagagagagagagagagagagagagagagagagagaggaattagataagacgatcgattgccatggttggtacgttgatggtggtgttctcttcttcgtctgctcgtcgtcttcatcgctcgtcctccctggccaacagcgacatgcgagctaaatcagagaaaggctttctttctcccacctgaatcgatggatgcttcgtcacttcgcgcccaagtacggctccattcccgtcttacgttgcagtactcatctccaaccacccatgtcgcaattaattaccacgcaccgtgattggttcgggtgtgtttagttcacgtcaaaattgaaattttagttgaaattggaacgatgtgacgaaaaagttggaagtttgtgtgtgtaggaaagttttgatgtgatggaaaagttggaagttcgaagaaaaagttggaaactaaactttagcctaattgatttcagatagggtacagaattcagacttttcgtatggttttttttgtacccttttggtttgcttttgaaaaatggtatcatcggttggtttgtggtacagtatagtggttttggttttcttcgctgaaaagtgaaatattgttgcaatgatctgcttatgagaaaggcattagtactcccttctgtcacaaatgcttgtgagttctgatcgtcgagagaattttgactttttaataagcaacataaaagcaaaagacatttccaaatatagggaaagtttatttgtccctcgagggaatatcctctcgttttttttcattctagacctctttttagatagcatttataattcagattttatatatatatataattttggtaccttatggtttgcttttgaaaatggcatcggttggtatatgatacagtacagtggttttggttttctttgctgaaagaaagtggaatactgtcggaaacgaccctgcttatgacaatgatattcatacactgttttgttgtgaatacttgtcaatttaatttgacggtcaagattggtaaaattataaccgtcatctttttagagatgtaaaagcaaaaggaagttccaaatgtaggatgttagtaaggtacttcaaatgacaaaaaaactaatgattcaacttttaaaactgaaaccatatgctaagaagtgctaattataactatactaccaactcttgtctgccaaaggaataggtcgtgttagatcgaagccatgcaagcataattccaattccaaatccagaaaagatagacgagatatatatctcgatgctagctacagcgacattaataattaatcaagcaagctagtggcgtcatgaatgatactcactccgtcccataatataaaggattttgagttttttcttgcactgtttgaccactcgtcttattttaaaaattttagaattattatttatttttttatgacttactttattatccaaagtactttaagcacaattttttgttttttatatttgcacaatttttttaataagatgagtggtaaaaaacgaaaaaaatctcaaaatcccttatattataggacggagagagtaatatctaattcctagttgattagtcctaaataggatgcatgagatgaatgatttgccgttgttatcttactgtcatggagacaggccgtcagtttcggcgtgtccttgtacaatcatggtggtgatttgagtgctgggtttcagagcagatgtgtgtagtgcaatgcaaggcaaaatgcgacactgcctgctaattgatgcgtgcacacgtgcgattcgtattattgtccttctaccctcaagaaaatttgtacgtatatgtgcacacgtgtttgagctttcagtatttttttaatataaaaggaagttcagaaaaatcaatcaaaattttgcaatacaaccaaaattccaaatttaggaaatgtacttcttttttttatatataaaagggcctcattccgttgataaagaagagaagaaatgtactttaagcatcggtgaatttgaattgaagcttggaattggaaatgccatgttgcccaaccacatgtctaattcagtatttcagttatcactatctaactacgatgattagaatgtataatatttaagtacaataacaataagatgtcgaataaatgctgagatttcgatgattggattggtataaccgactgcggtttgtcttactggcgcctaaattaattgattaaaattttaaatgcaacaatggatgcattagttcgtcagctggaaaattttttttggagattaattaggacgtagctgttgcctgccaccaatcatggcgacaacacagccgctacgaaaggaacggagattacatactcgaaagagattctttatcgtcagaaaaaactgatgaccacagcagcagtgacaggccagcacgaagcaggagtagtagtatatgaattataatttaagaaatacacattatatttgtatatggtttttattattatacatgcgcatttcggatcatatgcgtatcaatgacaaacatgatgaggcaatatgaaatgctggactgcctgccctggatagagtcatgcagatacttgtcggcagcattacgcgttgcttcctgcagttgcatcatttttattttcttttgagtacttttaaggtgttctattattctactgccagtattatcatccataaaaaaaattttatcaattgatttataagttctacaactagtagtaaaaaatatttcttatactaccaacagttaagttagtagtataaatagaaatgatacattggactagaaaaggtgattataaaatatctaccacctctgtttaaaacatagcaacttttagctataaatttcaataaagatatgtttatattcgtagcttaaggttattatattttagaccagaggtagtattttattttattttcttttttgcatcatacaattttgctagttttttttattctacatcacccttccttttttattatagtttttttgagatggacagatacggtaaagagtactttggatgattgttaaactgttttggagccacagatgctgtgtttgtttgggctaaaaagttcaagaactttgttgggctagatttagtattcctccgttttgtctggtccggcctgccattctacagtactttagctggctgggccaacatagcttgatctgatttgcctcagattaattctgcatcatccacacaattgcagtttggatacacacaataattacatttaattgtaggatccgatattggatttaagtttataaactgttcccacacttaactgccagcaagaaaccataataatttcaacaattaataccctatgtagataatagatactccctacattacataatacaaggcccaactattttttttcagatttttcatatataatataaggcatttatgcatacatgcaattaattagcacctcttctccactagtccaccttcgagatcccgaattctattagctgcatgtgttatatttactagttggcatttcgcgccttgtcgctgattctgtagttatattgttaaacaaaatcgaagtttaaatggttaagggcaactctatgtatgtacaaaatgtggctttatatataccttatgttacaatacaattcatgctttatgtccccacgaaaaaaatcatgctttattttttaaaccgtcattgtatattgttataatatattttcatgcgcaatatggatcgttgtagctagatagtttgcatctctctactatacctaagtttgctctaaaaatgggttaagtaacgctacataatacttacatgctatctaatcatacgtaatgaaacaaaactaacatcttaaacaataatttaagttgtatttggaaaaaagttagcattattttttaggacttggaagagagaaaacattgtgttgtgagcaaaataggaaggtgaatatacgactaataataaatgatgaattagatggataagtagcttccccgtgatgactataaaaaatcctcgagtgttgcaacaagtgaaactattttaatcttgttattgttatatggtttagttaatgtgaaattcaatgtgagaattagcttggatatgtattttctagaaaataatgagctccaagtaggagtccgatcatcttaaattagcatgcgagttttcttaaagggatttcttatacgattctttttatgtttccaaaaagaacaaacttaaaacctgacacaaatgcggatctgtatttttaaaagcgaacgaacttaaaaacgactcgtacacggatgacgtaccaaaagtaccgacaaaaacatcttcaattttttttaatgatatggcttcttgtatatcttactttataggagtaaatgctctttaataggtaccaattatataagaagataggattagggtgatcctaactaggaggcaataataattattattattattttggattaaaggtgtctgtgtattttggaacctgctagaattactggataatatatatataaaacccaggctgttgcatcagacaaattctacctctgcattacagcaaatcaaactctgctgcattaacctcctccttttccttttccttttccttttccttttttgcgtcttccttccaatctcgaccgtccgtttctcgatcgcacggtcgatccgtggccaaaatccctaggcgtaacgctcgtgcatctgcagctgtctccgttccaccgtgcacgtcgcgctctctcgctcccgacgcgacaacatgctcgcctccgccgccgagttcacggacaacccggcggcgacagccacggtggcggcgcgacacggcgtcgacggcggcggcagcagggtggtcgtgccgctgttcctggtcaccgtgtccctgttcttcgtcacgtaccagctcttcggcgtggccgcggcggccggcgccatggtgctcgacgtctgcgccgtcgccctcgccgcgctcaatgtcacggtcacccgcgcgcgccgcttccccttcctgcgcctgtcgctcggcggggaggaaggccatggtggtggtggtggcgccggcggtggtgacgtggcgccggcggcggccgggatggacgcggcggcgatcatggcgctcccggcggccttcgggtacaagcgggagcagacggcggcggcggcggggggatgggcgcagtgctcgatatgcctcggcctggcgcgcgtcggcgaggccgtgcggcggctgccgtcgtgcgggcacctgttccacgccggctgcgtcgacgagtggctgcgcgcgcacgcgacgtgcccgctgtgccgcgccgccgtgtgcgccgccgggccggagccggagctgcccgtgtgaccgtcagccgcggtgattgttctcattgttaggtcgatcatgctgtagagaaagtataacagtagagcttttttcttccattttattagtgttggtgaatggtgatgattttatctcaaatcgaggtagccttcctgttcttctatcgtcctcagtgacatctgtaaattccgtccaaattatgtcagtgcagttaaagtactcttaatagctactccccgttttatattataagtcattttaactttagttaaattacttaaactactactacaagtttgttcaagtttgtaaataaatacagtaatatttacaacatcaaattagtttcactaatctataattgaatatatattttaataatatatttgtcttggggtgaaaatattactgttttttttctacaaactcaaaacgattataatatgaagcagatggagtaataatgcccttgcttaggaaggagtgaagcatcatggcccctgcatccaaaaaagattagattttacaacatactccctcctttgttcagattcattatcttagaatagatcacatctctatcctaggtgattcatttggacatagggagtaacttgcaacctaaaatactccatctttcctacaatatcataacctaaaactggatgagacatatccaaatacaacaaatctaaatagggttttgtccagattcattgtataaatatacattcaatttaagattgttatagtttgggacgaaaggagtattacttttgccactaagaaaaaaaataatttatcctgcatgtaacaaagatcaaacaatgtatgtttaccaggctcatcaggttctgattaataattcaatttatctttccatttactccctctatatttttttgtttgacgttggttagctcaaaattgaactaaccaacgtcatatatttgtgcaaggaggtagtaagtcttaaatacgtaaaaattacaatatatgactaacatatttggagaaaccaaaatatgaaataagtctaatatttttggaaggagggagtagattctagtgtccacgaatatggcttggttcttgcgtccaagccggctttaagtttacagcccgcttctcctctctctcctctcttctctcctacacttcagcatttagtcagcttatagcctactattatacttgctctaaggctatgttaccttcaaacttccaacttttctgtcatatcaaatgtttggacacatgcatggaacattaaatgtggatgaaaaaaccaattgcatagtttacatgtaaattgcaagacgaatcttttgagcctaattgtgccatgatttgacaatgtagtgctacagtaaatatttgctaatgatggattaattaggcttaatagatttgcctcgcagtttactggcgaaatctgtaatttgttttgttattaatctacgtttaatacttcatataggttcgtatatgttaattttttttttgaaaagtaactaaacacggcctaatactaaccagtagagaccatggtatatttacctgtttccctagtcacagtcaaaacgattgacgcagtaacttacaagttgcccaagacttagaatatgagttcatacctcactatcaagactgcaggacttttagttattccggaatcaatatccacaattcgatctctgacacacacatagtcgcctatgaacactggaaatgaatatagagagaaacatttttgaaagaaataggagggattatgctgagaaaggaacttaattattttttaaaccttttttattttttaattttaaaaataaacccttcaaaatttatttccacaatctaaaccttttggtcacgctaaaactgtcacgcacgttgcaccgttgcggatggtgtgtcagtgatgttttaccatgccaggcgggctggcgtggccaaatgattcagattctagaaataagttttgaaatggttcatttgtaaaattaaaattttaaaaagttcaaaaaaaataaaaaaaatcatgagaaagagcatttctaacctaagcactactctccttctctatcaaaagtacctccccagggcttatctagcgagtctcgcttaatcaattcatagtttcgctcccagcgtagcgtgtgttcgctgcagcctgttaccggcgttagctatccattagcacgtgattaattaagtattaactatttttttaaaaaatggatcaatatgatttttaaagcaactttcgtttaatttttttttcaaaaaacgcgccgtttaacagtttgaaaagtgtacacatagaaaacgagggagatgggttgggaaacttgggggtaagaacacagccagtgtggtttgcccctcctacaaccaatttgtatggttgaccgatattgtatggttattctttgcttaattttttatatggaaatgctttacatcctagcctccgtgtacatagccaaaattttctcttaattggttagcaaaattgctaaaggacactcaaaaaatttgatcattgctaagaatgtgaatttgtccaacgacgcttaaaaaccggggcaattttctagtagacaccatatatattattttatgatttcctgctatttcggagagagaattttcacaaaactatagctttgcccttgggtgattgggtccaaattgctttcgtcgggggagaggtcaggcggtgggtgacaaggcgaggcagtcacatagcaaaggagacagtgggcaagggagagagcgccgacgacagagaggctggaaagctggtgggaaaccaagcgaagccggtgtcgagcagaggaagaagtccccctcgcctactcctccgacagcggcagcttggcgtgactgcaaatgatcgcggaagagggccacgatggtagaggggatgccactcccccatgtgtctgcggttcctagcaatgaagccgatgggttggtgcgggatccgacgacgttggaagaagctgagcgaagggcgccgtgacggtggaagtgaggatgggtcgccggtcgagattgatgcaaatcaagctggaatcgaggttgatcgacggcttgggaaggagctcgagggcgacaacagtgagagcgtctggcacgaaggaagcaaagatggcgaggacgaggaccgccacgacagctaggtggagaagcaggatgggagcccgatggcaccggctacgtcggccatgtcgaagcagatcaggtgggtggaggtgactaaaacctcttgagagaaagaatatgagggtaaaatgaatattttatatggtttctctctcctcaactaagtgaatgttgtattttaatactcatgtgttttgcagtaaattatcatactttctgagtactcgaacaaattcacgtttttacaatatcccctagaaaaaccacattctttgatttttcctgtagcaattatattatttttaaaagatattgcagcaaattaaagagcatatagatcctatccttgacataaaaaggagaacttcttttgaaaagatattgcataaatgaatccataaattagtcaataatgttgacagcatgagtcggcataacaaaatttgttggctcaattaatggatctcgattaatctgtcacatataaaatgtagggtccattgaatagcaaagtaaagatgattgccgtgtccttgttatatgtgtatattctcctatggtactatgctgtcgttgaaactttgattcagctcgcggtacataaacgggggaaaatacgtagtgcaaacacatatccagtgaaaatctagacatctgagattcattcacgtcaccatgaataaaaaattttactcgtaaatttactcatgagtaaaagttttagtgggagtaaaatttttactcatattgacgtggacaaatcatagacgtcctttttcgatccaactatagtttcaaattttcattacgtatgtagttttcaccacatattttctctaaaaacaggaatgcactccacccataaagtggactggcatatcgtacttgcgccttcactgtaattattgtggaaagttgttttcatgaaggtgatgtggcaaaaccacaagttgtatgagtatatagggtgtgtttagttcacaccaaaattagaagtttggttgaaattgaaacaatgtgatggaaaagttgaaagtttatgtatgtaggaaagttttgatatgatgaaaaagttaaaagtttgaaaaaaactttggatctaaactcggacatagctgaggtttttcctagcaagtgacagggttgaaatatccatcttctacatatgtgttctcatggttgtgtgtgtcagtttgggaaagtccttttccactggaagggatttccaagtaattatgcaattttttaaataaacaaaatatattaatatatgatatattactacataaatatataaatccagtttatgcaagttgatgggaaaaaacaaatatggccatcaatagtacacgtacttgttagattttaatttgtttttataacttctattcattaaatttggtcttatatgtatgtgagtgatataacttatatttatctgtgttattatctttttaagaaaaaatttaactattttaatgatatggaagaagcgaggggcatcttagcatctactcgagggaaaaaaacatgtcctgttcggtctagtttctgaagaaagaatccacaagtctttgtgctaaattcaaaaatgaaatcatggatttcggctgatctctctgactccctgtctcatctgaacttgctctatacggcagcgcgacgtgtgggtaaattagcaattgacaatgggcagcatgccactgttaattaaatcgtccaaatcaaagataagtgactgtgagtacgtgaccggctgtgattctctgttagtgttgacgaactgataggtcacggcaaataaagtgcaccgtctggaccttgaagacccagacagtgtcacggcaaaatgccccatcctaagggggtgtttgggtgtgagggaactttagggccagtttgttttgtgacctaaattagtcttataaatttttggcaatgccaaattttggtaagttttgacatgacaaattttgaaaaggcaaagttgtgcttggattgaagccaaaatagtctaagttaactattgaaatggcctattttcttaggcatgctaaaatttagcttcaaaccaaatagacactaaacactattaaaattatcaaatattggtaagccaaatttaggcctcaaatcaaaccagcccttagtcccaaacaccccctaaatattcgatatacactctccatccaaaaaaaataaacactcccaaaaagaatatatttggaacgaacttctagttttaatcatgagaaccctatgcaaagtaatactagtacctactccctccgtttcacaatgtaagtcattctagcatttatattgatgacatcaatatgaatgctagaatgacttacattgtgaaacagagaaagtaaaaaatagtaaacagaactccgtgatctcattattctagattctatcaaagtaaaattaaaatcacgcaaacataagtacattaggtcccatcgtttcgctttttggggaataagccaaacggcatatttataaatgaaaaataatttataagtaaaacttttatatacgtgtttttagtgatatcaaagcaaaggttgaaaaataaacttcgatgaaaaaaccctaaaattaaaaattcaaattttgaccgataagtataagcataagcaaagaaaggacataggatatattctatctatactactttaaaatataatagcagtgatgagatgaatttatcatcatcatccaactatcatgcagaacccacataaaccgtgagtccctgagataagattttccatattttcgattcccataggccacacagatcccatcatagaaaaatgataatatcttgcaagataataatagcattatctatggctaactgtacctaagaagttacagcaaaaatagcacaattacgcgagatatatatatatatatatatatatatatatatatatatatatgaatgaaagattacgatatatatattagacaacggaatagtttttagggacttaaaaatgcatatataatgagttattgtttttttaaaaaataactgtctattacaccgtacgaatattttgctagtccggacaactctaccctgaattttctgaatatatggatttagcattttcaggtgccggtaagtcttctcgctgaagattccattgccaacctgatggtacgaccgcacgcgcaaaatcttagccatttccttgcaaatgggcttggattggaaacctcccaatttccaagcaattcagagcattcaaccaacagctacgcttaaggaaagtaatttgaaatgttttttcatacttttttatgataaaaggaaatggtttgcattcccgccctggcctttggcttaagtaggcagaccgtcaatagatttttctacttatacatacttgtctggcgaaatttaaattttcaactttcaaatttagagttgattttagatttttttcatcaaagtttattttccagtctttgcttttaaatagataagaacacgtaacttttatttacaaaatacttttcatttgtaaatatgccgtttggtttattccactaaatgaaaagacaaagtgatgggatatatctctaggccgtgcaaaaagaaaccatctaaaatgctataaagaccacgtagattatactaagtaattttacatatcttcacataataagagaattttagctattgacttcaaaagtgtagcatcattacacatagcattatactacgtctatgataacactatactttaagtggatatcccttcgtaaccttgttataacatcgaataatcataatctttttcaattcgtttaacgattattcgaatgacatttgaaaaaaaatatatagatgaatgttatgtgttcgctataaatacagcacaagtgtaatgtattttcagacacaagttgtacactgggaagctagcagtgaaccgcgaaccgcggatacaatggctggctacgtcactattattttgttgctgttgctacccgcggcggtgtccggcgcggcgagcggcggcggcggctgcattggcgccatggtcgacgacacgagccgtgcggggaaggaggagaagctcgccatggaaatggccatggaggacttcacggtgagcggcgtggacgtcggctcgccggcggtggcggtggtgctgtgcacgatggcgtccaatggcgacccggtgcgagccgcctcggcggcgctgtcgctgatcaacgagaggggagctcgcgcgctggtggggctccactcgtggcaggaggcggcgttcgtcgcggagatcgggaggcaggcgatggtgcccgtgctgtcgttcgccgcggcggcggcgccgtcgacgtcccggcggtggccgttcctcgtgcgggtggcgcgcggccagcacgcgcagatgcgcgccgtcgccgcggtcgtcgggtcatggcaatggcggcgcgtggccgtgctctacgaggacgccgactacggcggcggcgccggcgtgttcccgcacctcgccgacgcgctccgcgctgtgggctccgaggtcgaccgccgcgtccccgtccccgcgtcgccgtccggcgacgccctgcggcggtcgctcggcgacctcatgggcgggcagtgccgggtgttcgtcgtgcacacctcggcgaaggtcgccgtggcgctgttcgcggaggcgagcaggatggggatgatggcgacggggtatgtctggatcgtcaccgacgccatcgccggcgccatcgactccctcgacgccgccgccgtgtccaccatgcagggagtcatcggcgtgaggaatcatatctccatggacaccaactccaagaacaccagagaccgcctcatcgcgaggttgaggaagaggttccggtcacagtatcccggcgacgacgacgacggcggcggcggcggcggcggcgacaacgacaagacgagagggccgcactacccggctctcctcgcctacgacaccatagtcgccgtcgcgtcggccatgcggaagaccaacgccaccgctccaacccgcgccaccgatccgaatccaagctcgccggactccggcgagacgatcaagatcgccgtgtcgtcgaacgggaccgagctgctcagggaggtcaagagcgtccgcttccgcggggtgagcggcgagttcggcttcgtcgacggcgagttctcgccgccggtgcggttccagctgatcaacgtggcggcgccgagataccacgagctgggattctggtcgccggagcacgggttctccaagagcgcgggaggctgcagccaccgcggcggcgacggcggcggcgagtgcgagccatcgatgaggttcttggggccggtgatctggccggggaagccatgggacgtgccgagggggtgggcgccgccggcgaacggtagccccttcaccgtcgccgtgcccgagaaggccgccttcccggacttcgtgaaggtgacgcgccaccatggccgtggcggcgacgacgacgacgaaccgagcttcgagggcttctccatcgacgtgttcaaggccgccgtcgaacacctgccgtacaacttccactacaagttcgtctccttcaacgggacgtacgactcgctcatgcagcatgactacatgaaggtgatctatccatctagctctcactactttaaaagaaaatttccggggccactttatttttgaaaattgagccatgtgtaaaattacagagagaatcccttatataccactccaaattaaccggttcccttatatgccacttcaaattggtttctcccttctatgccaccggttcaagtttgtcatcccttttatgccattgccgtcactccaccgccagttgaccgttaacttcatagtaaaaagacgcatttacccaagagttagtatacaactaataataagtattttagtacaattggatacaacatatgaaaattaattttttttcatcacatgcaattttagccatcatcatcacaaataatttttcaatataagcatgaaacatgcagttttccaacaatatttttaatacaaagagcattttcactggttctaacaaaattttgttcactctaaaatgatttaaaataaattagttatgtttttgtaagtttacacatttttttagttgagagggcatattggtcatttacgaaaaaaactaacatttgactaacagtcaactaacactatagtgttggaagtggcataaaagggtggaaaaacttgaaccagtggcatataagagagaagccaattttgaatggtatataagggaactggccaatttctagtggcatataagggattctctcaaaattcaatcatcgatcctaagacaacctcttcgtaggtatttccttagaagaccctcatgtgaaaataggaatatttttatagacggtggtatttggttatatcagacgtatacttaaaagtcctcacatttcacacttccccctcacttttccttggctcctcctctctctttactcttctccttgaatcgacttatcaagcttttcaaaggtcctaagatcagttgagctacgacggataagtagcagaaaaataaacaaaataatttatggataaaacttttatatatgtgcgtattttagtggttttaaaagccacatatgtaaaatactacattgaaaaaccttttcaaattttaaattcggctgtagctaatcagtaataaccagggttttaaatctcccgctaaactgccgctatctctcgctatagctgtttatctatttgctcttatgtacaatttttagccgctatagctccatttagtccgctatagctgctatttaaaacattggtaataacccaataaaaataaaccattaaaagaagtgttttttttatacagagctatgacatccttgtcggcgacacgagcatctcatcaggaaggtacaaattcgtggagttctcgcagccgtacaccgagtcaggactggtgatggtggtgccatttagcgcggacacgtgggaccgttcgtggatcttcctccggccattctcgccggcgatgtggctcctgatcgccgccgtcaggctgtacaacggcgttgccatctggctcatggagcgcaggcacaacggcgactaccgcggcggcgtctggaagcaggtgaccatcgtgctctggctctccctcgccgccctcctctcgccgggggagaaggagaggcggctgaggagcagcctctccaaggcgtccatggcggtgtggctgctcgtcgccgtcgtgctggcgaccaactacacggcgagcctgagctcgctgatgacggcgcagcggctggggagggaggcggcggtgacggcggagtcgctcaggtacgtagaaaaatctaattgttgtatttttgatgttttctgatttgttacatcgaccctctcaagggtatatgtataggagtacatagagtatatgtaggagtacatagcggatagagggagtacaatacaggtaagattatgagtagatttatctctattactccatcttatctctagaattttatctctaagactctattttatctttagaattttactttatctctatagtttatatttgacttttatctctgaccgacgtatttctacttctaacaaggtccgccgccggcgcggtggtcgggtgcaccgagggctccgtcgtcggcaggtacctcgaggaggtgctcatgttcccggggcaccgcgtccggaggctcgccggcgacgaggagcaccgccgcgcgctcgtctccggcgaggttaaggccgccttcctccgcgtgtcgcacgccaagctcctcctcgccaagtactgcaacgagctgatgaccaccggacccgtctaccacgtcgctggccttggcttcgtaagcatccatcgccacatcgcttaatattgcaaattaattaatgagtagagtgtatggccgatacttaaaacatattcggctgtgtcatttaggttacgtttatatatcttatgcacgaagaaatagatgatatataagcgcatgattatttaaatattaatttagaaaacttgataaatagataaatatatttttaaagtaattttcctatcgatttgttttaaaaaattgtttgccattattagttcgataagagtgcaaaaaaaatgagcgagttagaagctaggaagaggggttgccaaaagcgaaaaatcaaaatgtagatttagcatcttaatcttgtcttgtgttcacagctggttttgtttcaccacgtggagccatcgcaagttagggtttatttggtacagatttagctttagctccacctcttatagaactggagtctagccaaacagttttagtttcatctaaattagaagcgaagaaacgctctcacaaaataaactatatgcctgctcccacaatttcactccaaactcaattactagagctaaattaaaaagttgaacctctaccaaacaagcatctagggtcacccgtgaaaaacattagagcgctaattctgtatttcgagagtacacgaagccaagggacaccaatgaataattaattagttagttaagcttaattacagtggcttaactctggatcaagattcaagagttgattaacctacaaatttatagggtgtgtcgtctcaggtgttccccaaggggtcgccgctgctggccgacatttcgcaggcaatcctcgaggtgttcgagaacggcaccatccagaggctggagacggcgatgctgtcggcgtacaactgcacggcggcggcggcggcggccgccatggacggcggcgctggcgacctgtaccgcctcggcccggagaactactggggcctcttcctcatgaccctcttcgcgtccaccgcctcgctcgccgcctacggcgtcttcttccaccacgacaccagctgcggcagcggcggcggcggcggcggcgccgtcatcaccggcggccacaggaagcaaggtgatggccgtaaggattctgccactgttgacccaggaggaagcagccatggtgatgaagcaccttcatcagcatcagtcacagctgggcatggaggaaaggatacagagatggtagtaataagcatggcatgagagcttttacttcttgcttgcctcaacagaaataatgatgaacaaatttgtctgggattatgtcaatctaggcacaggtatataaacaatgcgtagcgttcaggaggatcacaccagaacaagaagatgaatgttttttttttcttttttgtatttacaccaattctgaaaagtcattaaggcacaatgtatgcagacagaaggtctgcttgacagaatctatctttctgaagaaagaaaaaaaaagatcatgagaaaagggcaaagactgactgcaaatgtgcatttttatcccactatattcacaacatccaggctagattttttttcttatctgttccccctctaatcctatgtttttatgtgacaaaaggaactacaagaacaaacaaacacgacccagctaaagaataaagcactgccaaatgctaccgccaagttagccctggagaactagccttggcccgagcatcagccaacgaaagagccatggccagcatcatctgttcttcgaaactatcaggaatactgccagcaccagtgtcggatccacctgaattggcagctccagcctctgttgtaagatcagagccggtaaagctgctactggcctcggccatctctgaccaccgctcattagaatactccataccctcccttgtttggtgcattttgttgctcgatggttcctcagacctagcgcctgaggaaccactcccgtttatgctcagatcctctgtaaaagatctgtctgacctgctgagaatgtcacatcttgacgtgtggcaagtagcggtgctagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 42244 - DNA, 1841 bp, Oryza sativa
tgggaaacttaggtagattcttccatcaagtttagatcaagccaccaagtggcctgaagtgaatggtgctagacgattgaacgccttttgtggccacctcctgactgtgcaaaatgatcctttgaacaagcttgagaagcattggacccaccagtacatttcttggagatggcatgaggctcaaagccaggtggaccagcccaagctgttggctgtgactcagaacaattggcaactttgttcgacgcagaagagcaatctttctcagcaaccaaatcgactgatttagatccaggcaacctttccttctgagatgtttgagcagcagaagcatcggttgcagatgtagtggtgacttggcccaggttctcagctgttgtattgtatgcggattcatcgtaatagtgcggccaataggacgtaggtattccgacagccgcctttgcgggatcatgcattgtgaagtgggagtagaaatgcgccatgtaactgctcatagcatctggatgaacaccagctatcctaacctccaacacatgcccatccagagggtaaccattcatgtgagtgagagccacagcagcagagtaagcatcagcaaacttgacaaatccaaatcctttgctcacaccagtgtatctctcaacaactacttttgcttgagtgatttggccacatggtaggaagaggtcgataagtctttcgttgttaacatagctcgggagatggctcacataaaggtagtcatgtcgatttgtccctgctcattagaagacatctgtgatgtcagagcacccttggctgcattggattctgctggaagccccgcgactctcacagccagtatgcttacaccaatctggtagccatccaaatgatcaattgctgcagcagcacatgaaggattatcaaacctaaccatgccatacctctgaaatcgaaacattctagcttgaacaactcgtccaaatgggcggaagagatcgatgaattgatcttcagttaaacttgatggaaccctgccaacatagagattggccatgtcgatttccttgattggcttgccacctgcttgtgaagcgttggttgtacataactctgatctcttgaccactaacctctttccttcaaccatgtatccatccatgtgttggacagctttggtagctgagggtgcatctgcataccacactagactatactccagattcatcaggactttagtgatctgaccaaagggcgcgaaaagattaaccatcttatcggcagtcatcgaccgtggaagattagtgatgtatagtctagacttgttgatgtcttgagtggtctgtacagctgagatggatgctgatggggaaaggcctgcaactctgacaattatcatttctcctccaaccaatgctccattcattgctgcaatagctttggtagcagattcagaatcagtaaacttgatgaaaccatatcctttggctgaaaaggtgtcaggatctgccaccactcttgcatgggtgatcttaccaaatggaaggaaaagctcaaccaacttcttggtgtcaattgacgatggcatgttacagacatacagattagacatgtcaatttccttgacggttctggtggtgctgggtgattcaacagctgaatttctggtggtgctgggtgattcaacagctgaatttggcagtgttgaaggtatgccagatactcgaacctctatctttcttcaatcgacaagacgtccattcaaatggatgacagcctcagctgatggtgaggactagagtactgcacaaagccatatcctttacttaagcctgttgtgtgatctttggccacct

SEQ ID NO: 42245 - DNA, 821 bp, Oryza sativa
agaaaatattcgtattcgtatccgaactatctgggaattatccgatctgaaaggtatccatattcgttcttattcagagcatacagaaactatccgctccgtttttatcccactgtaaagtatggggtcgcgtcaacgagatactacttggctctaaagaagcaatagagttacagtcatttgaaagagctaccgagggacaggcgaataatttgaaagagaatatacatatttcaactttgaataccaacgatacaacatgtagtatatgtaagaaataccatggcctgctcacaagacctagtctaagtcaacactatactatgcatagaggtcaccccatcattatctatcagtatgtgatgtaaagtactaatcagatatactcccattgtttcatgttgtaagatgttttttttatcaaatatagtaatatttatattaccaaattagttttatttaattaatagttaaatatatttttataataaacttaccatgattcgaaaatattactatttttcctataaacttgaaacagtttgtctttaactaaagtcaaaacatcttataacctgaaacggagggagtatattactatctccatatcattttaagtgtagttgtaggttttggtgtccaacgtttaaccgtccatcttatttcaaaaatttatgaaaaaataaaaaaaatagtcatgtactattcatgttttatcatatagtaataacaataaaaatactaatcataaatttctcaaataaacctgtagttttcaaataaaacggatgatgaaacgttagatataaacctgtaaaact

SEQ ID NO: 42246 - DNA, 24052 bp, Oryza sativa
  unsure (1)..(24052): unsure at all n locations
tacattgcaggttcagacaattgaaatgattctcgacacacaacatatatatgatggtgtaattaattatgcaattaatagctgagcaaggctaaggtctctcatgaagctagctttgctctatatatatatatatatatatatatatatatatatatatatatatatatatatatatatatatatatatatatatatatatatatatatagagaagtgtgcattaatctgtatgtatataacactggatctaacgagctcactcactaaaccatgctttatgtatatgtgagacgcacgcgcgctctcgcacncaaggacacacactgtatatgcatgcatttttgtatttatatgcagcggctgctagctactcctagatcaagctatacagcagaatgtaaacatatatgtgtagcagtacttatactagcacatcgatctgcacatgttggatgtagcaagaaattgctatgaaatataagtagagatgtgcttaatatcaaatgtgtatcacatgtgaatctatcagctgggcatatatagtgtctctttcaggcttccatctcactgtctatctcgccccccactgaatatgcccagtttaaggacaggtactacgtgctgatgatatgatatgatggtgaaagggactacagctagggagtatcaatcagaacccatgttttggaaaagctgatacggatcgatattgatcatatgcatgcgtagaagaattcatcgtcagaaaacgcgtacgattggtcgtatgtgaaagaagcatatatatctagatctgtaactttaaaatccactctcctatgatcgatcgagcatccattggtgagttatatgttcaaaagcatcgatcgagatcgtcacgattggtagtgggtgatcgatgcagctatactagctccttttctctcccaatcgtcgaagattcaggcattcagccaatgctgttgcagggatataattgtctctgttattttttattctgacattgtatacatcgatagtagtcgtcaatacacacatgttttatcattatatttcaaaacaatatattttacaaaaatatttaaaatactatagatctatagtctatatgcaagaaagagtttttcataagaaagtgtctactcataattttcacattttaaataaatcctgatacttttgcatttatatattaattacttaatattttcagattttttttatttgactacacgtgttctacgcctcatctttttgacaatggaggtagtatagctacatcggcatctttgagcaattactgctcaaacttctttaagtttaactaaatttataaaaaaatatagtaatattttcaacataaaacaaacatattatcaaactatattcaatattagattaataaaaataattttatattttagatgttgtcaaacttgacaaagtttgacttaaaaaagtcattcttcttttcatattataagtcgtttgacttttttcttagttaaatatttttaagtttgaccaagtttatagaaaaatataataataattttaacacaaaataaatatattattaaaatatattcaatgatatacttaataaaactagtttgacagtttaggtgttgctaaatttttctttataatatgaaacggatttgtaatatgaaacggaggtagtactttgtacctgataatcaatgcaaatgtgtagtggtaactgatcgcaatgtgtgaccactgcaactaattaatagatggcctcaaccttatttagttaattaagcatggctgaggttgatctattaattatgtcataaatacgaaactacgttttgatttttttttctagttaaattttttaaaattttgatcaaatttatagaaaaatgtagtagcatttttcacacaaaacaaaaatattataaaaatatattcaatgttatatctaataaaattaatttgatgtgatggatgttgctaattttttcgatcaaattagtcaaacttattaatatttaactagaaaaaagtcgaaacaaacttataatatagaatagatatagaatagagggagtagtaatttttagatcaatatgtaatcatcactttaattagtaactagctaggtagctaggggcatcagaatcagacaaacggctgaattgaaggtccatcaatcgttcgattgtacgcaggtcgatcgtcatgaggtcatcgccatacatatctaacacaatatgaacaccaaaacactactgattatgatgatttagtctagctagagacaaaacgaagaaccggcgccattagccctagctgctaggccattatggcagaatcagatcatcgatcgatctcattgcttttgttatccttttgagatcgatcgatcgatgtgatcgagtgctgttgccgaagcacgagaaaaacaacaccgagaaagaaatattgtatctactacgatccatgctagaccctacaccgtacattccaaaaaaggtcaattctaaggactccatcgtttcgcttatcgatagaacaagagaaacggaatatttgtaagcagaaaataatttataaataaaacttttatatacgtgttcttaacaatctaaaagcaaaaggctgaaaaataaatgacgatggaaaaaccccaaaatcaactccaaatttaaagttgaaaattcaaattttggcttataaacataagcataaaccacaagattaggctctaagtttaaatgtagacctagcaaaagtgggcattttgggatggagggaatagctaactatgtatacattgtacgggggacggagctaaaacaaagtagaatgtggtttccctcacttgttttactcttctttaaatcgagtttaatttgatacgggtgtctaaatttatactaacaaaatacatatatatatatatatgataaaaatagataaaatatagcttaaaaaaatatagtatctctgaaccaggttcttgagcagccccatctacaaatgtaggtccgcccccacccctgcgttgtactgacaagaatatccctctcgccgccacggttttgcctcggcccgcataattatacacaaatattgggccggcccgtcacgtcatgggccggatagtggtggattaataggcccgagttgggctatggagtggtggattattgggccgatttgggctgtggcggtgggccatccgatcggcccggcccagttacgggtaggtgacctccagtcctccacgctgaggcggaggcggcggcttgagctcgcacacgcggcggcgcgagggccggagaagagaagcgagcagcgaaagcaccggcgacctcggcgaggagccaggccatggcggcgacgagccacctccgccgcgccttcgcgcccgcgctttcccaccgccgggcccaccctgcccccttcctctcccgcctcgcgttcttgtccacctccgcatccccggatcaggcggcggcggcggcgaagaagggggaggctgctgcgggcggggccgggaagggagcggcggcgggagaggaggaggaggagaagaagaagggaggcgacgctggtgacgcgaggaaggaaggggaagacggcggcggcggcggcggtgagtacgtgaacaaggacaccggcgagatcggcggcccgcgcgggcccgagccgacgcggtacggcgactgggagcgcggcggccgctgctccgacttctgaccagctcacgccgcgacgatggaagctcccttcacaccggcatggcgtgatctgtcaagacatgtagaagatatggtgtagttttatctatcgcaatctgtgctcccctttcttcttgaattatgaataaattgaagttgttatgcaggccatgattctgaatttctgaatgtttcagagtttcagagcactaatgctcatgaatcttaccatggtaatctcaaattttcttatgtcgtttgatgaattgatgaattgcttgagctctgtgatgaggaattgcttgttctgtaaattcagtgcaaacctgtgagcacttataaattataatttatcccaagagttcctccatgctgaagttgtctgtaatctgtatcttggtcagctactgtttcatcttctatgttttccagaattccagtagcaccacataccttgttgctgttgctaggtcgacacagaaaaattgcaagttgcaagcttgtcgattcaacaaggtatgtggaaaaatcatttgctgttctgaagtcagattctaatccatcaaggggacgccgaaaaagtttcgcttgctgttcttgattgttcagcttgcatttcggttttcaacattccctgaaagtgcagctgcagtaccctctgcattttagcctgatgcagccatgctcccaggatggttccaatctgaaactgcagtagatcagtaaccttgaaccatcagaatatgcacttgatattgttcaccatgatcatcagttcatcacgttttcctcttgagaactgatctgagcaccccggttccccctttgtctttgtgctgatacttttagataatagaatccattccggactttgcttcaagaaattaaatccaattgctggtcttcaacttacaaaatcacaactttgacaaaacacatgaaaactacttagaacaccacctaaaaacagagaaaacactatttgaaacttccatctattgttggtgaggaagtgtgtaaccattgtttctgcaacggcttgcgagttgtacgtaatccttgtatttctcaaggcatcaaatatttatgccaattgagtttcgttcacatggccgtcggtggtcgctgacatcgaaccgaagcggaagataacgtcggagagtaactgagatgcaaatcattcgttcgccggtacgtttaccaagggggctccaacgaattttgatcgctcaaatttgaataattcaaaaaggaaactattcgaataacttcgcgtcgatgtcatgattctgatttcacagctacagcccatgaagaagcctgtctactatctagtgtcatctgtcaccagaggagcagtgcagtagcatatccctgtctgctgcaaatccctacaggattgcctcaaaatcattgctttccattgaccacaagatctttacttgcatttttttttccaaaaatgcagtagcatgcatgcaccatgcaatgcaaacaattgaaatccctggacaaaatatcaaaaaactttcgggtaaataaccctgacctgtcagatgattgatgctaacatgataacatccatgcacgcgttgcgtatcaacgcagatgattccatcttcaatttcccatttctccctataaataagtcgcatttgatccaaattcgtctcgaccagcgtgcactgctctcacccaacaatgtccatttccatgacgtcgacggcggcggcggtcgccgtggcgctcctcgtcgtcgccggcggcgccgggctcgcggcggcggggacgtcggacctgtgcggcctcgcggagacggcgttcggcgagtgcacggcgtacgtcgccggaggggagcccgcggtgtcgcgccgctgctgccgtgccctcggcgacatcagggacctcgccgccaccgccgcggagcgccgggccgtgtgcgcgtgcatcctgtcggagatgctcgccgctggcgacggcagggtcgactccggccgcgccgccggcctccccgccgcctgcaacgtccgagtcggcttcatcccgaccagcccaaacttcaactgcttcaggtaaattacaagaactccccattacgcttcaaaaaataaaaacattttagaattcttttttcttcatatgagctgattttgttttcaaattcttttgcagggttcgttgaagaatgaacaaagcatcaacacatggaggagttacaatttgaaaaccattgcaaccttcaagctttacattgttcttaagtttcaccattgtttgtgtttcatcttaagaatattataagcaatacattctcaatcttcagttcatcagtctctttcggctttggctagtgcagctttgctttcgtgaattctcaagcattaatgatgcagttttgagcttggtttgtcctaacccaatacacgcgtcacctggaaattgacattacacttgcacaaaccttcactgggcctaacaagttcggcccattaagcccagatgctatctgggcctcacgtgccgattaaacctggcccaaatgattacttagacctcatcaagttgcgtccttttctaatcatttttcttcaaactatttttttcttgcaaagttgcaagaaaccgcagaaatcaaacttcattatgaaataagggtctgttcactttgatgccattttcaaccttactaaattttggtaaagttaaaaaaaaaagtggctacatttagtttgctgccaaattttggtaactatataagaaatcatatcaggcaactatgccaaaattttggtaatgccaaaaatttagtaaggtttttttttatcaaagtgaacaggtcctaaatatatggttccgtagtccgtacagtttacgtacagaaatggtcttccagcattatggttgcgtaattctgaacttccttcggcccaaattcatcaagatatacagcagccaatgttgtacaggtcaattttctgcttctgtctgacctgttccatggataaaatttgtcgttaggaacagttagtcaaaattattatttaatgaacgttatttttcccagattactggggaactatagtgataagcagcagtagtagtactttgtgctcacctgttgataataattaattgagcaggtgattgctctgattaagattggtacttgctccgatagagaactctacggattaactttgtttgttggatatatgtccaatactcaatgtttacttttgtaaggtgtaccttaatttggcactgcccaagaaaattttgacaagtacttattttttaaaaatatttgataccgttgaattttagatataagtttgactattcatcttataaaaatattatctatatgacttatatttttacacatttgcatacgtattttgattaagacgaatggtaaaacatgtttaaatgtcatcaaacataaagaaaagggagggagtaatcgatctctcttccattcttacagcatactggtaataattactagtataaaaccatgttcagacatatagagaattggaatatgattctctacccaacatatgcataaacctgactgttgttattccaaagttacaaagctaattttgcttggttttgaaaagaatttgcaaagttaatttggacttcaaaatccaccctcctgaaaaaaaagaaatccatgggtggaatgagaagttgaaaagaaaaatcttttggtcatgtgcttgcatggtctcagtcaaccaaagacattttccctatatatctttaccaatctctcccagcttgcaaggcatcaatcttgaaagctcctctctctttcttcctctctcgtcgtcgtgtcgtcgccgccgtcgccggagatgatgaagcacttggtggagtcggagaaggcggcggagaatgccgggccgacgtaccggaacgtgctggccaaggacgccgggcttctgcggccgccgccgggggtcgagagctgctgggacgtcttccggtaggtgatcgcgcggtcttcatttctcagctccggcgatcgccggcggatggccggagacatgcagctccatttgtttttgtcattcatagcctgattcgatcggtttcttgaatcgtcttcggataattttgcagcaattcggtggagaagtacccggacagcccgatgctcggtcgccggagagtcgtcgacgacggcaaggtgattaattcaatatttcttttcccttcgtttgaacaagaataatctttcattatttcacattggtttctgctctagcttgtagctataattctctcttctgccttctacttctacaaaatgtattgctactttgatcattccaagcaccactttattatttcggatacacatgtggagtaaaacttattttttttttcggtttaattagttctctaatctgtatagttcatttgcaggcaggtgaatatgtttggatgacttacaaggaggtttatgacgttgtgatgaaacttgctgcctccattagcaagtcaggaatcagcaaggtaatcaacttcccagatgaagattacctccttaaaacttttgccggcagtaactttgttttttttataaaaaaaaaacgtaatgcattcagtaacatttaactgaatggaaatatttgttaagcagatcttgattccaaagatacatagtagtaaatgaataattggcaatagtttatggctcaggttcattggatatatatatttagatcatcatcaatggccatttgtgcacgtcttgatcaccagcagttggttagctgcaaacctgagccagctgccaaatttaatataatgtgagcaattcatgagattgtggatgcatatgcatgcttaccatgaattttggatcttacaaaatcttgatagtttttaaaataaactgcgcaggttgtgcatcaatcaaacaagattggattatttcagatatgtgagttgacttggtagtaaattaaccattaagcatcaggaaaggcttatttattttgattcgttataagcataacttaattaatttaatcttaaaacacagtaacttgacattgctgaaacaagatttaccaccagagatgaagagttccactcttgttgtcatcaggatgatgacagaggcactcacaaccataactttggcaggttgtgagcaaaagtccactgtttgaatcttccaaggttaaaaagtctgaagtctgaacaattcattacctccaggagagttgaattgatcatgttctagaatttggatagctccattgtcatgtactagtataacctggcatctttcagttcaatctctttggatatcatattccacaattcagaaaacattcagtttgtttgaaaagtaattgactgaagaatcctctcatttgctgatgagtagtactatgttattggatgggaacagttgactagttcaatcattttagattttacaattcaaatgttatcaaactgaataaattaccaaatttcagggtgaaagctgtggcatctacggcgcaaactgccctgaatggatcatcagcatggaggtttacttcaaccataaattactcatcactcatgcacatgaccagttttaaccattaagttgcatgaacagttttaaccattaaccttaatctgttactctgatctgaccattttcaggcttgcaatgcacttggggtttcatgcgtgcctctctatgatagtcttggtaagcacataaacgcatgtgcaattctataattgatgagaattcttttaaccattcttgaagagttcaagataccgataaccataaattaacacttcaaagtacatctacctcaagggtagtaaaaagagctcaagaattaagattagctcttccttttcttctattttttaatatattttttttgtgtttctgttctaggtgctggtgcagtggagtttatcgtgtgccatgctgaaatccagattgcttttgtggaagagagaaaaatcgcagaggtaattcgacagcttttccagttttttttaactagaaaaaatgcatgtgagttgcaacgggtaaagtctattttaatattattattgctatatagtttagttaagatgaaattcactgtgtgagttcgcttggatatatactcctccggttctattttaattgacgttttggacaatgacacggtctacaagatacatctttgatcttacttttctattataatatatataataaaataaatgcatgtttacttttattatagtactttaaaagacaaaatatgtatatgttgttctagtttctttagactgaatatttttaaagttattgatggtcaaagttataaaagtttgacctcaattttgtccaaaacgtcaattaatatggaaccggagagagtatattattagaaaatcatgagctgcagttaggagtctgatcgtctcaagtttttttaaatagatttcttatgtaattccttatgtattaccaaaagtgaacgatcttaaaaactaactcaaatgtggaaatgtatttccaaaagcaaacaaacttaaaaaacgacttatacacggatgacgtaccaaaatatcggcaaaaacatcttcaatttttataatagtagagatagagaagagataggctgatttggaagggggagaaaatgtaatttgggctggcctttcttcatctacggcccatataatcccaatttggcccatatagtcgatctacatttggcccgctttatttagtcttgtctcggcccggcccaataagatctcgagcataggccgtttcgccgggccgacggacggcgaagcgccggtggcatttccggcgactccggcctagcacggccacgccgcagttgccccgcgcatccgcgcacgccggagctatgcctcgccgtgctccggcgataggccggcgcgctctccgcaggtggcggcgctcgtagcggtttgccccgcgagaggggtggggggggatggggatgggctatggtggtggtcctggccgccgcgttgccccgcgttcggcagcgcgcgtcctcccgatcggcaaatccgcgcagcgcgatgaattctgcaggttttggttttgctctttttttttttgcgcgagtcgagatgatccgtactcatcgaatttatagcaaatgattgggaatttgggatggctagttcctctggttaatctgctctgctctaccttttttgggcgaattccgattcgcttagtgtgtatctgtgatacagaatattagtttgtatctgtgatacagaatattattctcgttactcctttagtgttggagtattagtctttgcatcgtttagttcctggattgtacgtgctccctgttgagcgaatcatgtaattcgttgaagcaaatacaggattttattccattattgaaaaaaaaactgtgatacagaatattattctcatgtatctgttatttgagattactgagtagacgcatatgcagagagtgtttgtaatcattaagagaccacatgctaagctgatgcagtattcgttagaaatttatgtagtgctgaactactgagagctctcgagctctcgattgtgtctcgaatgaggaaatagttgagtccaattgaccaaatagcgtgagatgcagatgggtgttttgggtaatttgattagggagaaatctgtatgtggcagtgcttactatggttgctttaaacttgaaagtatcctaattcttgttaatggttttaatgatggcagctcttgaaaacttgtcatgccacatcaaagtatttgaagagtaagttcattttatacccataattatatcaattagtcgattcccaatcactggagtatatgaattaacttttattttcttatctttatttagcaatcatcagctttggaggtgtgacaaatgaccaaaaagaggaggctaaaaatcatgggatgtccatattctcatgggaggaattcctgatcatggtaatttataaattgtttcaacttacttagtcctttatattggtataattcaagattatattgaagaattaaacttgtctgactaataatgtgttatttaccagttatatgacatgctaccgaaccattacaaatttacaaatgaacttgtctgacttttatgcttatagggaggtgatcatcattttgatcttcctgaaaagaagaaatctgacatctgcacaataatgtacacaagcgggacaactggagaccctaaaggtgttatgatatcaaatgaaagccttcttgttaacatcactggtgctgattgcgtgaccaggtctattggcgaacctgtgagtgtagaatatatttgtattctgtaataaccattgctatgtactatcttgaatgaatcatgcaactcattttatttgccctccattgctcttttgcagtttgatcatgatgatgtttatatatcgtatcttccactggctcatatctttgatagaatctttgaagaattattcatttcacacggatcaaaaattggattttggcgtggggtatgatttatggatactccttgtttctatttaagctttcaatggatgcatactcaaatagtgtcatatatgtatgtaggacgtcaagctgttggtcgatgacattgcagctctaaaaccaacagtattctgtgcagttccacgagtacttgatagaatatactcaggtaaattccaaacgtacacatttatagctaatatcatgttaatgcccactagttgatttccttgtatggaaagtggaactcaatgactatacatgtctcagaatttatttgtctaatcaatttatctgataccctgccatatttctgttcatgatgttaacatgcctagactactattattttcatggtctcattatttctaaatgcattaataaaattttcatatgaagtattgaagtgaacatgtgaaatataaaaatatactataacaataaggtccataacagtttactggaggccttacttgaaattatttcaaaactagctctttagattgaaaatttttgacaaggatgcataagggaacaaaccagaaactgttaattgtcaaatatggtggaaatgttttgcaaggattgatctactagctactgaactctgcgtaaatgaaagtcctttaatgtagaaattcagtggaaagttgcacataatgtctagctgtacttgcaatattttgtccttaactaatattcgatgcattttgtttatgtaggtcttacaggaaagatctcgtctggtggcatactgaagaaagctttattcaatattgcttacaagctgtaagtctggatatgactatactgagaactccttttacaaggctttccaaaaagaatttcttttacagaactcttgagttgatggattggacaatataagtttcttctgatattcttatgtcctttgaccttttctgaactttcatcatttttttcaacttatttgttcagttgattatgtcatggtgtgatacaaattctgaattagtcataattatcaaatgaacaggaaactggacagcatgaggaaaggaattaaacacgagaaagcagctccattttttgacaaattagttttcagcaaggtacaattagctagttcaggagcatttttttatcacttcatcagataaaatttagactgtcaatgcatcttcatatgtatatcattgccctaacttagtgtttatcctttaggtgaaagaaagactgggtggaaaactacgttttatcgtgtctggtggtgcccctttatctgtagcagtggaagaatttttgagggttgtgacatgtgcaagtgttgttcaaggctatggtatatgcttgcttcaccattcaattcctttaggaagtatttaatcaagcgcttcatatgttggttgatatagtaacacttttaaataaaattatgaaaaaccaacttcagggctcacggaaactggtgcggcgtcatttgttgcaataccaaatgatttttccatggttgggactgttggtccaccagttgagcatttggatgcacgtcttgagtcagttccagagatgggctatgacgctttgtcgagcattcctcgtggagaggtatgtgtaaaaggaagtgttctattctcaggatactacaaaagggaggatcttacacaggaagtcatgattgatggatggttccacacaggttagctgtttctataatctctgggacatgctagttgactataatggcattatttttttcagatgatgactatatgccaaataccatgtataatacaggggatgttggcgagtggcaaccaaatgggtccttgaaaatcattgacaggaagaaaaatatattcaagctttcacagggagaatatgttgcagtagaaaatctcgagaatgtgtacggggttctccaagagatagattcggtaactactatactaactactcactttttcaggggatcgtctcaaattttatgtttctatctgatatgagcctttttttccctattatatttcccatatgttttttatgtttgttgaaacaattgatgaatgtatacagcacctgatctgaaaaattagatgaagttaaagtgtccctgagtgggaaaaaaggtctttatagcataatctgctgatatcacaatatggttttaaaagcaccagtttaattttttttagccctttagcgttttgattaaaatgcatatcaaacagtaaattcttatgagcatctaactgaaccatgtcatggcacctggcttacatgctcaatagcactaaaactacacaaaaatggaaataatggcttcgcctcaaaattgtttactgtttggtagtgtctcatgctcatttggttctaaccattttagaggctatatagtgcatgtttgtttggaaatgtgatgcacctgactacccaatgcatgaataattgaatcttttttttgggcaacgttttgtttgtagatgtcttgtttttcattgtatcttctaatctatttcagatatggatttacggaaatagttttgaatctttccttgttgctgtcataaatcccaaccaacaagttcttgagcattgggctgaacaaaatggtatctctggaagtttatctgaattatgtgaaaattcaagagctaaagaatatattctttcagaactcacgaagattgcaaaggaaaagaaggtaaagttttgtggcatgtaaaccctacaattttctacgcatttcaacggggttagtatttttaaatgtttatatattttttaccttgccagctgaaaggctatgagttcataagagctgtacatcttgacccattaccatttgatatggagcgtgatcttataaccccaacatacaagaagaaacgaccacagttgcttaagcactatcaggttggatgccataccaaaaacagtttctctgttctgcaattccattctttgtcatcaccatcatttcttgaagtcttctagctaatgcaagttaatataatctctaatatatttattcgtgcattgtttgttcagggaaccattgacgcactctacaagatggcaaagtaaacgagcaatgctacagacaattgaagaaaggcttcacccattcatgtaatctcaccatgttggtatatatataaatccaattcacatgtcatgtacctaaccactcataaaagactggaaacagatcatagccttgtctttcttgtgctgaaatgattactgtcagaaacggtgtgacagggactgtcttttgttagatcattctgttaagtcatcctatgttttgcacaacttaattattactactattcccttaggctagaatctcattctgtgcatgtactactactatttctgattgcttagcaaataatgataagaaaaaaaaagggggggggggaactattccttgtgcggctgtgacccacaaactcccttttcttgggtcagcacgcagtcgtaagcacaagctctgaagcctctgcgtcactgtcatccatctcctgctctacacacggaaacaggtttgaagattcctggtcagttcttccaaccttctaagttgacctctcttttgccaatagtattgtgctattctcctcttctttgatccgtttgaccagtagcaatttggagtggagggttgactggtcagcggtcaacactgtctatatgagcttttgaactttcctaagtccaccaaactttgccaaaaagcagttctatggtgagtgaatgccaacacaaaagatgctactagttggtatcaagcttaaaatgcaacagagcatgtcattatcccagtgagaataagcataccacatcaggctccaaatatgtgattgttctggaaggcatcgcattaatacctgcaatttcgatgtaatatccgtgagctttggaaaaggctggagctaattagatcatcacacttgttatcttttattttcacaagtcaaaagttctgagcttttggcatggtagcttaatgcttatggtgaatatgacattaattaaacaaaagaaaaagaaaagcctatgcgtgttcccttttcttcctcctttattttctcctttgcaatggagattggagctcctttcttggaaactcttgtgtttaatttctacacaaccaactgaatcagggggaaaaacaacaagttgacttacaaaatggaatcaaatagtctacaaagtagtaaagcttatgcaattatgcactgtaatattcccaagataaatggaaccagatgagattaattgacattaaaaacataaagtagatccatactactccaagtaatgctttcttctttcgcaaactacgaactaccatagtatacgatgtcaagtttttcggccggtaccgataccgggtgtacttagcaaattcctcctgatctcccagtaatagcactagtacgatgatgagtatgaccaaagactggtcaacggggagcaagcacccaggaaaataaaaggagagaaatacaaagggaaaaaataagaattaaactttgcatggtttctgtttggtcaaacttctcttcctcttaccagcatatcatatctccccaaacccaactaagttcagagttcagacctcagacagccatggccaccggccttaaattcatctgtgcccataaccacatctctgatctctctccatgaatccaaccctagcttagatcaataatgtccttgctaagctatctcctccaattctgcttctgaatttctccattctttccagcaagcttaccaaagcaagcaagcaagcagagaaagaaccgatcaccattccatttcgcttctctcccagttcacgcaatcttgcagtgtttgctacatggtaggaagtgaataaaaagacctgatatctgtcagagctttgtttgtcgtcctagatcactaatttttcagagtttcagactttgggagtttgctgctgccgtcttgttggtcgcctctgcaacttctcttgtgtttctctgaacttgccatgcatgatccttccattgctcctgcctgcaagcttggctcttcaaatctgccattgcaacatcgatcttgcattgcttgcaacatctgaagtctgaatctgcaagctgattgatccaaagctacaagaacaatcagcttagctttcgcgtgtcgtgtcgtgtccaagaattgtgccccatggacggaggagacatccacctgctgctgagcatcctcgccgacggcgaggagcaggcccggcagctcggcgagcccgccgcggcggccgacgacgagtaccacggcggcggccgcggggaggagtactacaggggcgtggcgcggcagctgcagggcacgctcgcgagggcgatgggcatcgcgagggccatcgaggcggcggccttcgccggcggcggcggcggcggcggcgcgtcggggtcgcgcggcaccaccggcgaccgctccgactcgccacggtcggcggacgagagctcgggccggacggcgagggacgccgccgtcgcgcagcaagaacgccaccatgacacgatcaagagaaggtgcgtgtgtgtgttcaaattcgtctaaacaaaaaaaaatctctctctttcagttcgttttaaaatttctctttcaatttgctttaaaatctctatcactgtctcacacacacgtttggcattttggccgtcgtcacatcactttaattttttttaaaaaaatggcgcgaaactaaggacatgcccgccacgcgtaagtcgccacttaagcaaattgagataatggatagagtatattatcatcggcttgtcttatctgaaactgaataaggataaaattcgtgtcaccctttctaagcccctatttgtgtacatggttggacttgtttagagccttaaactttttttttgttataaatctcttgccttaatgttaagaatggctcttatcagtccagctacagtctataactataagtcgtagacaaattaacgaagtaataaaaaaataatattccctccgttttttaatagataacgccgttgactttttctcacatgtttgaccattcgtcttattcaaaaaatttacgtaattataatttattttgttatgagttgttttatcactcatagtactttaagtgtgatttatatcttatacatttgtataaaatttttgaataagacgaatggtcaaacatgtgagaaaaagtcaacggcgtcatctattaaaaaacggaggtagtatctaggtaaaattttacaagtcaaggctaaaaaaataaaccgtggtaaaaaaactcaaaaccaactctaaaatttaatttgctaaaaaaactaggtttaaaatcaagtcactgttttttttctttttagcaaaaagggcaaatgatctacctaatgcgttatggatgtagatgagtatgtatgtcgtctctgtgttgtatcatggtgcaatgtgaattttttagcttccagttccacatgtttttggtagttccaaaatatcgatgtctccggttaatcaatgtcagggggaaaacccattcgaaatatcattgtgactctaaacagaggatatttaatttcctaaaaaaaaggctatttaatttgtggttatttgcttaaatataaaaagaacaaattccgttttcaaaccaatcatatgcaaccgtcaaaaatatatttgaaaaggacctaaccccaaggacgggcaatgtagaaatccatgtcatagttctttggtcaaaagcatggaaacagtcataatcataagtggaaacagtcataatcataagcatacagctgtactgaattattagaatttgcctgagtcaaccaaaggaaaaaaaggagtcaaatatcattgactgaccatttggtataattttcttggctctaaatcatcatacaggaagggcctgccaagatggacagaaaaattcagagtgccagatgcaagtttggaggctacaccagatgatggattcagttggaggaagtatggtcagaaggacatcctcggtgccaaattcccaaggttagctcaacatatcattttatacatgttttaatttaaaccttggtaattttaaacataagtatatttctaaatatttagattggatgcatgaaaacatattgtaggttaaaaaaatattataataattttgtcaggattattattattttgaataaaactagtggtgaaagatcaattttgaagactgtaaatacccaaaacagcttgtttcttgacgggagggagttaaacctacaaaattcattccccacaaaaaaaaaccctacaaaattcaccattatttgaagcccccatagttccaaacacaaaaatcgaatcattttacagcctcatggctgactctacggttgataagcttaaaaaaaatcgaagcagtcaaaaataatttatgggtacaacttttatataagtatatttaatgatttaaaagttaatgatgaattactgataaaacatgatatttttttaaaaaataaagttaagtttcaatttttatattttggttgtggttaacaaacgataaaagcttttgattgggaggcctagtccgagcccaatcgatttatcgtggcaaattcatttcttaaaattgggtcaaaattaacattctcagttttttaaagcttgtgggccgacaaaaagaaagtaaaaaaatgaacgggccagatgcatgatctgatgcctcctgtcactgacacgtgtcggatggattcgcaggggttactaccggtgcacgtatcgcaacgcgcaaggctgcccggcgaccaagcaggtgcagcgctccgacgccgacctcgccgtcttcgacgtcacctaccagggcgcccacacctgccaccagaagcagcgccgcgccgccgccgccggcgaccaaccgcctccgccgccgccgcaggccgacccgagcgtggagctgctcgtcaacttcaggcacggcctgaaggtggagaccaacgggctggctcctccgccgccgccgcctccgacgacgacgacgaacttccacgacgaccagcacttctgcttcccctccatgccgccgttccacgccggggtggggccaccgccgccgccggacgacgcgctaggaggagggtgtaataatttctcctcgccgccgttagtctcgccggccggttcggccgccggcgagagctacttctccatggagcactcctacgagccacgggaaggcggcggccacttcgtcatgagccgaggggactcgtcgaagctccacgaggtagtttccgccgccgcctcctcctccgccgtggtcgaccctgccgccgccgccggcgggttcgactacccgctgtaccacggcgaggtcgacccgcacctgccgttcccgccattgtttggccacgcttccatgtacggccaatacagagacgcgtgatgaaccgtgccacgtgtcacctgacgtggctatgattttcgttttgttaatttgaacttccttttttttttgtatcttgatgacatgataggcagcagtatgcatggagtagtaatcagttagtttgttcttgttttatttgtttagtgttgatgagtcgttacatgacacttgttaactattgaggattttagagtcactcaaagaggattctagttaagttctagtccataatcagttcttccttttggaaaccttataatttgaatttgagttttgtgaagaagtattggatatacgtcactatattggtgaaatggtgagatgtcatggaattaattagcagtacagtgcacacagtttccttgtagttttggacaaataccttgtagttcagtgatctttaggagtacttatccagacttgatagatcacagtgacctgattgtatgagaacagtatattccctattggttaactgcattcagtgagcaaagctggtcactttcactgtcagtaatgcatcatccatgcaagtgttcagttgcaggcttcccaggttgattgaaaacaactgctcaatcattcattggataagattaagtcctttcaggtgacactgtcctactgaacattgcactctgacagagagtcatcagtacctacaagaatgtatcccccctcttttagaaaaaaaatcaatattttagtttgattttgaatatagtcacattcataactataagttgtgacacagcctcatcttttgacttatgattatacttataagctaaaatttgaattttaaaccttaaatttggagttgattttgaggtttttttcatcgtactttattttttcgattttacttttagattgctaagaaaacgtatataaaagttttatttacaaattatttttgtttgtaaatataacgtttcgcttattccgttaataaacgaaacgatggcctccacaagtttttttttttaaaaaaagatggatggaatacacaagaagatgaatgaagaaaaggtttggcaggagcagggaccctgataacctgatcaattagtgagtaatcatcttccctctaccaaacggcactaagttgtagtgttatggtagtggacaagataagcctgaatccggcagcctgcttccacaaaaagattgttcttcagtagcagcaagattcggcaagcctgcgtgactgccaccacaagttgctcccttgctgtgtaaccttctttaggcttaattagaggtagccccgattatttctaagcagaaacggcaaagatgttgtaatcacacagttaggacatgttcggtacagccccaactcctaaatttagcttcaggagttgggtctagagtggagttgtgaagctccctagatccagctacacaagtcagttcattttgtgagagagctttacccagcttcattctcagttttggtagagctgaaactgtttggctgagctccagctccaagaggggtggagctagagctggagctgtgctaaataggcccttaaatacctattaacaacctgctaaatttagatcagtataaaacacgcttctaattttaccgtgcgctggaggctgcaaaacccatcggatcttattcgattaatgcccctaaaaagtcaaaagtattattccacacttatcactacaaaaagattgagagagatttagagataggaggattgagagggatttggagagaattaattccatgactattgaggtgtgaaattaatccaccttaatcctattataatcccttgaggattagccgaacaatgaaattttactattttaaatgtgttggttggggacaagaccactatagctttgtgcaatctatagttataccattgacgtatggactacagtaaaataagtcgtctatattagtgacttaaaaagcttcattagggttgaagagagattttcaacacatatattaaataagaaaatatattagtatatgattaattaagtattaattattacaaatgtgaaatatatgtttattgttgtgttagaggtataccacgtggaccttcggctgggcctactgaaaccaaggacctaggcgaaggactcaagccgggggcacgcggcgaaggccgagaaggcacccacatgggcgaaagccacatggcgaaagccgtggcatgaagtacgcgggcttcactaaatgcggaccttgtggagggccatacggcgcgaagactgcgggacgaaagcctttgcacgaaggcatgggtttcgccaagtaccaaacctcatcgggagaaggcctagcgggccatcgtgtcttccagaggtttcgccaacaattgggcctagccacttagcccattaggggcccatacatgtaaattctatgtaaaacctaaaccctaatgatggaggagtctataatagagctataaataggcccctagggccatgtaacaaggggatctaaaaaatttttactaagcaatacaattatctttttttccaaccactgttgagagaaccacgtttttcgacgtgacgcagttgtcgaaaacgacaacatgttgttttctaaataaatttctatatataatttttttgtttcacaaaacatatcaaatgtgaaaatgaggaggttaatgtttggagttaagattagaacagggtctccaaacttcaacgtcttcattttccgttagcatattttaaaaactgttaaatggtgtgtatttaaaaaataagttctatataaaagttgttaaagaatcaaatagatttttttttcaagtttataacaataatactccctccatctatttttgatagtcatatttccaaatctgaaaattttatttttgataggtatatttcaatccaacaacatatcatcttaatgattttctcgaatttaatgcgtgactctccattcttccacacatgattggctatatgggctttgagaaatgtaaatattaatgaatcgcttgtttacgatgaatgactagtagcatgcttaaataaatgataagtagaattacttatccttggtctgtgtgtcaagatgaaatatgactattaaaagtagatggagggaggtaatgaattttctcgtttcgcgtgcgctgtaaatctttctccaccatcaggccggcgatctggctccgttcgttggacaccgtgcgggtaaaaaagggaggcgccgaggcggaggaggacggcgggtgggcgcagcgcaacggcgcaagtggcgagaaggaaaactcgtgcttccgccgcgattttccccccacttccaccactagactatttacg

SEQ ID NO: 42247 - DNA, 892 bp, Oryza sativa
  unsure (1)..(892): unsure at all n locations
ccgccctccccctcttctcccttccgggtttttgcctttttaccgccccgctctgccccccccttccccacgccgcgccgccctcctcctcctccgcctcgaaccggggccgcggcaccccggctggatctgggcccgaacccccgatggcgttcggcggactcgccctcgcgctcgcgctcctcgtcgtatcaggtaatcgatcaatcaatcaatcccctctcctctcgccctcccccgccgcgtgcgaatttgtggtgggcggaacgcgcttcggtttttggtaggatcattccgtggaatcatcgctgcgttgggtagctatgtatgtgtctgcgctgatttgcgcgtgtcgtttttggtgtttcgtttgtttgcagtgaacttgctccaggttgcgagctccgatggcgaccacgcgcgctgcgagggggtcgtcaagggctgggcggcctcggttgcggggagcgagggcaaggatggggacaagctgagcctcagggatctgctcttcttccttcacattcctagaaccggtggccgtacctacttccactggtacgatggggacatgcatagtagcttgtttcatcgtcatcaaaggatgtgtgcatttcactcatgctagttgtttttggcagcttcctgaaaaagctgtataccaatgctgaggagtgtccgcgatcctacgataagctgcggttcgaccccaggtagaaaagtttgttctctgtttttgttctattgtatatttgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 42248 - DNA, 13014 bp, Oryza sativa
ctgcagcccctaaagatcgatttttagtcccggttattttacccgggactaaagatagcgatctttagtcctggattcgtagtcccggttatccggttggataaccgggactaaagtgggattacgaactgggagtacaaagggtttctccataagtgaacactaggttgatcgcgagagagagagagagtagtgacataagaaatagggtagagcaaaacgagatgtgaggaggaggaggaggaggaggggaggggggatttaagggttgttcagtttgctactattttcttccacaccaaactttggtattaccaatttttagcaagatagcaatctaaacacatcccaaatactctaccgcaccttaccataccaaattttggtgatcttttagaaacttctccacacaacactatacaatagtagttggcatggtaacaaaccaaacaacacccgcacacttctaccctatcaaattttagcattatcaaactttgccgaattttgatcttaccaaaatttggaagtgttaatttcggcaacaaagtgaacaaaccttagtgcctacaactgtcgaaaatgaggggaaggcgttgcatgtgaaatacttctttcttttttctttgcgattacacggcgggtacgcacgcacaccactatacacgttacaccacactcacacactcacgaatacgtcccctaacacatgcttgaagagacgaaaactagcgatatatatttgatctcactaaattcttgttgaaaacccacttgcgtatgcataatatttatgagcgctatgattcgaactctggtggttgtcccaccacaccactgatgcttctcttgtatgtgtgaatactttgacacactagtagacgcttgtatagtgtacgtagtattggtaggttagcctaatatgagaagttgtgttgatgagattagagaacatataaagacacgtattagaaactagaaagtaacatatccaaactaaggttcgcctcgttgttttattgagctagtttggcttagcttgttaagcttacactggtggagaaaccatctttggtcggtcggccgaaatccacaatagtcccaattccacaaaaaaccgggactaaaaatgatctttagtcccggttggtggctacagtgggcatatttgatctttagtcctggttggtaacaccaaccgggactaaagatcatctttagtcccggttctagacctgtcagaccttgtcaggccccctgggatctttactcccggttggtgttatcaaccgggactaaagatctagaagatatttagtcccggttggtattaccaaccgggactaaagttcaacgcttactatataaggcttgttcgctatcctctcctccacaaccacctcgcacttatcctctcagatctcgatctccctctcctccctctcagatcgatctccctctcctcctccccctccgcttcctccccttcctcctgccatccccggccctctcctccccgtcctcccttcccatccgctcagatcgatctccctctcctcctcccctcctcctctcagatcgatctctctcctcctcctcctccgcctcctccccttcccaacccatccccggccctctcctccccctcctcccttcccacccagcaggcgtccggctgggccgcgcacgggcccagtggcgagcggcggcaggcggcagccactgctggcatctttttttttttacaatttgtgattcactaagatgtataattttatgatttgtggcatgacctgagatgtataatctgtgatgtatttggtttgtgtgtaatttttttaagatttgtgatgtatttgatttgtgtgtataagtaacttaagatttgtaatgtgaatgttttgggatgttactttgatttgaggtttgatttgggatatgtatcccacttgatttgggagaaaatacagggattaaactctagctaaaaaacaatgaaaaaaaaagagacctaatgggactgccgctaccctctctttagtcccggttggtgttaccaaccgggactaaaaatggatctttagccccggttatttcaatcgggactaaagatgggcatctttagttccagattcatagacccggttgaaaaaccgggactaaagggggattaccaaccgagagtataaatggtttctctaccagtgttattagcgagaagtctagctaggcttgactcgcgagctggctcgttaagctcattaacatttattccaccagtgtaattttaagtttatcattttatcatatatgtgtggaaacgaagaatccactaaatagtaaatacatatatatagttggatataattaaataattaattaaacaccagttgtgaagcgctgggtatatgaagatacggtgatgtctagtactcagagattaaaggggtactagataagagagatgggataaaatcgctcccatacatcgtggtgttcttttccggatggttttagccaaagaccaggttgaggcttgactcttgtgaagagagaaatgtttgggcccatatgttagctcctattgtggcaaagcagagagatattttttttattttattttaatatacatgtaactgaacatggtaccaatgctaatctatacacccttcgtaaaaaaacttaaatcttggctatgaacataaacacgtcatttgattacttttttatgatgggatacattataacttctttcatctggtactgacatagatccatatttaatacgtgtgtatgtgatctgcacactattgatgctctaacatgctaaacaagcaactcgaaagctagctcgttaagcttacaaactataagactaatttgacttggcttattaaaactagagtctattcgagccgagctcgctacacaagccaatttaaactactactccctccgtcccaaaatataaaaagttttgaatggatgagacgtattttaatactacgaatttagatagactatgtatttaattaaaactccttatattttttggattataggacgaagggggtacgagcttagagctcttcttctcgcccctggtggtaaaccgaccaccacgggatcgacgtctcgctacgctgtggcgctgcgtgcgccagcgccggtgcaaagcgtgccataccgtacctgatcgcaaccagtgaggcctgcaggctggcagcaactgcaaagcctggggcgttgcggacggagcgcagggtttcgtggaaaaccgaggcacccatccctgtcagtgtctgtcgggcagccagctccagggaataatggtcgcagctttggtactctatggctatgcaccatccactgcaccgcatccgccaaatgccgcccgggaccagctgcagctagacagctagtgctgatgtatatacgcctgttgcaatgtacgattactacgagaggaattagggagtattagtgtactactgtgtgatcctcttgttttattgtaggttgcacttctgcttagatatggcacggttgggttgggcgtttttcattcctggctagcttggtcccgttgtggggaaccaatataacttgtcttctttccctcgactcgatcggatggcttttaagctatggcaagctagatgtgtcgtagattagttcgaaattttgataaattaaccattttcaaaaacttattttgaaactagatcttgtaaaaaaaactttaataaaaactgaaccatgacctcagcacgaatcttagttcctatacttcagcgccagtggcgcagctagaggggttgccatagggtgccaacacccccctatccaaacactaccaccactacacccccatgtttttactctatattaaggttagctaagataagtatttatctagtttattttgtgtagcttgaaagtattatcagtttagttagttagcaagtctaaaaatattagcaagaaacatgatctacaaagttaatttgtgatttctcatctttttcaagtaaaatagatgatacttatttgtgagattattcaatagtttacattaaaagaatttagcaataaagactagttttaaacttctaatgatattattaaagagctaaaattcaagtttttcttaaaggactagtttacacattgcttgttattgacggtgactatttgacctcctttgctatcaatattagttattcggtatcatggtttatcttcacccccacacctcccccgccccgccccatgtgctcacatgacacctgagctgatcccctcgtaaacatggtaggtgcttagcaccaaccgctttgacgttcacaaggcttgttggtgctgaaactggggacttagcattgcgtgcgaccaaccttcttcttcctctcctctccttctgtgtctatgtgcgacaacgccccccccccccctctccttttccccagatctcctcaaatccaccccaaattgaagggatttcagggatttgttgggagattgatttgcaaagtaaactccttccaagacccatctttctccatgtattttggttgttttggttgaaatctaaattggggaatcaatgtgggttgggatgaagtgtggtagttccgtattgatgttgctcaggatgattcatgttgatttttgtgtgggaatgggtagggttacaacttataattatgaaatttgattttgtgtgtgtgtgtgtatgtgcgatgtaatttatagtagtttgaatgtgttaagttgtatttcaatgttggaattatcagtagttgattcatgtatattttttttacttttgaaaacattaggactactagtcatccacccatgcgttgcacgggctattgttattggtacaataaatactaaaattgtaatcatatgttaaagtcattggttatttatgaaattattaagcttaatgtttctaatttagttttctgaaagcaaattgataaaacagtaaacttatagttcgagatcgatggtacattttttattaattaattttgaattttaaaattattaaattttataaaaactaaaactaaataacccttggtaatccaattcaatgttttatataactatggtcattagatatgtacgggttgcatatagatatttttatatgccaagagagcaggtcttttacaattatatattatttgttacaaatataatcgttgtagacaataagactaaattattaatttgtaggaactgttgttctaaataatataatttgaacacatgcaaaatttgtatcagtaactaccgaaatgtagacctacctcaatgataaaaagatgaatctttgtaaatatgatttcatacagtctgtagatatgaatctcttcatctataaattaatgccaaaaaaaagattatggtgaaaactattcaaatttttaaatactttatttagtagttcaatagtaaactaaaaaggtacaattctgaactaacgatcaaatttttcgtgttctgaaaaccaacttttgcaacaatcaatatagaacgttcaaaaaatgctatacatcattccaacttcatgcacctatctttatttagatgcattattagaggttgtgtaattcaccttaattcaatgtctaatttaagtgttgaaggataaagactaatacaaacgatagttattctaaacggatggctaaaatatagtttgtttgaacccatagtagaaaattaaataaataaagaaaaagttattgctacatttcaattgcctgaaattagaggagagagtcaatgccacaggacaaaatgagagtgtgccccaagtgcaagaacaaagaggagaagatatacacacacacatatattacgatggggtaatataggtagctataaaaactatcctaacctaatcaaaatttaaaaacaaaaaacactcagtgcactataaaaagattcggtatagtaaattggcctccacgttccaatttaattttgatttgcatggatcgatctatctttgtgatgttagcgtatttgtgcataatattagtttgtaaacatagcatggattttcccccaaaaaagcacagactaagctaatattgggttggatcaaaccttggttaagttgatcctagctttatacatatcaagagcgaggcaatataatcagcacggctcatggatacagatagaattagtaatacttaatacatgaacatacatgacttactaccaaggtttggatctgattgatggcatgaactatgacgatcgagcctctacaactgctggcgcgcggctacatggacgtcaactgcccggatgaatcgatcatgcgtctttccatgtaggccgcttcttccttgcatttaggctttagctccctattgatgcccatctgttgcatatacccatgctgatggatgcccaactgtcgcatgcatgcctgactgatcgatttccatcgataaattcctgcatcgtgaaacagatctaatcgtgttccccagtgctataactgccaatatcatcttttctctcgcacaatctctctcttatctcctcctccgtgaaggggtggaaaatagattgatttgaaggtagcccacaaagttacacacacggattggtttttgcaatctactgtgactataatatcaattacttaatcaacggttagatttttttggttaacatgggagctcgtagaaagtgtccaattagtataggtatagatatatgtgagatagggtttgttgcaagtaaattaggcatccaattcagagttgtaataggcacgatgtctaaaatgttttgaactactacgctcttacgtttgttagttttccgattgatgtgacatttattagtttacctcctatatgtattattttgaaatgctctatttttatttattggttacatattgtagatggatagattggtacaccttcattttggtggttgtgtggtagagaaaagaaccgatggaagccattttgagatgatgattgttaggcagctagtgctcggtgccaaacccacatatatgaggtaatttttcgtatgaaggacgaattgggtaggatttataagtcagttggtatacaagaaatatatgatgttggagccgatcccatgtcgtataagtatgtgttggacttgaacagagagatggaatgaaaaacctatgtggatatagtgttgggtcacaattcaactcgtttgaggtgttttcttggaagaaggagtgcagggaatccacaaatgaattcttagaccttaatcgaagtatgtgtgtacaatcccccagtattgtcatgaaccgaagaacgatgtgtttgtggcggatcagaaggaagaggagtttaaggagaagccaaggtatgctcgaaaggaagaagtgattgaggaagacgtcatggtaggggaggaagtaccagttgaggaggatgtggaggtataggagaatttgtcagatggtggatgataatcatgtagagaatgagatgggaggtgaacttgatgataggcagatggcttctaactcgaatggtgatcgtcctgtgggcaagctgttggaggaagagaggaaggtgtttgaggaaattgtaggttgcaattctgaaatctctcaattcgaggatcttggcaatgcgggatgggtagttactgacaaggatctagaatactgataaaccctaagcaccactcaagacaatcactgttgttggcctgatctttcgatgagttgatgataactacgatttgggagaaatgttgacgacccgactacaaccgtacaagacattgcgttgcgccttagtgatcgatacacctctccatgggttgttgatcttgcctgtgcaaatcaaccctattcctacaagcaaatcaaagaaataagcaagaacaagataaaagcaatctgatattgcaaataggaattgaatacaaatgataagttgggattccgaagaacaagtagacgggcggtctagccgacatgcgcgctgcaagcaaataacaatggctaaactttaatctaataaaacccgagaaaaccctgaaggggtacctagctatttatagaggtgagaggacgaccaagggtgccctagggtcgtgctccaccagattggggcggcatccaagacaacccacttgggctagggtccaagacaaagttacatgcccataggcccactattggtgatgcagcaccttgtttctttgattgcggataactgagatggagtttggtaatgaggctcgatctgttggaaacaggactccgagatctttccatcaagtactcacaggctgaaaacggaggtcgtacgcatattttgcggccgtttgaagtcagcaatgcaataggtggccgaatcgaattctagcacttggaggacttgaccttgatgacttcttattgatccatgatgtgagcaatggtcgtatcaatggtagccatagtcacatcaacaatggacccattaatgaaatttgggaggaatcgaggaaaggtttggaatttcgatctctagaagacttgaaactatggctgcagagctactctatccgtgtgcaccgccattccttgtgaagaactccaatgcatctattaagtacatggtggcttgcctcgatccaggctgcaaatgggaggtttcttcaagaaagagtagagctgataggtagaggataactggtgtatgtgaagatcacaagtgttgtagttctgaggcattgggcaacacttgtagctaacattaagggtaacagcttactgttgacggtccttaaataacaaatctgaccgataattcctgcataaaatgaaatgaaataccaaacttagtagcagtgtttattactcatttccacaagcattggtgaatatttgtatgcaggtgattattgactattcgtagctgtaagactacgcaaagagccatctgcatgggagccaacctcaactccatagtgaatggtgttgagctagtacacctcagcaccaaatgagctggcgctgaggttaccagctcaactccattccccttagtgtcgagatgttgaatctcggcactagctaattttgcgctgagatgtgggcaccgagcgcgccacccaacacaataccaatgttttggtggctggttgctacccagtcctcaacaccaaatagaatggtgttgagccctggatagtagccccctactttttttccttaaatcctcaggagggtagcacattacgggttttacaatgcaagtgttgacggttcttaaatgccaaatatgcctatcaatttctgcataaaagaaataaaagaaaacaccaaacctagtggtagggtttattactgaccattttccacaagtattggtgaaatatttgtatgcaggtaattttgaatgaaaaacacacctgccatgtgaagaaatacagctccagccactcagacatgagcataaggattggagagcccacaaatagagaaaaccgacttaatcgagctaatccaccatgcaaccacacaagggcccaccaagcagccactcaagcgaaggagcagctgagaggtgggaccaggagttcggctgaccaagggggtcggccgaaccgaccttggccccctctcatcctggccctccacgtggtagcttttcattggatgctaatgatggttgtgggtgaaactgacctacataaccatcataactgcctataaaagagtgtttcatcatcactctcaagacacacatctcaggtggagatctctaaagttcattcaaagctactttctagtagagtattggaaaatagggagagggtgaggggaagttctggaggagtgccagagttgtcggcactctctcctctcttgtacctcggcatacgcttattttatacaagtgagtatttaagatttctcttggttatttaattttcttgtttaagtaagaaatattctcatcattgcatattcatcgcttagtatttaaattaagtgctctagtactaagactctagatgaagaaggatgttcttgcgcgaggctagagtagtaattgataacgtggacatggtatctaggttagaggtttcctttgtgttgttgcgtgctccacgtgttgtagaggtaggcggcaggtggtgacaaacatgtccgtcctttataatcttccatgtttgtgtatgtcatagagctgtaggccacatcacttggcagactagtggaaagccgatacccgaagcaattgatagatttttatcctaacatatttcgagaatcttaacccacatgaatcatctctgtcctaagcattccattggttgtccttggacgaacccatttcttagattctacacacatgttccttgtgatttgatacccttcgaatactctaaggagaaatgctacaacggtatacgtgcgcttgcggatttatctgtgatcgtaacaaatatcaatagaaagcaagacatgtactaatgtcttatatatagatagaatatttcgagttggaagcacataaattagttttgataaatcaaaaaaacaaaaggattgaatagttttgacatatcctcaattttgttcaactacaaatgtttcaacgatcacatgcagcttaggggaattaaatacatcctactaggtgcaacgggggtacttgcccttcctagcggcctctggtccggcttccttgcatgcttctccctagcaacctttctctccctttcagccgcaaggtcctccttctccttctgttctttctccttgacccacttcttttttctattttgaatctatgcattcctaaaccagtagtgaaagtcttcttcccaccaaagctcccccctgcgaagatcctcgacatctttcaggtgggtctccttatcgatccacaccacaaagtcacatagaggaggtggtggcttcggtacctgcatagcagacaacacactatgaattcattctacaaattgcatgcataacaagagaaatcatcaggaagaaaagaatttacctctatcggctttttcgacttttctttctttccctttggctttggcttctctagggtgtatgtgtagttgcagctcaaatacctttggtgaaatgtcatctgactgtcacttattgcaaattgccattcatcgctacaccaacacattagacgaggaatacttgatgaaggttatcaacgagggctataccccaccaaatccatcctagcaaacaaagcatagacaaattaaaaaaatatcaaacacctacaaaatactacagcatcactacatgaactcacaagtattataaccacccccaacaaatcattcctaaaaaacaatcaggtcaagtaggtcaaaacaattgtctcctaatatccactatcctaaccgtactaatatccacaaatgaatcaaacaaaccaagccaactaggtattaaacaaatcccactaaaaaatcacaaacaatggacgataaaactcaaaccctaaccatgaactcgaatttattaaggcatgagagggtaacacaagctcacaagatccaacaacagatttgagatagtgagaggggaagaagtaaacttaccttcgaaattgcctgggctcctcgaaaaccctagtttagttaggcaaaactagactgagatgtggatggcacggggaggaggatacaaagtcccctagctcagcaccaacgggactagcactgaggttgggagcttagcaccaagacaattggtgatgaggtcttgccacgtcagcgaggggatctgctttggcatcacatgggcagaggaggtcaacaccgacatggactagcgctgacccgtatgacctcaacgccaagacgtttggtgctaatgccacggtccattttttgttaaagttttttttttttgtacggtctagttttggaatagttttaataaagggtcaatttgtcaaaattttcggtagattagaactacttgggttaagaaaagttaatattgaaaacacaaattcccttcagaaggaaaaaagaacatcaaacgataattggggatcgatataggtaataggggtaagtttcacgagatccaacaactgttagtgcatatatatttgcaatttcctacatttgttctacaaaattttcaaattaaaactccaatttctcgctatttccttcgctatcccacttttctcccatctgcatgtttatcttgtgcctaaaaaaacctcatccgcgccaatggactctcctaccattagggagtagctgaccatctctccctctctcttgccggcttcttttttttttattttattttcaaaactcatgcattttgtttataaagcagtctaaaaatatatgctgtatatccttaggtacaacaacattacatctgattaaatgaagcaacaccatggctatggctgatctaatcaccatccaaaaaagagtactttggaagcaatctagaaggtgaagctctcaattggaagcagaccgcagggactaatgcaattgattggggccaacagcaatgccacaaagccaaggtgattgcgaccaaggtcctcttcttggaacatgcaactcgttgagggttcaatcggcgacccctactgcctcaaacttggcacttgttaaggatgattactgtgggctgtagatttttgtgctacatttttggctattctaaaatatttttttacaataattgtttgtaaaatattttttaaaagggacattatgtaaatatcttttcttataaatatgttgccaagagcctatttgtagaaaaaaaatatttatattttaagacttttaaaaaaaacttttacaaatggatcctcaaaggcggtctttttggtagcgacccccttcacatcagcgacttaggcttaattcggcagcatgggttccaacccatgtaactcgtatttcgcgcgcacgcttttcaaactattaaacggtgtgtttttt

SEQ ID NO: 42249 - DNA, 720 bp, Oryza sativa
gccctaacagtgtgattttgtgaaactttaggaccataatacccagggatatgtggcagtggcatgtgccaaaatacccgtggctttgtgcaacttggatcataataggtgaggtttagtgaaatttactcattaaaattataagatttataaattactcacttgaaccataagaggatttggtccagatggagagataaaaagagctggtccagaattgacaaccgcttctgactgaaagtaaaatgcttactggtcagtacagcagtacagaatcattccaatgtgaaacgaggtaaaaaaaaaagctgtcagaaaaacctacagttgcaggatttatacgcagcatcattgtcgtgcggccaagttctagaagtaatgaaccaaggtattggatgagaactccatatctgactacactgttttgaaggttcctccgtgttgtagcatcagttacattcacaatatctcctagctggtttggtagttgctgcattgaaataactcatcttaacttcagacacgctagtaacgtataaaaccgaagttaacaactcaacaaagcagataagcagcaaaccaaactaaagaaacaaatttcagcatctatgggagtcagttgactaccaagtaatcataatgaagtgatcacagcacaataatataattaacacaggaaatgaacttatcctgcaattagtttttaattgcatacatgaa

SEQ ID NO: 42250 - DNA, 46147 bp, Oryza sativa
tcccgcatgctacaattcagaccatgtgtaaggaatttcttgcattggctatgcaacggtgtcatattaagtcaaagtattggttcgggcagaaaagcagtgcagggagactcgacctgtcaagcagcatgcgagtaggacccacgcagcagcagatgaatatcatttggagtgtcaacggactgtttgacagtacatgatatatttaggatacataaagggttctcttcatttctagtgtatttgatttatctattttggtgatacgtgtattatcacatcatggattagatcaactcaaacttaaaatggaaagtgaaggtgaacaaggtctttgcggagtctgctgtgtgccactaagaagaaatttaatttcacttggcaagacgactatagtgatatgagagaaggtggagccctgttgcgggtggagtcaagagagataatttacggggatagcaaggtctctcgttaacggtgagccgggtgaaggttcgtcgggggcggctcaacatgaacggcaaaaaggaaccaactcaagtctgggtaagcagaggttcatacatgggacaaattcaggttgacgtggcatattcaccgatgtggaatttgttagtgttttgtgtcgaatatgtgtacaaagtaggttacaatttaggaattggagttgtaataggcattaggtctagagtaagagtcggactctatcttaggatctctcttaaatagagagtcagacctgttgtaaccatatgatgacttaatatagcgagagggagcggccgcctgcggcgtccggccgagggtcgttgtaactctgatacgttttaatatgctggatcgggaaatagcgcttgtaatcagcgccccggggatgtaggcttcggctgaacctcgttaacaaatatcgtgtctcgttgttctcatcgtgcttggatctcctatggcgtttcttccatgttcggtttccaatggtgattttgggaccggttttttaacagctaggcatgtgctcgaagcaactgagacaagaaatagagaaaggggagaaagaaaggaagtggattgggaggaagaatatacacgtgggctagttaaacttttcttgaaaaaaaaaatcccctggctcggttaccacgcgtatatcacttggcatcaaactgctcttggcttggttagagggtaattcgttcaatttgaaaatttggagggtgtaaaatattcagtatagaagtttaggggtgtaaatcatgcgtactgttgcgatagttagatgatgttgtgtttagaatattcttataagttgcttgttgaagaatagatgacataaaagaaaccaaagtttaatttgagactaaaggtacgtaagtcgttcttttaagtacaagtggtgcatatcatttagtccaagtggcaagttttcctatttcgttttgtcttaataacaaggttatttgaatgcaagtatgtgctatccccttactggccagacacgtgatttgacgagacttttgtggtcagtcaacggagtgatgcagccaaatcgcaaacaacccgtaccccgcaagagatcgaataataattccccgcaagagattgaataataattccggaagctttgcagaagaaaaagttcaaaagaatcgatataaaaacaaattaattaaagaggtcttatcgacgttcgtttaaaacggaacaagtctgttttttatcatactctttccgtcctatatagctggtcgtcgtttaaggattcgtaatttatctaaaaagacttatcactttagagtaacttacttcagagtaatttttgttacctcagttatcctcaatatatagtttttccttcctacctttaaccaccctctcactcccaacaacacatgaatcaaatattaaggtactatggttatttcttgcccaacacattaatatatgctaaacaatttataataataactacttgggaacggatgggagtactaaactaaggtccccatcgtttggctttttctctaataagccaaaacggcttattagggaatacaaatgaatttgtaggtaaaacttttatatatgtgttctgggtgatttaaaagccaaggttgaaaaagaaactacgttgaaaacatctgaaaatcaatctcaaaattaagtatgaaatttaaaatttggctttttctttagctgattaggccatccgatgggagcctaattaactttgcacaattttactgtagctttactaatgcgtgacaatgctaaaaccactttaatttggaatcttaattaagtagtaagcgacttcttctcaatttttttaaagtactgacttctatatacatgcattatgaacatacacacaattgctgtatagagtatctgtgttaacatctgtatatagtgaaataagtttttctcatgtgagaaatgacttcatgtaatataaaaaaaatgaactgatgatatttacatatttctatttaaatcataccaaatttgtccatatgatcacaaatgatctaccatgcattgttgtaaccgactcaatactgatatgttagtatttatgggttattatattttaagtgtatatgacagctcaatttctcagaaatacttggtaggttgcgtgtatgtgatcataagctctgtgtgtacacatgagattctatactgtatttggggaaaaaactgtctaaagataatttcctttatttggatttacaaaaataaagaaaacgtttcactacatatatattaccatgccatccagaaaaccactcttgtgtgagttcttataaacttttcatattcttcgtaagcacgcttctaactattaaacgatatgtttcttgtaaaatttttctatggagtatctttaaaaatcaaataaataacttttttcaagtttaaaaaaattaatgctactagattagttactctagtggtttttcaataattagcatagagtatatgctaacggtttttcacgtttcacgcccgtgtcgaaaatctaagcctaatcgttgaaaccaaggaaaagcctagctgtgttctttcccatgaactctaactcatcttccttatttatcgcgtgcacgctttttaaactgctaaaaggtacgcattttgcaaaagtttataatggaaagttgctttaaaaatcatattaatccatttttcaagtttttaatagctaatacttaattaatcacgtgttaatctatcgctccgatttccgtgcagatgggagggttcccaacctcccaaaaaaacacagccccgagatatgaatctttcactggaattttgaatggcgtatacaaagacatgaagcattagcatgtaattataattaaccgagtacttcctccgtttagcaacttttgtatataaattttttgcaaaaaatacaccttttagcagtttaaaaaagcgtgtgcgcggaaaacgagatagaggggttgggaaaaggaggtgccgaacaaacccttagaaggtaacctatgagtcaattcgtgggttatgcactagttttgtttataagcgggttcgccgcttagctcgcttgtatccccgtacgagtactctattcgtactcgtaaaggaagtcgtttaggatattaacacggtcttcaaaatataattttgacttcttgtttctataaaaatatttattgaaaaatgatatatgtatactttttatgaaagtttttttcaagacaaatctatttatataatttttatatttttaaacacaataacttaagagttatttataatttatattctcaagatttgactgagttatttataatttatattgttaaatattgtcgattttctttacgagtatggaaggaggacgtatgaagtgaatagagcgtttcgatcgtgtaaggactgtgtttgactaaccagaggattgattcactcgaggaggcggcggaggcagtccacgtcagcaacgacgagggcgcagagccctccagcctgtacttgtccttgttgccgacgatctcctcaaagcgggcatggatggccgcgatgtcgctggagagcctgtggcggacgcgcagctgggtggtgatgccggcgaggaagccgacggcggcgcgcgaccagccggggtagcgggacaggtcgacgcggacggcgtagtcgtcgagggcgtcctcggcgctgaacgcggcgtcgcgggtctggtgcacgagcacgcgcatgagctcgccgccggcgtcggccgcccgcctctgggggtccgcctcctggaggaaggccatcagccacatgagcttgtcgcggaggcggttgatctcgccgccgacgccaaccagcgccctcccctcgctcagggccacctcctgaagcttgctaaccagcggcagcaccaccgccttcgccatcgcgagatctctcgtcactccactgattcactcgctagctagctacgactagcaggggcggattcaccgttggggctcgttggggctcgttggggcttgagccccagctccatctcggcagaaccagcagcagccgcatggtttcgggagagaagcagcgtatagcataagtgcagatcaaccaggtcgcaaggaaggagcaaacaaagacaacatatcgcgatccatgggtgattaagtggactaattggctgctagaccttccttattaagctactgtattagtttttgtttcttttttttttcctacttcaatggatggaacgatcaggggattagggaagtgagtggtttttactcacaaagtaatccaacaattatcaacaattgtgttattgaatttgtggttgtgcccttgtcgtattgtcttccatcatgggaaagcgtttttatccctcgaggggatatcacatcgttttgtgcatgtcatctaaataatcatcaaaaaattaaaaaaatgattaatgtgaaatatatcactccacaaacatgaaagttaaaattcaacttctacatgttgcaaaaaaaataaatataattgtgaatgtacgataactattttcaatttaatttgttatttttgttgtaactcgtagaagttatatacttatggagtaatatatttcatatcaatacatattgttattttttttcaaattaattagaactatttagatgacatgcaagctttcatccatacttcctaaaacgcattagaaaggagcacccctatattttcgttatagattcgccactgacgactagcttgctcgttattagtggtgctagctgtgtagctgctgtatcaatatgagcagaccttgtactgctagttttataactgcgagccgggggtaccgtcctttcgtcggacgtaccaccggcgccacgtgcttcctgtcggccaagttttaataacctttcactgttctctctgtctattagctcgtcaaaattattctcctcgttagatatagtcttttgtttttgcatatagttttgtcacgtgcataatcataaaagatactccacataattaagcatacacgacggcacgagaagctgagaccgatccagatggcattagcttcgaggtcatccctccttcaatattacgtggtataggacaactgacgagctgagcagctgaggaaatactaggttggcaaaaaggctatctaatggcgcagtcacgtggcttgcgcggagaagggggcggagcgtgggaaagaggcacgtggtcttttttttatatttttttttcagctttctcactcttttttttttctctagatggttccaattcacccttttttaatacatacctatacaaacttttatgtgtatgtatataaagtttgtgatatgtttttcttttggttcttttctctcagttattttgtttttaaattatgtacgtatacaaagtttttatacgcacctataaatcattatacatgtgtatatatctttttatacattaaacatatctatataaaaaacatatacatatacatattacaatatatgtacgtactttatatatgtatatataatttgtgtacgtatatacaaaatttatacgtatttatataaagtgtatatatatatatatatatatgtgtgtgtgtgtgtgtgcgcgcgcgcgcgtgtgtgcgtgtgtgtgtagagaggagagatgagagactaagggggccaaaccaccacgcgagcgcacgagcacccgcacttgccccctccccagccacagccagctcctttcctcccgcgcttcaatttgcataatagcttagtaaaaattctactaaaagagactcttcctcctcatttttatattctaagtagtacttttactggatagaaaaaagtccaaatccccctagactatgcccaagagtctatatagtacccagaactataaaatggggtatctagccccccaaaccttataatccagtccatttaaccccctaggctgtttcacgaggaggttttgcacacgtggcagactgactggaccgtatttgccatgttgtcatgctgaccaggcggttgcaaactaataggaggggaagggagagttcctctcgctctagggttcatattccccatcttgagttcttcccgcacgttaatagcagcgtcaaatcccgaacctagaggcgtggcgactctagcgtgggtaatcatagcagcggctctggtgtgcagccaccgcgagcgcgacgaccccagcgcccgtgacaggctgatgatgggatacgcgtaagctacgaatagcataaatctgttgacaaaaaacacgtggcctgggagatcttcttaactccagtgcaggtccaaagctcgccttcgaatgtatgagcgtgccaattgatttgatcctgtaatcaacaagaaatagaagcaaagaaaccgtgattaaaactataaatgatagccgatcggctagatgccgatgacatatcatttatctttgagctgatgtcatctgtgtatcggtcggcagtcatgaataagtaagaaagaactaaatctactcgatcagctgtagatatcaacgatatataccccttatatcgatgtatacttaaatcaagtgatcgggatagatcggtcaccatgccgagacagtataaatcacttagatcgaaatatatatatcaataacaggactatatatgtttatagcatagccgatcagatagatctagcatgtatcggctaatactccgatactactctatatcaggaaattaaagcaggtataatatatcaaacaaaggcctaatatacttagatacaacaatatctcgatataaaggacagatttaacatgtcaatgaagcatatagaacaaatatagttaaatcagataagatcggctgaaactccgacgctactctaatcagcaactagaaggcaggctaaagatcgatattctaagcacgacttaatagatcaaactcaactgatatagcattaagtatgaaaagaagaacgatatctagacaatcaagccgctagaagtttcatagagtggtagatatcttatataatctagatcaacgtcaaaatctaacctaatcggttgccctctgctaacagatgttagccgatagtagattagatagcgatattgccagagattatgtaagatatatgataactcgacgaattacataaacaagattagagtgtcataaagatggaagcactaatcccgagaatataagtcatcataacaagttttacctcttgttgaagatcgaatccgatgcagctcaacccgaaagtaagaactcgtcgaaacaaaactaaagcaaaagggtggcgatgcgccaaaattgtattgaacgtgtgtgttatcaattacatagggctcggggtctatttatacccgagaattacaagatatacccataccggacacgactattatatctaacaaaccctaaaataccataagtctttgcggtagacttttgcccacatttatctataaggaatttacataaaatatcttaattaatagatacaattgccttcccaggactctatccgtgcatggcaatcatcttgaagcacattaacttaaacccgatgtcgtatacaagtcgtattgtcgggatcggctacatcggctcacctagcccgtctcagactcagccgatctcatcgtagccgatctggactccagccgattcctgctctgttttcgaactcgatctccgcctccgactttgcttcgatctaatcttctttcccaatgccgatgttaccaaatttggttgttaacacacgcccccaagtccggaatatttggaaatgtttcggatttgctgtaaatcgactccgacgaagtttcgcactttgccgttttccgaccgttattgccgtgctttaaatactaaccgtcaccctcgagaaatctcacaccgtgacttccgttttcaccgctcaagcgaatcttaatcccctctctctccggcgattcctccgatgcaaaagcgactcccgggcgacttcgtctccggcaagacctccgcctgcaacgatgtcgtcttccaccaacccatctgatgcgccatcaaccgagtacactgaggtaagtctctatcggctagatcccctttcttatcagcagatcgattttctcctatcttatatcgttttccttatatcgattgccttggatttgtagcatctctcccaccaagtcgcaattcccagtcttttgcaccagaaccactatttccttggcccaatcggcaatctcgaccccactgatttcatcattggtgaaaccaaccggatcccttttaggctagccaaccctaacttgggtcactggaagaatacctttaagtcttggccatctctcgaaaaactcacacctgataagagctggtctacttggtatcaacgcggctagtaagaaagttcattgggacgagattggaatcggccaagcacttgctctcaccatagccaattctgctaaggatgaacctctaatggctgccgccacctacttctggtcgaacaccatcaacgctttcttattcaaccaggggccgatgactccaactttaatcgacatcaccatgattaccggattagatgtgacttcatcggctaaccccatgagcataaatatcaagaaccaatttgacttgaagaccaagagcataggtggttggttcggctatgtggcggcatacatgggccaaggatctgttacccctcgagagcacgtagcctttttgctcatgtggctggaaaagttcctcttctgtggatccagttgtggccctacaaccaattggcagttcgtagctgaagccttagaatcaaagaaagaattccctttgggcaaaatccttctcggctatctgtatcagatgttgaacaatgcatcggctagaatagccgtcggctcagtggttggagcaggtggaccctggtggctgctgcaaacttggttaaacctgatagttatgaaggttgtcaatcggccctctataacagaagctgaattcacactgccagggccgatcgtggaagatgacggagaagagcgcacccatcgcaggtgcatgtcgtatggagaatatgcatccacaccaaccgatgcaggagcaaagttatcggccgagctgcttaaggactggttctgtagcttctacgaaggttttaagaaagatgcacgaatctggttcccttatgaagactccgcagacctcgaacttccatcagattttagattcgaagatattaatcacaagaaattccaaaaatccagagaagtttttatagccgcaatcaacccatgcatccttcctgtcggcattcatcaagggagaaacatccaagactcctacgagttttatcacccaatgagctcggccagacaacttggattgggccaactcccaatcggcttattttttgccgacaagattcagtgccgaggacaaatcacatccactctaatgatggatcggctacttaacctacctgggcctcctctgggcagcattgaaaatattgagttggcaggatttagaagcaaaaactttgacagatggtggggtgaatggaagctgcatctgtttcatcaatcggctacgatgtatatgacagatctgttccccgacgtcataccccaggtaaactttgtcattactaaattgcatagtcaattagccgattcattacttgaccaatcttttgctcctgctttgcagacaacagagtcctcccctcctcatcaaagtaatagtggcaagaatattgagtatgcttcgggtttaattctgaatggaggtgggctatctccccctgttatcggctatcatgcccccaagacttcaactctccttcacggcctaactagggaactagccgatgcaggccaaaaaaggaaaaccagaccatcagccgtgaataccttggtcttggctccaaagaaaaaggccaagttcaagaaaaccaaaccgactgataagccggctgatgatctgcccgccttggatccatttattgaacaagccttagatgaagaggaaattggcgaagatgttgaccaggctgtagccgaaatgagtgacacagaaagaacaccatcggcttcacccaagcaaacgcccccaactccttctgcccccgttcactttacaagggtaagtatctctctttaatccctttcataattattttgtcttatagccgatcacttccaagttttataattgcagaaaaagaagactgcagtgaagaagaaatcggctgcaacaacatctaaactagctccaccagtaagataattttaactttcattagttaattctcagccgactctgtctaacacttgtttccttttagcctcctcctcctccttctccttctgtacagcaatcgtcaagtgaccagactccttcggctgtggggagtcatcacgttgaggaagaagaacaaccaactgctcctgctgtcccagtaagtttctctttgtctcaacaaacattcagatcggctatgcctatttaacctctaactgcttctaaatcgttgctgcaggtattagccgatcttttctcttttaacatcagagattatcttgatgaaggagaagaagataccacaagcaaagccttagcctctttatctgatgatgtgaagaaaactctggaaagtatctctgatcggctagaggcatcatcactagatagcttggtggttgattgtggctcaatcagggctcggctacatgagattcaggctctaatcccagatgagttagccgatatccttaccccagccgtttaccttgagcaacactaattcaaactggagaaagccaagttaagactggccgaacggcgagagcgcaaggacattgaagctactatccaagctaaccgacaacttgtgcatgaagagaagtccaagcttgatcaactatctgaaggcccaatcaagtccaacattgatcggctcgaggctcgcaagattgaactcttagcacaacttgaagaatgcaacgctgagctggatatggagcacaaaaaactagccgatctcccaaatactattgaagaacagaaagcaagactcaaatcggctatcaagcatgttgctgatctgaccaagtctctgaaagttatccctggaaccgacgctcaagatgcccaagccatagaagaagtagaatagattaggcagaaggctatattggctatccagcgatacttgtctcaataacctttgtgtaataggacttagaattttttgtaatcggctaagacattctaatactgtactgtcttaacaatcctttgtgccgattaatatgactttgaaaacttgttcaaaaattttccattgcattttgacatatatgtgcccccctaattttacaatgtcaaaagcattgataaaattataaaacaactatgggcgatataacaatatcggccattgtacattggcaaaccacaaccgattacaccatgaaaaacaactaagggcgatataagaatatcggccattgtacatcggcaaaccacaaccgattacaccatgaaaaacaactaagggcgatataacaatatcagccatctcaaggcgatgtaagcacatcggctatcatgcatcggcaatacgagcctatcatgcattaacccaaacacttgggtaagatttcttcaaatacttgccattgagtgctcgcccatagacttcaccatcaagcccttgcaacatatatgctcccttagacacaaccttatgaatttggaacggtccttcccagttcggcgaccacttgccgaatttactatcacaagtaccaatccgcaaaatcagcttccatacaagttctccttccgaaaaatctttgggtaccactttcttattataatgccgagcaacacgttccttatccttggtaaccttcgcaagggctcgcaatcgtgactgaaccagatcctccctctcatcggccataaggttgtaatactcatcggctgttaaatcgttttgtaactcagttcggcgagagccgattctaacctcccatggcaaaacagcctcatgcccataaacaagtttgtaaggaggaacttgaattgatccatgacaagccatcctataagaccacaacgcttcggccaaccgagtatgccattgccgaggataatcagaaattttccgcttaatcaatttgatcaaacttttattagatgcctcggcttgcccattagcttgtgcataataaggtgaagaattcaacaatttgataccgacgctatcggcaagctaaacaaactcatcggacacgaagattgaaccctgatccgtagtaatagtttgaggaagaccaaattggtagattatatactcctgaacaaattgaatggcatccccagaatcaactttcttcaaaggaaccgcctctacccacttggtgaaataatcagttgccaccaatataaatttatgtcctttactcgatggtgggtttatcataccgatcatatcaattccccaacctctgaacggccatggcttaataataggattcatagccgacgctggcgctcgctgaattgctccaaacttctgacaatcctgacaccccttataatatctgaaacaaacttccagcattgttggccaaaaataccctgcgcgccgaagcaaccacttcatcttataagctgattgatgagtaccacagattccttcatgaactttgccgattgcaaccttagcctgatcggcacttaagcacttaagtaatactccatcaatcgtctgataataaagttcaccatccaacagtgtatactttaatgccttatatcttaatttcctagaagccgattgagatggattactcaaatattgatgcacatcttacctccaatcatcggctgtcatcgctgcaatttcaactttaacatctttgatcatcggcttataccccgatgccccttgggctaaatcattagcttcaatattttgttctcgagatacatgctttaaagtaaccagccgaaactctttcattagttcctggcacttctcattataaaccatcaatgtatcgttcttgcattcatattctcctgccaattggctgattactagcaaagaatcccccatgatttcaatggtatcggcttcaacttccttgagtaattgcaaacccctgagcactgcctcatactcagcttgattattggtcgcatatggtttaatagtataagcaaactcgaaacatgcccccctaggggaaattataactaagccgatgccacaactatgagtacataccgatccatcaaagaataaagtccatggcactatttcaaccgagccgattgaatcatcacgatgctctacaataaaatcggctatagcttgtcccttaatcgctttcggcgactcataccgaagatcaaactcagtcaaggagaatatccactttccaactcttccctttaatattggagccgatagcatatacctgactacgtcggctttgcatataacagtgcactcgttagataatagataatgcctcaaccttgtacacgaaaaatacagacacaagcataacttttccacaggggaataccgagtctcagcatccaagagccgtcgactgagataaaatacaactcgttccttcccttccaactcttgaatcaaaactgagccgattgacttctcaccagccgataaatataacctaaacggtacccccttctgtggagggatcaaaacaagaggagagttgagatactccttaatattatctaaagccttttgttgctctgccccccaagtaaactgctgatcggctttcaaccttaacaagggtgtaaaaggctctaaccttccagacaagttagaaatcttgccgatcatctcttgtagttctgtcttattttccaggggctgaatcttcttgatcgcattaacgctcctttgagttacctcggtccccctttcatgaacaagaaatcccaaaaattggccggccgacacaccaaaaacacattttgtcggattcatcttcaagccatattttttggttctctcgaaaaccttccttaaatcggctatgtggtcctctacttctttagacttaacaaccacatcgtcaatataaacttcaaccaaccagctgattagatcatgatatatataattcatggctctttgatatgttgctccagcactcttcaaaccgaaagtcatgacgacccactcaaataagccgattgcaccggggcatctaaaagctgtcttatggatatcttcttcagccataaagatctgattatatcctgcgttcccatccataaaactcaaaattttgttccttgatgcagcatcaactagctgatcagctactggcattggatattagtcctttggtgtggctttattcaaatctcgaaaatcaatgcacaccctgaccttgccattctttttaataactgaaactatactagaaacccattcagcatatcggcagggacggataaaaccagcatcatacaatcgtttgatctcagctttgacaggttcaagcatatcagctttacacctcctcagaggttgctggcgtggtctaacccctggcttgataggtagccgatgttcgacaatcgatcggctgagtctaggcatctcataatactcccaagcgaagcaatctctaaactcttttaagagctctatcagcttggttctaaactctggagacaaattcttgctaataaatgtcggccttggccgatcgcttggacctatgtttatttcttccaactcatcggccgacatgaaaccttgaccttgcttgtcatcgagatcatccactgtatccttggtgtagacattagaaccctccacgacgccctcaaagtaatagcttgggttctccatcttcaattggctgtatatcagaatcggacacttttagaaaatctccatcccagacttttccagataaacaatcaaggccatccatctcccaaagggctaaatcggcactggcaacattaactgacctgtcgactggcacgatctctatcttgtcgccttgccattgaatcaagcattgatgcatagttgaaggaatgcaacaattggcgtgaatccaatcccttccaagcaacaagctgcacgaacccttcccatcgatgacaaaaaacgtggtaggaatagtcttactgccgactgtcagctccacatttagaacacctttggtttccgatggattaccaccaaagtatttgagcaccatatttgtcttgatgagatcctcggcgttcctatccaacttcctgaacgtagcataaggcatcaaatttaccgcggccccaccatcgaccatcatcttagacatcgccttcccattgacgtagccgtttatgtacaatggtttaagatgccgattctatgttccctcgggtttctcgaatactgcctattctggtgacagaaccaacttagccgattcctcttccacttcatcgacatcggcttgatctatcccgaattcagctggcaatgtaaagaccatgttaattggtgccgctacaacactctttccttttgccaacctcttcgcctcatcggctgcagcatcatcggctacaggaacctgattcttaacacgccactcctgtcttggctttggtttcctcagccgatggttgatttcttgttcaacctcctgaaggcgctccctgttcctcaatctttgaacccttctcttctgattttttgtgaaaataccagaaggacaccattgattcttcctgattacctcatcctcttggccatgatcttgattcatcggacccaatctttgatgaataggaagtcttgcctgccttagccgattacccttattatatgaccggctcgagctctcgatgatatcactgcacccagggcagttttcgatagatggcaacctcatcccttcattccagaagaatctaaagaactcacaaccccaatgaggatcaaaaccatcgtcgtattcttcataatgcttctcctgctacttgtcatacttcctctgatacttgttgataatcttagccgaatttacttgaaaaccctttgcacggatcctatcggctgtttggccagctgtatgcaccatattaacaggaaaaggattaccatcgactttcattggctttttggaatcatcgaacctaatctttcccccttcagtggcaacctggatttgctgtctaaaaaccttgcaatcattagtagaatgagatccagaattatgccatttgcaatacctctttttgcccaattcctcagccgatgggattgtatgaccagcaggaagctgaatttgcttctctcggagtagtagatcaaagatcttgtcagctttggtaatatcaaagtcatacttctcttttttaggaatttttacccattggcatggtatgacctttttactcctcacccatttggctgcagctatttcagaatcgtcttccccatcatccgacccatacatatacggacaaacatgattaaccttcttagagcttttcctgacttccgccgacctatgctcatgcaaggttaccttctgtatgataagctatcaaagtcttcagacgagaatttctccctgattggagcaatcataccctggaaggctaaatcggctaactgagcatcatttaaactcaaactaaagcatttgttcctcatctccctgaacctctgaatatactcgtgcacgggttcatcatgccgctgcttaatcactgtcaagtgggacaacttcatctcatgaaccccactgtagaaatagctatggaattgcttctccaaatcggcccaactattgatcgacccatatggcaaagaggaaaaccaagtaaaagctgatccagacagagataaccggaataacctaactttcagagcgtctacagccgatgcttcaccacactgagcaaggaatcgactaatgtgctcataagtcgacacgccctcttgtcctgaaaacttggagaaatctggaactttaaaccggttgggaagaggaactctctcaaactactcagggtaaggctgccgatacaagcttccagtctcttttggtttaagcccaaactgttctctcattacatcaacaatcacatcggcccacggtcgttgctgagctgccccttgtggctgttgttgcatgggctcaaactgaccatactgagatgcgaactggggttgagccaatccccctggctgatattgggcttgcggggaaggaggctgagatgcgaactggggttgagccaatccccctagctgatattgggcttgcggggaaggaggctgatattgataactcaagttacccccttagtaattatgaaggttcggttggatgttgcgcaccaagtgctcaggaacaacctgaggcattactgtgccgtctggctgtacatggtgaaccaaatgttctgggacgacttggttcacaaattgttgtatgggctaactaccaggtgctgcgaacccagccgatgcgttcattgacccctggtgctaaatcggctgaacgatttgttgccttaatggagtctgttggatcggctgcagaggctgctgccttggtggtgtttgctgaattggttgcagaggctgctggcttggtggtgtttgctgagctggttgtacgacctgttgttggattggttgcacaaccggctggattggtggtgtctgctgaatcggctgctgctgcactggatcaacaataggtggaggtggcagaaacatggcagcaacttgatcttgggtcagccgattcgcagcttgcccgccatgctgtggctgttgcctcattaacaactgagggttcaccggctgtcctggcgtcatagctagtgtagcaggcagaggagttgacactggcgccgtcggctgagttgtgggtgcaacggagggaactgcttgaatagatggctgaacatcggtgatcaaagatcgataatttgggaagacacctccttgcaaataaactgggcatgcggcctgatgcttagctattgaactatcggctattgtcttcatcatgtttgacaaggtattgactaataccctggactgattgatcaaagcatgatgcacggcgtaatcaacccgatcttggaagttattgaaaaagtcctgcgctacttcgctattctgattaagatttcctccttgtggcccctgagcaccatcaccttgaacgccatgaactccttgagaattgtcaccttgatcgcctagagagccgttggtagcacctttggtactcggctgagccgagccgcctggagcttgtttcacttctccatctttagaagaaccggtcctaggactatcagcaaccacttttattttatacttctgaacaagtgtccctttgcgggtctgcatgaatgagttcagaaactgatcccgtgcttgctgcaacgttgcttcaaactcttccttctgctcaggcgtgaatttctctggatcgatcggcataacgttttcttcaatgatgtcagtcaatcccaacttcaatgccttgcctttaacagaacctgggctagatggtggtggtggttgtttctcggccatgaggaagaactgacgtctgacttcttacaggtcccactgggcgtgccaaaagcgtgttgacagaaaacacgtgggctgggagatctactgtcacaccctaaaaatcctaaatatataaattgttgtttaattggaattattagaatttattttaaaagcctagaagagaagatctagttttaattaataaattccaatataaaatggggccagataaaatttcattaaatactttgcttaattctataattcctagatttttctgggatttatttgagctaaggaagtatttttaataaatggaattgcatttcatgaataatttaaattgaaaaaggttttttaaaagtcttcttttggctttgggccgaaagtcggcccaaaaccctctctctctcctcctcggcccaagccggcccagtcaagccgagccgcccgcgcgcgctcgctgccgctgacaagtggggcccacctgtcaggcctgtcgtctacctccggccggccgccgcccgaaccctagcgccgcgccgccgtcgtctctttccaaattcggccgcctctttccttttccggtgaaatcaatagaggggaaatgatcttcgggatctcctctaccttttctcttttggaatcgtcggctaaaatcgtttggaaatccgtggattcgatctcgaatcggattcgtctatctccccgaaccctacaccttccttcgccgtcgccggttgctgtgggcctttgccgccgcctccttgcccctataaaaggacccccaagcccgccgttacctgccgccaccctcgccttcgtctctcgtcgccggtagaaccctagcaccgtgtagcctcgcgccgccgtcgtcgccgccgctccagccgtgcgccgccgtcgctccagtcgtcgccgtcgctcgggaaggccgccgtcgtggtcgccgtcgcgttgccgtcctcgtccgcccctccatcgttgctgtagaccgccggagcaccgccgtcgtcgtcaagccgaaggttgccgccgcttcttcctcgacgccgtcgccgtccgttgatcttccgccgccgttttggtcaccgatgagttcgccgcgtcgttctctacgtgctggtgccctccgttcgcgtcgtcgcgccatctttcgccggcgagcttgtgcgcccgagccgccgccggtggtgacgtcaccgctgacgtcatcgttgccatccgtcgtggtccggccgtggaccggtcgatctcggccgttcgttttggttaggatcgatctcggccgttcgtttccgtgagccgccgccgtgcacccggtccaccgcaaaccctagccgctgatgcaataaacccctttttccttttcaaaaataattcattattgcgtcataattcaattaaaacccatataagtgttttaatccgatttaatctctaaaaattcataactaattcatcttagctcggatttagttggttcaagtctctaattttttctaaaattgagatctacatgttaaaaatatccacatgtattgttcatgcttgtttatgtgctgttttggtgtttttgctcttttctgtttagattccgacgtttccggagagttcgttttcgcaggagaagaatttgaagagttccaagggcagcaaggcaagtcacacagatcccaaacaaccctttgaacatgttgatcccgtttaaagctattgtttctattcaactattgcatttattttcgaatgtcattgggtggaattaacctattgtttgttatagtccttttgttcttgattactttattccttgataccttgggttattataacttgactagttgagctttatatattggttcagctagatattagatatgattgcttagccatgcttagaaacattagcacacaattgggataactaatgtttcactattacttaatgatggatatttaatgatagctcatgatggttaattatgattggttaattaattgaattgccaactaaaacttgataatggtgggttgtgagcacatggttttgagagtcgtgctcatgacaattaaggaccggttcacgagtttcggttgtgaaacattaaccgtgccaaccacaagccagcgtgggcaacgactttaccttttgtatagcatggttcattgcggagcaccagactgagaagtggcagagataagcccacgggggtcgctggggagtccatgccttgtttataagggggtgattatgatccaagaaaggtgcgctgtggtggattgtgttgtgcgtggggtactgtcacagctcctttccgaggtaccgtggtggtattgaggcacatggtgacatgttgtggagctgtgtcttgtgggtacagtggtacacctctggccagagtaaaactattcgaatagccgtgcccacggttatggacgggtctaacaatgtctttcgtgattagtctcacacttctcaccataataaaagatgctataactggtaataatttgattagctcctggtttggaatggtatattcctggtttggagatagaactgtgcagccaggattggttgtacagaatggttgggcctatgcaacagggtatgttgtatagcgttggattaatattgtttaaattactacttaactattttattaaattctgaaatgtttattaaatgctgtttatgcaaatgaaaccctactatgccatcctttgttatcctgtgcacttgcatatttgctgcgtggcttgctgagtatgtcatatactcaccttgcaatcattcatcagaggaggagttctacagtgatgctgatggtgtggaggattaggtgtagccctggtcaagctgcttgtggagtggagtcgtctgcgccgtttatcttatttttccgctgcttagatctttattgattgagaggaactatctacctctgtaatgacattttattcgtttattaattagagtaataattgtactctattattaatttgttattgtgtgcctcggctgattcctggacgagggttcacacacatgtaagcatttggaattttggatagaaattccgggcgtgacacttgtgcaagcaagtttcactcagagtcttatctaggactagatcgtctgtagactatccctcaggtggagcatgtaagtcatactccttggtcttttagtaagcttcctagaagattcaccccaaatctccatagactgtgaccaacagtcaagctcacaaaggtgagttctttcaggaatgctctgcgggacaacatcttcgctaattaaagccaacataactcattaaggcatagccaacctgccttgcagctcacgagagtacatgcatcttcacttagagagggtatagattggtactctcctccagttaactaatggcttgttcttcctaggttctaattcacaggatcttcgatcacatagactggtttactaccatagtataactcacatgggtcttaaacccatctccttcgatgcattgtctatcacattacgtgatagccccttcgtgaagggatctgccaggtttctagctgtttggatataatccaatgttataaccccggagtttctcaatttcctaacagacttcaatcgtcttttcacatgtctagacgatttcatgttatccttagaactgtttactttggcaattaccgtttgattttcacagttcataagaatagctagcactggtttttctacaataggcagatccattaatagatcacgcagccattatgcctcaacagtagcagtatccagtaccgttagctctgcttccatggttgaactcgtcaaaatggtctgtttgcaagacctccacgaaacaacatcaccacctagtgtgaagacatatccactagtggctttgatctcatacacatcagagatccaattagaatcactatatctatccagtaccgcatgatacccagtatagtaaagccccaattccatagtacctttcagatagtgcattactcgctctagcgcatgccagtgatcatctcccgggttagaggtaaaccggctcaactttctgacagcaaaggagatgtcaagcctagttgcactagccaggtacataagcgagccaatgatttgggagtattccaattgattcctagcaattctcttattcttgcgaagcgacaagctaggatcataaggctttggagaaggcttgctatcaatgtagccaaagcgattcaagatcttgtccacataatgggactgcaagagtgtaatctcattctcacctctaattagcttaatatttagaataacatcaggtactcccagatccttcatatcgaaattttgagacaagaataatttaacctcattcatcacctcaaggtttgtcccaaatatcagtatgctatcaacaaacaagagcaaaataactcccttaccgccaccatggcgaccgtacataggggtgggcatttggtctagaccgaaatttcgatccggttagttcggtcttttaaaaattcggtctttggaaacaggaaaccgaagttgttaagcaaaaattactaaccgctacttcggttaaccgaaaattcggttcagtcttcggtctaaaccgaggtgtccgaaccagaacgtgcgtcctcttcaatcttcttgtcttcttgctcctgaaaacctccatggctccatctcagtcacatgggacggatatccactagcatggtgacaagtgttggcgggacggaaggcgacgacgcggcagaaatcagccacgtgacgcagacggcacgcgatggcgcagcggccggcatgcggctgtgctgcaggatcagcaagccaacagcctgtggcctccttatggcttccacgtgaccacacgattgtatgtgacactgcggcaatgccggcgagcagcagcatgcggcagcactgcagaagacagcggcgcggaaggaaggggacatgcgatgtgatgagataagtggcgcgccggcggcgcgtggcctaactatggctaggagtgcttcggtcaatggaatggtggggtcatggggattgggtcattgacgtggatttgggcctcaccttgttgttgggctgttttggtccatgggatggtcacgttgtctgcttagtgattggtattgatttggtttcttcggtcctcggtttcttcgagtagtattgcacgatgaccaaatctttcgaagtttgttcggtctttcagatgtcacacccgaacaaatgaccgatgcccgagagttcggtctttttgggtttgggttcggttttttcgggttcggtcttcgattatcggttttaatgcccacccctaacagtacacacatttatctgcctcattgactgcgaagcttgcagatgtcaatgttctatcaaatttctcatgctcttgcttaggagcttgttttagactatacaaagacttcaacaatttgcacaccttgccttcttaacctttaactacaaacccatcaggttgatccatatagatctcctcatccagctctccattaagaaaagctgtcttaatgtccatttgatgttgatccatatagatctcctcattcagctctctattaagaaaagctgtcttaatgtccatatagatctcctcatccagctctccattaagcatgagtgccaaacattagcctcatcatccacactgccacaaatatgattcacaaactgtcacgctcggaaattcactagtaatttccgaacttatttgtgcataaaatcctcgtccaggaatcagccgaggtacacaaactgacaatttaatatacaaatccatcataataataacgccttagatacttacaaaagaaaagaaaacagcagcggaataacggtctagcgatgacttcagctccactcccacaggcagctcaactggggtataagccaaacgtctgctctttccggatcctttctcttcaactgaggttgattgattattgccagaatgagcatatgacatactcaacaagccacacagcaaatatgcaagtgcacaaggatactaaaggatggcataatatagtctcatttgcaaaagcagcatttagtaaagatttaagagtagtgaaatagtagagtaattaatcagaaattttaatcaacactgaacagcacacccatgctgctcaggcccaaccaattctgaacaaccaaccccagtcgtacagatcaaacctccaaaccaggaatttaccattccaaaccaggagtcaaatttattatcacattattatcattaatgaatagtgtgggactaatcacgaaaaacattgctcaacccgcccatgaccgcgggcacggctattcgaatagttttactctggccagagatgtaccactgtacccacaagacacgattccacacatgttgccatgccccgaagtaccaccacggcactgcaaagggggaaatcgtgacaatacccttcgcacaacacaactcaccatagtgcaccattcctggattataatcgccccctctataaatataaccagaggcatggactccccagcgacccccacggacttctcgccgcttctcagtctggcaccccgcaatgaatcatgctatacaaaaggtaaagccattgcccacgctggcttgtggttggcacggttaatgtctcacaacagtagctcgcgaaccggtccttaattgccatgagcacgaccttcaaaaccaagtgctcacaacccaccattaatcatatttaattaccaattaattatcataacatgattaaccatcgtgagctaccattaaatataaccataaataataatgtagtatatatgattcatcccattagtgagctaatgtttctaagcatggccaagcaattatatatataacatttagctgaccaaaccaatacataaggttcaagctaatcaatttattacctaaggtatcaaggaatagggcattcaatgcaaattggccataacaaaggaataggttcacaccacccggtgacattcgaaaataaatgcacagttgaaataaatacagaatttaaatataggatcaacatgctcaaaggattgtgtttaggatctgtgtgacttgccttgcaataatcggtcttcaattaatcttcttgaccacttctaacgcacgcacgaaccttcgcaacgacggaaacgacaagctaacacgcaaaacaaagaaaaagactaataaaaaccaaataaacagtaccaaaacaagcataaacagtacatgttgatatttttaacatgtagatcttgattttagaaaaatttagcaacttgaaccactcaaatccgagttacgacgatttagttatgaatttccgaagtttaatcgattttcaactaatagagaaaactaagaaaaaaggattaatgacatcatcgccggccatggcacggcttccacgcgaccaccggcaaaagagagctcggttgggctatccgagaacacctacgcgtagaggacgacgacgcgaactcaccggtgcaaagaacaacgacggacgacgacgaacgacggccagcgatgaggttcgacggcggcttggctcgggtccccgacggcgacggcgctccgatggtgttcggcggctgcgaaggggtggacgggattcctctcctccgtgcgcacccgacggcggctaaaacaacgcggcggcaactctacgggcgacggctctgcttgggacttggggcaaacggaagaggatgtcgaggggatgcattatataggcttggactagagagatcggactccaaacgagaggatttgagccggaaaatccgagggttagtttggagagataaactcaaaaacgaattcgatttggtttatccaggcaaaattaatctccgacactttaggggaaagggagaggataaggtggagatgatttcccctcaactaattttaggaaaacacaagagaaaaggttggatttggaggagaaaaaccgagccaactcggtctcagttcggctgccagaggttgaagatgaacagtgcccagggaggcaaattaaactttgttgctgggcttctacttcttggcccgattgatagagggacacaaagcagacttcgacagagggagggagagggctgcaggctgagaggagattgggccaagaaagagagaggacttttcctgtttcggcccgaaaaggaaaagaggaattttaataacttttccaattaaattaatcactgaaatgatctttgaattgttaaaaatacttccaatgctcaagtaatttcaagtaaaatcctgaaaatacttggacactcaaagtacttaacaagattataatcagaccatttaatgattaatttaatatgtgggtaattactgaaatgttctttgtatgattaaaattaagagttgagctccgaaaaatctgagaaaattccagagagtataattaaccatggagaatttaataaaaattaaatccatccatgctttatatttaggaaattttatttcccacatttaacttcacttgtaaattaatgaacatttaatataaattctaataataatttattaaataatttataaatcctgaaacgaaaatcaggatgtgacacaaacttatggtagaaatcagaaagggaaatgtggaacaggcctccgcactcataacctttaccaataaaatatccatgtttagacacgactactttattagactcaaaaaccaacttaaatccgtctctagttagacgggagccactaacaagattcctgtcgatagtagggtcatgttgcacgttcttcagctgcacgatctttcccgaagtaaacttcagatctaccgtgccaacactatgaacagaagtatgtgacccattcccaattaagacggtggaatcttgtgcgacctgataagaagaaaacaatgagatgccagcacaaacatgtacaatggccccagtatcaacccactagttagtagactgattaactgaaaaaacagtaggtaaattaccatacccgcttacatctccattgttgctaatggtcacatttgcagactaagaagtctgccctgcaagtgccttcatccccttgtgttgtgggcacttcttggccaaatgaccaggtaggccacacacaaagcaagtcctctcatcctggttaggattgttattgttcttcttcttcttgaagttggtggtctgctgggctttgtatttccctttgctcttgttttcggccttgtgcacaacattggcactagactgcccaccattgcctttagacgcggcatctttttcccgagctttctcctcaacatcaagagactctatcaacctctcaacggagtattcctatctcttgtgtttgagtgcagtaccgaaacctctccaagatagaggtagtttcacaataatgcacccggccacaaatttttcgggtaagacacacttaaggagttcgagttccttagccatgtgttaacgacaaattttggtaggcccctaagagaattatcacatcgccaatagtcggattcctgctatattctgttaaggaaattaatctattaaaggaagcttatctagtagtgtccgagttaaaggaggatgtggcatggcaacttatctattaattaggaatagtttgttagtttccttttatctttaggaaagtgtgttcagtgtcctataaggactttatgttttctttttatctttaggaaagtttctttcttgtcctacaaggactaatatctccctatgggtataaatatatacacccggggtcattgtaaaatatctctcgatcaatacaactactctcggcgcatcaacaccctctttaccgaggttgttacttatcaaccggcggaatttggcacgtgacgcggggctgcatcgattcggttcgatctccagcgaaggagtaagtcctacgttctaccagcctaggcaattgtatcgtctatgtcagcgtcgttcagggctgcatcagtacattcgacctcttggattgctctggtttgcatgatatatttgcctacctatttatcatatgtatctgttaatctagtcttagcttatcaatttagctctatcggctgcttctcattttaggatttctaccggtatcggctaaatcatgttgctagattagattagcttagacatctaccaccctaaaaactcagtcaacgacttgattatctagatattatgattcttttcatacttagtgctgcatcagctaagtttgatctactaagtcgtgcttagaaccataatctctagcctgcttcttgattgccaataagggtttcatcggggtttcagctgatgagttatctggacgttgcatcggcttacaaggattgcatacctattggatttagccgatagcaacaaagattttactgtttatctaatcttctgaatttaatgacatcggacctccagccgatgtatgctttaaccttcggatcaatacttgttctatcatatcattattagccgattggtttctactcgattatattgttaatttattacatcatcatcagccgattttctatatgtcattatttacatcaagtgtgagactccacatcaacacatagccgatagctcgaaaccctatcgctatcggccggtatcggcatcggctggaattaatctatcggcttgtcagccgatcggctcattgatctgctatttgtatatcttgtcagttgcagggtcaaactgactggtatgcccgtatctcatcaacctttggacctacgctggagctaagcagatctcccaggccagtgtgtgtttttcgcgtcaacaccatggtctgtatttcatgggcctgctcaactacaaaagagttgtcaaccatcttgtagtcatgaaactgctccgtgacgtacatatcattgctagcatcagtagcaccaaatttggtattcagtgcatcccatagctccttaacgtcggtcatatgcatatacagctcgaccagacgatcgccaagaacgctaagaatgcatcccacaaagagagtagtggcctcattgaatgctttctactggtcagcagtaagaactcccataggttttgtcacaccctaaaaatccccaaatgtataaattgttgcttaattggaattattagaaatgattttaaaagtctagaagaaaagatctaattttaaataataaattccaatataaaagtgggctagataaaattttattaaatacttcatttgattctatagttcctagatttttctgagatttatttaaggcaaggaagtatttttaataaatggaattgcatttcatgaataatttaaattgaaaaaggttttaaaagtcctcttttggctttgggccgaaagtcggcccaaaaccccctctctttctctccccggcccaatcgcgcccggcccagtccgccaagccgagccaccgctcgctcctctctctctctcccgctgacaggtggggcccacctgtcagggcagtcgtattcctcccgccgcagccgcgccctaatgcgcgcaagccgccgctaccgcccttccaaattcgaccgctccttttccgatccgatcgaatcaatagaggggaaatgatccccgggataccctatatcttttctctttcggaatcgtcatctaaattcgtttggaaatcgtgggattcgagctcgattcagattcctttttcctcccgaaccctaaaccttccatcgccgtcgccggtcgccgtgggcctcaatcgccgtcctctagccctttataaggaccctcgagacttcctctctccgccgccaccctcgccgtagctcgccgccactcgtagtgctctagccgtgtcaagtcgtgcgccgccatcgccgccgcaagtccaaccgtgcgccgccgccgctccagtcatcgtcatcgctcgggaaggccaccgtcgggttcgccaggtcgtcgccgtcctcgtccacccctccgtttccgccaaagatcgccggagcaccgccatcgtcgtcgacccgatcgtcaccgccaattcaaactcgtcggtgtcgccgtccggttgccatccgccgccgtccgtgcctcggtaaggttcgtcgcgtcgcccgcttcacgtagatgccttccgtttgcgccatcgcgccgtcgttcgccggcgagcgtgcgtggccgagccgccaccggtggtgacgtcatcgccgacgtcagccatagaccgcggtagaccgattcgatctcggccgttcgtttccttagaccgtcccgtgcacctggtccaccgtaaacccgagcccgctgacgcaataaatctcttttccttttcaaaaataattctttatcgcgtcataattcaattaaaatatatataaatggtttaaaccaatttaatctttaaaaattcatcttagctcggatttagttggttcaagtctttaaatttttctaaaattgatatctacatgttaaaaatacccacatgtactgttcatgagtgtttatgtgctgttttggtgattttgttcttttctgcttagattccgacgttcccggagagtccgagtttgcaggagaagattttgaagagttccaaggccagcaaggcaagtcacacagatcccaaaagaccctttgagcatgttgatcccgtctaaagctattatttctattcaactattgtatttatttttgaatgtcattgggtggaaataacctattgccttgttatagccattttgttattgattacctattctttgtcacttggttaacaattggattagctaaaacattatatggttttagctaaagtgaatcggatgcttagccttgcttagagacactagctcatataaatgggatacttatgattccctattatttaatgatggcttaatgatagttcacgatggttaatcgtgattggttaattaattaatgtgccaactaaaatctgataatggtgggttgtgagcacatggttttgatggtcgtgctcatgacaattaaggaccagctcacgagtttcggttgtgaaacattaatcgtgccaaccacaagccagcgtgggcaacggctttactttttgtatagtatggttcattgcggagcaccagactgtgaagtggcggagataagcccacgggggtcgctggggagtccatgccttgtttacaagggggtgattatgatccgggaacggtgcactgctttgaattgtgttatgcagagggtattatcacaatctctattcgggtacttgttaagtatcgcgacgcatggttgacatgatgttgaggttgtgtcttgtgggtatagtggtacacctctggccagagtaaaactattcgaatagccgtgcccgcggttatgggcgggtctaacaatgtctttcgtgattagtttcacacctctcaccataaaaaatgatgctgtaataggtaataacttgtttagctcctggtttggaatggtatattcctggtttggagatagaactgtgcagccgcgattggttgttcagagtggttgggcctatgcaacagggtatgttgtatagcgttggattaatattgtttaattaaatactctattgttttattaaattctgaaatatttcttaaatgctatttatgcaaatgagactatattatgccatcctttgctatcccttgcacttgcatatttgctgcgtggcttgctgagtatgccatatactcaccttgcaatcattcatcagaggaggagttctacagtgatgttgatggtgtggaggattaggcgtagccctggttgagctgcttgtggaatggagtcgtctgcgccgtttatcttattttgagaggaactatctacctctgtaatgacattatattcgcttattaattagaataataattgtactctattatcagtttgttattatgtgcctcggctgatttctggacgaggatttacacacatgtaagcgtttggaattttggatagaaattccgggagtgacaagttggtatcagagcctccttgaccctaggttatgccaaatggttacctatagaagccctctaaaaatattaaaaaagtagaactgttctcctctctttctcttttaattaaatcaagctaatagcacatgcagtttatagtccctttaattgttctcattcaaaatttatttattattcctgtgttgttagtactgtacatctattactgtactaatggcccatttaccagtaaaagttttataacataattttatttaatcatgttgcaacataacttagcatgttgattttataactctcttttatttcattctatttgaaacctgttactcaaaagtgcaaaatttgttatcctgttttcaactgtttcaacttatcttgcaagattggtttactttattaatttacccttcactttgattttctaactttattcaattaatccaaaaacttgtgctattaattggataaatgtcttaactccctcctttcacttgtctttagatgccgcgcttcaagcctgagtacttgttcggtactgagggatttgtccaggagttgcgtacgttgtcctttgccataggattcgggactgcccctttgtatgcccagattcctcatgatcatgatgaagagaagtgccatgtcaaagtcaccttgaacagtaatcgtgaagatatcccatcggtgatgttcgaggctggagggggaagctacattcatgcttgtcaggaggtggcaaggatcaccataggagagctccgcgaaagctacaatgatcagttggccgacactgagtatcgctatcatcctcgccaaccccagggaagtgaccgtggcagctaccttgaacctgcagggattgagaatgatgctaccaccaggcatttggttgagatgctgtgggccatggatgagacctgcgctgagattatgttagcagctcaagatcgcgaaggccggaatcgtggtaagatttgcaagctggaagacaaggtggatcgtttggagaaggaactagccgcattgaagggagaagcaccaccacaaaaagctagggttcgtcttaccgcaaggaagagagctctatttgtccctcgctaccagttggcgccaaaggttcgtgtggtggaaaaagaagccgcctcagccccagcggatcctccgatcgtcaacgtaagtgatgatgatggagaagaatcgaagcgcacccattcaaaggtcgagtggggagctactcgagatgatggggacgagccaaacgagccttcaatcaactccgatgcccggaagacctagatgtcttgttaagtcattgccttagatcgttgtgttagtttgcttgtttaagtttggttgtgtgtgtgggtcttgcgtgtggtttacatcattggtgggatgtaagtgcatgcgtttgtttgctttcgagtgttaggaagttggtgagttttgtggtgtgagagtcttcagacatatgtaataatgaaactcagttaagatcaataaaagtcaagattgtaaaaaattaatttcctgtcctaagtagtttttcccctgtttctcttcttgtgctcctgtctatgccagatggtgtttactcgcagcaatgggaatggccccaacaacaacaacaccaccaacaacaataatggagagaatcccacgcttgcccaagtcctggctcaacaggcacaggttatgaatatgatgatgcagcaactccagaaccaacagaaccagggaaacaaccatgcacctccccagaacaagttagcagaatttcttcgtgtgaggccgcccactttttctagcactaccaatccagttgaggctggtgattggctgcatgccatagaaaagaagttggacctgcttcagtgcaccgatcaagaaaaagtctccttcgcgtcacatcagcttcatggccctacctctgagtggtgggatcatttccgtctaaataggactaccgtggaaccaatcacttggcttgagttcactgctgctttccggaagacgcacataccatcgggagtggtgtctctcaagaagaaggaattcagggcactcactcagggatctcgctctgtcaccgaatacttgcatgaattcaatcgtctggctcgctatgcttcggaagatgtgtgcaccgatgaagagcgtcaagagaagttcttggaaggactgaatgatgagctctcttacccattaatgactggggattatcatgattttccagaagttggtggataaggccattcgctaggaggataagtacaaccgtatggagcagaagaaacgcaggattgctcacttcaaagctcaacaggggaatagttagaggccgcgtcttgctatgggacctcaggcagtgtcgcagggaggatcttcgtctgttgttcgtccgcagcgtcagttcttcaacaacaatactagcaacaacaaccgcaaccaagctccacgccctgttgcaactccaacccagcaccagcctgccaagagggagcaaggtaacaagctaggagtgtgctttaactgtggggagccaggtcattattctgacaagtgtccgaagccccgccgcatgaaggttgtccctgcctagaacaactccaccgcaccagcgacaaaggctcgtgtcaatcatgttgctactgcagaagcccaaggtgctccagatgtgattttgggtacgttccctgttaactcagttcctgcaacagtgcttttcgattctggtgctacacattcctttttatctttgagttttgcgggaaatcatgggatggagatagaagatcttagacgtcctttgatggttagtaccccgagtaaccaggcactctcatcacaacgtcagtatagagattcaaggtgtaccatttctggccaaccttattctattagaatccaaagaccttgatgtcatcctagggatggactggttaaccagatataaaggtgtgatagactatgccaatagaaaagtaactctcaccaacaatgacgggcaagttgtaactgttcatgcattgccttccgagcctttaaggtcaagtctgaatcaaataactttggaagagattcccatagtacgggactacccggatgtgttcccggatgatttacctggcatgccacctaagagagatatagaattcagaatagatctggtaccaggaacaactccgatccataagagaccttatagaatggcagccaatgaattagcagaggtcaagaggcaagtagatgatttgcttcagaaaggatacattagaccaagttcgtctccatggggagctccagttatctttgtggaaaagaaagaccatacccagaggatgtgtgtagactatcgtgcactaaatgaggtgactatcaagaataaatacccgctgcctaggattgatgatttgtttgatcagcttaaaggtgccaccgttttctccaagattgatcttcgatcacggtatcaccagttgaggatcaaagaggaagatatacctaagacggcttttaccactcgatatgggttgtttgaatgcactgttatgtcttttggacttaccaatgcccccgctttcttcatgaacttgatgaataaggtgtttatggaatacctggacaagttcgtggtggtctttattgatgacattcttatctactcccgaaccaaagaggagcatgaagaacatcttcgccttgcactagagaagctacgagagcatcaattgtatgccaagtttagcaaatgtgaattttggttgtctgaagtaaagttccttggacacgtcatctcagccggaggagttgccgttgatcctagtaatgtggaatctgtaaccaactggaaacaatcgaagacagtttcagagattcgtagtttcctgggtcttgcaggctattaacggaggtttatagagaatttttccaagattgctaagcccatgacacgactgctttagaaagatgtgaagtacaagtggtcagaagaatgtgagcagagttttcaagagttgaaaaatcgcttaatatcagcacccattttgattttgcctgatccaaagaagggtttccaagtgtatggcgatgcatctaagtttgggtaggttgtgttctgatgcaagatgggaaagtggttgcctttgcatctcgtcagttacgtccgcatgagaagaactaccctactcatgatcttgagttagctgcagtggttcatgcattgaagatttggcgtcactatctctttggtactcgtacggaggtgtacacggatcacaagagtttgaagtatatctttacccagccggatctgaacatgagacagcggagatggttggaattgattaaggactatgacatgggaattcattatcaaccaggaaaggctaatgttgtagcagatgctctcagcaggaaaggctattgcagtgctacagaaggacgacagttgtcgtgggaattatgcaaggaatttgaaagattgaatttgggaattgtcagtaaaggtttcgtagcagcattagaagcaaagcccactctcattgatcaggttagagaatctcaagtcaatgatcctgatattcaagagatcaagaagaatatgagaagaggaaaggctatcgggtatttggaagatgagcaaggaaccgtatggatgggcgagagaatttgtgtcccaggaacaaggagttgaaagatgcaattctgaaggaagctcacgacactttatactctattcaccctggtaataccaagatgtaccaagatctcaaggagaaattttggtgggcaagtatgaagcgtgagatagcagagtatgtagttgtgtgtgatgtttgtcagcgagtcaaggcagaacatcagaaacccgcaggtttgctgcagcctttaaagataccaaaatggaagtgggaggaaattgggatggatttcatcatcggtctacctagaacatcatcgggccatgactctatttgggtgatagtcgacaggcttaccaaagtggctcatttcatccctgtgaggacaacatattccagaagtcatttggcggaattgtatatggcaaggattgtgtgtttgcacggtgtgcctaagaaaatagtatccggtcgaggttgccagtttacttcaaagttttggaagaaacttcatgaagaaatgggttccaagctgaacttcagtaccgcttatcacccgcagacagacggacaaaccgaaagggtaaatcagattttggaagacatgttgagagcttgtgctttagacttcggtagaagttgggataagaatctgccatacgcggaattctcgtacaacaacagttatcaagctagtctttaaatggctccttatgaagcactgtatggtcggaagtgccgcactctgcttttgtgggatcaaacgggagaacatcaggttttcgggactgatattctgacggaagcagaagagaaggtaaagatcattcaagaaaaattgcgtatagctcagtctcgtcacaagagttatgcggataatcgccgcagggatttaagtttttaggaaggagatcatgtgtaccttcgtgtcacgcctcttcgaggggttcatcgttttcacaccaaaggaaaattggcaccgcattttgtgggaccttataagattgttagttgaagtggcgaggttgcttatcagttggagttaccccaatccttggcaggtgttcataatgtgttccatgtgtcacagttgaaaaagtgtttaagggtacccactgaagaagctaatcttgaatagatagaaatccaagaggatctgacatatgttgagaaaccaatccatatcctggaaacagatgagagaagaaccaggaatcgagttatccgtttctataaggtccaatggagtaatcactcggaagaagaagctacctgggagcgagaagatgaattaaaatcagctcatccgcatctattcgccagctcttctgtatctcgaggacgagattctgtttaaggggggtaggtttgtcacacgctaaaaatccccaaatatataaattgttgcttaattggaattattagaaatgattttaaaagtctagaagaaaagatctaattttaaataataaattccaatataaaagtgggctagataaaattttattaaatacttcatttgattctacagttcctagaattttcggggatttatttgagccaaggaagtatttttaataaatggaattgcatttcatgaataatttaaattgaaaaaggttttaaaagtcctcttttggctttgggccgaaagtcggcccaaaaccccttctctttctctccccgcccaatcgcgcccggcccagtccgccgagccgagccgccgctcgctcccctctctctcccgctgaccggtggggcccacctgtcagggccgtcatcttcctcccaccgcagccgcgccctaacgcgcgcaagccgccgccgccgcccttccaaattcgaccgctccttttccgatccgatcgaatcaatagaggggaaatgatcctcgggatcccctctatcttttctcttttggaatcgtcatctaaattcgtttggaaatcgtgggattcgagctcgattcggattccttcttcctcccgaacactaaaccttccatcgccgtcaccggttgccgtgggtctccatcgccgccctctagccctttataaggaccctcgagacctcctctctccgccgccaccctcgccgtagctcgccgccgctcgtagtgctctagccgcgtcaagccgtgcgccgccgccgctccggtcgtcgtcgtcgctcgagaaggccaccgtcgggttcgccaggtcgtcgccgtcctcgtccacccctccgtttccgccgaagatcgccggagcaccgccgtcgtcgtcgacccgatcatcaccgccgctccaacctcgtcgccgtcgccgtccggttgccgtccgccgccgtccgtgcctcggtaaggttcgccgcatcgccctcttcgcgtagatgccttccgtttgtgccgtcgcaccgtctttcgcctgcgagcgtgcgtggctgagccgccgccggtggtgacgtcatcgccgacgtcatcatcgacatcagccgtagcccgcggtagaccgattcgatctcggccgttcgttttggataggatcgatctcggccattcgtttccttagaccgtcccgtgcacccggtccaccgtaaacccgagcccactgagcaataaatctcttttccttttcaaaaataattctttattgcgtcataattcaattaaaatctatataaatggtttaatccgatttaatctttaaaaattcataactaattcatcttagctcggatttagttggttcaagtctctaaatttttctaaaattgagatctacatgttaaaaatatccacatgtactgttcatgagtgtttatgtgctattttggtgattttgttcttttctgcttagattccgacgttcccggagagcctgagtttgcaggagaagattttgaagagttccaaggccagcaaggcaagtcacacagatcccaaacgaccctttgagcatgttgatcccgtttaaagctattgtttctattcaactattgcatttattttcgaatgtcattgggtggaaataacctattgccttgttatagcccttttgttattgattacctattctttgtcacttggttaacaattggattagctagaacattatatggttttagctaaagtgaataggatgcttagccttgcttagagacactagctcatataaatgggatacttatgattccctaatatttaatgatggcttaatgatagttcacgatggttaatcgtgattggttaattaattaatgtgccaactaaaatctgataatggtgggttgtgagcacatggttttgatggtcgtgctcatgacaattaaggaccggttcacgatcttcggttgtgaaacattaatcgtgccaaccacaagccagcgtgggcaacggctttactttttgtatagtatggttcattgcggagcaccagactgtgaagtggcggagataagcccacgggggtcgctggggagtccatgctgtcgcgaccgagaaaaatacattttcccgaacgctagtgtattaatccctgtcccaggaaaagccggggtacaccacacaaacatgatataaaagacacagctttattatatcgataatatttacattattacaaaggcacttaaggcctgacaatcaaaaataaacagcagcggactagcgggcctacggctccatcttcataggcgctcaactggggtataagccaggactccacctaagacttcttctccaaagcttctcttactgaagggggggaaagattgagcaagaatgagtacaaccacagtactcagcaagccacaccggcagatgcatgattaatgcaagggggtacaaggggtaataatataggggttaagtttgcagaaaacagcatttaaaagtcacttagttgcccaaagccattttataaagacgatcctagagttacacagtgttattaatcaaggccgtgaaccctcacgaacctaccttaacccaaggcctacgatgattcagaccgaactggcaacccaaccctgggtcccagctcgtcccaagccaacccaggccaaccattccacattttagttgttaagcaaattttaagaattgaaacactaacttgggtacattgctaggcttgcccataaccgagggcgcggctattcgaataggttatactctgattagaggtgtacatctttacccacaagacacatcttcctcacgtgtaaccacgtgccacataccaccacggtatacggacggaagacgtgacatagttcccaacccatcctagccataaacaagagtaccgacccaacccacctacggccggaacctccgggacaggcaggcaggattgagcccctagcagcaggacaccagccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgagcttaatccttatagtacctgaggtatgactaacaaaacccaaccacgcacctcgagcccagcctaaaaccattttgggggttttgaatagagggggaggtgtgtgtccaattccaacataagccaaccattccatagtgtccaaatgatatgagaattcccaaagtctaaagttataaaaccacctaatgttgcctaattaatcagcgaagcatctacctaaattcataccagtggaaccatgaatagagtacccactagttggggttttgtttatcctagggtgaacaaggtaataataacaatagcaataataataaggtcataacaaaggtaaataggcatggctaaataaaacagtgataacgcaggaatttaaataaagcgataatgcattaatttaaatcaaaataattttataaactgggattcaatatgctcaaggatgatgtgacttgccttgctcagagataacggccttccgaaccttcggcgacgaccgcaaaccacgcttcgggaacctccggaacgacgaagactacgcgaagcacacaagcaaagctacaaacctataaagaagcaataacaatacataaaaagaaagcacagggttctttaggatataacaaacattaggagacttgaacggatcgattcggagctcgtatgaccaagatatgatcatccgaagtttaatgctgttacatggagatttgcggattattgtaattaggttttacaactataaaacatgtgtaagcgctagcctggaaaagacaggaaggctgcgctgttgacatgcggactccacatgccaacctaagggaccacgctggaccgggtacacagagacggtccacgggtcgacggaagcagatcctgtgtgtcaaccgaggcgagtggccgacaaacgaactccactagacaccacacgggctgcacacgtggaaaccacgcggctaccgagcgggcacactaacatggtcaccacacgcacaagcaaacgactaccgacaccggtacacgggtaccggggtcgacaaccgcacaacgggcacgggcggcaccgaaaggacgaggacggggcagcgagaggagagatccttaccaccacgcgacgtggcgagggaacgacaacgacgaatgggcccggcggagacggccaggaacgacggagacgaaaggtgaggggacgacttcggtggcgatccttggacgaaggcgagacgcggccggcacaaggcttgacgacgcggaggcgaggacgaagacgacgacggggctgcagcggcacacttgacggacgcggacgacggacgagaatggcttgacggagggacgaacgccacgacgaccgggaacgacgggaggacgacgacgacgacgaccggggccggcgaggaggcgacaagggacagctagcagcagctgcacggagatgaggacggcgtggaacacgccgctgcgaatccgacgacggaggcggcgccgcgagacgacgagccggcgaggaggaacgatgacgacgacgacgaacaccggcggggttcggtcgaaggggaggcgaggccgagggcgaccttaccgctgcgatgccggaggaggagatggcgacgtcggccggcacacgggcacggcggaaggggttgccgaaggaactccggcaaggcggagggcgagaccgacgcgggcgacggcgttccggcgaaaccgagggcaggccggggtggaggtcgacgcggtgacgccaagggaggagacggcgcagccggcccgcacctgagcggcacggcaggggcggctggaggcagtacagtggcggcaacgccactgttttgccggcgaggacgcgtctccggtgatttccccgcgaaacggagggctgaccgggggagaggaggcggctgcgaggccgagggcggcgacggtgcgaccggacggcgctcgggcgaggagggagaggcggctggaggccgatcggcgccggagagagagaaggagaaggcggggagaggtggtacggccacgggggagctcgggaagaggctaaaacaagagaacgcacggagggggttccattttataggtgaggggagggagctgggcataggagagggcggaacggcgacgggaaacatggccggcggccatggaaggcggccgggaatggcgcggccgttccgggcgattgggggcgccattcaagggggaaaacgggggaaatcaaagaggaatcaatggggattaattccccctatttaattttggaatcccatgattaaatcgcacggatttgagggaggaaaggagctagggttcacgggagagggaggaggccgtgcgggaggaggaagacgaccggcgcgtgggccccacacggtcagcgcgcatgcaacgcgcgtgcggcgcacgtgaggggggggggcggctcgggaggctggggcagctaggtggcgtggcttgggccgggcggccggcccaggaggagaagagggagtggcggcctggggaagagagggtggaggagggagctgggccgaggggaaggagaggaggcccaagagaaggagggagaggagtcgagggagagaaagagagggaggaagagaggactttggccgcgggccgagagagagagagaggactttgggccagaaagggaggaagaaggattatttttagcttttctttttagtaaactttgatcatagttgttgttgcttaataaatatttccggtgctctaaaaattcaagtaaaattggagggctctttttagaccaaggagaatttaacaaaaattctccggaccacattcgaatttttctggcacgtattttagtgtttgccaatttcttttcaaattttaattaattctattattctttttagaggatgatttttatttcgggatgaatttatcaggacgtgacacatgccttgtttacaagggggtgattatgatccgggaacggtgcattgctttgaattgtgttatgcagagggtattgtcacaatctctattcgggtacttgttaagtatcgcgacgcatggttgacatgatgttgaggttgtgtcttgtgggtacagtggtacacctctggccagagtaaaactattcgaatagccgtgcccgcggttatgggcgggtctaacaatatctttcgtgattagtttcacacctctcaccataaaaaatgatgctgtaatagataataacttgtttagctcctggtttggaatggtatattcctggtttggagatagaactgtgcagccgggattggttgttcagagtggttgggcctatgcaacagggtatgttgtatagcgttggattaatattgtttttaaatactctattgttttattaaattctgaaatatttattaaatgctatttatgcaaatgagactatattatgccatcctttgcaatcccttgcacttgcatatttgctgcgtggcttgctgagtatgccatatactcaccttgcaatcattcatcagaggaggagttctatagtgatgttgatggtgtggaggattaggcgtagccctggttgagctgcttgtgggatggagtcgtctgcgccgtttatcttattttccgctgcttagaactttattgtttgagaggaactatctacctctgtaatgatattatattcgcttattaattagaataataattgtactctattattaatttgttattgtgtgccaagagctgagggggatcca

SEQ ID NO: 42251 - DNA, 33613 bp, Oryza sativa
  unsure (1)..(33613): unsure at all n locations
aggttttttggattgttgaaattttaagcacataatgatttaatttattccataaataaatcatgacattgcagatgtaaactagcatgaatgcatcataaaatctttacatgtaaactagacagcacaacatgaacagatcaaatatgtgcaacatgttgagcacgtaccgagagtaccggaagaccagttgctcagcaggaattacttgcgttgcgggtgttgaggacgacgcaagtcgtcgtggacaaacagggagcagtctcgcggagtgcttcccaaaaaccttattgttgtcttctcctggagtaggacgtcaaaggcagaggttccggagacttactctcccgatagctagtgcacgccggtgagcgggatggagtaatctacgagcgacggtgcaacacattggcggaccatttgatgcgtacgtcgtgcacgcgctgccaggccaggcctggcgagcatggttcaagtggctaggagggcatctttccttttaaggaggtccccctcttacaataagcaaggtggtactaaactccccatgcatgctatcccatgaggtgggcttttgtgattttccaaagaattaatcttcgggtgagctaagacccatctattaattccaatagtagtaaactagtaaggaacatagatcttgacaagaatacatgtataaacacaaaaaacactgctgatcagattgttggtctagttggcttgcccttcagtgaaaccttcttggagctccttacaggtacctttcctagcctgtgaattgttccttcccctgctccttgcaagctatgtgatgcctttaatgtacacaagtcatactgaatctcattttctctataatctcatttatttgaaacacacaggatcacattaaaattaaatttgcagttagctaataaagaatgcatgtcacaaacttgagtcaacggtcatgcatattttcgccaacttcgggtggagatttacaaataggatttaataattgtgttttctctatcttgcgttggtgcctattagtttgtgttatgagtattgttaaattcggagtgtgtcttgtgaactctgtggtttgtgttcgcttttgaacaagtttgtgtaataagtggttgtagctctttttgagcaaaggccggatttatttccattatctaaaaaagttaaagggagatgtgattgcctgttgttctgtatgagcagtcgatgattttgctccattaggttgatttctttttctattagctcctgtgacaagagcatttttcttcttgcccctctctttgggtgaacaacccctgctactatgcttagttttatggcaaagcccacacctcataattgtgccaactcttgacattttagtttctttaggtttctcaccaggcttcctcttcctagattttccttttggcctgccaggcatcttgacataactaggtggcgaaggcttggggtgatgatcagatgtaggccacctctcctctccttccaaaggctccatgcaatgatcatatgttttcttatactcttcaattgaatagccttgagcaataaaaccatttgtggcatgtcctgacttacaaatagcacttaaggcatgacaacaaggcagtccagatagctgccagtatctacaagaacatgtcatattttgcaagtttattgtgtacctccttctctccttttctttcacctcaaatccatcctttccattccaaaatacattgcactgacttgacctctcaatgttcatcttgagcttcttaaatatatttggacacactatgccctgccacttatttgccttgcctctgttctcttgaaatttgatcattaccttacgcctaactgcctctagcattgagatatataacaggataaaacctggcatcaacaatcgaattgttaaatgattcacacatgttattgtcaacctagtcacagcttgaccctaattcaaaccaagctctacaccaatgttttggttcagtattcatcatatccttggctccttggacagtcttttgtgcaagcttggtctgtagtagttgaaatcctctacgtttgatgccttagcacatcgccaaaatcgtttttggagatttaggtctttgtatttcttcgtccaattggcatatatatgcctagcacacatcatgtgctcatcccttggcaagaaggtattgaatgcatggagcaagccctacataagaaaatttattggccatattaattgaaagtacttacaagtcactaaaacatgaattgactagtgaattttatattaccttttgttgaccatagatgaaaactcatccttctccatcattgccaacgtttagatccttgatcagcaaatccaaaaaccattcccatgagcttgttgtctctttctcaacaatagcccatgctatgggatacatttgattatttgcatcccttcttaaggcacaaagcatctctccattacatgctcctttgaataagcacctattaagactaactattccttacttaagtaaagctttcttcatttcctctttccccgaaaaatggggaatagcataattagagtcatactttctccacctactctttctcctcactatatggtcgttgtcttcaccactatcatcgtcataagaattgtcggtgatatggacccgggggtacgcacggtagaggagaataaccttcccatctggccacgtggtcgtgcggcgccttttcccccaccccctcggggggaggtcaggtagttatgaggtggccagggggcctcggggtgccacgtcacaccactcgggcccgtgaggcatactaccccgaggccctcatccggccaccacgtggcggggtgagtgggcggagcacgaggcgctgtccagcgtcttaaatgcgcggcgccgcaaccgtccctcaccgcatttaatgcggcatgggcgggcgtgcggcgccgcccgattgatgcatgtcaatcggtcttgaccggcctgcgaccggctgcaggcggatgggacgagtggcagtgcctccatgtcccgctttgtgtctggcagagtaggggcaggtatgccctgtcccatcggcacgctgccaagtgtgcccctatatatggtgaatccaccaaagtctccatgcatttaagagggaatgacggggatgtcctccgtgtcaggcggaggacggcgctgggccccacctaggggcgggcaaccactttgcttccggttgaaggcacggatagtgatctgactcaggctatgtgggcccccctcccatggaggggtagggatgaacggtgcatgtggtatccccttgaactacaagaggaggaccttacccaccgaaaagagggacgactcttaatagctcgaactctaaaggaagcacagctagggtttcccaggagctcaagatctcttgtaagatctccacgataatttcacacataggagtagggtgttacgcctcccggcggcccgaacctgtataatcccttgtctctctcacggattcgtaagcgatctagtagcccgaccttaagcggagatgcgctcttgatcatcgcgccttatcccccggccgaactcacaaaaggagggtctcacaacctcccactagagaggatcactcctcgacaagaataatcttcactagaatcatatatgtaggttcatcagttatctcattcaagctatcatctccatgacctattaactcaacgggcacactgtttgcatcaggatcttgtagaatcagcttcattgcttttaactttttgttatacatctcagcaaacttctgtaaggtttactacctactcatcatctgcagagctatttccactttctggttgatagtcactatcagtagtgtcactatcttctcccacgcttccttctttgtttgcatcgtattgtgtcccttccacgttttccatctcatcagatttcatattgtcagtttcccaatcactttcttcagaattataatatgacattgtttcctccacgaaaatttcagccactccaccttcagcaatgcaacttgacatatcaaggcatgccttgttatctatcactctgtcagtaaccgtaatcctgtgcttaattcttttccaggggaaacaaccagtggagctgcatggcatccttgacctcgatatggtctgcaaggtggcctctaatttcaggcatagaaatcttgtccttttctatatatgacatcccttcatctccaccaacgtattgcacaatccttctagaattgacaaactccccactataataaaatctgacaagaagtatctccaaattattcattctttctagcttgtgctgcattataaaagacgaaattaatttaatttatactagacttgacaagattagaaaagatcatcctacacacatcgatctgcactatgcaacagaaaaacatcaaagccctaaacctcaatgacagaactaaagaaatcaaaaccaaagaaaccaaagataattatatcttgactcatgcctccctcgtggaggctgtcaaccaatgtgagtaaaacaatcaccacaaaaccctagataaaaagggaagaaaccttcttgcatcaaacactgcaatggagtcagggatctcacctactccaagacgtactccgcgatcaccttgatcttcccgtccgtgcgtgatcacgattcacgcagccatggtcgccatgggcgcaacactcgagagaagaaacctagaagatgggatgagggagtacgatgaggcaagaatgatatatagactgatgtgcgttccctccctcatgttatttcgcgatcgctccacttttccctcttgttactttgcaattgcctggtcagcatgacaacgtggcaaatacggttcagtcagcccgccatatgtgcaaaaccgccttgtgaaacagtttagggagttaaatggactggattataaggtttgggttcccccggccccggctaaccaaccacatatacattcattccctatcaatcccgatcgtatattttttgggatgtgagagggcggtggctccggcggctcggtggagcagttgagcgacggcagtggcgacgaccctggctaggagcaacggcatccatgtagcagcaacgctagcgtcacggagcaattgcggcaacgtcaaggagcagcagcggcgacgaggatgaagcggcgtcctccatatccctctctcggcacctgtcaccagcctcaccgatccagccacctgcttctttgccccaggaagagagacggagaggaagaagaaaggagcgctagatccagcggcaccggctcgagagacgctggattcggcgaggacggcaggggaaccgcccatgctgcctctgccttgtcacgtgtcctcgacaccaaaatccgaaggcaagtaagaggatcagaacggttcatgcaggtgggcgcgcagccaccgatgcttccgactcacacaacacgggggatcgcccctgaggccctgagccccgacgacgacgataccgccgggagaaccaggtctcgttcctggtggcacttccctccacggtcagaggctgtcgatgaaggaggccaatgcacttgccccaatgcagcctgtggatgtagcaaaggaagatgatcatttttcttttgtttgttctgtcgtttttcctaatcactccgatctggtggcttccggttgtaagtgattgcaatgcatcttaggatctgtttggggagcttaaaattctgagaagcagctgctgagaagctagctggtaaaaatctggagaagcttccggcttctaattcatgttccagattataaaagactacaactatgtattctcagaatctggataaaagctgaactgtttgagggagcttctggcaactgaagattctaggagaagttgtaggttaatctttttttttactgggattttgttaatgtgatgtgattttctggttgaatagtagagaaattgaagtggattcctcataacataaaagttgaatggtacgaggaatatgattaatagcttgctcactgcatataacactgttgaatacgctaggttttctctgaatattttgacaataaatttcttcattctagaatgttctgaatttaatttatttgtgaccatggtggtagcagttgctgtgtgcactcttacaggcggaggcacatctcgatgcatgtgcctggaggttggcaatggtccgccgaagaaattcatgtctgaattattttttgggttgctcatttagaacctcgatacccaaccccatacggtcgatgctcattccaaacatccttcctcactcatatctgagttttcttttaaattatgaattagtttgtgttcaggaaactagaaaaagaacatgagaagattctgccagtggtggtgatgccaccggaatgctatcctggtagtcgtcctcgacccgggcatcatccacgcttgttgccagcggccaacacgaagggcaaaggttcgagccacgataagcacgcaacgactttgaggaccggctccgatggtaggcgatggaagaatcttaggcggctaatgccctctcattatgattttttgtatgatgagtgtatatgtgtgtttgaaacgatgatgctacgaccaattgtaaaataccggacattcctggtcactccccaatgacggttacggggcatttaggacaatttcaactgtcacaaccgtcattagcagcctataaaaggagctcaccttctcaagaaaattccctgtgtaccctgaaagttcgtccaaccccttctattctatacccctgagatttgctcattcccttttatacccctaaatttcagattggatcccttttatactcctaaatatatttatgagtttattttgtgagatattatttaacaaaaataatttttatctcgcataacaagatttatcttataaaaaatttcatactactctaacaaaatatgctatatatatagtttttaatggtaaaaaatattttttttgttttatctcaaataaattttgtcatagataaaaattattttttcccttcgtgaggcgaaaccaaaatattacatttgttaaataatatctcacaaaataaactcatacatataatagtcgcatataataaatttatacactttatcaatatacttcataaatttatattttcttgataccaaatagcaaaatggactttatgatagaaatttaacggtcaactaatggaaggggtatagaagggatccaaactgaaatttagaggtatggaagggaatgggcaaatctcaggggacatagaagggattggttgaagtttcaggggtacacagggaattttctcttctccattccaaagtgcaccaagaaggatcaaattcaagacactctctagtttatttacattgttctagtgctagtggagtaggaatagaatagtttccttagttcttcaagtcttcaaaagatttcggatatggctctagtagcttttctttctattataagactttactcattaatgaaatattattctttatatagtttcggtcttttacttcacttgtataattattcgaataccgactttagttcatatttgtctcgttataattatgtagctagcttattggatatatgcaatggtgtttgtttaatgttcatttatatgattgctctatgtcacctgcagaaatgtagagtagtatttagtaatgtaagtgcggtgcttagattattatataccattaaatggtgttatgtgctactggtctgtagacgtagaccgctgatggtgatagctcagtacgggtatcctccatgtgtgtatataatactaagagaatttccacaaatttcctagtgtggatactcctacgtattcattaccggttggatgtctatgacaggttgtcataaggaagtcggcaatcagggatggtttctcgatacaccaggaggatatagttaggtggtattggttgcatagttgtatactagcaaatgtagactaaattgactatatattagaagtacagaaatgacacttttcttattatttcttcacttagtttggactacatattaatgagagtattctggttactttcttcagtgtgtcaacacattctaccctcaaattttggttagttacttctgtgtgtcaacacattctataaaagtgtcccacgaattaattacctctgcattagactttgatatatacaagtgatataaattattagcataataatctcttatcatatcttcccttgggattaaataaatacgataccttggaatagtccgaggtgaaatgctacaacagtatatccgtacgtttgcggattgtatctgtagccataaagtataccgagaatatttcgtccccattgctgggaattatatttctaataatttcgttaagaaataccaacagacggttggcctagccaactgcggatccatcggtggcggatggacagtagcttctccccctccttcgtggatccaccggctggcctcaagggtggtgtatttgacagtggtggtgctaggagaggtggatctggcactgtggcgtctaagaggaggagcatcaacaaaggatctaaatgctactacacatgttgggaatcatgataatcctagacaattgttggccattgtaatcatgcagtattttaggttgggtctatccaacacattgttcacattattgattaggtatctttaccataatccatgaaaagtgatcatcaatcattacatgtgttgatcttgtaatcacttgttccacatatgacatacaatcagaaatcatttagaaatagcaacatacacaaagagcttcattaacaaatcacatgctcactgatggataatatataaggctgcgttcgcaacccctccttccggcacgcaaaacggagcacaccttattgcatgattaattaagtatattaactatttttttcgaaaatggattaatttgatttttttaagcaactttcatatagaaactttttgcaaaatacgcacgtttagcagtttgaaaatcgtgcgcgcgaaaaacgagggagaggggttgggaacttgaaggtaagaacacagcctaagttatctatttaagcaacactttattacaaataaataaatatagtgtgcaatacaataatctctatgattttgtcctcaggacatatcactaactgatgatcggatgatcaatcacagctttatggcattgaggaggtcgatggtgatggtcgtcgccgcgtcaatctccttaacggtgggaaccatgtcacagtacttgaacagataacctaacttgcacttgcttgtggccccgttgtattgggtctccaaattcttggtccacttgagcaccgtttccacgtcctccttcttgcgtctgccttttccggcggcggcgaggcggtcgagtgcggcaagcaccgagttggtggactctgaattgctggagccaatgccgaagaacgatgtgcagtcgtcgatgttcttgtccctgatgccccgcttcttaccgcgcccacctccctatcgagggcctggatcttggtgagcaggatgatggtggccacttgggtggccttcatttggttgtcctggaaggactcggcgtacgggaggagttcgccgaagcagcagatcttgtagataggatccttggggattctgcagatggtacgggagaactggtacgccgctggggagggctcctgcccaggcggcgtccgcggtggcagctcaaggctgagcttcacccagtcctttgctgcataagctgccggcgttgatcgctatcaacactacctgcaggaggacggcggtcatgctcgacctgctcattgtatttacacacactcacactctctctctctctctctctctctctctctctctctctctctctctctctctctctctctctctctctctgagtttagttagtagccagctacaggatggattaatgcatatatatgttcaatcgatgaggtaccagttaatttatactagcttgctaggctggctcgattggtcattacaaattgtcaacctttccaatataatttcttcaatggctgtgatatcatcacggcatgcttagttatataccactatttcgatgcaactaataatagtcattatttagacttgatcgttgtttgtttcctgtccattcattaattgttggagtatatatttttggcaaatccaatcttactgctacaaaacattaaataggtgtcgccattataggtgccggaagtgctaaaacacgtacctataagctttttccctatctccgcgggtggaaatagtaaaaaaccggcacatttaaccaattataggtgccggttctaaataagaacctacacctattctataggtgccgattttttataaaaaccagcatcattaaaaactgacacgtataatatattataggtgccagttttttataaaaccgacacccacataagccgagctgaaccaacccccggccacatcgaccttatccattcatctcctctccttatccattccccctctctctctctctccccctccctccctcaaccgaattggtgtgcggcggtgggaggggatgttgcagcctggcggcggagccctcccctccgccagatctggcaggaggagaggtggcgtcagcggcgtgaggggaggcggcggtggtccgatggcccggcggtgaggccctccccctccgccagatctggcgggaggggagatggcggtgacggcctggcggcagaaggggatacggcagcggcgggaggggagacggcggtggtccaacggcccggcggcggcgacggtggtgccgcggcagcggcgccctcctcctctccatttgacgacggcggcggtaattgacccaggtgaacatcagagagggagaagaagttttcatcacaggccaaaatcaccctgcccttggaaccatctgctggcagatatgcatattgatgtacaaaacgttggccaagagtattaaggatgtgttggtcagacatatcgccgcaacttttgtttcctggagacaaacaattgaagccccatgttgttgaatgcagaatttgacagaatcttgtttagctttggcattcaaaccccttacattccagttgaacaggtacacattatcttgcgacataaattaaagtggcagctatcacacccaaacaggcagaaacacaactagaaagtctagaagaaacacagcctgaagagtaggtgatagaagagagcagagactttgagacaggggggtaacacatcatagaactgaccccagtcatacacgggaagcaaaagcctacaactgtcacgcccagaaattcacgaaccagaatttctaagctgaatgtgcattaaacccctgtccaggaccaaccagggtacacaaacgataattgttgacatacagatccatgtcttacaaaaatataaaagattacaaatgcagcggaaaaggtaaaacgagctaagcctaaagacttgactcctacagcgggcgactccactctataggcatccttgacggcagcgacgaaaccaacctttctgagacagctcaaactgggaagaacttccgctctggtgtgggggaaaagagagcaagactgagtactacccactgtactcagcaagtcataccggaagaggatgtatgatgcaggatatatccaaaggaggctaaaggtcattttgcataaagctagcatttaaaagcaatagttgaaagcagtaaaacagttgtagtaattaatcaatattaaccaatcattgtccaacgctacaccacgttgcaacaagcccaaccaaccacctgaattacaccagttcattagctaactaggggtgagactaatcacggtgaatctggtcgaccgcccataaccgcgggcacaactattcgaatagttttactctgatcagaggtgtacaactgtacccacaagacacagccccacgacacgtttccgtgcgccgacatgccaccacggcataccggaaagaggccgtgacaggaccgttcgcataaccccctctaaccaatcgcaccacacctcaggtttcacccccactcctcgcaaggcagcgggcagtcccctctcgtgccacggtgaattcggaagccgatcaaccggacaccccggccgacccaactccatcacgcccacccttgcttgggtacgtcagctagaggaaagctacactacaagcccagtcgttgcccacgctggcttatgataagtacgataagttcttccagggtatcccgtgaaccggtccttaatcgccatgggcacgactagcaaaaccatgcacccacaacgcaccatgtagtgtattttaattaactaacaccattgcggtggctctattccaaagctatgccaataatcaaagtctatgcattaatatgattccccctttgtgtactagttgaactaagcatggctaagcatttcctaaaccaacatctagtcattttaatacccaagttatcaatggcataaggtaaacaatatatggctgagtagtaggacccatcccacatgatgttgtaaaagaatgcaatatttaatagaaatgcgggacatttgtaaattgggtacaatatgatcaattgtaatgcatgacttgccttgctctcgcactgatgagaccacaacaacgtcttcgagaaaccgcggatcgacgaaacggccgaaatctacgcgacaaacaaagcacacaagtctactgaaacatgaaataaaaccattcttaatggattctatgcatttttatgaatttactgagacttgaatggacttaatcggagctcggatgaattagatatgaattttagaagattatctgtgtttattactataaaagaaaaagccttaattatttattgcgcaatatgtcccaaggctgacgtcacccaagggggggcaccgacatgcaggacccacgggtcagtggcacaaagagagggagagggggcggcatgtgggcgggccccaccagcagcggctccaagggaggggaggtggcgcctggcttatctcggctccaagccggccggccggccatgggggcggcggcgcgcgcggagctggcggcggcacgcggttgccagcgacagcaaacggcggcgggaggcgacagcggccggcgcgaaggcggctgcgcggcccggcgctaggagaggagagggaggaaggagggagatgggtcctcagtcctcaccgaggggctcggtcggcgcagggaaggagcgacggcgaacggcgatgacgagcgacgggaggacgatggcgacgggcggaagggctccgggaggacctaaagaacacaacggggaaaattagagagagggtgacgttctacggtgagcgaaacccatggccgaaggcggtggcaatggtggtgctcaccggtgcgcgtggacaagcaggccccgacggtggatttggacgggcggatggcggacacggtggctcacgggatggtgaacacggcggcgtcgacggtgaggattggcgcggcggctagcgacggctagcggcggccggagcgcggccggagggcggtggtgatgggtgaagcggcgtgggagcaaaggagggcacgggggagtacggcgaaagtgaaaaacgagagagggggacacggggagcgttttataagcggagggggaggcggacgtggctggggaggctcccgatttcgccggcgacgtgggggagtggggaggaagagagagggaaggggattcaaaagttgaatccgccccttgtgggcgcgcggcgcgggcgggaaggcgagagcgtgggcggcgtcgcggcgacgtgggcgcaggaaaggcaggcggcgtgggggcgtggggtggagcggcggttgaggagggaggccgtccctccggctggaggttaggggcgaacccgacaggtgggccccacctgtcggcgcccgggaggagagggggagctcggatggactttagggaggggaaggagaagaaatgggttggcggcccaaagaaagaaaagaggggcaaaaggaaggaaaaagggaaaaaggaaaataaaaggatttccagggactttttaatgcttgtgctcaattttaattgattaaaattatctctggagctctgaaaattccactaaaaatcctgttaacatattttgacatgtagaatccaagaaaaattccatatgcctattccaattattatttgcatttattaattagggattcatctctaggttaatttgaaccaatttcttcatgcgatttatttagcaaatttaaagcaagggaggggaacttcagggcgtgacaacaacacagacagcttgagcataggaactctgacaaaggtttgaaacttgacatggagtgtttcacagcaactgtcttcatgccgaagaccttcacagcggcgctatagccgcttttttcttcaaggtcttcagacggattgtcttgcatcctcccttttcaaccagatcagcaatggtcttcagagaagccggggagagcggcttcttgtagcgctataaatacaactttttaatattatcatcgaaggatgcataatcatcaatgagaccgaaattttttgaaagtatttcctgacctaaattctctagctttgcgcccgcatggcacttacagagcaaacgctcactatggtgttgggctgaggtaatggcacggatcttcacctttgcacgggaaggtttccacgctttaacatcaggagccggaaggaggggagattggattggtgttgcgatgttgttgatgaaattgtcgatctgtgacaccttgcctactgcaggagaggatgggttggaggtcgccacccaccctgtgtaagatggcacaaaaataggggaagaaacacgacgggagactgtatccggtgagtaaatagaatgctgaactaccgcttcatgcaacatgggatcgaggtggcttccaggattcccagaacatccccgtggacctgcgaggggagggaatcatcagattggaggattgcaagttcctcagaagcagagcagcgcacagtgagagccgcatctccatctggcttcgaactagggagaggggacggaaacttgcaaggtgtggccgcaacagagggggagacaagaggaggagctttagcatattgatccgaatgagagacaggttgggcagaaaaaggtggtctcaccttacttggatcgcgagaccggtggctgcgactcctatgatcagagcgttcctttccccgtgattggcctcgtttgtcctgatcacggcgctggctgtcccaccgatccgtatccctgctgtgactggaggagcgaccactaagccgatcccagagagagcgactacggtgctagcccctggagtggctgtctccgtcttcatcttcatcctcggggccacgggttgggtctggttcagctctacaaggaagtgcgtactccttgtagcgagtgccatcatcttgaacttcatagtcccatttgtaagcacgggctttgcgagagagaagatcttccagagtgtcgacgtggaccaggacattgtaggtctagcccttctttggctcggagggaggagggttgcggtgcggctctagttccggaagagggatatcagtggaaagcccctagcacctcctcattagcagcggtgatggagaaggagccaccccgagggatagccctcggctcatctgtccacatccacaagtcgtaggtgcgattgtagttgccacgacgggagtactcttccacatagtggatagcacacttgcgaccgatcacctttgtcatcgtctcgtcaatacgaccatgcatggggacgccctcgatacatagacgggcgcgatagcggtagcggacttggacaccgtggagactttcatcccaaggacgaaagagaaagacccgaccagaggctgtagcaagtcttggttggcggagaatggcatcccgatcactctgattggagcaagtcacaaagaagtcttcggggtggaatttggtaaattggatgtcagcacgtctaatgtggaaggcagaacggacgtcatcagcaaagacattgagttctaccttatcacccaaagccccgacttgccaagctactaaggagcaggcagagaaacgctccctgcgcctctctatctccccagtggtagagacgaccacagagtcaagcaaaggccgggcagtaaggtcgtccatggaggaagaagcagagacagagaaagatttgggagggaaatggaggggaccaagcgctgggaagttttctgtggacatagcaggtgggggagggttgctcttatagctcaagcgcttgtgacaactagccacaaggtgtcccgatttcagacagaaccaacaacggacatgttctctgcaatcaaaaatttgatgatgggtgctcaggcagcaaaagcatttgccatccatgtgtttaaggaatttttctcttctggattgaatgctcacttggttgttggattgaatgaatgaagaagactttcgccaccaatgcttctttctgacttcttcccaattgctttcggtgaagtgcaggtgaacgatgtcagaagacgagaccgaaggattttgcgctgatggaaggggattctgagaagacaggacgaggcgtcgaccgctcttgagataggatcatacggccggacgcaattccattcattcaccctttatttattttcattctcctctcctgtttcccccatcacttcactattactcactcccccttcattctccttttttctacccctatcatttcttccccattttgtcggtgactggagtggccagcaatgggtgtatcttgtaatggaagcatgggccaacaagagcggccgccacgcgcctcggctcctccaccaccggtggcctcacgatggctagatctagtgctggtggcttcgtgaaagccggagtggaggcagccccgggatgatgacctcgatggtgacggtgaccccgactgctagtggtggcagcgatgggagcggctgccgcgcaccttggctcctcctccaccaccaccatcgtcggcctcatgaggatccagcggaggcgaccccaggacgacgaccttgatagcgatgcgactcctactgctagcagcaggggtggcgcctaggttttgattggaggttgtggatcaacgactggatcccctagatccaacatgggaaggcttggagcagtggagagggctttaggtccagcggtggcggtggtggatcagtgcagtggtggagggtgttggtatttcttacgatcacagataaatccgtaagcgaacggaatataccgatgtagcacttcacccgggagtattctcaggtatcgatttccacagggaacgtgtatgctatctccaatttagattcatgcaaggacacgaagctatagataggcaaaggatagagaggtttcgtcggtgaataacagtgtgtacggaaagcttaactttaatcctaatgaggtacttcgggcactggccagctcgctgctcctagatatcgctctactgcgcacccagacagggatgactttagtgtcttgagggctgtcaccacctctaacccacctcacacctactgtgagatgcggagcaaacaccggcaattatctacctagacaccatgtctaagcagattaattacttactttaatgctagctacacactaaaccaaatcactatattttagttgattatagtgaacgatgatcatgtactctgaataggaactaaccaagaaataattcttaccgagcaaaactaaattactcaaaagataattctattataatcagagtaattaacagagcataaagaaatagggagaggattaccgacaactccaaaattcctccgacttcttctactctactctcttcctattctagtatacaatatagtacaatagagcctcttataattcaactcaagcttggagtgcgtgagtgaagtgaaatgagctcctctatttataggacaggtatgacggttatgcctatgcgaaatgacatttttgccctgcaaccgccatcaggagaggatctagaccgtgcacaccaaaccctaaatcggacggtgatcaccagggttcagtcgaattcctccttcttcctaatgagaaacggttctcttgcttacatacgcacttatacattttattccccgccacccccccctcccaggccagcaacaatccctctcgaaataaaacatgcaaaaaaccattaaaattttgaaaataaaatcatcaatttcctttcaaaatccgtcaaatttagaattcatgttctagaatcaaaatctcaatcaaaataatacttctgaaatcaaattccaagaaaatattacggaatttgtccacttacgatgacatttcccttattttcatctctctcatttccttctcacccggtacgctcactcccctctttttagccatatattattatagcatgaatgcgcagtatgccttcttaccagattgaaccctcctttcagtgcttttttttttgttaatatatattcatttgaattgaagtagctcattatttgggctttcttaaattcctttaattaaattcatccaaacacaacatctgtccctccaacttgtctgtgaaggaagtgaccatgttttgcaaaccgtccagattatttcgaaatgttttactccaaacgcttaaactcttctcagaaagcttttattttggcaaaataaaatgcaagactgtcattaaattagaaatttgtaaactagacatgaagaaccttttcaaagaaaccttcgtctttcctggacaaaaaattttcaaatctgaagatgtgagcttgagttacaaattcaaatttactattagtgaagtttgtagagaattaaactaataattaaacacatccaaaatttactatgggtgaacatgaaacacattcaataaataaaataaaatagcatagttgaattttttttttattgggcttcgcatagaccatgacttctattatttcattgttgttgtccagatgaaacatttgaaaaagggggaaaatattctcagaagcacgcggctaagaccttctctcgagttggaacaactgtactgtcacttatccatgtttacccatgagtagtgtttgtaagatcagatgtcagctgatcatctcgcagagatggaggtgatgaggtgatcgtggaaaaattcctgcatgccatcggattgtaagccactgcatgcaatcactctccatttgcactaagtatcgcaaaattttccatnnnnnnnnnnnnnnnnnnnnnnnatacttcgatcactgggaggcaatcattgttgatcggctagcttaattgttggcagatggggcactaccaccatcgtccatcttctttcggcaaagcttctttaacgcacttatgaattgcgcatacagccttcccttctcaactttaatatcatcaatctccttcacgctcgccaacagcctactcgacagtgtactcggagcattcttctggagcctccatatcttcctgttgagtcgacgtacctacgatatgacaagttaagaaccaaatgtcacataaaataaaatggttcctttaacacgtacacacagctgatatatacctctgtcatcaggtagcttaatgttccgtcgttccggtaaattccatcgaaggaggacagagtattgatttccttctcagtctccttcctcgccaagctcagatactctagaacatcttttgcattccttctcggtacctcctgcttcgtctttccccttctggcttgcaagcttgggtatatgatagctctacctccatcctgctgctgggagacatgagaagattccaatatctctacgtctgagtttggtacaggccgactggttgcggcgacatagaattcttcaactgcaaccagcatgctagcataatcccgatccttgcgcgcttttcgcggcgccgcctttggaggtaatgctactggaggagctgcagagaatggttgcgccgctggggctgctacctgatctgcagctgcagtgcatacaattaatatcaaattatatatcagtacaactaattgaaatggttcctgcaaacatttcatgcatacatttttacaaactcaccattctgatgatgatcagccgatggggcggacatgatcgtctggagcaagttcacttccaccgccgtgtgtgggacattcacattggtgcggacggattcaactaaattggagtagccgctgtccagaagctgcccgtttgtattatttctcatcgtgtcaatgtttctcgcaatgaactcgctagcccattcctgcgtccacttgctgaggctgtaaacattggaacgaaccgatatcacatacattctccgtattctgattcaatatcaggcagagatcggttaatttatcatggtcaaatatcaggcagggtgtatatgtaattatgtataaggccctctttgattattcaaaggaaattcataggagttttagaagattttatttctataggatttttttcctacatagccctatgaatcaaaggactgaactctatggagtccaataaaatacctatgaaatgcctcttcccatacaagttttagagaaaatttaacataaggtagaacttcatgaaaataatcttttaattattatctcttcttaaattcttgtgtttttcctacggcccaatcaaacggacattcatatgtttttcctgtgttttataattctctattcctgttagaatcctatgttttttcaatttctccgttttttcactcgtctgatctaaaggacccctaagaaagagtagtatagatgaaaaaaaaatcttaccagcgacgtgcatgacatgcctgacaaggtggcagcgggagcagtccagttggccatgccggagcggcagggaaggcaccaggttggcatcttgctcgacggggagcacttggacgcgagccacgccaccaccactgtcgccgtgcgcggcctcatcacggaagctgcttaggatagcatcaagctcgtcatcgtcaggccggtcagggtttgcggcgccgagcaaaccttcaggcggtgacgaggactgaggatttggcggcggacggcgtcgttgtttcagggcgtgaatctcatccgagcggagatccagtccccccggcgctggatgaggttgctgctgctggccgccgggaagcatcctcgccggaggcggaggagagcagggatcgaatcgcgagatctggacctgagcgggccactcccgctcgacgacgtgaatcgccggcgtgggatgggactcgatggcggcggcgacgggcacgaaccaccggcggctcggagaacatcgcgatatccgtggtcgggtcgagcaggtagcgcgtgacatcgccatcggcgtcgtaccagtcgtactgctcctcgttggccatggaataaatcggccgggggcgtacgtacgtacctcgccggagcaagaagacggtagtgaagctgaaactgcaaaggcggcgccgccgcggtggaccgggagagactggtgatttgtagtttcaagcggatcgcgagccaaacgcgtggcggcgacggtgaggagagagggagtgtttgtggagtaaacgagggcgcgaggggggggggcaagttcgaatggaggcggcgattggtgcccgcgagtttggaatttgggttttcgagatctactagatttttaagatgatgtcggaatttatttaaagagaaaaaaaaactgaattgaactcagtaattatccgaataaactccaaaaaaattccgttaaaaaaatcaggatattcacatccaacaaaaaaatatatttcctacagaaaataaaatatgttcaacttataatcatgattttatttaactggattgaatattttattttgttacaacaatattccaaatattatttttgttcataaataatttaactcaaaaactagtacgaacttccaaggagaaaacaatatattttttttcatatatacaacgatgtttaacacaaacgaatcttctgccatattttttaaaagaaaaaagatcattttactcccccaaactatttcactaaagcacttaaccccttaaactattttttgacttattttacaccctgaactatcgaactataattacattgtctcatctatacttatcacacgttatttctatatgtctaattaggtgcttcgagcaagagtattacgtcataaatcataggtaaataacaatcacagtataatccaaaatattttagcttcgtttatgcgtaatatataaattgtattttattgctggcgtacagcataccccttgcggccttacccacttctctacttggtacctttccccttcattacatcctcttcttccgataactcaagccagcttctcctctcaatctcctcctaaatgagcctccacttctcctcacaactgttgacggtccttaagttataatatctgaccgtcaatacctgcatataatgaaataaaatatggtattcaacttagtggtaggatttattactaatcatttcaactagtgttggtgaaatatatgtatgcaggtattttaaggaggaaacacacccgtcatgcgacacgatgaacctccgcacgatcaggacgcgtttacatggattggaggccccataagactatcaaaaccacttagaattgggctttggcatagtacatgatgttgggggcccattaagctacctactggccataggagaggccaggatgatatttttctagttagaccgaaccaccagttcggacaaaccagtgttgtggccgttgatcgccagcattccacatgtacgctgctaatgaagtcccaatgatggttggagggcacattgatcatttcccatacttgtaaccgtcatttggagcttataaaaggaggagctctcactcacttcaataaacacaactttgagctgaattacaagaggctctattgtatcttttgtacattagaattaggtggagagaggggagggaagctctgaaggagtgcccggaagtttggcgctcatccgacttctacctcgatgggtgtagctttctaggaagaattctggaggagtaccggagttgtcggtacactctgctccgggttcggagaaacttcttctataaaggaagcattcatgttcttttcttatgttatttaaatactttgtttaagtaagatagatttccatctttgtaggttcattatttagtatttgtactaagtgctttagtactaggactccggatagagaagaaagttcctacgcaagtattagagtagtaattaataacttaggcgtggtgtctaggttagagattacctttgtttgttgcgtatcccacggatttgtcagaggtagacagcaggtggtgacagccctgaatcccgtcctagtaatcctccacgttcggttacatcatagagctatagccgaaaccacgctggcaaactagcaggagtcggtgcccgaagcaacagatagaaaattaccttcaacttagcttagataattaaaacacatagaaagtcctctcaagcctagccagcctacctatagttgttgtccttggatagtcttatgcttacgtagattacacacgttccctgagttcgatatcctttaggggtcacccgaaggtgaagtgctatagcggtattccgtacgcttgcggatttatctgtggtcgtaacaaataccaacaacaacacggagggaaccctcctatggctgcacctgatataatggataggtttccttctggtttcactacactgtcgatagtcttgacaggttttgaaattgtgtgtattggattattaattagtttgtaacacatgtaatggcaatatatgactttgtacacatgacctaacagggtaaacaacatttaatgaaaagaaaattcacatgaaatattgctcttattcttctccaagtctttgacctgtcaccaccaaattagaaagagaaattggcagtttctgccataggttgttcttacttttgctagccgggaattgagggagaaaaagatccacttttgtgcggtcaagtagatgatcatctcttgtatgtggttttgcgaattcgttgtgaaaggtgcgttacataggcaacatgcatgtcgttcatctagttcgtcaagttgtatggcgtattctaatctaagaaagtcaggcaccccgtatcacaatgaatcaagggagatgatcatgaggcttcccaggtagtcaagggcagcaacttctgctcgttctaaacgtcactatcactaccacagatcccggtatctgtgatgggctaatgcaacccgttctgatgactcatgtctaacggatctaaactatcccacgtaagatatgactaagatatgactacctaggatgatatctattttgaaaaacgtaattttaaatttttcaaatgatctcggttggagacatatcctatatcagagtgcaagggttcgatgagatctacaactttccaattgacaatattttcatttgagattgtttacatcaccaaatatgtgttataagtaatgtgatctattttcacaatattttttgaatttttcaaacgagctcaatgagatctacaactttgtacttgaaaagttttctttttaagtcatctagagagtcaaattagtatttcatatttggaccagaatagccaaaataacaatatccaaagacctagcaacatgtggctgagaatatgctttatgtgctttggaaggtcttcggttgaaatcccaccatagtgtgcttgtaaatatctcttaaaaaatcatgaatttgtggctagtgatgtacgaccatggttgaaataatataataatattttgaatattttaagggtttttttgtttattataatttaaaaatcataaattctcatccatgaaggttcataattacgaaccatcatagataactctcatatgtgacgggagtcatctttggtgtgtgataagttaaaacctatcatcgatgggttattggtaacggttattcactcatcacggatgaggtttttattggtgatatgccctagaggaaatcataaagatgattgtatcacatactatgtttacatatttatccgacattgttccttgaaatagataactcattatttgttaatgaatatgtgattctttcttgagactctttatattatatgttgctatttctaaaggatccctgatcaaatatcatatgtggaacaaatatgtttagatgatcagcacatgtattaattgatgatcatgtctcatggatcatggtatagagataccaaattaataatgtggacacatgttggtgaacatgttgttagatagacccaacatgagacactgcaagagccgtatgtgttgtgtcatcagtgatcttatttagtgttggtattgaatccttagacctgagattatcatggttcccaacatgtgtagtagcttacttagggactgctaaacgctactccataattgggtagttataaaagtagttttcgggtatactataaaacatgtagtgggatatgaataatcaagatgggatttgctcctcctatggagagatatatctgggccactcgatgttatagattatggaagtgcatagtcatgccaaaggtgattgaggagttaatcacaagttatataatctatcacaagttcgagtgaatggttgagctattagatgatggcacatatctagccttgagcttaatctatatcgtgaggcaaaggggtccatacaagtttacactagaggttcaaccgatatgatctttatgtatgctcggtgggtcaatacgttctgctagggtccgctgttgacacgtggaccgaaaaggagttttcaggttgcaaccgagtgtatatgaacctacagggttgcacgcttaaagggccggaataaagggattggatggagatctaatatgcactcaatcggatagggatccgagtaggactcatatgggcctcgaaggcccagtcgtgtatcctttatattcgtgaggggatgtgaccggcggaattaacacaccacgtgaaaccctagttgtcactcccctccccgagcaaaccctaaccgcgcgtggatgctagcacatctacgcgtggtgttcctttgtggataccggtagaggccccgctgctttgcggtgctaatcggcgtgggagcacggcgaggacaacgcacgagggggagaaggtcgagccggtgtgatcgactacttcctctacatcgatgcgcactacatcacgcgggttcctcgccttcttagcgcttaattacttccgctgcgcagcgcgtcgagtggtaacgatctatgatctaatatttatatggttcctggtttacgcggtgaaaaatttttagtttatgctatcgtagcctacgtgtatcctaacagttttctcatattgtccaccaatcattgacgaggttaccacccattataaatgagtggttctgttgtagtggtgtgtggtggatctttcatgccgggcaccatgatggctggatggtctaccagcaccctataagaaattacagagctagtgttgttcgcttgtttgccttgcgcctatgcattcggtagagcttgttgatttagctaatcagtcgcacgtaaaacatacacaaataaaaatagctaggtaattactgcatatttaattaggtagtactccctcctttgatcattatataatcaaatctaaaatttcttaaattaattatcatataaccgtatgaacacgaattccattgaaataccattaatacagcatgggagaatgtgtgcatggtaggatgtaattagcatggtgatttaatcgatgcatacatagtaggagaatatgtgcatagtgtcttaattgatgcgatttaaattatccttaatcttgatgcataaacctatatgatgatcaacttcggatggaggaagtattaactattgtaaattttcaaaaaataatttatttgatttttgtacagaaaattttgcacaaaattgatacaccgtttaatggtttataaatcgtgccaacagaaaacaaggtaatagctcaactaagcgcatatggccaatgtttattgccaacctaactttaaggtgaaccctcaaccctatgccagttaacaatagacgtgaaccctttgacaaatgaaaaagatttcaaaccaaccttttattcggtggagcgagaagagagattctcctctcttttttttcgcttgtgactgatcacaaacatatgcttaatttttgttatggcccagcttatgattaaagccacaatggttatcgtccaacttatggcctttaattatggttattaatttacaatattatggatgccctaagccttcctggatgcaagaaagcacggaagaagaagatatgtggcttaatccaatccataggaaacaaattgaactgccaaggcctcctttgatttataggaatttcataggaatatgtaggtattcaggatttggcactatagcagccttcgattcattggatccaggcatagggaagttggaggaaattttcctttgcaactcatttcacaggaaaaacatgagagaaaacatctactataacctcttttttccatcatgtgcacgtaggattgaggtaaatgatagatgtatacatagtttctggtcttttatatagtagatactctgtataatctaactcaatgtcgatatctaaatctatcggccgttttcgatgatagaggctagctaatgaggttagatgacgagatcgatctagattatacagcgtatatgataactcggcgattcacatggacaggattagagtgtcatgaagatgtaagcactaattccgagaacgcaaaccgccataacaagctttacctcttcgtcggagatcgaactcgatgcaggccaactcgaaagcaaaaacatgtcgaaacaatgaaaatagaaaagggtagcgatgcgccgaagtattattgaattgtcgtcccttgtttacaaggtgtcgggccatatttatacccaagtacataacatgtccttgctagacacaactctttctctattacaatttaaaatacgaacaagtcccttaggcggactcttatcaaaaatatttctaaggaaactaacaaaatatcctaattaatagatacaattacattttctggactccaatccctgcgtggcaatgtctatgaagtgccttaattgatcccgacgatagttgcaggaccgtctgttcgagactggttgtatcggcttgtcttcgtcggatttggtgtcagccgatgcatatggcagtcgatacgcattctgcttcccctaaacagaattcctcctaatttgttttgaccctggctttgaacccgatccatggccttaccaaatttagtcgttaataattgtcagacaactatgatttaggggactgaaacaaatgtaaggagcgcacggtgatttggaaagatgcagtgagcaaagacacgggacgattcaagggaattattcctatgccccaacttaaaaatggtgttctcttatggaggatgggagcggtcctgacaagtcggttttgtgccctgataacgggaggacaggtaacaagaaaaaaaacgaagaatattagtagtacattcgcaaaaactaaatcaacagtatgtagccatataattccgaattttattccattattaaaaaatataaattccgaataaaaggaattcgaatattaagtacatgctccaaacacggacaaatataactcctaaagaaaaaaaaactcaaatcccagaaatacacaaactgaattcaaacgacaacaaaacagaatttatatagatagtcaaaacatagacatttttatttcaaaattttcattaatctaagctttgacaaataaactctgatctaaatttctgaattacggaaaaaattataactgaaaaaaaaaggaatgtttggccccattcaataggggtattagtgtatattactacatagctagggaatgggtgtaatatttttcctatggacaggcccgagaacgtagcgagcagcagttgggtaatatttttgcctataggtaacacatgtccatgtccaacccggtacctatgtattaactaaatttggctcatctcttaattatcatacccttttctcttgacaatacacacacttactcaactaatagaaaccctaacctaattcccccactcacctctcctactcctacccaaatccccacggcagtggcggctgcgtagggcgtgggcaagcaatgacgccagcgcaggcaaggcagtggcggcccaggcaaggagtggcagcatgggcatgtgacgacggtagtggcacaggcaacagacaatggggagcagagcgagcaggatggcgtcacaggccgatgacggcggcttagctcaacgcaagcggcgaggcggctcaaggtgacgacggcaggtggcacagctctggccaacaccggcgggcagcgacgcaagggaccatcgggtgcaaactgggtatccaccgggcatgcccatgtacattgggcatgggtatggacaccaagttttacacgcttaccctatcaggcatgattcaagcgggcattctctggtgctggatcaggcatggtttagctctgcccgtggccgacccggcctgttgccatccctatacggaacaaagggaactcaaatgtacaaatcatagagggtattattaagtggcaaaaattctccacatgctacagcaattactaccaaacgaagcttttggttaattgcaggcataatttaaccccaattgaatcgaatttctacagataggatagtaaaataacattacaaccgatccgcaggaaatgggcaaaaaaaaaaagatggtgccttgactaatgaaccggatgccaactatacactgccaaataataataatccactgccctcaactctgtcaagacattcatgacagtccatcctcgcagtgagaatcggcaaaattctcggcttatcttgcaaaacggtgaccccggaggacatgaagatctttatcactcacttgttctgaaaaaaaaatgttccaaggcatgtaaaacaattaattcacatatcattctattgataacaaaacagaaagcaaaagtacagatctgattccttgtcctcccctacacccctacttttctaccaaaaaagagatagtttggactaacataatgaaattaattggtagtatgttatcataagaaacatgtacatgcgtttgttgcatgttgaggttacctaaccgaataaatatgcttaaataaaatttgtgactaaatttgaacctcctacagtaccagacgtaatgcaagaaactagtatatttgtcagtcagattatacacacctttgccttttagaattaggtccatcaactggatcacggttatgttgatgtgaactcctggaatgacttggaccagctcttgcagtattcaagttcccatgtgcagcctgccagtactgattagtccatcatgagcttaactgtatttacagccataataagaagaaattgcagttacctgtgaaggggtgctgctactgactgctgaggcactttgatgatgtgactcaacttgggaaataaatggcataatttggcgaactaagctagcgaaccgtagaccctcatcactgactcctgacacttctggtgctccatgatttctaccatctacctgctcagcagaagccggtgcatgctgatttgtgccatttactcgagaattttccccagaaaagagtgatgcaatccaagggatactatccatcaactgagaaaaaggcccctggccattctgctccccaggggaagtctgagtgccgttttccgcattgatatcaacaggagatcctagagtacctattagacaaatacttcagtggtaagaaaaggaataatatgtcaaccatacatttgttatagaggaaacatgagtatttgccacagaaagatgaattttatgcacttggcaatatgccactgatttgtcattagtgaccacatgtccatgacagatcaagtggcaaatcctcagatgccaatatttgcagtggcaaataactggtaacccattcttttgatgcgcaaaaaacatgagcctgtcaacctggagtacccatacgtaaaaagaatgaagaatcattgaaacaaaggcatgcagaaatcattagacaaattctagaagatgaagtacgcaaaaggcattccagaatgagttaaatgtaaaaaattaaaaaaaaaaacagatacgaatccagacaggcatcaatgctaatacaattgcaaatatattgaagttcaataagtttgcatgtaaaatgctagcctaaatgcttaaataatacttataagaatttgagcaaataaaagtgatatttagtgcacctgaatgtggcaagttcctcatcacttggaggaacactacttagcacttcaaaaaggcaaattgaacatacaactcaaacaaggaaacagggaaagcagtctctagcctcatcctctccttcctctggcttaacactggcaggccaaccaaggcattgctaaccaacctacggtgaagaaacgtgccatagacttcctgcaacggtgataaatccatttcacttctctcccctcccatttcaatcttggacctcagattttattagaatctggacatctctcatccaaatctgcatttctagtttacaacacctatccaaaaaaaatctataaatgtgaccgtttgcctaatctggtcttattcagattcaacataagatcagtcaagagctatccaaccagattgcacccctagtagatagcagtttagtgagcaaacagaaaatactcgagcaagggggcaaacaatacagatagagtgaaaaaaaaaaaactcattcacctgcttcatgatactgagatgtctgtggattcggtatctgattagcactatgggcaacttgagcgttagtgtatgctctttgttgaattctggcaaacagtgggtagataataccaactccactagaagacattgaaggaggatgactgatgccagcaggcacagcaaccactgttctatgcggcaccagcctaactccagattcaacagaaaatggagcaccagctgtaacccctgcaaatgcttcactactgtttgcaggtgaagcatttgcacttctatctgtacgatcttgtgtttgatgttcctcaacccgctcaggtgggttagtaccagttaaagacacagacccacctaacaaccaaaaaggaccgcatttaaccatcatcaaccaaagtaacagtaggaaaaatgtacactcaaactaagtgtggtcatggatgccataataagtttaagacatgttctgtatggatgattggacagataatggacagttgcttacagggatgaggtaaatattataattgagtaattataattataaacctaataaatagcttagaacaagttatctaagtaatgctgatgtagaaaggtgcaaaatccataagtccagaagcttaaaaaagaacacgttctagcattcaatcggcattcattggttcaaatgtattattatctaaaccaaccttaccaactgggacttgcactcattctaaactatcaactctgaggtattagcaaactggtttcagttgacacaccagtttgttatgattaattttagtatgctggactatgcctccaatcaaacaaccttctaatctaaattagctcttatcaactcgtatttcaacaattaattgtcatgataagatcagagcattgatcattgatcagactaatcgtatatatcaaagctaacaatagacatggtaatcctagatggataaatgtgacatccaaactcccatgctggtcaatcctagatggataaatgtgacatccaactcccatgctggtcaaactacaatagtcagactgaagaaacaaaatatagcaacatttactcactcgtgcggacatggatgtcaatatctcttgggtgcagaacagagcgatgtgaagtaagactagaaaatattgggcccacttgaacagatcctgttcctggaacaaaaggagcaggctggactaaaatgagttagcaacgacggaaataggataaatgggttctctacctgttaatattaagagcaaaatttcataatacccccccccccagttatggtccaagcttcacaataccacagaaactttggcatgtggcacataaccacataacccaggtgttatggtccaaacg

SEQ ID NO: 42252 - DNA, 1690 bp, Oryza sativa
aatgaacttggtatgacactgacaacctcaatgtcacaacatggattttttcagagcagaggaattgtacttgtgtgctcggtctgccatacagattgtgtaatgctattaatgtttggtgtttgatctccttttttttaatcaaagattgatccttctgcacgtcccttttcggacgtcctacgtaccatgtgacatcttctctttgcatctcctgcctttcattgcctttgggtattgcatctattttatgatattgttttatatatatagtgattctttcaacatacttgatcactacatttgttttagagtttatcacttcatgttagtaacctgtagttgtttcttttcttagacgcactacgtcttgctattatgttcgtttaaagagcagctacagcagcatgtccgtgttcatgctatggaagcagtaatggcatgctgggaacttgaacaaaaccttcagagtttgacaggtacaacctttttgttatctctttcaattttcataatttacaaaagtaaaacttttattaggaaaaaaaatccaaacttttcttggtaatgcaatgatagtaaagaattgactaatggtttggaaatggcatattgttggagcagcgaattgtttgttccttgctcttgcttagtctggcacgatatgctcttgctcttgcttagtcttgctcttgctcttgtttgttcaagatttttgcttcagatagaaactccaagtccggtttaatccattttctaaaaaaggaaaaaaaaagaaagaaactccaagtttgtgagcattctctatttctaaagctttgagtgttacagacacgatcagagcgtaaattgagagggttttagtattttgctaagttagtttttggtagactggtatcaatcaaattgattaaagaaaatgacaaactggaaattcatggacaggtgcctcgcccggtgaaggcacgggagcaaccatgtcagacggtgaagatgatcaggcagatagcgaggcaaacatgtatgatccaagcttggatggagcggataacatgggtttcggccttcccacagaaagcgagcgatccctaatggagcgtgtccgtcaagagctaaagcatgaactaaagcaggtttgaaatggattccaataattgcttttcagggggaaaaatggacatgttgatgaatctcagtactaatcacttggcaaattcagggttacaaagagaagctgattgacataagagaagaaattcttcgcaagcgaagagcgggaaagctaccgggagacacgacttctacgttaaaagcttggtggcagtctcatgcaaagtggccatatccaacagtaagtgatgatgagagtgagacaattcacatgcttagcttccttatgactaatatactccctccgtttcacaatataagactttctatcattgactatatttgtttagatgttaatgaatctacacatatgtatgtgtctagattcattaacatttatatgtatgtgggcaatgctagaaagtctcacattatgaaacagagggattatttgcattcacaggttagtctagaaggagtaaaatgcaccaacggtccttaaacttatcgggaggtttcacttaggtccacgaacttgcaaagcgcacatcgagggccctaaacttgatttattgtatca

SEQ ID NO: 42253 - DNA, 8081 bp, Oryza sativa
agaccacagtcaaacgaggctttggaccggtatgatacaataaaccaagtttagtgatctcgatgtgcgctttacaagttcatgcacctaagtgaaaactcctgacaagtttaaggatcgttggtgtattttactcgtctagaagtctattatttccatgtgtcctgccttctctgaatcttgcgagttttctgaacttgttatggtctcctatactgttcaagcaccttattttattgtcacgcttgttgtgttgcaatgccgtttggccacttgtgccctctcttttcatccattttgggtgttcatcacaggatgtacataactgaattcctctcccttttttttcgtcatgtaggaggaagacaaggcacggctagtccaagaaacagggctacagctaaagcagatcaacaactggttcatcaaccaaaggaaaagaaactggcacagtaacccatcttcctccaccagcgtcaaaaccaaacgcaagaggtaccaaatcaatctttgcacatctgtcatatagcctggagttctgccgatccattgatttgcacttaattcgaacaaaaaaaagtaatgcaggtgataacaattcgtagcagatgatcgccgagggctgaacactatgctgggttacagggcaggaggaattcatccaaagcaataggaggacaattgcttagatcaggaaatgttctgcaagatcaggatcaggagccgtatattagagaaccagttatattttatagacaaaactaattgcaagtaaacatatatagttctgtaagcgcttgatttgaagaaaaggggaaatttttccaaaggggttgtataaaatggcgaaatttatatttcagtttctagataccactgggtaatactgctcatagcactggtgttgatgtttttgttctccatgcgtcgtagacaagcggttgaaccgtccgcttcagacgatttttttcacacgtatatatgtatgtattgctgtgggtttatttagcttatctattgtgttctgctgcactctgtgtgcttaatcagttaatcacttatatatattctaagtatcatttgttaatttgtgcacaagagttgagaaaatatcacacatgatgaatactttgcattcttttatactactcccttcgtcccatttttaaatacagccatgattttttcgcgctcaactttgactgcccgttttatttgaattttttttaaaaaataaaaatataagtcacgagtaaagtattattcatgttttatcatctcataataacaaaaatactaattataaaaaaatttcaaataacaccaacgttgcccttaaaatccagtatattgcaaaaaaaaaaacactgagttatgtattatctgttgacgtgaaattacgtcatgatacatgaaaacctgggaaaattgcttaacttcaatgtattatgagtttcgagcgcgccagttagtttgatccgacaactaacaagatgaaaatagatcgataatcaagatgttgatcatcaacttagggagccgatatcaacttaggaggccaatacagtatttagaaatcatcacaaaataacttatcgctccgatgaaacactacacaaaaacttatcagcttattaatagcaatctgatagatcggatttaactgagacagttataaatggtcgttaagtgaaaactttaaccgtcaactcctgcataaaaaatataaaatatattatcaaaacatagtggtaggggtttattggtggggttggccgaggcccaacaaattaaggttgcccagaccccaacagttcttaggcccacccactcggggaaaggcctaatctccctaaaagactagtccaataggggaagggtggctctcccttttaaggtggcttcctcctcccaagctaagcaaggtgggattattcagaggctcacatggttgccgctcgacttttgcgtctttgccaacgggtaatagtggaggatgtcctcatcaacctagatagaaatatcggacttaaccgagaaagttctagccacgctgatacaagtgaagttgatgaaacttacttcattgtcggagatcgaaactaagaactcactagaataaaatgtggcaatgtgtcacacccagaaattcccgaataaaattccaagcagaatgtgcattaaaatccccgtccaggaccggccggggtacacaaacgacaaagttgacatacagatccacgtcttacaaacattataaaagtcttacataaatgcagcggaaaacttaaaggataactggagctaagccttgacttggactgcagcgggaacaccactccacaggcatcctcgatggcacggacgaagcctactcctcggagaaaccaccatctgacgcatactcaaattctggggtttggggaaaatagagcaagactgagtactacccactatactcaacaagtcataccggaataggggtatgatgcagggaattatcaagggatagctataatggttcgtttgcataaagcgggcatttataaacagaagttgaaagcagtaaaatagttgtaataattaatcaatattaatcatccactgtccaacgctataccacgttgcaacaggcctaaccatccacctatactattcaattccattagactagtctagggtgagtctaatcacggtgaatctggttgaccgcccataaccgcgggcacggctattcgaatagttttactctgatcagaggtgtacaactgtacccacaagacacagccccacgacacgtttccgtgggccgacatgccaccacgacataccggaaagaggccgtgacaggacccttcgcataaccccctctaaccaagcacaccacacctcaggtttcacccccactcctcgcaaggcagcgggcagtcccctctcatgcctaggtgaatccggaagccgcataggccatcgcagggcccatccaaactccatcacgcccacccttgcctggatgcgtcggctagaggaaagctacactacaagcccagtcattgcccacgctggcttatggtaaatacgaggaattcttccagggtttcccgcgaagcagtccttaattgccctaggcgcgaccatcaaaaccatgcacccacggcccaccatttaatattaattaattagccaacaccggagcggtgagcaataaccaacatcaatcctagaatctgatatctatgcatttaatgtagttccccattgtgtgctagttgaactaagcaaaactaagcattccctagtccaatctctagtcatgttatatcccaagctaacaaaggaacatggtacaagacagcatggctatgacactaggtaaacatcccatagtgttattataaaacaatgcagtatttgaaggaaaacaatggagcatttgcaatatagggtcaacatgttcaagtgacaagcatgacttgccttgctctgcagctggaggaacttcggcgactatttcaaggtacaccggagcgtcgggagagacggaatctaagtgacatacaaagtaaacaatacaaacaggctatatgactactgaaacagagaacaaaaccatttttgatggattctacacatttttcttgatttactgagacttgaatgggcttcaacggagctcggatgatttagttatgaattttagaagatttactgtgtttttactataaacggaaaaatccttaattgatttattgcgcaataaataaatcccggggagagagagagagggcggcgccgacatgcaggccccacatggcagtgacacgggtggcggccgcggtggaccgagtccacggactggggaaaggacggcgcaccacgtggcgctgacgtggcgccgacgcggcggccacacggcagccacgtgggcggccgaacggacagctcatccggtagatcggacggcgagcgtggctcgcggccggcgcgcgcgggcacggctcaagccggcccagcggccatggcgcgcggcggcatggcgcgcgtgcagcggcgacgcaaggcggcgaccggcggtggagggcgacggcgtcgcgacgacgcgggcgacgaagcggcggccaagcagctaagcggcggcgcggcggctagcggcgcgggagagagagagagaggaaggggaggagggatctcaccgacgacgaccgacgacggcgagcgacggaggacggcggcgacggcgggattatctccggaaccacctagcgaacacggtggaaggggttagagagggagagggaattggaagagggcgaggatgccggccgaaggcggcggccatggcgatgctcaccggcgaacggcgcggagtgggttccggcggcgggatccaacggaagaggggtggacggggtggctcgcacgacggcgaacgcggcggcgtcgtcggcgcggctcggcgcggcggctagcggcgaccggagcggtggcggcggcggcgaagaggagggtgacggcgctagggcgttagagggcacgggagggctcggcgagatggggaaaaagagagagggggtggcggtggagcttaaatagaggagggggagcccagacgtggccggtaaaggtgggaatcgccggccgacgtgggggagtgggggaggagagagaggcgggattcgaaatcgaatcccggccgtctcgggcgcggcgcgggcgagagggagggggagtgggtgcgggggacgcagcgcatgcgcggcgtggccgacgtggcccagaggaggcgggaacgtgggtgcggcagcggttgaggggcgcggcggcgccggctggaggaaggggacgggcctgataggtgggccccacctgtcggcgaccccagggagaggagggaggtggccggctcggctgggcctcggactgtcggccggcccagcgggaagaagggggggaagagagaatgggccggcggcccaattgaaagaaaaagagaaaagaaaaagggaaaagaaggaaaatggattttcctgggattaaatattgcttgtgctcaattttaattggttaaaattatttctagagctctgaaaattccactaaaaatcttgttagcatatttcgacatgtagaactcaagaaaaattccacatgccaaatccgattattatttgcattattttattagggttttctcttgcttttacaccgatattttctctggtggattataaattcaatttaggcttgggaaagaacttcagggtgtgacacaatgcaccaaaaggaattgtattgatatgtgaagatgtcttacaaagacttcgggtgtacatatttataatctcagattgatacaactttttattagacacggtataaaatttcctaacaagaaaaggaaaataactaaacctacatatttaagagatatactaaaaatatgaaactgcctttgttgtagtcttcacgattcctccttgacctcgcatgatctggataaacttccatcgataaatcaatttgtttccttaattgaatccactaaagaaccgtaccaaattttggtgttaacacatgcctcctaatttttgagtatgagaactcatactacaaaactatcttcttcctgatctttatgacttcaaaatttattcatcttttgcctcttgcaatcggttttcatgagttgataccttctacatcagatgagctaaactttcaaactcttgaatggaaaaatctttctttgataggtgttgacaatccttgaaataccaattctgctaattgtgcatcacttaagctcaaactatagcatcgaccgcgaacatcacaaaatctttgaatatattccaaaaccgattcatctacttgttgcttaagcaatgccaaatatgtgagtttcatctcattgattccagcaaagaaatacttatgaagctgcttttctagatcggcccatcttttgatagaatttgaaggtaatgatgaaaccatataaaagccgatccaaacaataacaatggaaagaatctaactttcaaagcttcaccagctgatgcttctccgcactaagctaaaaatcgactgaaatgctcaattgttggtatattgtcttgtcctaaaaatttagagaaatctggaaccctatcaaactacttaggatatgggcattgatacatataggtttgatcgatcccaaactgttctctcatcatctctatcggcccactcattattccttacattgtccatgttatagtgatgcgacattgttccttgcatacaatgatacccttcaccatgcgtatactgatgaggttcttctggccaatattgatgtagttcttcatactgatgtggttgcccaccaagctgaatacgtccataaaatatttgaggcactgctgtcatcattggcatcaacaacggcatatgtatatcaatgtttgccgatgtctttaatccttgagcaattgtttcgttcaccccgcctgagttgaatattcattctaactaggaggaagccgcaccccaatagaggtgcacgtggttttgttatttatttttctgttttgtttatttgaatttatattttgcgttccttttaactgctgtcgaggacaggtcgagcacttctttaccgtgaatattctagaggaccatcatcaagcaacatgttccattttaaaaccaaacttgtcatagttaagattctggcttagaataaatgggattgacatttttcttttatgttcagggcccgggggccatccgtttgatagcgattttaaaagaaaaagttcactttagttctcttatctaatgattgaggttgattgaatcgggtcccacaacggtaaaaccgggacatccattagctttgcctccatgccactggcctctacaccctccgccaccgcaggcaaccaccacaaccgtgcgcagccaagggagagggaggggttgcgctagaggaagacggtgacgaaacacgagctcgacatctagcgccgaagggaggggaaggaggcgccgatggccgcatccggggaggtaggggagaaggggaagaggcaccgtctcgctggcctttagacccctccgccccccaccggccaccaccactaccgtgcatggccaaggaaaagggaggggtcatgttggaggaagatggtgacgatgctcaacctcgacatccgccaccgtccaaaggggatagagagggagagagggtgatgaagggatacgggtaggctacgatagcatgaaataaaaattttctacgtagactaggaaccatgcgagttagggatcacaaaccttagtgtatttgtgtacgaaaccatttgcctcatgatatcgattaagtttaaggctagatatgtgccatcttttaaattgcttaatcatccactcgatcatgtattagattaagtgggatgaggatcaagtcaatccaaccacgttaaccgaaaccgccatccaaaccatcttgggacctcgtttgtggtttagcggttgtgggatgctattcaaactcgatcgggagccaaattaaactttttgtcatttcaaaacataaaggaaaaagtataatttgactccctcaactatcgcccgagtatgattcatgtcctccaactacaaaaccgggtatatcgactcctccaattatcaaaaccggtgcagacaatatccctaggtggttttggaggtggttttggcttacgtggcgcctatgtggcggtcttgaccaagtctttgtcctatgtggcgcttacgtggaattagaataaaaacaaaaataaaaaaaatgtgggaccccatatatcattcacacaaaaaaaagtattgtgggacccactaacatgtgggtcccacatgtcatcctccctctccttcccttcttcctcccctcctctcccttctctctctctcccccctgcctttctcttggccggagtggcggcgaggatggtagtggggagcggcggcggtggcggcggtgccggtggggacgagggtggtgccagccgaggagtgcaacgccgcggtggcgtcacttgccgagtgccatg

SEQ ID NO: 42254 - DNA, 3737 bp, Oryza sativa
cctgcagccccccatcgcctcccgctcgctgtgttactcgctagcacccgtaggaggcgtcacctactccaccatccccatccaacagccgccgccgctgctgtcgaaggccgtcggtcgcagcggtggaggtggcggcgagcgcgcacggccgtagcctggcgaaaggaagagcggtggcacgacggtggcacggcggtggcgccagactcgacgaggccgcagacaccggcgggcgacgcgtggaactcggccagtgacgctgccgctacgtcgcactccttggttgccgccatcctcattcccatcaccgccgccgccgctcccaccgccatcgtcccgaccgccgccgccgccgctcgccactgccatccccgcagccgctccggccaagagaaaggacagggggagagagagaagggagagagggggaggaagtagggaaggagagggaggatgacatgtgggtcccacatttttttttttgtgtgaatgatatatgggtcccacattttttttttgtttttattctaatgccaagtaagagccacgtaggacaaagacttggtcaagaccgccatgtaggaccacctcgaaaaccaccgagggatattgtctgcaccagttttaatagttggaggaatcgatatacccggttttgtggttggaggacatgagtcgtactcgggcgatagttgagggagccaaagtatactttttccaaacataaataatgttgagtgacccttctattctgattgcttctgggctagtgagctgtgggttgggcttcttttgcctactttagagctgggatgacatgagccgagttcgttagagtctgggttttgcaaccttttcgtttacattatgttttttaaaccattaaactgtattttttaatatattatataaaatttattttaaaatcaaagaaacatatattttttaataattatatttaattaatcatgtgctaatggtttgtttgtcatctaaccgtatgctgtgattctttaaagccttctttaaatctgtatacaacctgtagtttaaatctgtatacaaactgtagtctgtactctgtagtttcagttgcagtaggttgtgtgattctgacagctgaagcatgtgaacatatgttagatactaaaactcttttaaatatgaatctaccgaatctattggtccaggtgctggcaatataacacatggataacttagtattttcaaagaacaaggcaatggcttgagattttgctaccccaataaacaacattcttctcagaagcatatactagcactaaaacaaaaaaacaacgttcttcagagccaagataacttgtaatagaaaaggaaatctctgcttaaaaaaaccaaaagaagaaacgattcaaatcctcctgtacacatatcagcgctcgtagtcgccaacaaaaatcgaaggaatcaaacaacaaaaaaaaaagagaaagaaacccaaactttaatctcccgtacgtatgtacatccgaacggcctaacaatcaattcaagaaccccggtcgacgggcagcgccgtcggcggcggcggcggcggcggggacgccggcagccgcgcggagaaggccatgtacttgaacggctgggcctcgccgtcgccgtcctcctcgaagttgagcgcgtagctgacggggtcgtagcggaactccccggccagctgctgctgctgatgatgctgcagatgcggcttcctccgccgccccccggccagcgccaccatctccggcagctccacggcgcggtcccgcacccaccgcgacgacgtccgcagcgccctcgccgcgcgctgccccagctcctctccttccccgtccccgtccccgccgccgaagcagcaggagaggcacccaatgccgccgccacggcgctcgccgcgctccactgccatcacatcaaaagaggattcaggcttggattgggattggagtggtactacctaccggagggtgacaaatcttggggttggtttatagcaggatggaggaggtgggtgcggatggataaggaggggagggcgccggagtaggggaggaaggagacggggaaagtggctgggtttggcttccccgtgggcgcgagcgtcgcggagcggaggatgattattattattttttttataaaagagaaacagggaggatgattattgggagtgggaatgaatgcgtgacgggggacggcgaaccggacgaagaacgcgttggggacgcggggcttggggaccagaccaatagaccatcatccatcaccgcgggccgcggggacgggctgtgcaatacaagtggaccgcgtgtcgttgcattgcacggcagattcattcacgaacatatggtactaattctattttggtcattatatgacggtttttacactaacgtcatatattaatgatgggagggaatactaattctttttaagcgatgtggaccgggcttatatatgaactttggtgttttttttttgccagcgtcactcccaaataatccatccgtccgaaaaaaaacaaacatagagcaagatgtgatacattactatgaatctgaacctagaatcacatcatattctagatttattttttatgggacagagagagtagcacggaaataacaattcagcctgacgtgttggcaccacccaccctcctccctccattgctgctacagagcaagttgtcggaattaggaatgattgtttggtttattcgtttcgatttgtactattttgtgcatgttcggctttttataaacactaaccgatttcattagtaacaaattaggaagccaagccaaggaaaaccacactatttgggttcggtgtcggtttctaccgaagaaaccggcggagtactctacaaagttttgaaaatataagcatacattgatacatgatattaaatcaatatatgcttatattgaactataagcatattgatttaatatcatgtatcaccatattccatcaaatgatatgaagcatgtaaactagtacaaccacatcatgtgatacatatatgtaaaccaggctgtaaatcatgaacaggtcaaataaatggaatatggtgaacacgtaccgagggttttgcttctgctgtggatcggattgacaaagagtagcacgcatcataggaacaacgcgtggtgctgggtgttgtcatcatcgcgcaaccctcaagcgtagaggaagatgagccatcgtggaagaccagcaagccgtcgcgtgaagcacttgccaaaaaccttattgtcgccttctctcagtgcaggacgttgagggcaaaggttctggagatctgctctcccgatcgccagtgcatgccgacaagcaagacggagtagactacgagtgacggcacggtacagaggaggaggcaaaccctagattaattttgtgtatgttgtgaggcggcggcggacggtttatatagagatatcagaacgcgtgatcaggacacttgcaagatctccacatggcgtaatcaaactggataaatcgcgcatatcttatccaaactccacgccgctccatgcatcaaattattcgatgtgtttccaaaaaccaaactgaattctacagcaaaaggaaaccacgtttgcacaagcatgaggagccctccgcgtccgatctggcccgtgccgagcctggcgaggcaagcaagtgcatgtgtgtccctctagttctctccattatacatgtctcaa

SEQ ID NO: 42255 - DNA, 12479 bp, Oryza sativa
  unsure (1)..(12479): unsure at all n locations
tcctgcagcccttaaattactgctagaactttgtctcgcagtgtgattttcattaaaaggaaaagtatttacaaaagataattacaaagagagcactgaaaatattataatggttataaccaatcaaaaactctttactttaaatgatctttcattccgcacatatgcagaagaccttctttcttgaacaaaattctccaggcctcaaaggaagaattcttgttctgaaatatctttccatttctttctttctaaatatgccgggcagcaataaagaaatttccaagaagcccttttgccggaaacgcagtcacgctaccacaaccatttgaaagaaattgagattaggatcccaaagaatgcctaggtgccgtcaacatctctgactgaaaggacaaaagaagaaaagatgtcctcttatttccctatgaccatttgtacgaagtacacatgtaagatcatcatcctcctttgcacaatgccgatgattaagcatatctctagtgttcaacctgtcgctaaaaagaagtcatgcaaagaccttaattttcataacactacgtgttttccaaatccaaacataaggccttggcgtctgcaaagacatgaatataagcttgtaaaatctcttagcagtatatctagtagaattccatatgtagctccattcatctcccttgccctcgtccaaattgagaagagagacctcatgttccaatttgagatactccttgtaagcttgactgttcagaggcaaaagaaaacagtcctctaaggatagttactatagaccgatcatatttgtgctaatttcttttttttttcaccgatcctgaacaccaatatatattattgttctttgcacgtgatagttaaatctgattttttttagaggtgatatcacctaactatcacgttatagttaaatctgattttttttttgttagaggtgatatcacctaactagtacattcaaatccatacaatcaatcaaacaaaatatatttcaaaccgtatctcatatgtgtatctcatatgtaagtaatcaaacaaaatctcatactagtcacgctaaaccaatactcctttcattctaaaatataaggcataaacactaccaacatgaatacaaataaataatttaatcaccttatcggttagatcatatcgatgaatgcgtgcaatataattgaggtgcttgatggtaaatatatagatgcatatacgtttatattatgacacataaaaaatgattgtattttatatcttagaatagagggagcacaaggaaccaaacatatctccttatcgtgcccaacctcagcctggacgaaaaagatgggctagactaaggctgcgttctttgcatagcggtagaggaagatttacagctcacgcgaaacgcaaagcctattagcacataattaattaagtattaattattataaacttgaaaaaacaaattctatatagaaatttgctgcaaaatacgtatcatttaacaatttaaaaaacgtacttacgaaaaatgaggatgttgaaatttggagttgaagaagagagctgggtctaaggagataagcaactaaaacaaccttaagcggatcggagatgggaactaaaaactcacccatggggctggatgcaagtatagctcatcacaacacatgagcaaaacccattactaccacacattaaacaaaatgtaagcatcgcaattattagtatgcaagcatggcacatcaacctactaacacacaaaaacttaacatatactagcatgataattattagtacgtagtaaaacttaattgcaactagactactccctccatccctgtttacttgtcgctgggaatttaagtcattgtccatgtcgtgggcagctagtaggtgagccactagcatgaatagttttattaatttttttctccatgtttgttgcagacatgtaatggtaggcgtaatactagttttgtgtcaaattttaagcattgaaatgattaacataaaggcacattggtcatttttacaacactatattttgtcatttctatgctagaaagactactaaactgggataccatctacaaattataacatataaacatgctaaataattatttcttatataactcttataatatcttaatataaaacgatcctaatttttatatttgacatatattcatatataaatctgtaagtcctatagtaaagtagccgaatcctgattgccgctgcaacgaccgcgactcgactccgcgaggtgcgacgcgactgcgcgattcccctgagcgacgccgccctcatgccctcattcctcccgcgcgatgcgagcggctgctcgatggagataggcacctcgccaagctgatcgacgccgccgccgcctccgtgccgaccccgtacgtgagagctccaggcgctgttctccccgaggcgagagtagcccctggcgccacaacactgtccggcggccatggacgccgcgacaggaaccccggctgatcagagcccgaacgcgcccctgcctgtccgcgtcagtgaggatggcgtcgaggtgtcgcggccgctgacagcggtggcgtaggcaaggtgttcgacggaatgcgtcctggcttctgaggcgccatggctcgacgacgcgcgaggccggccgtgggcggacctcccggcggacatcctcggcctcgttgtcggctgcctccccctcgtcgaggaccgggccaggctgcgctccgtctgccgcgcgtggcgcgtcctccaccagcggtcgccgccgccgctgcccctgctcgtgatggccgacttctccttctccagcttctgcgcaggagagaccatcatgggagtgcgtggccgtgtcccgctgccggagagggagagggagatggcggctggtggcagcgtctgctgcgtgggctcgttcgagggatggctcgttggcgtcaaggccaacaaaggtcgctacttcggtgaccgccggcgtttcttgatgaacagtttctcccgggatgttatccgactcccgctaccttcgggagcctcccgctccgctgatgcctacactaggtctctccccatcatcaatggctctggtgtcttgcattgcacgatcaacgcagcgaagtgcgtgatgttgttctggaaggtcgtcttgtcctcgtcgcctgactctggctccaagtgtgttgtggccgccacctccatggtcaaggatgcagttaagcttgctctctggcggcctgggatgaagtcgtggagcgtgtgtgatggtgatactatcattaggtccattgatattgtcttctgccatgccaagggaacctccacatgctcagtttcggcaaattcaccactaacctcttagtctttgagatctgtgaagatgacaatggcttgatggtttctcgtgttgagtcttgtgtgatcaaactgcctggggtcatgggtaccgctaatgagacttggagcatagtagagtggcgcgggaaactactgatagttgtgacatactttggtgaatttgggcacaacattattgagattagagtatatgaggtggactgcagcacaaaccctgccacattcactgagatcaagagcttggatggcgactgcaactttatcagccaactcagcagcaagtcttttcgtttatctcattatgatgtagtcaaagattatcttatctattttatgcatgaccgctcttttgataaatctgtgtacaacatgaaagatggtacaatgacaccaattactgcagacatgtcagaggacaaaatttagacaccagatggaagactgatgaattcgacatggttatttcctcctgaatgaactgctgcatatcaaccccgatcctactgagtcttaatgtatgaagcactgatttttatagtagaaaaacttatgcatacttaatttgttttcatgtacctatgtgaacaagtggatttttagttgctttcgcactcttggttgtgggggtgttttaagttcctgtctatatgaaattatgaacaatgtttctccagatttcccatccactagtatgctgcaatgcggttatatcaatttctcttttaattcaagctgaagtgtttttcgtgtttctaatcaaggacccctggactgtgctgtcattcttgactgtctaggaatctggagcagtttacttaggggaattatagtcctctaggttgatgttacgataattaaatagaacatggtgtttgcatatcatcatatgtggatctgctaggcaagatattcgttacttgaaatgcatactgtttttccttggacactttcggtcttctgagtttgtttcggattacaggaaattagcacatgcatttatattttgtcttcatgatacaactttattgttttttctaacatatgtgcatttcttctctcgctctttttctaaaatgttgtgggagctcttgtcaaaaaaaaaatgttgttggagcatttagatgttactcggctatttttatttcatctcgaacatcagtcgatttttgaccaatgacaagttgacccataatatgtattaagttccatgcatgaagggaaactcagctgttttagttcattatttccgtcaggtttttatttcttataatagaggaaaaaaatcgactacgtcattgttggattgctgttcaaaaaaattgagtgaacaattctcttattgtagtcaattgttgtttagaaatttcgtttttttgtactatatatttttatgaggctgacaaaggtcctgtttggttccatgggctaattattagccctgaattagccctaaaggatctaaacaggtgggctagtttggagctaaagtgaattagcccccctcaaaacattagcccctccaaggggtgctaatggagctaattttctatggagaccatcaaaaagcagccctatctccctctctcttctctctttccaccttttagccccaaattagtctaaggatccaaacatgtcaccctacattagcctaccaattcaagactaaatattagctctcaaaattagccctgggctaatcttccaaacaggaccaaagtgacaactgacaaggctcagtccaccgaggcgcaaaccaaatcattttaaatacagaggtggggggtataattgtgatgggtttgcgctggggtggtcgatgcccaggtatttgtattgttttgctcccaggaagaaacccagtatgagcacagagcactcttaattcaaatgtaatagggaatgagaatcaagtgaggatatatatgtcagcaactgcagggacttttacatgtcatcaactgcctacagtgtgtagttgatagttagaacatgttgtcatgcatgaaagcaaattaaagacgagaaacagagcatgcaaactaggaaggcagcacttcctcttctatgggttacacatttttaagataacaataataatataaaagtcacagtctctgcgtcatataatattgcatacaactattatatatatcaagcatggaaactgccggtcgaccggcgcttagagcaaggtcaatagttagccggctgctggctccaaccattcttatattatttcgtagttactactaaagccaactattacaatagattagctattgtgctgactataattttgtaatcaaacaattaattgtgcatacaggtattgacatgtatgatcataagtggatcctattcttgtggtcattgttgtgatatgagggtgaacacaacaaagcaagctcgcgatggattagctccatccatacatcgatcccaccgggtcttcatgaatgatcagtgatcagattatgcgacagcacaagacgagggacggtcaccgctacttacctcaccacgtacccaaattatcaggatttggcgcacgcatgagatgcttctcgtcggtagcaattgcgccgccaagacttcatggacgaggatgaggaactgaggatgagtgtgcgtggtgcaggatggaggacgagactgcgtgatttgtgggggcggtggggttttctcgctcgctgacaatgaataacactagcggaactgcggaagacatcgtccgtcggtcgacgaagcaccggagggcggaacgaaggaggatgcgcacgggatcggataggtcaccatgggacccacaaaatatgtttttaatcgcgagtgcgcgtgaaaacgcgtgctatcgccgggcctgcgttgttctctctttgattctctctcctccatctatgaaaaaaacaatataaaaatttttggagcctcctgactaggattatcgtactgctcttagaacacatgccaagccacactagaaaacttttatatttcaaccaggtttctagacttctacgataatattccccttgttgatgacgtcatggacatgaaaaatgtgccataataaatagggttaattggatccatgccattataaattcttcagttttgatttataccattactattcaactatttagtgttatgcaattatacttttttaggtattggaaatatgccactacataccccttcgatgtgtttcacaaaatttttagactaaattgccctcatcttcttccttggcctcatcgtcgtcttctcccatcgtcagatccaaatctggcttagggaaaaataggaggtagaagatgaacgagagaagacgacgagggcaatttagtctaaaaattttgtgaaacacatcaaaggagtatgtagtggcatattttcaatacttgaaaaattataatggcatgaccttaaatagttgaatagtaatggcatatctcaaaactgaagaatttataatggcatggatcaattaaccctaataaatactcatttaccagcgaatgcaaggagacacatcaaagaaaaatcaggcattgatgcctaccatacctaatccagggtgatcacggtttgcatttagtccatatgacaaataacaggattgccactcataacagaaacaagaaaatgagagggggagcataagctatgggaagcaaataaatgcaagtctgtacctcgcaatacctttgcacatgaaaggctgcagatgaattaattccgttaactttgcgagccatgtaaacaaacaagccatttgattaaaatttattgcttaatcaagtttgttatattcgacctcaatatgtttggtgatgtattaaagatggaatcgcacccaaatattccacgaaaaaaataaccctgatgaagaggcacgcacaaagtagcgaaaaaaaaatcgtagtccatgcatgccatatttctagctatcaactttccagatgctccagatccaaacaaacaattcatatgatcactaatcgagtttattcagtggttgtgtaagttgcaatagtacagaatgatccaggaggcgggtcgcatttccgcgcacaaggaaacgaaattaatgacgaactacaacacgtcaacacccgactcctgagaaaaacgaaaacaagaaaacgaagtacaagtctacttacaggtaatttgcgcattgtgtaaaaattgcaaacagaaggaaatcactttcgcaatgtcatattgcagaattggtttatgattgtcgatgacattttgaagaggaaactgactcttcgtcgatgacatcgtacaactttcacttgaagattttnnccctttnttttcccccctttaaaaaaaaccccaanccttgggnaaattangcaaaaagaaggatatccaattgttacatgcatgtaaacaacatatgatggaaaaatacagagctaaagcgatataatttgacaaacttacaaggatatatgcttgttagcctttggttatctctttctgatgacaagtgcagatacgctgaaaaagatttatgtcctcatgtctaatcttgttgataatcttgtgagtaggatggatcgagtgttggtaatttctactgttcccaatgatatgcaaagagaccaatacaggcaaagcatgctcctctatcacaacacgtttggacgtgtcgtttacttccaattttttcaagcaatgaaacccatcaggcctgaaaacaagctcttctccgtcacaagaaacatccttgagtgtgagattggaaagaaggggcagcttgcctagctttccaatgaacccttgttgcagacacgtctttgacaatgacaatttgctcaagttcggcagctggaaatcagaaggtgaagtggtcatcttgtctatttctggtgatggagttgtgagcaggatggttccggttagttctatagtcttgaggaattgcagggaaggtgccgtaaaaatgctagagattgggaggtcaactcctttcaagatcagtgtagtaaggttgttgagattgttaaggttgtctgataacttgcgcgccttctcctctttgagcttctcttggatagtcacatccagtaacttgaggttaaccattcttctcaacatagagccatcccaatcctgcaatgctctcaccgacttgagtgtatttagctgtttcagttcacgagtccatcttggcacgatcagctcagagccaaacacatgccttagcgatgtgatcttccaaaaggaacacggcagttcatgcactaagctttgtctgacatcaattgtttgaagatttttgagattcccaatcgacgggtggatcctcctcagagatcggcaacgcgtgctaaggtaacggagatgcaccatgcctccgattgcctcaggcaactcggtgccgatattcaggccttcgatcatgattactcgtaggaacttggatcttttcagcagcttggtgaggtcaaatcttgaaattttcggtgatctgtgctgctcgcatgaacagcaggtggggaagcagctaggagatgatacactttcttctgctgtgctggctggtatctcttcgaagattgcaaagatggaccgtagcttgggcatcttgttatctagtgccgcgtatctgtccatactgttatgtagtgtgaggcgtcgagccctgtccggcgatgggaagtagtcaccatcatgcagctccatgaagtttgcctcatgtgcctctgaccgtgcaaacaagtagacactgtcatggaggaaaaagtggcggatgtcgtagtcaccatcagctgatgcttcagtaactagtcccctagtggtaagctgcctcaggtatagctgtcccagttgctgtaccgtcttcccgtgccgcggcaccacaaagccctctgatacccacaagttgacaagcacgttctggtacaccttgtagctgaccgggaatgctgtgaagtagaggaagcagagcttgagctcatggtgcaggtcatcgaagctcagggacagtatcctgttgagccgcttctctttggctgactcgaggtattttaacaccctatcccattcatgtggatactccttgttgtgcatgagtccagcaagcaggataactgccaatggcgagcccccggtaatgtcatacacacgctggtagtatattggcaggtaggtttggttttgttcatcctcctctttgccatggagcctcatgtggaacagcttcctgcagtccgtttgattgaggcatgtcagctttatctcatggacatcattcattgggtggtctagaaactgtggttttattttcgtgatgagcactacccgactacctctttcgttcttcggaagagcatggatcacagcattccagtcagcgatggacatctgcctgccatcgatgatgatcaagtagcactcttcaccaagacgtctttgtatcttgcttctaggattctcattgtcactttcgttattttctttcttcagttctttgcttatcaaactcaggatgttggatataccagcatcttttccgaccttcactccaattcgctctttgaagtgttctctgacagatggttttgaacagacactgtttacaaggatcgtcttaccaacaccactatcgccgacgacatatattacggcgaggcatcctgcggagctgagaagcattgcctctagttcctgctgctggtcgtcacgcccgataattggtggcttggatgtacccctgcatttccaacaagatgacaatctacaggttagtgtatggccatcaacagaacattagccccaaatagcctaattttggggctttgtttggtcacttccagaagttgccacaattttgtagcaaaaccacgacatgtttaagttatatatggattgtggcaccaaaattggtggccacacttgtggtaaaacaagctaaacaatatttcataaaaaaacaaggcaaacaatatgtgacgagtcagatcaaaattaagaaattatggcaaaccccaacctgtagtaaatgattaaaacactagctacaaattatatatctatatatcctatatagttgggaccaaaagctcaacatacataaagccacatcaccctttaaatcttaaccattgtatcattaattcttgatatgcacatgtagctcatgatatctgttggattgtttaggagagagatgactgttatcttcttgtgtaactgaggaattaaattcctttaattatttctattcatgaccttataatgttacctcccaatgcatgtgtcaattcatctaagcaagctcatcaacatacattgacccacgtcaccgtttaaaccttaacaattggatcattcttgaaatgcacatgtagctcatgatatctattggattgtttaggagagagatgactcttatcttcctgtgtaactaagaaattaaattcctttaagtatttctatttatgaccctaaaatgttacctccccatgcatgtgtcaattcctttgagcaaccatggtccacaaaggttaagatattcattatgaatgtatcatactattgttgtggcttgaatttgtgttggtaaaaatacattattgtgattaggatggtaccaacaatatttgacgatgttctcacaatattaaaacatctgcataactaatcatcaacatatttttgtcctaaccatctattttttaaaaaaaacaaagaaaaattaaaactatcataagaaattctaaatattataaatagtatcttgattcctttaatgtgtatttcttttcattttagctcaagtcatctaaaagtgaatattattttgtttctaggtactaaacaccagttcatccccactaagtgtagttaatgctatttctctctttgtcatgaagccacatggatgattgatctacggtccaaatttattttcctctttatttcttgttattaaattatatcaccttaattttgcttttggatcataacatctatattatctcccttatttttcttttctcattgcaccgcatcaccttagttttgttataaaccatatcatcttataatgtttaggttttttctttcaatagtcaaccaaagataaaaaaatatataaattattccctcctttttctcctatcaacttagttttgcttttggatgataaatgtaattatctcccttcttttctttctcattgagccacaccaccttagttttgttataaactaccgttcatagttttttttaaatagtcgatcaaagatgaatattgtataaagtatataaagttgtcatctagctatcttaaatgatacaaaactcctgcagcacgggtttcatcaagtatcaaatatgactaactcaagtgttgcaaactactttaattagtgaatcacacacaccctaactaacatatttcaaccattagatccatatcaaatcatcaaaatttcttcaacaatatcttatctagacaaccaactgctagcctcctttgtcttcaatccaagacagtgacacacgctacaacaaaaataacttgtagacacatttttctaatattgtaggatattttctaaatgtatttacaaggctatagaggcattttataaaatgtatactttgtgtcatttttgaacagatgttaaaggcatattctagaggcattcaattgtgtgacaaacataagaaaccactatgaaaaatgagagattcccttattctaccaatccttgaacttaacaattctcgaaaaaatcattcacaccttcaatgtacacctctaaaaaatgcctctatagaagttggaatgcaaccaagcaaatgcctttacataaggaaatttttaagtgcctatacaatacctctagtagataaaactaacaaaatttgctaatagtgcctctaggataaaagtatcctaggcaatttttaaagttctaaaaagtgtctctacacaataaatctccaaattttaaaggaaaattgaaaatttcctttagaaaagtgccacaataaaggtttttcttggagtaacataacaccatttttggagaaacaaaatgttaggataaactaatgtaaatgtttaatgg

SEQ ID NO: 42256 - DNA, 8275 bp, Oryza sativa
  unsure (1)..(8275): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaaaaaaacaaattagactgcaaacaaccttggcacccacggcgattagccaattgcagccttggcacccacggtaattctaccgtacctgcccatgctgtcgtcatcccaccgaggggagtcaaacgcccaaaaccatcaaaaccctcttcggctcggcccaaacccctatctaccctaatccatccgccgccgccgccgccgccgccgccactttatgctcgtctgcctccggcgacgaggcctctcgctcctccggcagcgcccgccccgccccttcccccctctcccgcgcccgcgcagcagcccaccccgcgtcgcctccctccgccccctctccgccgcggcgatgggggagaactccgccgccgccgccgggaaggggaaggaagcgaaggggaaggcgacgacctcggcctcggcctcggcaccgaacgtcgagcccgacgtggcctaccttgaggcggtgacgcagaagcggatccggcagttcgaggagatccaggccaagcaggccctcgagcgcctcaacatcggaggcgagcccatcaggtgagccccgttctgcgattcgttgtgaatttgatgtagttaagaaactgggagggctttgattcggaaaccgtaatgcttgcggcgcgttatagatgaaaatggagttagatactacatggatggcagatgtctcaggcattgagatgtagatataggcatatagcacaccaagggaatatcctcgatagccatgctttgtgctgcataatttggagtcggattttgagtgttgggaatatttgaatgtcgatgcgacgacaaaatgggcgctgcgcaaactgcataataatgccataatgttattcaactttaacatccatctgtctttaataagaaaatagagacggcaagcatttcttctgcctaaatattctaatatagaaaacccttgattatatggtgcttaggtttccttttctcaatgtacctttgctagttacaatacaaatgtggcacactgtgacctgcaatgtgcagcacaatggcaatggcaattaattcttctcatgtgatttttttccctgcaactttcttcaggataactttgccagatggtgcagtcaaggacggaaagaaatggatctcaacccctatggatattgctaaggagatatcaagtggattagcaaatagctgcttgatagctcaagtgaatggaacactgtgggatatgacgaggccactggaaggtgattgtgaattgaagttgttcaagtttgatagcaatgaagggcgtgacaccttctggcactcaagtgctcatattcttggagaagtgagttaaagcttcataatttccttgtatcatgtttttttctttaagcaagttgtatggttgtctctttttcttttttgtttacacatcgagtgattttgcatgtctctctgctataagtccttttgaattcagtattttctaattgaagatgcacttttgcagtctcttgagagggcatatggctgcaagctgtgtattgggccatgtactacaagaggggaggtattgaattaatcaaaaatcgtgttcagtgcaagaaagataataagccctcttagtgattaacataatgtttctacttttacctgttaagggtttctattatgatgcctactacaatgatctgacattgaatgagacacattttggtatcattgatgcccaagcacagaaagctgttgcggtatgctcttattttgaactcattttaaagtttgtgtttacccttttttgtggacgctacttagcagttttactctttgacttatttgatattaatctgtcatgaagtgtgatatcgttattggattccatgattatgccatgttttctttgtaacgtaattggaatcatctatctgctaactcttggtttttaacccaacatggtgcaggaaaaacaaccatttgaacgaattgaggtctccagggcagaggcccttgaaatgttcgcagaaaataaatttaaggcaaaattcctgatttatgcttgttcttgatcttttcttgtactctaacagtcccattgtttcgcttattcatatgcttatccgaattgcttattaacaaacaaaaaaaatcatttgtgactaaaacgactcaaaagaaaatgctgtaaaataaactataatgaaagaaacaagaaaaaaattaaattaaattaagttctaaatttcaaaacttgacttataagcataagcataagcgaattaatgaggccctaaatatctatttctgcttatatcacatttgagattttattaaattttttatttgtttgaattgtgtttctaggttgaaatcattaatgagttgcctgaagacaagaccattacagtatacagatgtggtcctctagttgacctttgccgtgggccacacatccccaatacttcctttgttaaagcttttgcttgtcttaaggtaattctttggttgtcttaagcttttgcttgccaatatttttatggaactatccaatttgtacttgcatgtaaatatgtaggcatcatcgtcgtattggagagggaaagcagatcgagagagcctgcagagagtatatggaatttcttttcctgattctaaacgtctcaaggtatagcatatgattttggctattgttcagatatgggcgttcattaattaatgtggagtctgtttttgtgctatcatgtctgtgctactggacacaataatgtaccctctatgtttgcattttagacactagagtattaatatttcattgtgataagattggagttgatttggcaggaagtttagcgtgcactacatggcatgtaaattgcacaaaatatacaactatatctcaaaagtgtatctatgggctctgtgctttggtggaggttggggttgatttgcccaactgaacaacaattgtcattacagaagtatatggtttctttttattagtcagttattacgaatttcttcaattaatacatggttaggttcagacagtgcaacccttgtcagctattttacaagttactaattcctaagttcttttttatccatttgttttatcactggtacactatggttttcatatatgtttcctgctcaataatccataggaatataaacatctgctagaagaggctaagaagcgtgatcataggctattaggacagacccaggatctcttctttttccatcaacttaggtaactcaaggttttcggtttgactttttcatatcttaatttaccttggcttctattctgcctcaggatgtttgattcactttgactgtgcagtccaggaagctgcttcttccttccacatggtgctataatatacaacaaattgatggattttttgcgacagcaatacagagatagaggatatcaagaggtgggcattaatttgattggctggtcaatcttttgttcagattatgattagattactagatcatgggcatgcatttccactgtttctctctgttcatgatgtctgtattttcaggttttgagcccaaatatttacaatatgcaactctgggaaacctctggacatgctgcaaactacaaggagaatatgtttgtttttgaggtaagtctagtgtgcagaggatttgctctgtacatattatagattacattttggatgaattacgatctttattactgggtgcttgttggtcttattcttgcagattgagaaacaggaatttggtctcaagccaatgaattgtcctggccattgcctaatgtttgagcacagggttcgttcatacagaggtaaatctccttcataatggcatagttgtatcacaaaatgtatctcttttatcaagtgaaaattcctgctgtcaaagtaatcgcttcaaccttctgcctgtatgaactgtttttcttctatgatttaattctccctctatttctttgatattgtgcatgcacatttattatctagtggcttgtgctttctcattaaaattttcataaactgaaaatgtaggcagcaaaaacagttccttagttgtctggcaattaaactaggggtgggcataattaaccgtgacgaagaactgaacccgaaatgacccaaactggaatccagtaaaaatatcgggcttcagctctcaataactgaatttagtcctgttattttggttattaggctcgggtaattgagaaatcgaaacatatcaataagccttgtccagttcagcccaagagagaaaaccctaacttcccctcacctccccactcttaactccccagtccccacttctcctaccactaccccgactcctcccacacacggcaaacgctgctgttgccgccccgccctggctcccgcctgtgcccccacagcatgctgctgtctctgcaacactctgcctccgttgccgcaattccacgccatcaacagtggggaccaccttcaccagagatctcaaggaggctctcggtgctctgccacgccggagagctcaaggcggcggttgctggggaacactggtgtcgccaccgttgtgaacatgcggttccctgcccatggtcccctgatggcagcggattggtggacacgtctatgcccgctggctacatctcgtgctctttgctccaaattgtgttgatttgaacttcatctatgtagggtattgtgcatagatctaatttgtgttgatttctgttgattctgtggctgattttgggattatatgagttgattctgtggctgatttgagtattctatgatttctttttggatgtgtaaaacagcagttgtaatatcttggttagtttggtcacaaccggagaccgaactgaactagccgaaaccgaattcgtcagtattcatttttttttccaatgtgtttcggtctctattttcagatgaccgaacttttcaaaacaccgacgaactgaaccgaatgcccacccctaaattaaattcctaattcggcaaaagtaacggctctagaattacttagtgaattgttttttggtgaatgatgtagtactgaaattgttgtccacatgtacattttgaactattggcttttgctattgatataaatgatgaacttcccttttctaatattatagcaaggggaattttatatatgatgtgttgtgtttttgtgttttgacaacctttttcttaacactaacaacttaattaaaatgctgcagaattgcctctccggatggctgattttggagtccttcacaggaatgagcttagtggtgcacttacaggtttgacacgtgttagaagattccagcaggtaatgctaatgttgttttgtgggttgttaatttctatactaattcaatccagttagtaatctccttgttttaaccacttctgatgcattttccctgtaggatgatgcccatattttttgcagagaaagccaagtaagtttgaattctgcaccattctgtatatctgtttttagtagggaaggggtgccattgcaatcataatgacatgctactgaacagtgtatttacactgtgtgacataaattagtttaggcaccagaagctcataatatttagatgttcatgacttgcatactgtatggatgctagtttgtattcccatttgttttcacaatgtttcagatggtgttaatcacaacctccttttaacagctgcactgtgcttcggataattttaaatagtgtcccctgattgtataagggcctacttttcttaagagttctttctttgttgcagatcaaggacgaagttaaggctgttttggacttcatcaattatgtttacgagatatttggatttaaatatgaattggagctatcaacggtaatcatctcgttgttgctgtatgattaatagcatctagaaattcacaggaactaggattcttggaacttcaatatgtattcgagaagtcacataaatagatgcttagcaagtgttaggttgctgttataatctggatgaagttggttaagtatctttttaccatttctgcttcccatgtctactcctgcctaaatcccaacataccaggtaactttgtgatgattgcatttaagagaaaaaaaggttatctctatacaaatttttaaaggttaacaagtcatttcatctcctatggtcctactggaattcctgtgcacatttcttgaacaacgtagaaggaaaatcgaactggctatgaagtataactatgttggtacgatacaatccatttttgcactgtgtattgtgaacctgaggttggtgaggtttatgaaaggcctatgaacctgctagtctctgttttggcatcgtagatcatttcatactttttgtttaatttcaatcgttgtaggcgaatcataatttatcattgtatgtgggctttggacatgtgctgagaaaataagcatgccagatgttgaacatgttacttgtattttgcatctatgtactccctctgtccacaaatataagcattccatgtgtttgatatttgttcacaaatataaggcattccacagtactaattgttccattcctcctttaatgaggggcaccaaagtctttctcctcaaccttaatatctgctgaacaacctagaaatgcttatatttgtggacagaggtagttgttttcccattttcctatcactattgtgaactgctaatgtttgggaaattctcagcatcctacggaacaatatgtgaataactgatggttatggcttgatcctcagcatggttgtaatgttgcatatctttctcttttttttttttttgcagagaccagaaaagtacttaggtgatattgaaacctggaacaaagcagagcaacagctgacagaagccttaaatgagtttggaaagccatggcaggtactatgacagtcactcccctcagaatgtttgtttcagtctatgctattagaagtgcatttccaacattcattattttcacaatatggttaacgagagtttgcactaatttcttccactatttttaattttacctgcactcagcattatcactagagtcctttgtcaaaaggtattatgctttatttagttttggcttaactctaatgtcgttttggtaacaacatgtactgtatgttgattactattgatagaaatatatttttttaatactgatttctattgatacaaatatatttctttatgccggataatattgatagaaatataatttagtggtaatgttttcagtaaacatcttaggagagattattcttctttgactcaattggctggttcctgtcatttttaaatttcaaataatttcatattctcaatctgaagtttggatgtaatactggcggaatacccaatcttgaagtctggctcgcaagttgtgattactggttgtttcctagcagtttttttatcccttattggtgtacttatttagatgtctacatgcagatcaatgaaggtgatggtgccttctatggtccaaaaattgatattggtgtgtttgatgccctcaagaggaaatttcagtgtgcaactctacaggttatattgaatgtcattttgtttttaattgtagacagaatagaaggttatttatctaaacttcatttcctgttacagctcgattttcagctgcccctacgcttcaagctgacttactctgcagaggatgaagccaaacttgagaggcctgtgatgattcacagggcaatcctaggttctgttgaaaggatgtttgctattcttttggagcattacaatggtaaatggcccttgtggttgagtcctcgccaagccattgtttgctccatatcttccaattcagtggaatacgctaaacaggtaaaaggtccttgtgtcatagaatttactaattactattaattagtagctcttctccattgatcaaagtgtgaaaatcttctagtaccttctgattcgataggtggtgctttgtcttagtttt

SEQ ID NO: 42257 - DNA, 3438 bp, Oryza sativa
actacttgttaaatttgagttgcctgatgggttttaaacatgtataatttttttatatgttactattattttgacgtggaatttgtctggtgaacctatcgctacaacccccagctgtgaaatatttttaaactttttgtactgcatgatgcactgtgtcaacttatttcatagaatacttatgtaccgaactaaatgccaaacaatttacacgtgtcattagactgtagtatgcatgatgcaggtttttattttaaattatagcctgatgtcgttcgaatgcaagtccaatttgatacagattatccacagctaagggcttctttttgatttatcagatctcacacatttgtctgacataagttttttgatatgtttgcatgagtaactattcagctaattgttaatttaagtcccagacaacattagctttctttttgcaaggtgaggatggcttttaaaaagtctcatgatgaaatgataacaacagtacaagattgtctttggtttcttatttgatcatatatacttcctcgatttcttgatggatataaacatccatgcagtgctggaaatgtttattccttattaattaggcttcgtttttgtattgagtggatttcatcacacagcattggaagtctgtctagtccattattattttaattggctcaatttatcttaaatggattccagatgacacttgggtgtattagtaatgtactttttataaacataatacattttgaagttcgcccactaattccacgcatggtcaaatgaaaccttgcttacagtggagtaagaattttggtaactaatcagttctcttctgtactcaggtccgtgctaggatacatgaagctggttttcatgtagccatcgatgagacagacaggacaatacagaagaaggtagttccatcatgtcatagtgtaatttatgtttgtcctttattattgtttgctttcaactctttgaatagcaaaacggaggtatgcaacaatatgtggtatgcattgttctgattttttgttgcagggactgttccattttggttttgcccatgctgcaagaaagttctattattttagtaatttagtttacacggttctcaacaatgtaatctgtgaattggtcacgaccatttttcatctttgcaggtacgggaggctcaattagcccaattcaactacattcttgtcgttggtgcacaagaagcagagactggacaggtttttaccctttgcacccctgttttcactagagatgtggaataattatttctttctgccatccatatgtacaggtgaactagacaattaaattcaagagatgaagtagtcatcctcagataactaaaaaaaacagcccactggttcatatgaaatgtgtagtcctatattatttatacggttgccttatcattatggcttacgctattgcaggtcagcgtcagggtaagggacaaagctgaactagccacagtgagcattgatgacatcatcacacgttttaaggaggaagtagcagcttacaaatgattttgatttcacacccttttgctaagaatttactccaaatttgtgattttgatggtgtagcgggcagtgtaatcttgctattttatttcttgacaaaagtacatctgattgtcttttcttaataacgaaagtgtgctattcttcatcagcgacatatatagggatgggtgtttgatcaactcttgctaacatgaactgcgtctctaattggatttaccccaacttagcgtatatttccacttaaaccatttgcagatcttattttctcataatgttatgttttggagtaaaggacacaacctgtctagttgtgtcatctaggtgggtatgacttgtcaattggtgtatggtttggtaatgatgccacataagcgtccaggtggcatgcaatgtaggatcctagagcgctagtgcgctcgtggtagtttgggaacgaaacgatacaatttaatttaataagttttgtgtattttatgagtttggggatatagatgatgcatccgtcataagttaagtctaagaactagttgagcagtttactttggctgcctttgttcaagccggttcttaacccctcttccttgttttctgcgtgtgtgtttttcaatcggataaacggtgcatttttgtaaaaagtttatatacgaaagttgcttaaaaaatcgatctattttttaaaacaaaaattaataatacttaatcaagcgctaatggaccgtttcgtttttcgtgctagagagtagcgttcccaacccgtgaaatgaacgcagcctttgtatattacacatcttaggagacttaacaaaaattgctagttatacaacatcttaaatgcgctaaactcattctcatgtatgactagttcctaagctaaggcctcgtttgattcagcttaagattattataatttggattataaggagtaagctaaaacaaacaaatagatcattataataggttattataatctgcaagccagattactataatctaataatctcctctagagaagcttttttcacattattgagtggctaaagacccactactctcagatgtcttcaataatccagagaaacaaacaactcgcagcttattttatgttagcttattataatttagcttagagtaatctgatttagtaatctaggttataataatcttaagctgaaacaaacagggtctaagtattagtcccgcactttcatctatactaatattacacaaataaaaaaaggtgtaacttaaataaaatttcatattataactagatatagttacataggccgactagccagatataatcagatccaccaaagcttggctatccaatccacaagcaagctaataaggggtagacctccaatagagaagtcctaaacaaaagcaacagttctcgatcactcaaaataaactaagttcaacaccaaaaaaaacaaaggtactacctccgtcccagaatacttgtagctttgtggtttttttttgtaacttttgatcttttgtcttactagcaaaaatgcccgcgcgttgccatgggtgaaaaaattataatgataatatacatttttcatgaataatcatttcaatgacaatgtttgtattttaaagagcagcttgtttttttataaacaatgtttttttcttgcgcgattttctcaaaccattcagaaatggcgcatttcattctaaagtttttttttctaacatgtttttttttgcttttttatttacaacgaaaaccatattttctcctctttttgcttttcttttctagtgtgttttgcctttttttacaattattttctcgtgcgtttttttgcttgcttttttcaaatgttctttttttgctttttatcaatacaggagaatatatgacgaaataaaagccgtg

SEQ ID NO: 42258 - DNA, 9491 bp, Oryza sativa
  unsure (1)..(9491): unsure at all n locations
tggtcaaacgttacaagaaaaaagtcaaagcgactactaatttgggacggaggtagcaaatatgtatagcaagagttagtacattggcaagcagtcaaacctagcatactaaatgcaaggctaaggcctggtttagttcctaaaatatttttcccaaaaacgtcatgtcgaatctttgaacacatgcatggagcattaaatatagataaaacaaaaattaattgcacagtttgtatggaaatcgtgagacgaatcttttgagctcaattagtacatgattagccataagtgctacagtaacccacatgtgctaatgatggtttaattaggctcaaaagattcgtctcgcggtttccaggcaagttatgaaattagttttttcattcgtgtccgaaaaccccttctgacatccggtcaaacatccgatgagacacccaaaaattttcttttcgcgaactaaacacaccctaatacttaaaggaaagctttatatagttcatttttagcataaagcaagttttagttcacaaacgtttgcaaggaagtctttaaagcatttttaaagcgtgaatataagtagataacatgaataatcatagcatatcatattattatccttgctgccctcctcaacaacatggcgcaaattccattacaaaatcatcaaactcaacacaaatctgcaattccaaatccacattccacaaacataatttaaaagcataaaactatactcatgacacttcaccaagtcgcttatgaccgcgagtacgactaatcgattagttttagactctacagagtttgcacaactttagtcacatgaaatgaacactctagtttgtctcgtactcgtgaagcactaccgcactttagagattgaatgtgatctagaagttgcaacgaagcctttacattacctaatgcctagtcttgcactagcacgataagtgtgaacccactctaggaatgacctagagtcgttaggtgacgggccaccaccttaaacttaaggccgtggcggtaaacgcatctgtttccatgaggcattgtactgtcatattggacaaacttagacacctaaactactcccagtgagcaaataggtagctcctctagatagccctgctataccattaacgggtcaataggcactgcccatactttcccggcctaccaaaatgcaaggctagatattaaataacttatttagctaagtccacaccataaaatagcacatgtcaatgtacgataaaacattagttagtggcacgaagttcagtccggacattccccctattagtgtacaactaccaccatttgtacaccacttgccgcccaagtctaaaaccattctatacacattttagttcacaaatacttaaccttttcacttctgtccagaaataaataaataccaaaactccatttgtaaagtgttaagaatgattatttgtatagttttaggcttggctaagcaaatggaagcatataaagcatttatagacccaatcgagcatttagaaaaaactcaaaccaaagctatggttacaaacagagggttgtcaatatttcaaggtggatcatgcagcaaataggttatatctaccattttaccaaattttaaatatcggtattaacaaaatacacgtgcgattttgcaaacaaacaatttcattcgcccaaatcatagggttcaaggtgataaagggaggaggggagaacctgcacgtaagtctctctttcaccgttatcgcaattatctatacaatttacacggtatgcaattaaataccaaaatatacaaaaaaaaaaacaaaatgctctaaaatgcatgatttgtgcacagtaggtaggtgatgaatttagatgaagaaatttctattttatctctttttatttaagacttatgaatttctaaagtttgtgctgatatagggtactccttccgtcccaaaatataagcatttttggactttgacacagtcttcgagatgctactttggccaacaatatctataaaaataagatgttttaaataaaaagagtagcatattatgatagtttgtttaatgataaatttacatgattgttcttttttattcttttgctattaatagtctaagttaaaaatgttttacttgatactatgctaagaccctctttgtttaggcttagacttattggcttagacttttaagtcagcttattggcttatatgatttataagccggtgaatttaatgtcctaagtttaatggtggagtcataatctacctcacataagccaaaaaaaaacttctccaatctagcttttggcttaggccctctttgtttaggcttataagccaacttataagtttaaaagtctaagcctaaacaaacatgctgcttttccgtgtggattttttgaagccataagccactctgacactatcatgcaccctcctatgagcgagaagaccttctgccactatagcaagtggatgaatagacgcaactactaaacttaggacattaaatccaccggcttataaatcatataagctaataagctgacttaaaagtctaggccaataagcctaagcctaaacaaagagggccttaatagtgttagagtggcttatggcttaaaaaaagccaaatgaataagctgcttgtttgtttaggcttagacatttcggcttataagctggcttataagtctaaacaaagagggcctaaaaatgtttatattttgggacagagggaatatattatttatctaggtagtgtcgtgaaatactttttataggtgatttggttaaagttgactttgcagaggtcaagataattgttttctaagactaacccatttggtttcataattgttggagtttgtatgattttctgatgtattttacaatttgtagcgtgtccaatgttagtaatttccctatatttttaggtgtttatttgtacagaatgtgttactttatgttcttgttaaagaaagataatagttcttaacctaacaaaactgagttcacaagatttggagctaatatgaattttctacatattttacaaattgtgatgtgctttatgttgataatttgttataacaacttgagaggcattaaatgtactaaagctgagttctttccccaactataacaacccacttccctcgttttccacgcgcacaattttcaaacagctaaacgtcacttttttgcaaaaagtttctagaaagttgcttaaaaaaaatcatattaatccatttatttaaaaattagtaaatacttaattaatcatagaaaatatgttgctccgttttccgtgcttagggaatgagttcgcaactcaaaacaatgaacacagcctaagtgttttgagttttgggtaacatgaataatgttatagccttgctggcctaaccaagtcttattttagcttaattggagctatagcgtattttctataaattgcatcatttataatttgtgatttaatacttatttcacccattaaggtttagagatgattttcatattaaatgtactactttttattatttttattttactgtgattaaggagtacatgttttgtgcaactagcaggactccgttcactttattttgagttcactttactttcgtcgacgatgcggaggaagcactaggcctcgggggtgaggtgagtggctggactggctgggcagtggagacgccgaagtgcctacacgtgtttccccaggtggcggagtcggtggccatcgcacacgcgcaggccgtgtgcccctcctgcttcatcatgttgccgcccttcgcccgcgtcgcgttcatcgagtccatctccagcttggatgcctcaggcttcagctccgacggctcagacccggactccttgcttccatagcagcgatgggatggcaccaactgaggggaggaccgcagcgggaagacattcccactgaggagccgaggaggtcgacgatagaggcgacgctaccttcgcctccgatgtgtataggttggaggggggggtcctcttattctaggagcggtgattgagatcaatgcattgttatttctccacatgcactgcttgtcattggctcattgttgatttcatgtctacagtagttgttgaagctgttctgtaagttcgagatgatgaaggagaagatgcgagcaataatgaacctacagcacaacgtgtccgtgtcttgcctccacaattgttgctcaagtggcccaaggaagcgtcattctgtcagttgttgacgcaacttgtgccaacaacccgatcgaatgaagaaaataaagggggatgaggaagaagatgaatatgacaggtgggttccacatacagatgggaaagaagatgggaaacgtgacggtgatgccatggtttcgattttgtaaaaaaatgagttgcacggctacgaatagacgaattataatggcatttatctaaatagacacatttgcaatggcacgaatcaaattaacccaacttttttaggaaaacgctggggatcaggcgcccgacggtgccagaaaaattgcccccctcacgcgcgcctccgcctgcctcccacgcctccccaccactagggccccattacaacaaatccctcacatattacggaaacgctctattaagggatttcgtttcatttttttccactaacaatgtttcagctagtgtactcgtaatgtttcactatgtatagataaaatgttgcagtgaattgaattattcttttacaacaaatcacccacatattatagaaaccctttattaagggaatccgtttcatttttttccacaaaaaatatttcacatagtgtactcataatgtttcactgtgtatagatcaaatgttccagtaaattgaaacattctttcgatatttgctaaaacattgtttttatatagggtgaaacaacgcttaattttttttggaaaccgttgtttcatacgttgtagcaaaatgtttcatgagatgatttggttgtgtttcagctttttaaaaatactgaatttttttcgatttgtttagtgaaacatgttcgatctagttgatgttcataaatcgggtgcccgatttagaggcgcctccactttttaaggagctatttgtaaaataattttttaaaaggacctagaggtgaacaatccatggctaaacccaccgcgcggggcgcgcccgcagcgaaccaggcgcgcattaggcgccccccgagtttctccccccttcccttgttggcgtaaaagaaaaatctccccgtctcgtctcctccgctccttgcgccatctcgcggctgaacaggggagggggaggggcgccgatctccatccgacgagcagagcaggggaggggagggggatcctggtgagcatccacatcctctttctgattcatctctgtcccccaccggtagtacttttgtctggaatttgcttgcgttaaccctagcttctcttctagatctggaagaagggattaagagaagcatttcttaattccagagccttaatcttaatacaagtaacagtttgtttgttcccctaaaagtttgggggttcagtactgaacccccatgtcccaagttggatccgcccctgtggggagattgaatggtgcccttagggatctgtggtcgttcgtggacgaaaagcggttggtggtcgcaaagattagtttttaggtttctttttttctcctgaagtgattgcgattaccgtgcctgtgatgaagtggcgaagagaggtaatgatggcatagattttgcattggccgttcggggtgacgttcctgtattggggctcaatttgttgtttctcccagtaactaggtgcttcctggttgctgagcacgccgaggtgtagattttgagatatactcttttgactctttaactttgagtaattttggaaattatgatggttctcttgcctaaatgatgtttattattcaaatatctttatgtacttctcttttgaacttttattttttttccacattttgtttcgctctcaatacaacaaataagcagttctggtaattcttttattttcccatttcaggagatcatggagagtagttcttcagatgttcaaatgtcacattgtgctgaggacttgaatagtgagagtacaatcgagatcaaaataaagacattggattctcaaacatacaatttgcgtgtcaataaacgcgtaagtggataacaaatgcccatgccagagactatacagttgctttttacagtgctcttatggttccttagaaactattggctatttgcatgcacaacatgttgcaattctaatgatatttaattgccttctttcccgggaacaaaataccactcaatccctttcgcatagtttaattaaataataataagtgaatgtatgtcaaacttgcttaaatttccccaagtaattttgacaacccactactatatctcatatttttaccattttctgatagtttattgtgcagcctagttgcaagttcattttatgttcgaatgatgtaaattgcctttttctcaattttttctgttaatggtagttttgaatgtataaatagcatctaatgtagagcatgttgttatatgtatgttcttttgggcatgcactcacttctgatgcacaacttctgatacacatatggtgtgcatttagattcttttgagtagcagctggtctagtgttgcattaccataggagccctggatgaaatttatgattatataagattgttgtttgctagcagtgtttttcatagggcctttatgatctgtgaacgttggttaggtggctctagtagcactcctcaggtcctgggttcgactccttgtgggagagaatttcaggctggggttaaaaaaaatccccttgtctgtcccacgccaaagcacaggtctaaggcctggcccaggtcattggtcgttctcacacgggctacggtgctgctgtgtaagggtggggctggggttcgggggttttctcaacttgcgtgagaaggttttctatgcaaaactcccaggggctgtcttacccccccataggtcgattctttttagtggtctgcgaactggaatattatctttgaactccattgatcatttttagaacctgctcagaataattctatgtaccctttaattttcagaattaatgctgcattagtttgttcaatattttgttccagttctattttttgggtggacatgccatttattgttaatgctttgtcttttatacaggtgccagtgcctctgctaaaggaaaaaattgccactgtaactggaatattgtctgagcaacaacgtctgatttgccgtgggagagttctaaaggatgatgaactcctctctgcgtatcgtatcctcatctatttttggcttgtagcattttagttgttttgtcttccaaaatttgtttctccatctacaatgccatatcctacagtttcaaatgttagatgtcattcgacaaacaatattctagatcaagaaaacaatgcataatttttatgcacaattaaaagcataatattaatatttacaaatgatgatggtcccattgtttggaatttcggatgacatgttggaaataatggtattatatttggaaggtgttgntgggtttttttaaaatttggggggtttttttttttaaaggggncccccattctttctcttcttttgatggatgtacactgatgttgctttggtgatttttgtccttttcttctatctatgaaaaagggtcagatatccctgtttactatgaantctnnnncncagttagtaagatgtgcanatgnntcctnnnacctaactggtttgatcatattattggacagcacctgttttacatttgaagtacgtacttggcttaccttgtaaatggtaatccttaactgaagtttttattagacgtggaagatggccatacattgcatctcgtggttagacaaccaggacaatccgctacatcaggaaatgctggaaatgaaggtttgtaaactcattgtgtgtagttaaaaattgattgggaagtttaagagagcattctttggacacctgcattgtgtgatataatttatttagtttcttgggctgtttttcttcttggtttcaagatcgtgaataatttttattgaagcaaaaatcttccgcatttgcagtagttctaatggtagataatactgttatgaggtttgtgagtattatttaggttgtcagttttgactctatattgctttagttagcattctgaaagactgctgtaatggaacagatgctcgtatgttgtgattgcatgtcatgaacatcgaatctgatgtgttagcagcatactgcacttggtctattatgtcaactagttgctttgtacttgtcatcattacaattactttctatcctttccattccttttttatgtacccatataaagcagagaaatgtaccacagaccttctgtgttcccaccatcttcctaataaggattctatatgctattcttgttaaatacctaaaaggctaaaactttctgacacccatatgacttgttttgttgctatagaggcctttatgccttttgatgttatcttatacctatagccatgtcaattttgtattttgatctgttttgcatttgaaaatttaatttgtattagcttcatatttctgtaaagtcaagtcaagcacactgcagttaccatttggccactttgaactatgagctttattatgtggcatgcctagaccaaaaacttgtgacaacagctgcatgttttctatattgcaccatagaattcattcttccattttctccttccgtatttcttcattacgcaaaaactgtcaattttataggtaccacatcaaatcctgctcgtcgtcgtggtcccactatgactcgcagtattgtacttgaggctattaatgtgggtcaggggagtgaactcagtgttgcacaggttttccttgttcctatgcacctctatatcttctcttactgtgttcctttggttgacatataacttatttttcacttattttgttcttttggtagttgctccaaagcctgcttcgagctcctagtagcacacaagtttcggtaatccagcattctgaaagtctttggttcagattggaactaaaaggatcttatttgaaaataatttcccttgtgttagagtggaccagcaccttctgatgccagaccttcagaaggtgcacaatcttcaacgcaaaatggtgtcagggctgtacttgatcaaatgctggttcctccacttttccagtctgaaacgtcagttgggttatcagaaccaaacgttagtcttggtcttgtatccttcacaactcacatgccctgatgttgaaatattaataagatatatggctaataacatgttcttttgcaggtcattcctgattcgttgaccacaatttctcagtacattaactttttgaga

SEQ ID NO: 42259 - DNA, 1644 bp, Oryza sativa
ttacatacaaaccaaatacatcacatattatacatctcagatctatacaacaaataacaaaattatacatctcagtgaatcacaattgtaaaaaaaaaagaaaaaaagaatggatgccgtagcgccgcctgccgccgctcgctactcggcccgtgcgcggcctgcgtgcggccccgccggccgcctaccgcgtgcggccccgcctgacacgtgcgggaaggaggaggggaggaggcggccctcgctgggcatcggatgggaagggaggaggggaaggagagggctgggatgggagggatgggaagggaggaggggggaggagagggccgggatgggaggaggaaggggaggaggagagggagatggatctgaggagatgagaggccggttgttgaggagattgaggccggttgtgggggagaggatagggaatagggattatatactacgtgtgattttagtcccggttggtaataccaaccgggactaaagtggtgagctttagtctgggtttgtgacatcaactgagactaaagatccccgcccctctgacaagagactgacaggggatgaactgggactaaagattgtagaatggctatggggttttaaactgatctttagtcccagttatttttataaccgggactattgtgttttgggggtgaccgagcaaagatcagttttccagtagtggttggtagccaccatcacctcaccgactccttagggcattctcagtgtatacaacccaagttgcttataggttcccttaacttggggcccatggaaattttctacgagagctacaatgttttgttgatgagagatgtataagtatggacctcacatgctaaataaaatatgcaattcctagctacctttacatctaacctcatcatcgtccatatatatatctcgccctcagagagatggccaggcgtactttctcgcatcgagacgagaattgatgcgacttatttattcattaagggcatgttgtaagcttatagccgattgatagcataggatcgcctaagattttttccacaattaatgtatatatgtcagtcataagaagcttatgacatctccttatttccatattgcatatgtccttacctgctatctatcacgattatcaaccaccatcaccgcccccctcctttctgctttcccaccctaatcctgctcaaaaaattgtcattgggctcactgaaaatggagcgggaagctagctcgttggagcatgagtgatgcaacagacgagagtctggaattttcaagattttgctccaacattttacttgaatttacaagattttagccattaaatccgatattgcggtaacgtaggaaaaaaaaaagggattgctatatggcattcgaatgaaatttggggatgaaatcttacagattttggaccattggatccatgccaagattcgtgcattggcttatctcctccaactccagtgggctccccttcttctccagcgctggcgacacctcaactccggcgggttagggtttggggttggggtgagggtaggagggtggttgggggaggaggaagagggggtttcctcacggcttatagggatggccgtgggcggcggaggaccagctgagggtggtggactc

SEQ ID NO: 42260 - DNA, 9234 bp, Oryza sativa
  unsure (1)..(9234): unsure at all n locations
ggagggggctcgccgggagggggcctcgccggcgctgttgaccttttccggccagccggcgaggcgggcggcggcgcggtggggcagtggcggtggtggtggcggcggatcgcacgtgggacaggaggaggagggtggcggcgtgatctggaaccgggggaggaggagaaggagttagggttaaggggctacacgaatcttaaagcatatctaatggtccaaaattcgaatgataggaggtgggattttctgtcacatgatatatagacagccaaaaaaaaaatctttggaatccttacttgcgcctcatcattaccagcttagcatcattttcctcggattagcttgccattctggctcaagcttcttgtccgcgttggctttttgtggcaatagccgcatcatatcgtcgtcctggtggcccaagctctcttctccgtaccacttgtaatatgagtctactttctcgatcctataaaaataaatattgtacaagatatgatatattctagtactataaatttaaataagctattcagattcatatagtactagtatatgccatatcacgtatatattatttttgtttttatagaacggggagagtatataggtagtttaattactgaacttcccaacctagtggtaggcatgagacgtcactagtcagatcatttaggccacaacagaagtttcatgtttcttcttgtcatgttttctggatatgctaaatagttccaagagcgtaaaaaagaaaagaaagagtaaaataattaaatagtgttgtctgatatcattgtagtggacacaacagttatggctttgctagtctcgcctaatttcagtaccctacggccctaccacaaccctcctaaactagcacgaaccactgtctcctacttcaaaacattctgaaccaaagtccagcttctagatttttcacttttgatctttttaaaattttattttacaaatagatccatcataacttattatgagaatggatcatttttatggcatcaacatcattagcgtcatggtccaatataacggcgcaatgacagtgatgccatcccctagcttccttgcaaaacctatgggtatgtttccgaagcttaagattttgagaagctgtgggttggtagtcagcttctaagaatttagaaaagctaagttccccttcccgtggatggtcggggcatggtggaccccaccgagacctacaacgtctgcctcttcaaggtttcaaaaggagtgtcgagatctactgaatctacatcttccaggtgtcaataagagtatcaagatcaacaagatctatatcttcaaggtgttaggaagagtgtcgagacttacaagatcatcttcaaggtgctaaagcagacactgacggataccggtgtcttgtctaaagctatgcccaccatgaactccttcttcatcaacatcttcgagaagctcatccaaaacaacaataaaatctatctttggcaatatgagcgcgctcgagtgggcaggggttatagttattgagaccggactagtaattgagccgacaaggctcttggttcgatggttcactggttcaaccggttgaaccattggtccaacctagttcaataggtattaaatatattactcattccttgacatcacgaggtgcatgatagcctggtggttcgtgatcagcttcctctctcacatgtgatcttgtgttcgaatcccatcctagtctcgttttcccctacctgctcccctgcatgcatgtcttctcgcgcatagctgccacaaggctggttcaactacagttttccctggttttatagcagtttttcctcaaaacaggacgctccaatcggttcgattgcatatccagtcttttaactagaccggactggtataggctctggttttggtttttacaggtccaaccgtcggtatggttcggtcttaataactatggcgggggtgccctgaggattcgaggtgacccaagcacggtggctagtcgaacacaagttttcaatcccttggggacctgagcactgattaattagtgccctaaaggtttaaggagagcagatcggatccggtgattacttttaaccaccactttacgtttattatagggtggttcaaacttaatgtacaactcatccacaacttgtacgtggccgcacatgcagccccttgcatgcccacatcacgttggagaacacgagacgtgcgatgtggctcatcttcagcaacattccctaggggtcacctctattggatacagtggctaataggtaggctcggggacagttttaatgaagacttttacctcccatctctacttgtcattcggtatatgtggctatcacatctggccgactagcttggaggtacaacaataatactaaacatatcaaattcagaagagtagacctcactcctacatgcatgcaatggcattgtggactccccttcacgtataaggagaattcatgccaccgagaaaaggttcacactttcatctaagctaggttagctgaacattcagtgagcaagcaacctctccttctcacttagaactttctacatcactttgtagttcacctcaccatccatgcatagtccatcacacaggagtaaagtgctacgcatccgtgtgggccgaatttgtatatccgattgtgttcactctattcgcgtaattaaaacccgaacttagaattggcagcccggccgaactcacaaagagggagtacttagctttctcactagaggagttccgtactccgacaaacgccaatatcatttgcgccatcatgttggaccacaaaatcaatgatgttggcgccacgaaaagagaccattgctagaataagtttttaagtgtctatttgtaaattaagttttcaaaaagatctaaattaaaatataaaaaatccagagcccagcttagccctaaccatgcctggtctggcccagcctggctctcctagcgcagcccaaaccgatcagctgactcactaatccaattccaaataccacacgaatgtactccactccattgatcactcatcaatcatcaatcactgtaatgcactatccatccattaattttcctcccttgattcacgtcgaccgaccgagacggagtcatgtcacacggtcctaatttctttcgccgtgtggaaggcattggatggatctccccagccacggggcaagcgaggggaaaaagggctccgagcccacaaaggacgagccgtctatgccatgccatcatcatggcaagatcacaaacttcacgggggatatatgtaatgtaggactaataataatattgcaacaattgtgtttctgcctttttcgctgtgatcattacacgggtccagccttttagggataacaatagttacctataacacttggagggttgaaaatctagtgtgtccttatatactttatgtgtatacatcttggtaggatatttggattttttttcaagccttgttcagttagtctctccaagagagagggaattgagggaattaattctacatcttaataagtgcgaaataaattaccttaaccctcgaaaaaaatcaccttcagatcccctcaaccttagcgatcaattatcccagctgagcacatacaaagtggacattcttatggtgcgggtgtttgggttttccatgtaattaaaaagaaaggccacgtgtctgcttgatataaagatcgcacgatgggtacgtatgggctcgatggtgtgttcaagggttgatgccatgccaaaccaacaatattgttgaataatagaggattagatattgaacacattatattgatccttgggagcctgtgcatataggagtacaacacttagttctcaagtaagcatagagatatactcccttcgttttaaaatgtttgacaccgttgattttttagcacatgtttgaccgttcgtcttatttaaaattttttgtgaaatatgtaaaattatatgcctacataaaaatatatttaacaatgaatcaaatgataggaaaagaattaataactacttaaattttttgaataagacgaacggttaaacatgtgctaaaaagtcaacggcgtcaaacatttcgaaacggaggtagtagatatataggagatacaccacgacgtgtgaatctcatatgtatccatgttttatgcagtcatacaccacgatgtgtgaatctcatatgcatccaacgttttatgcatctatagtgtatcacgttgtccctttttctggataaggaatgattcaaagtttatgatattcgaggtcacacacaagttaatttaataacatcaaaaagtttaaaaattgtttcaaaaacttttctaaaattgctgataaaaaatattatgagacattgtcccgttaaaaagcttggaaagcgtgatccgaatagtccatctttgccaaacgggtagacggtatcatcgctttgaaaacgtggtgagggaggccctacagagtctcgagtcttctaaactctaacacgagatgtttacagtcgattgcatttcagtttgacttttgaacctcttgtgtctgcacagaaattgaacccgacaagtgtcctgctagatagtttcagccttgatggaagccacatgctatatataaaccaaacaagctaggttagcgatcaaataaccatgtccaagctgggccaaatagttgctaatcctctgtaccgacagaacatgcccccgacacaacaacagttcttggatagagaaaagaagtttctcgtccatcaatgctaaaacagtgaacagtctgacatgaaaaaacatcaaaagatgttgcccaggtaggtcaattctgtgagaagctaatcattagcatcatagtctcaacggttatccaagatgaaagctgacaggtcaagaattttgcacagcactgtaatatatttacttcgatgaatcagagacccgtcgtacacattttgggccagaaacacagcagatgtcagttaatactagatggcatatatacagttgacattggagggagaagaataagtgtaggtacacaaaattgcctctgtggttttttatggcagacttggaggggaaagtgatggtttggtcacttttagctctccgcaatcactgatataaacagtttttagcgggcgatcccacaacgctcgagcagtttgagctctttcatcaccaatcaactgggcaaaatcattgaagaagcggatcctttcagctggtttataggtaggaatagttgcaatgctggttataacattcattcctgcacaataaattaaataaacattacgaaaagattagactaatttagtcgggggactgttaatgcataacaactattttcctaaaattagcatatatttactgggcaatctagtaagtatcatagccaaattgcttcaattgcatgcatgttaagaatggcaggatcatatggtctacggtagtctacaatgtagtaaaaggagaaaagatatggactgcctcaggcagagtttctgcagcactactacagttaacagatacaatttacggaataaatttcaatacagataaactccagaagtaaattaatttatactgaactgataatctgatattcacaagttttaaccatattcaatatgttcataagacaatgtgatctctaaattatttcataagatgtcggtgccatagtacatctttcactgtacatatgcattccaaacagatgaacctaatatctattatccacatgtgataaatctgccacttggagaaaaaaagaagcagcatcaaactatcggccttaaatgtgcatccacatcaccattctcaaccacatatcagtggagtatggcaatgctacccaacaatacatggtcccaaacactttaatgaaagcactattgagaacataatcgttcaccacatgatttgactttttgtattttatacttttttctcatttgctcaagaaaaatgaggctaataaaaagatagtaatggctacctttacatattcacaaaaaaaatgtcatacagtctttctgttttatgtaattaatatatacttccatggctatacggagagtatgctttgttaagaaaaagggggttcttcatgaaagaaagataagtggtagctgattttttttttcatacactgacttaatcagaaatagattaaaaaccactcggtcctctttttttttgggcaaggaaatcaagacagttctctattatgctagaagtatccacttgatttatactattaacacattagctcttctgtaaaaaatttcaaccttgaattgaatggactgccaatcgtgcagaaataatctgataaaaacacaagttgcaagaccaaatagttaaaaaaaggaattgcggagaaaacagttttttttttttttgacgatgaaaacagcaggagagactgctactgcgatatattaaaactatataatagttacaaattacatatgtacaaattatcatgtaaaatctttcgaattagccgctttctgttaatctgaatcaacaatatcatcattaatcatacagtggcaatactagtttccattaagacaacagaaagcaactcgtacaaaattgaagcttcatgtcaattccactggaatatatccaattaatacacttgtttaactcagtgcttgaaagtctgttttagtcgcctatgtgtgcatgtgaatgcagaacttgacaatcaaagttgcttatagaagaagaaaaatggatgcttaagaaaaaactgttggtaataatcaaatactgaaactgagactaagtagctagttcagttcaaatgagtaacactattacacttcaagtggcaatgggtcctaatgacaagcattagtgtgcctcaagtgtcatgtgaatataagttatatagttgtatgtgcgcatgcatttgttgcgtctgcccatgcatgtgcatgagagcatgccgcatgggcatgcagatgcagaacgtgggcatgtgcttttttggggatagaagggccgtgcttttaagttcttgatgcataaaacttaaatatgaactgctttgtagttaactactgccctggttgttgttgtaaagtttattaaattacaaatcaaactgtcaaagcagacatgtcagtcttaaattagctagaagtagattctcttttggggtgacatgttcagtggcagtataaatctcattgatgagttgcttggtttagttcaatctacttctgataaccaccagagatctaataaatcagaacagggaaaaacaatgaagtatgcaccaaatttgactatatgaggatgatacactctctggtgttgtttattgacaatgtggcacattgttagaacaaaccatggcaggaattgatgatgagttatactgtggtgaagtgcagagaagaaaaaaaaaagaattaatcttagtgtgataaccatccttggtgttgagacaacaaaaaggaagaaataaaatgacaatttctttacaagcttatattacttgcagaaattggtaataataaaacatctaactttatgttctgcatggatgaagtcctagccagaatacggacacaactgtttgttattttgttaatactcatgcaaagctgcaaaatttgcattttttttcttctctgttatgtactaatgttgattacttcaatgaaaacatgtttaccttagcaagtgtatataactataccaaaaggagaatggaagatgtcatataattatacttgacaaaaaatgaaacggtttgaaatacattttatttttctctgtttgaaccaaagaaaatagatttatgcatgaatttaatcatgccaaccttgcattagtagattacgcacaggtcaaatcccaacttgttcgagggaaagacattgaaattcttgcaagacagaatttaacacaaagtgtgcaagaaccatttagtaaaagttcagaaaatgaaagcaactaaccttccaatacagttccaaagacaatgttctgtccatcaagctctgggcagggccctggtccagtggtaaccaagaattcaacattgtgataattaggattgagcttgatgtcatcatcgtcatcgttctgtccaaggcacaatgagagggtgccaggccttgcatgctttagttcaaatgctttagggtcaatagtctcagcattcctcacaagtccggtgggaggttggacctcgcccctgtcacgccgaggaccttggcggccagcaacgaagaactggccctgaaggagcttgtggacaagtgttccccggtatgcagcagaagtgcaagcagctttgaagttggcagtagtgagggggaggagtcgaccatacaaaccaaaaattacacgaccaagaggttcagaatcaggacatgtagcaagctcagctcctaaagtgcggtcagagcgaaagtagctagggcagacactgaagtccatgaagatccgatctgtgatggtggtatcaatggcagaggtggatggaatgtttgcgtcatctaaggcaggggatgatgaagcgtatagaagagaagggaggacagggaggaagatgagagaccgtctagaaattctagaggattcaataggtttatgagtattatcatggtttgttttcgagggaagaaaaaaagcatggtggttgttggggtggtggtggaggctgctcagggaaacagggtaagccatggaagaagtggccctggtatttgatgaaggcaacaccatactgttgctaactgaattcttcagttcttgtccttctgacgaaacagcagtagaaaatcactaatatccttccctgcaaatgtaatagttggcttttgagatataacattactgaaattctaaaacctactgttagcctcttcgttgtagggtcacaattatcacttgtgaataatggcaaatagctgacagcccaaacaattacaattttaaaatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 42261 - DNA, 805 bp, Oryza sativa
ccattcgcaagcgtaagcatattttgctaaaaatgctccggtgggggagagctgtcgatcccatctcaggagtgttttatattagtccccaagtcttaacgactttaaaggtcggggagtcctggtcaactttgccatgaccgcattagtttattaacaccccacgactaaactacgtattcctgcaattttcacaagatctaaccatcacccgtagttactacttcttccgtcttataatataagagattttaaatttttatttacactgtttaaccactcatcttattaaaaaaatttaaaattattatttactttttcttgacttactttattatctaaagtattttaatcacaatttttttgttttttatatttacacaaattttttaaataagataagtggttaaataatataaataaaaaattaaaatctcttattttatgaaacgggggagtagtaggccgtagcgtctccaaactctcgtcaggtatggacgcgatcgcgcgcaacggcggcgcacggcgcccgcaccccccgtgccttttaattaactctccttttgaccgtgccaggttaacctcacctcgcgaagcgaactggtctaccacaccaacacgaccacacgacacgatcgaggctcgcatggattttcgcattttcggtggacagagtagggtaggggcgtggagaggggaggtgagcggtggtgagccacacgagcagggcagcgcagaggatcgcggggtgcatgattgagcggaggggggaaggggtgtggtggggtcagtagtacgggggggg

SEQ ID NO: 42262 - DNA, 896 bp, Oryza sativa
ggctagtactactagtagtagtaggacagcgagccactctcctcgtgccagcgcgagaagccaattcgacgcagcgcgcgcggagcggccggagcggagagagatgaagaagaagggcgggagcggcggcggcgggtgcctgggggcgccgttccgggcgctgtcgcgggcgtgcgactcggcctgcgacctctacgtgcgcggcatgtccgggtgcgcgggccgcgtgccggcggcgatggaggccgtcgcggtcggccgcgggttcggcaggccggcgaccgcgacggcgacgatgcgcctgcgggggctgagctcccgcgacgtcgacgacctcgtccgcgccgcgtcgaggcagcggcgcgtcgcggccgagccggcggtgggggcagccaagaaggttgggtattatcgcgaggcgccggcggggaagaaggggcccttcgaggaggcggcggccgccgtcccggcgccgaggaagaagggcgcggcgatggggaccatcgccgaggacgcgccgtgcgagttcgtcgcggacaccacgctgaaggccacgccgccggtgaggcggggcgcctcggcagacggcctagcggcgcgcgccggcgggtttggcgccattaaggtggggaccgaggccttcgcgcgctaagcgaagtgtataatacatgtactgctactgccagtgtataatcagtttttttttttgcgagagtataatcagcttttttttattattatttttggctggagtataatcagcatttgaacgtccatagaatctgaaatttctctctattttcatcttgatgtaacggtgatgaatgtaaatggatatgtatttgtacagtggaaaaaaaaaggaacaaagcgtaaactggaactcataaaactga

SEQ ID NO: 42263 - DNA, 24255 bp, Oryza sativa
  unsure (1)..(24255): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaacaacaggtgaagcagtgtgtttgtagaatttatgtcctatttcacgctatatttgtcttttaacttccaccttctaactgttttaggggcatgtccactgtccatgcaatgtttatcacattaatgtcagtttacctagtattcttctccaacctattctctgatgagctggatggcccagtaacagttcggagttcaaacctctccaattttacactgggggtaacatatgtcactgtttatccgcattgaataataggttatgctgatatatacattttctccttttgccacatgttagctgaattaaatctgtttaggtttctctggggtacttcatcgctgaccttgctatgttatcctgggcttatccttcccttggcggaatggagtatgtaagtgagcatagttgatcattaccatttattttatttcaccatttgtttactttctaggttactgctattcagtgtttattcaattactgtgtgctctgctgttcatattattcatcacttgggttgaccattgtcaggttcttcaccacttgctgtcaattatttctttagtctatgctatttattctgaagaaggacagttgtacacatacatggttctcatctctgaaacaaccacacctggaatcaacctccgatggtatgcttcatgaaaaagatcatgcaccttttctttatacttattttacttcaatctatctgacctgttatgtaccttcttcatcaaaggtttcttgatactgttggaatgaaaagatcgaaagcctatcttgtcaatggtgttacaatgtttgttgcatggctggtaagtgaaagttgctacactgtaattggaggttagaagttaaaaatcatgcattgactgcaggtgatcggatagttatgtactattattagatgtactacatgcatgcacgaattataattgaatctgtatatagcgagattcaaccttgttatttgttgtgtgtacgtaagtatgagagggagggagatttggaatcgtgcttaatcaataatagttgcctaatcagttagacgctgtctctggtgctgtttaggaagttcttatatatctcaaatgtggaccaccatttgcttactacaggtggcaaggataattttgttcatctacttgttttaccacatatactttcacattgatcaggtgctatatccttctgatttgatatatgggtacatgtctacatgacaaaaatcactgaaattaaactgttcttgtttattgacaggttaagcagatgcgcacctttagctgcattctgatattcgctgtgcccacaatactattagtgatgaacacagtgtggtttgtcaaaatcttgagaggtctcaagaagacgctagccaagaggcagtgaagagtggtgaattgctcataggcgcatctacaaccatcctttcgtacagtcacatacaactacatatattttctacgttaagctttatagtgcaactcatagcgcaagcaaaagatcccttgtacacatgttggaaaaatctcctcaacattgccgaaaatttttgtccctgtacggttctacattgtacatatatatatatgcacgtctagttatggctgaggatgcttttatctgtgcactaatgattcatagtttcaattttcaacaactggagatactgccatagtggccatctcatagacatatagagaactccatgattctagatacaacttgaatgtgcaattcgtattgctctcactatgaacgtttttgtagctcgattctaactccagatttgtagttcattcccgtcatttcaagggagctggtaacactcatcatttccgttcttcaaatatcgtatttctgtctagtccagcgtcgccttaattggccttctaagtggtagatgccgtcgtcattgttgtagtagatggtgcggtcgatgccatcgtatctgtcctagatggtacattgttgtcgtagatggtgcggtcgatgccatcgtatctgtcctagatggtatggtcgatgccattgtatctgtagcgtgctgattattcccttttacagttacagaaacctctaaagcaggaacaatagtggagtagtatatatttatacataactattatctgaactagatattttattttaagttgattatatgtgatttagagctagtagcttgctgtaccattaaactactctaaatacgagaagcacagaagaagagtcgttgccacactttgggtaattacgaaggaaagatcgtgagttgcgactgtcacgagcacgcggttcgaacgcgcgcgggtgctgacttggcgttgacctgtgaaattctctcgcttcactcgagtctcttggcccttgctcgaggcagactcatcgagcagcccaaagccccaaacgactgcgcgcgagcgatacactggcgctgcgcctcgctgccgtaccagagagcgccgccgtcgacctgagcgccgtcgctaataccctgccgtgcatatcctaccgggactcgatccggagcgtcgccgccgtcactccggcggccgaggcctctcttccagtcggaagattccgcctccacctggtcgtcttcctcctacgcgtccgactgctccggccactcctccggcgtctccgccgccgcggccgctggcttcagggcactcacggcgcacgagctcagggaggtcgcgcgtcgcatggtcgccgacggctacgcccagcgcatggtccaagcgttcgacgacgcggcgacggtcgaggtcctcgagggggaggtggttcttcgagctcgacgtcgactgggtcctccgaatccgcgaggggcaggggttacggcagctggagaagtcggccgcctcctccccgtcgtcgtcgccgctgcaagatctggtggagagtgacagattatgtcttgtttttactatatatttttaacatctatttttgagataatagttggctgccttaggatgtaaggcactagtaattttttgagataatagttggctgccttaggatgtaaggcactagtagttttccttaggatataagccactcctaatttttaggatgtaagccactaatctataccttatggtgtaagccactggcctatatatatatatccaaccagccatagttgattgagtggagaatagaaattaaactagcctcaaaacctgtgttccttttgctaacaattggtatcagagcaaggtttatctgacttccatcgactccccatccaaaaatgtctctccactccattcgttccccctctctctcgtcccatgcctcaagcacttccagcggacgaggcagcaggcggtcggcggccgacgctgagggcgacggcgatgcgactgctgttgcgcaggaggcgcgagcggctgcgcgggaagcgcgcacgacgcatgaggaagtggaggcacggctgcaggcagccacgagggcggcacgtctcgcggcggcagaagctgaagcagcacgcaccgcggaggcggccaggcaggctgcagctgtgttgatagaaaacacgaggcctgggagatctacttaactccggtgcaggtccaaagctcgccttcgaatgtatgagcgtgccagttgatttgatcctgtaatcaacaagaaatagagacaaagaattcgtggttaaatctataaatgatagccgatcggctaggtgccgatgtcatatatgaatcgatcggcggttataaatagaaagtaaggaactaaatctattcgatcggctgtagatattaacgatatatagttcttatattaatatatacttaaatcaagtgattgggatagatcggtcaccatgccgagacagtataaatcacttagatcgaaatatatattaataacaggattatatatgtttatagcatagccgatcagatagatctagcatgtatcggctaatactccgatactactttatataaagatatcaaaacaaatataatttaccaaacaaaagcttaatatacttaaatacaataagatcttgatataaagggcggatttaacatgtcattgaagcatatagatcgaatatggttaaatcagataagatcggctgaaactccgatactaccctaatcggcaaccataggacatgctagagattgatattctaagcacgacttaatagatcaaactcaactgatgcagcattaagtatgaaaagaagaacaatatctagacaatcaagccgctgggtgtttcataaagtggtagatatcttatataatctaggacaacgtcgctatttaacctaatcggctgccttctattaacagatgttagccgattgtaggttagatgacgatattgccaaagattatgtaagatatatgataacttgacgaattatatagacaaaattagagtgtcataatgatggaagcactaatctcgagaacacaagtcgtcataacaagttttacctcttgttgaagatcgaaaccgatgtagctcaacccgaaagtaagaactcgtcgaaacaaaactaaagcaaaaaggtggcgatgcgccaaaattgtattgaacatgtgtgttaaaaattacatagggctcggggtctatttatacccgagaattacaagatatgtccatactggacacgaccgctatctctaacaaactctaagataccataagtctttgcagcagacttttgcccaaacatatatctaaggaagttacataaaacatcctaattaatagatacaattgccttctcaggactctatccatgtgcggcaatcatcttgaagcacctcaattcaacccaatgtcatacaccaaattatactgtcagaatcggctgcatcggctcacctagtccgactcagacccagccgatcctaatcgtagccgatttggaattcagccgattattgctctgttctcggatcaatctccgccttcgactccaccttgatctaatctccttttccgactgttgttgcgcgggttgcgcaggaggcgcgagcggctgtgcgggaagcgcgcgcggcgcgtgaggaagcagaggcgcggctgcaggtagccacgagggcggcacgtctcgtggcagcagaagctgaagcagcacgcaccgcggaggccgccaggcaggctgcagctgctgctgctactttgcgagctgaggaggaggaggagcgacgtgacctggagctgacagacgcggcccgcgtgcgacgcgacgcggaccgggatcgacacataggccgacgtgatcgcgacttcagcccccatcgcagaggatcagatctccaccgcggtgaggaggagcggcgcgatccatggcgcgatcctcgaatcaaccgcgctctggagacccagcgactccgggagcaggcagcggcgattgaggcacaactggacttcgaccgggagcagggtggacgagacgttggcgcacggagccctcgcaggcagcgcgcctccccttccccggaccggcgccgtggtcgccgtggacgctccggctctcctcccgttgtgcagatcgtcgtcaaggatgttggcggcgcatggcccatgctcaccaagactaactacgccgagtgggcgatggtgatgaaggtgaagttgcaggcgcgccacatgtgggacgcggttcgatacggcgacgtcgactacggggaagatcggcgggcgttggaggtgctccttgctgctgttccgacggagatccagtcctccatcgcgagcaagcggaccgccaaggacgcctaggacgccatcgcttcggtacgcattggcagcgaccgcgcccgcaggtccacgcttcagaagctgcgtcaggattgggagaacctggccttcaagccgggttaggacatcgactactttgttctccgcctcaactccttgcaacagcggttggcgcagctcggcgacaccaccatcgatgaggagagagccgtggagaagctcctttgcgtcgtccccgagaagtacacgcagctggctctgtcgatcgagacgctgctggacttcaccgagctcacgaacgaagaggtgacaggtcgcctcaaggccgtcgacaaccgcaagcagctacctccctcagagccgatcaccattggtggcaagcttttcttcaccaaggagaagtggctcgcccgccaacaagagcggaagaagggggaggccacaagctcttcggcttcgggatcgtcgagcagccgcaagcgtcgaccacgcaagtgggagaaggcgcgtagtggcgctcttggcggcgccgatggcgagcgcaagggcagccgcaacgacacctgccacaactgcgggaagaccggccactgggccaaggactgccggcaggcgaagcacggcggtcaagcacacgtcgctcaagcgcaggagggtgatgaggtggctctgtttttcgtacacggaagcatcgagccacacttcactcccacaccggacgctaccgcgcccctccacctcgacgagctgtgggcccacgtcttcctcagcaacggatcctgcgacgacaagatcgacgggtggtgcctcgacactggtgccactcaccacatgaccgggcgacgggaattcttctccaagcttgactccagtgttcaaggctccgtcaagtttgaggacgcctcagccgtggagatcaagggcgtcggctccatcctcttcaccaccaagaccggcgagcaccggctgctcaccggtgtctactacatccccgcgctgaggaactccatcatcagtttgggacaactggatgagaacggcttgctcgtggagatagaggacggggtcttgcgggtttgggatcgccatcgtcgccttctcgtcaaggtgaacaggggtgccaaccgcctctatgttctccatgtacaggtggcgcagcccgtgtgccttgcagcccgccgcgacgatgatgcatggcggtggcacgagcgctttgggcacctcaacttcgaggccttgaagcagctcagcaacaaggagatggtgcagggcatgccacgagtcgagcacgtggagcagttttgcgacacctgcgtcctcaccaagcagcggcgactcccctttccccgccaagcaagtttctgcgccaaggagaagttggagctcgtgcacggcgacctctgcggtcccgtgactccggccacacctggaggccggcgcttcttcctgctgctcgtcgacgacgtgtcctgctacatgtgggtggtcctgctcgactccaaggcagtggctgcagacgccatcaagcaccatcaagttgctgcggagaaggagtgcggccgcaagcttcgggtgctacacaccgacaacggtggcgagttcacgacggctgagttcgcagcgtactgcgccgacgagaggatccagcgccacttctccgcgccatacaccccgcagcagaacggcgttgtggagcgccgcaaccagacagtggtggccactgcccgcgccctcctcaagcaaagagggatgccggcaatctactggggggaggcggtgatgactgccgtccatctcctcaaccgctcgcccaccaaggcccttgatggcaagacgtcgtacgaggcctggcacgggcgcaagccggtggtgagccacctccgcgtctttggctgtctcgccttcgccaaggagctcaaccacgtcggcaagctcaacgaccggagctcgccgggagtcttcatcggctatgcggagggtgtcaaggcctaccgcatcctcgacccttcgacgcagcacgtccgcatttctcgggacgtcgtgttcgacgaagggcgaggttgggcttcgtacaaggcggtggacgacggctcgacttcgactctcagagacttcgtcgtcgactacgtccactttagggcagccgggggagctagcagctcatcttcaccgagctcgtccacctcggcacccggctcgccatcagctccggcgagtcctctaccacctacaccaccagcaactcctccatcaccagctacgccccgctctcctacaccggcgcccacaccaccggtggagttcgccactccgttgtccaacgacgaggatcgtgttgatgcgtaccacgacgacgagcctctgcgctaccgcaccatggacaacatcttcggtgatcagcccgtccctggactggagacgcgcgacttcgaggccgagttgcacctggcgcatgaggacggcgagccctgctccttcgcagaggcgaatggagatgtggcatggcgcactgcgatgcagcacgagatggacgcggtcgagcggaactggacgtgggtgttggcagatcttcctgccagccaccgcgccatcacccttaagtgggtctacaagctcaagaaggatgaggccggggcggtgatcaagcacaaggcacgtctagtggcgcgcggcttcgttcagcaggagggagtcgactttgacgacgccttcgcgcccgttgcgcgaatggagtctgttcgtctgctcctcgcgctggcagcccaggaaggatggcgtgtgcaccacatggatgtcaagtccgccttcctcaacggagacctgaaggaggaggtctacgtccaccagccgccgggattcgtcatccccggcaaggagaacaaggttctccgcctgcgcaaggccctctacggcttgcggcaggccctctacgccaagctggactccactctcaagcaaatggggttccagcagaactctcacgaagctgctgtctaccagcggggcaaggacggcaatgccctgttggtaggcgtctacgtcgacgacttggtgatcaccggcaccaaggaggctgaggtggaggcgtttaaggaggagatgaaggcgactttccagatgagcgatttgggccttctctctttctacctggggatcgaggtccaccaggacagctctggcatctcccttcgccaaaccgcctacgccaagtgcatcgtcgagttgggcgggctcaccggctgcaacccagcctacactcccatggaggaaaggttgaagctgagccgcgacagcacggctgaggaggtcgacgccacgcagtaccggcatattgtgggcagccttcgctacctcgtccacacgcggccagacttggcatttgctgttggctatgtcagccggttcatgcagcgaccgacgacagagcaccagcaggctgtcacgtcgagggcaccaccgactacggctttcactacccgaggtgtcccggtgcgcagcacttcatcgggtacagcgacagcgacctcgccggcgacagcgacacgagcaagagcaccagtggcacgctgttcttcctcggcaagtgcctgatcagctggcagtcggtcaagcaacaagtggtggccctgtctagttgcgaggcagagtacatcgctaccacaaccgcctcaactcaagctctctggttggctcggctgctgggtgatctcttgggcagaaacactgaagcagtggagctcaggatggacagcaagtccgctttggccttggcaaagaatcccgtcttccatgagcgcagcaagcacatccgcatcaagtatcatttcattcggagctgcttggaggaggggagcatcaaggccagctacattaacacccaggatcagctcgccgatcttctcaccaagtcccttgggcgggtcaagttccaggagtttcgcgccaggattggaatggttcaaattccccaaaaggcgccacacatgacttagggggagaatgacagattaagtcttgtttttactatatgcttttaacatctatttttggaataatagttggctgccttaggatgtaaaccactagtagttttccttaggatgtaagccactcctagtttcttaggatataagccactagcctatatatatatatatatatatatatatatatatatatatatatatatatatatatctgtgtgtgtgtgtatgtatccaaccagccatagttgattgagtggagaatagaaattaaactagccccaaaatctgtgttccttttgctaacaacgagccgacgccgtcgctcgcgcggttcggggaagcttgcgtcgccaagatggtcggtttcgtcgacgccgtcctcgccgctctcaagcttgtccacgctccgccgccggagaagctacacgccctggtcagcatgtacgggcacgccatggacgcctcgtctctcctctggtcacagtgccgccgcgtgctgatcacccaccaaaccacccaggccatcacgttcgacgccatggagaacgccctgttcaggaaggcgaccgagctgcacggcgccatatcgagcaccatggaggagaccaaggcgctcgtcgaggccgccgccgacgacgacccgacggagatcgcgcgaggtagcggagacgacgtgcacacgagcgctcgcgtcatggtggactgcgtcgcgtacgctgggaacgtacaggggatacctgtacgccatgatcgacgtacgacgccatcggctacctgaggcgtctcatcaggaggaaatccaagctgtgccagggcacgggcctgaggtacattttcctgctcaacaactcgcatttcgtggcgcagcagctcgagccgttctccaacctacggtggattcgttgccagtggcggctacatcgacggctatttcagcgcttcttgggcgcccgtgctgtcctgcctatcgtcgaagtctggcctctctccctggagcaacaagtcctcgccattgaggaaattcgagttggcgttccatgagacgtacacggctcagaagctgtggaaggtcccaagccctgagcttagaggaaggctgcgaaaaactatcaccgagagagttgtttcaggttatcgcgagtacttgttggagcatcctgagctgaagagactggttagccgcggaaacagcaacactcctgctgacctggaggagatgctggcagagctgttcgaagggtgacaagttatggtctacagtagtttgcagcttcagaattgtaaatactgctgtgttggtttcatttttgtttctattccattttatcttgtgtttcactgtcaaatctgggtgcccttgtgcaagattccgtagatatatagataattagttgatatgcacagctgcaattacacaagatttttcttttttgcatatccattacctgtgtctcacagccaaaaaaaacacttgttctccgatacatagcgttggcgataagcaacgccgtctttttcttacaaaacttgcagcttctacgatctcaataatggcagtatgcttacgagacaattagctatatatctattgaaaagattttatcattatagccatcctgaacaaaacagaatgctacaaacatattcacgagagacactgctttggagcctctaatcagctggttttcttttgccagtttcaccgcatgggtcccataaaccagctgagtgcagcccagaacagcactttctaatattcgaagaagcttcgatatctaattgttataccactgtaagactatacaggtctattgatcgatatctcttgtcccagtaacatcacgagcggaaatttgttacaaaacttctgtcatttctttgcaaccttgggaggtggcgaagatgacgatgaagatgacaagatagaaaacatgctattatcagctctgtctttgctgaatgccttgcgcacatcctcctttaactcacagaaccgcatccttttaacattttgctcatcagaagtgccattttggaggtcgagtgcatcaggactatcgggcaaatcatcctccagaaatttgtcgagcacctgcgagcagttagggaagtagcgacgtcccagctcaactgaaaacagaagaaaaaaaatatcataagaatgatcatcaagttctgaggaaagggtgctgagagtaaaacaaattaccaatcaacatttgagtaaataaaaaccccaactatttgtgctcattaggttcaaagtatgcaaaatgtggaaatcacgccagttttacaagagacaggaatgtttttaacatgaactacaacatcctcacataacatttgacaactaaataattattttccgtgttccattagcagttaaaattttagccgggaactagcaacgtgcgtgctggggtgatttttttagtgagagatggtggaagaaatggggattttgaactaccacggtatcaacaccaccaactcaaacatttaaagtacgaagatgaaggtattagcaacatgtgagaatttctgatggtaatcagtgacatctactcataagctataatagtttgcatataaagaatgtgtcatcagttccgacctgttttcatgagtgcatccacccttgaacggagccttttgttttgtgttactggtgtctcgttcagatcgacttccttcaattttccagaagtgctagctgcaggaacaatgccaaattctggtgtggtgtctgcttgtgcaatttgcattgcaacctttgcttctgcaggaaaaaataatcttgcaaatgcaactgcaagagaaaatgcaatgtgtcagcatggattctccaggtgaatgtagtatggttgaaagcaaacgtggtaaatgctaggatcacttgtttatgtagcataaatgtataatttttctccatcctgtttctgttcgagaaaggtctgaaacaagctgcaccacgaagtgctattctaccgagcatgaaaagagacttcacctctgttttcaaggtagagaagcttcatgtgaagatcgtcagccaacaaaggcgaggtgacagaatcttccactgccataggtttccttatcatctccctatctaatatatcaatacataatctgtctttgtttgactcttggccttgctccatctttgtattgtagtctttcatccttgttaacctccggcagatactcattgcactctggccatcagcagtcaattgtgatacagctgctcctttgtttaggagacacatgataatagctggctctctcctcatagcagccagatggagtgccgtgtatccacgcgaattcttcaaattcaagttggcaagtctcaagtctaacaactccgaaacaactttcgaatcacagtaagcagcagcatagtgcaatgcattggcatcatccaaggtgatctcagattcgttaagaagcaacttcacaagctcaacatcatcagaatccagtgccctgtggattcttctgacccttttctcatgtacagggtctgaaatgacggtgtcaccctcatttggctgagatttttggcgaatctcttttatctgaacagcaacttctggaggaagttccttatccaacgatacattatcaagatttgatcttgcaattctccgaatacatttttcaagcactggagtcagctctgaatgaaaagcaacttgcagaattggaagaacatcttctactagagtcttatcgacgaagttaagaagccgtcgctgtggtagaagaagaccgtattaacccagattaaacaacaggtcataaaaatataagctaaaagactttgggttattggacatgtagtggattcataaaccgttgaactatataagctgagacaaccaagctaattagtccactaaccaatctggagcacactgatacacatcaccaggaccaggactgcatcctagctcctctaatcgaacccaatatagatttagcaagtttctttcaacttaaaaaaggtataacacaatctagttagaagatctgaagtggggacttgagagcaatgtttacaagctatcaagcttatgtaacacagcctatgtgcttgaacgacttccagaatccagactcaagacatcgtgcagcttgaagttattcgcatgcaaaaattggttgaaaatatgtttacaccatcaaatacagattgcataaaaatataatcggtgacagaacagtttctagttctgcagctaccgtttttggtatcctaacaagcacaagaagagcatccttttgtatctcacctggaacagcgagatgagctcggtgatcttgaacgcccacgccgcgtacatttgctcgacgttgaacctgatcgccggcgggcacgagtcgtgcgggcacatggggtcggcgcaggacaccacgtcatccggcgccggccggagcttgcccgtgtacaggtaacccagcagcgacaggaaggcatcgcgccccacgcggcctcccggcacgagctcctccatcttgtaccgcggcctccccccagtcctctcccctcccccaccaccgccgccgccgccgccgccggcagccccatcgccgccgcggccgcgcgccgcgaagaggttgtagaagaaggtgctgcgggcggcgaggatgcagcggtggactggcacgggcgggccaccgtcggccacgtcgacgtcggcgtcgctgcagtcgaggtcggaatcgaggaggagccgctcgaggttagcgctaagccgattcaggctcaccacctccacgctactactccctcctcctcctcctcctcctccgccgccgccgccctccccggcggcaaccggcgccgcctgcgccgccaccgcccctgcccccggcggcgcaagagagaccgagcacgggctagacccgttcgagaggtacgaggacgacgacgcgatggtgatggacgacgagggctccatggctattaccaccaccgcgctacgcgccggcatctcactgctactaataccaccaccaccactactactcgtgccggatcaccatggcgggttcggggaatccaaaggctcccccactttccggcgcctcccgggccaaaccacccaattccggcgctcccccctctgctcgtctccacgcagatccgcgtcggcaaacaagctccccaaaccaaagtaccaaacactttcgaccccccgcctgtttgggaaacggatctcggagagagggggagagagagagagagagaaaaagaaatccttttctttcctcgcgagcggccggagtggagggaattatttggaaattggaagcgactgcgacctggtggtggtaggggagaagaacagtgggggtcaaacggaatcgcggggaggcagttgcgaggaaaccaggggctttggctcgcggcgagggatgagaggaggaggaggaggaaaaaaaaatgggaggaagacgacgaggacgaaggggggaaatcggagggaggaggagaccgatggatttgttctgtctgtcctctcctcggtgctattcatttctttttccttttcttctgttgggatcgagttggaaaagaattcttcatctgggaccttttaaaaatggttttttagtttctttttcatactggtggtatataatttagtgagttgtctaggaggattttgatgggtagggtcaggtgtggggaggcgaggatctttttgttgttgccgtcctctctcgtgcctttgggaaatagtatgagtaaaatacatgtgaaatataaattagagtgtgtttgaggctacgaagatgatgtcagcacacacgtaaaatacaaaaactattaacatatgagtttatattattataaacttgaaagtatttttattttatattttaaagcaatttttatacataaaatgtttttaagaaacacatcgttaagctgttttaaaaacatgttaaaaaaacataggtaaaatatgtatcttaataaaaaatatatactgtaagtaaaaaacttaaaaactagtaatttttaaaggaaaaggtatactttattttaaactcacactattcataaaagaatattattgatattgtttaagataatcaaagatgaggaagagaagggagtacaactgggtttgaaggttaaaacgaaaaaaaatactattaaagatctaatggacatctacttagaaaatagtctctgtgaaacaaatcttttaggtgcggagagagtacatacatcgctacacaaacggcaagtctatttctatttagtgtttgtgattttagtcaatctagatccaatagtagggttatttgtcaaccagtattagactcttttctatgagtatgtggtacaatagagagtctacaaaaattccattcatgtgctgtacactcacagcatcaagtaatttaaacgtgctgtaaaaagccctcaaaatgtgcaagttcagatattcctatgcacctagtattagatattttattgagcgaaaatagcttaaatttttccagtagcactactgttcagatcagtcagcatccaacacatctccttcatttctttttgccatacacatcacctcaccccccggtcaccccaccgggagtctgtacccttccttgccgtgcactgcggccgtccacatctctctctctctctctctatctctctctcgtctcgccgctatgccgtggcatcgcctctcttcacacgcctttcctgtggcgttccaccatacctctgggagctaatgatgttgggctgatccattgatcgaacaccacaaaactgactagagatctaaggcattcaccgctactagcctgcaccaccttgtctcggcattaccggtcattttcgtcgaattaaacacgatcttgttgttgaaagatcacgaacatgaggtgaccctaacaaattactagtaacacatccgttataataaaaaaaaagtacagtgtacggacggttcttgtaaggtgtgtcatccagattcttaagctctcaagatatatattcaagttccagaaattgtcctagtgtgtcatctagatctcaaatcgccacaccctcttcaagatcctacgtgacgttgatgtggcatgccacacaaatatgacgtggtgttattttgactgacaaatgggacacatttattttttttttctttttctttttttcttctctttttcccctttattctcctttctctgtgacccgagcagaagaaagtaaaaaaagaagaatgagaagaaaacggaaaagaaaaagaaaaataaaagaaggaaaaaaaataaaaggacacgtcacgtccatgtggcacaccacatcagcgccatgtaggatctaaaggggatgtgtcaatttgggacttagatgatacattttgacaagttctgagaccattttcagagtttagggacctatatgacacaaccctataagattaagaaccgctaatacactttactctaaaataaaaggtatagtaacttttggtcatacttttagaccagtaaaatcattttcttcgtgataagtatgatagcataagggcagtcccaactcatagtgtccataagcagtgtctatggtgccatgtcaataagacatcacaatagaaactacacttcacaacccatgatttgttaaagtgggccattaataaatacaccatctctcttctctaccaatcatatttattcttcatctattatgaagacaatattctctcccaatgcaaaacttgatagtgtctagtgcataggttctcgtgttgaagctgtgttttgcatgagacccagtttcttcatctcttcactctctctcttaattaatatggtaccacataagttaaaagtcctacatggcaatgtagttaatgctataagtactatcctaaatagagagttgggacttccctaattcctattagaccaaacaagtgagaaatttattggtctagatttgagtctatcctgccagaagagcggtaacaaggttgcgtttaaatgaggggttagcttatacttatccgtaagataaatcattattgaacgactacttatctattaactattacaaatttaaataataatgttatcattttaaaataattttttgtataaatagtttttttgaaaaaataaccgttcaacaatttggtagcgtgtttaggttgaataagaaagtagttcaatccaaacgttaatgttgtcatgttgatcttgtgctcgaagaaaataacagtactccatctattctaaaatataataatttgtaaccatcaatttgaacaaaagtaaaaattttaaaatatagcagcttaaaaaataaaataattatgctccttcatatttgtagttaaaattactatatattttagaatcggtgtaatagcatggattgtcaggattagttttactgttccttgtggttatcctcatagaaagcggccggacagatggttatcgcgacgtgacatgtacggtgagaggctcacgccatcacgtcgtgccctggccaagagaggcaaacccccagcgttatcctctcctactactccttccgtctcgtaatagatgacatttttgattttttatttataacgtttgaccattcattttatttaaaaaattagtgcaaatataaaaaaagataagtcatatgtaaaatacttttgataataaagcaaatgataaacaaaataaataataattctaaaattttttaaataagacgaatgatcaaacattgacaaataaaaacttaaaaagacgagtaatatgggacggaggtctccaaagcacaggtggcggggcagcgcagggcagaggccgcaggcgcgtgtgtgtactgtggataggccgtcgaaatcaccacctcctcctctcctcctcccaggctccagctcgctcggtcggcttccccgtctttgcgcatgccgagccgatatgtcccgtaggtacacgatacagaagttgccgtaacacacacaccgcgtgcaacgcaaacggcgcaggcaaaaaggaaaatccgtggtcgcgggacgcggagacgcaaccgcgatgcgccgcgatctccccaaggtttttttcttttgctcggcaactcggtgcatcttgttgcctggccggccgcagcagctgctgctgcgctgcgcgcgactgtttttttagcggaaagatggcatcggcccggtttttttagtacgtaggagtactgtattgactccctccatcccataatataataatataagggattttgagttgttgtttgtattgtttgaccactcgtcttattcaaaaaaaatttgtgtaaatataaaaaacaaaaaattgtgcttaaagtgctttggataataaagtaagtcaaaaaaataaataataattttaaatttttttaataagatgagtggttaaacagtgtaaataaaaatttaaaatctcttatattataagacggaagaagtagtaactacgggtgatggttagatcttgtgaaaattgcaggaatacgtagtttagtcgtggggtgttaataaactaatgcggtcatggcaaagttgaccaggactccccgacctttaaagtcgttaagacttggggactaatataaaacactcctgagatgggatcgacagctctcccccaccggagcatttttagcaaaatatgcttacgcttgcgaatggcgaaagcatcaacctttctttgcgtcctcaaaagagagagaacttctttgcgattaaaaaaagcagcagctattttagaacgtagtaacggaaacacgatgtactgtactgtactattttatttgattgattgattgttgactcggctatacgtggtgtgaatataactttgctaacgccatgatcccagctcagcatgctcataaatttatcacggccgatgtcagcaatgagctatatcgaaacctgaatcacaatgtaaggaagtaatctattggtctatgacgttttcacttgagcacccgggcttgttcccttcattgtccctaataaacctaagggctccttggttgctcctaattaacgtaaggactactaatttattgcaatagcctattagtaccacgatgtttatcgcaatggttgccataaaatttaattttgttgcattagttctatattacaacgaatttaagagtcctaagatattatacacaattgtactactctgttaaaatcagtactactcttattgtagattacttgtcattctaatattcatattttgtatcgaaatgcttcactctcacatttcgatacaaaatgcttcactctcacatttcaaatgagttttagaggtggcattccatctctactctgtttgtcaatgcaggcaactactgctactttaggaaacatttgggatatagttaatgagggtaaccttgttattagagacatctacatgtttaatgtgaaatttgctaaaatgattgataacattaaacgaaaggtagcaatagtcctttatttttcacttcttatctacaaaattctccctccgtctaaaaaaaagataaactctgggtttccgtgtccaacgtttgactgtccgtcttatatgaaattttttttataattagtattttcattgttgttagatgataaaacatgattaatactttatgcgtgacttgtctttttaattttttttcataatttttttaaataagacggacggttaaatgttggacacggaagcctagagtttgtcttttttttgagacggagggagtataattgctaaagggtctatgcgttttgctattgtagcaatagtcctttatttcacttcggatgactctatttggatccggatcaaatgcagtagtagtatggactgtaacttaagcagctgtagctgctacgttggatctaaatccaacggtaaggattaggccggttgctgtagcaaaagtaccacgacataaaatattgttcagggtactatagcacgagtacggtagcagttgatctgtactgttgatcacaaaaataaatagctgaaaatggatgcagtcctaaggtgcagtcgcaattacgactgcaccgatctcaatccactctatatcgtattctggctttgtactatgtcattggagaggcaggagatgtgaagttgtgaaccattccaattatattctacaaatatatcctccataaaacaataatctgctgacaataggaggcaattattggtctaatcagtagtagtactggtcagatgctgtatactgcgatgatcatatcacaaaatagtttcgcatgacagtatggcacgagtcgtcgagaacgaggtagtacggcgaaaacatgatggcgccactgcccactggtcgatgcccgtacaagagcaaagccttttttcacgtacgagtattaaacctgccattgggccattaaaacacgtcgacatccgccagctatgtaacgtgatgggcgtggcaaatccgtgttccaaacgggcggatgttggcacctgctagacattcaatctcaggtcaggtggtcctgagagacacgtgcattacggagtactacaaggttgctacagtgttattattttttgggtgctagtagtgccccattggtacaagagcaattatatttcactcaatttctcttcttcacgaagagaagagaggccggtcctggaggagcttctagctgcagtttctctcggaattgctgcagttcctcttataatcagaagctccctaaatagtctagctttcaatgattctgagaagctatatttgtaaaatcctgaaaataacctaaaaaccagaagttgtgaaacccaacttttccagattatcaggagctcagctgcttatccagcttcccaacaggcccgcagcgtctctgggtgcgactgctatctcaaaccagaacgggaaaatttaggcgcacggcataacatcactgtggttacacatggcatggagaatttaggcgcatgtactactagtactactgtactactccagtactataaaagaaccataggtcgaagaagggaaacacaccacttcttcacgtacatcatcagagcaaaacaaaagtttcagactaccaacctactactcctgtatggctgtatgagggacatcagaattcagactcccgttgagcctgtatgggtcactcttccaacgagtacaatttggtggttagacaccagtggactgtggcatggcatggcgtcgccttgccatcagattacaaggcacgctcaagttgggaagcagagctgaacagaatagcaacgtgcaccgaacaaaggaaggctgcaagtcaccagcaaaacagcgtttctggattatgatttcagctcaaggcatcacgttgccatcgtatggcccttcaacaaaggaaggctgcaagtcctatttaactcccggccaagacagcaatcctttatttctgccacaaaagcctttcatccaatattccagcatagccgaaggatctgcaaaacgcggccgctagtccagagtcactgtgcaccgttgcgctgtcttttgaaagtccgtgctgctgaactcccaggtccagaattattacgttgaggatggcgagactgatcaaatctaccgacggaggtcctcgatgaccgaatatgccctgaagctccatctggatgattaaaggacttctgaaaatgaggcgcattaagaggtttatccgataacaaagacatgaggaaaccgccaggtggaatataaccgactctacgaccctgagagaatctgcttgattcagctgaactttggtttgaaccctgacttgtagcaacatcatcagatgtaatcatagcaggcaagccatcgtatgataggatgcacgcaatagcatacatagttgctccaagatcaggtgggaggacatcctgtggatgtttgacctgagaaaaataattccattttttttcagaaataattggactataaaggtactaagaatgatgcagaaagcagtatgatgatctattgatccagatccattatctgattgagacaactcagaatgaacaacggaaggcaatgcagtctatctacatgccttatagatttttcatgtatgcttattatccagatttctgcactggagaaaaatcaacacaatatatttaaaggaaaactcgggggtcagagtgggacagtgggagtgtgcagactgaaatgtaaaacaaaagtttgctaatatgctggcaaccatgcatggcatcttagaaaacattggatgaaagagagaatacaaaaggaacaagttgtattgcattaatcaagcttaaattagatgatgcaagatataaaaatcttactttgaaaagaatagctgatgctaggcgctccctaaggcagtatatttgagcaacatcaagagctgtagcatcaaaccgaagccatcgatcaataacaactgaaacagagttatcaggagaagacattatctctttatgttgtcccaaagtgactttctcagtttcatcctcactagaatccccatcctcttcatcactatcatcgtcctcaggtggagcaacaaccatttccgtagcaagaataattaaaggataggacccaacaaccgaagagttttttatgtacattccaccatcgcctcgagtgatctcatcatatatcactaatgggttcccagaagtcttacggaaagacaagttaaagttgcaagaatgtggatgcagtcgaactttggcaccacttgctgtttcaatgactgctcttctagtatttttgcgagggggaagcaatctccctaccattggataagcaccggccataaggacagcacgaatgatacctacagaatttagaagtcagttaagtacaatagaacaattaaaactttgatgcaataaagcataatttgttaggaactaaggaagattgatgaagttcgggtgacaactgattttactacataattttactaagaataaaaatagaatccagcaaatactctaaaaataattttactacaaagaaaaggcaaggacgatttgctcgtgaattagaagtaagaagaaaattaaaaagattgaacggggaaaggatggaaaactctacaatacagtgaatgatatatgtaacttagtagctactaactttagagtgatatatgt

SEQ ID NO: 42264 - DNA, 13346 bp, Oryza sativa
taggcttaaggaactgctaatccacaatacaactaataaaccctgctgtgcataggcttaaggaactgctaatctacaatacaactaatcaggggatggactatcccctacaatatatccaaatgggaactagtaatataggcgtgaacatattgcaagactaattcatagaaacacaaggtttttctttgtaactaaccatggaaaactctagttagctatcctgaaaaggaacacccttctcactgagtatattatatactagggacttaactaatcaacttacttgctgcttacataataccatgtatccctcaaccatgcatatactatagttaagcaaagcaaagtggaaacaaacaaaagaaatcacatgaacaaagaatatgtttcagaactcaattttttctagaaaagtacctggatctctagcatttaagctgcatgcagatgcatctacaggaacaaatcctctttgggctagttcattctgaagctgtttcctcatgtttgaaagcatattcatggtgttagaagacacaaaatacttagaacaaaattgagcttcttggcccctatctttggcacgtctccaacagtccattgctgctacaactgcaagctgatcactgtatccaccatacaatgaagcaagctcaactttggctgcagcagcccttttcctctcatctggagccattggaaggaggaaaggatctctataatctgctgcacatgccaatgtcaacgccggatctaggcaattcattaatataccaaacaagagcatcttgcttgtagatggatggaccggaagggagcccaacttttcccctaactctgtcagttgttcatcttgagtcaaagcaccaagatcctgaagtacggtgatagcatttcttacagtttctggaattggagggtccaaagttttccttaaaaagtctgcaattctgcagttcggatcaagcagtttgacctgcataatacagattgaaacatttaacagctatcagtaaataaatgtcattcttattgcagcgaaccataatattgcagaagtattgatttcaagagttattggaggaaacaaatctacaaaggttagctaggaatatacctgtaaacatagttcctcaataggcatcctctttatttcagggatttggtattccagtaatgaggctgctcgaaatctagagtagagatggtagcacgttcctggctgacaacgacccgcacgcccttgacgttgtctggcattagcttttgaaacccaggaagaatgaagtgttgagacattattatatggatcataacttttctctttcattctcccactatctatgacaaatacgacgtcatcaattgtcacagcagtctctgctatgttggttgagagaattattttacgagatcctgctggtggacgcttgaaaacttttttctgctccgaagatgggatcatggaatggagtgacaacacaagaaactttgacgaatcctgaaagaagggagaagcaagcaacctttcccgtgtttgatttatatcttcccacccaggaagaaacaccaagatagctccttcattggaatcaacacaaatttttctgagcaaccgttctattagcacagtatcgatgtgctcaggattgatggttgccaagtatttattgagcagctcattctcttcagttaactttgctgaaccacattccatatgtttcttaataacttcgcaaacctcttgctgattcccttgttctgcccaacctaatgcagattttccatcatgatcccgtgtagaacaatccaccccaaatgatgaagcatgcaaatgtccccaacctgaccttttccagcaagaaccatcaaaggtgtcacaccagtttctgagtgctggtaattgaaaatttcttggttctgctcagcagaaataagctcaagaagaggatcaaattcatcattatccaaagctaggttaatggcttcatccattgagcttttgtaatcatctgttaacaaactgctctgtttcagatcatctgttgtaggatcaagatgattatcgcctacagattgcaaaatagaaagcacatcctccaaatagaaagttttgacctgagaaaaaagagccaatgttgccatcaattacttcaatatctttcttaacaaaatgtaaattagtgtgttactaacaggatgggtaaaccctgggacttgaataaatgggcatccactgaaataatttgagaaccgctcagcatcaatcgttgcactcatgagtacctgctcattaaactagttaatactcatgtaacggaaagcggatacactcagaagaaattctgtgcttcaaatatggaatggaaatatggattctgtgttccttggggtatatgaacctattttgtcttgtgaacttgaaaaaggaacaaaatgttcgtagatgtaaagcaccatgccacgagtgcaattgcaaaatttgtgcaaaatcatgatcatatgtgtactgtgcaaaaataacaacagagacaaactaacaaaagatgtggactaacttttgtcttttgcacagttatctggtagaggattttgtaaagccgtaccctaatcttttggatacatgatagaggatgcatgattgtgtgtagttattactatagagccttaaactagaaggaaaaatcttcttaccaaacgcagatgaggatacaacggcagcaaatctctacataattgtttggcaaaagatcgttaaagcactaaaaacacaatctaagcaacatgtggacgaaacagcttttagcataataccttagaatagccaacatgaaatctgaaaacctgtccctttcatggatttcatcctaaagagaaaaggagagtgccaactcatattaccaataaaatatatactggcagtatatgccattgaaaatcaattcagtaaggaagtgccttgtataaggctccagttctgaagcacaataatatatgaagctttccaagattaaaaaaaacattgtatttcaccaaaagacagtatgctattagaagctcaataacaaataatcataaatttccattccagttatttttgcaatagagttataaactaagttgcacaatacctcttacatctaattgatgcatgacttgccccagttcaacaatgacaacaatattcaatggacaatgctaaggggtgctaagatagtactaaacaaataacaagatttgaataggtaagcactgacataaccattttgcaattaatgctcaccaaatgctctgccctctcagaattacaaaggaacagttggtaaatgttttctgcaatacgctgtatcaaactacaaaagaaatgcaagtacagttataatattaaagaaataatttcacactagacgggaaaataatttctggttgtcatagatctacttagagcattagagttaagtttctgcaacaagtctagtgtcatacaaacccagtggttgattaaatatctccttccccccttgtacaaaaagcatcatatttaactacttgttggtactaatagcatggatgcagtgttggtgcaaaataaggagtgtaaagtatgtgcagttcagaatacaataatttgcaatcaagctatttgaaagttctaagattaaacattaccacaataatatgtgttatcccagtaactgcatcatcaaatgagcgtttctgattttgttcttttgaaatattagttaccctgcctatcaatagcctcaaaagaacaccatttgtgcagaacatgattgatgagttcttccctccttttgactccaagcgtatctgcaattgaaataaacagcggaataagacagaggtacatatccacattatgtgcacaagtgcaaacatgtcatagatgacaaatatatgaacattaaggacgaaaattgaagttaagaacatagtccaaattacaaactttctcaactttgtcaagcgaaataacaaaactggtgtttactcgtttcaaaatacaagatactgatactgtttcttgagtaaactttgtcaatttctaccaagaaattctcaaacaatgcaaagtttgtttgcacaaaataaccaaggcaaattcatatctacaagtattttagtgttatcatagacatgtcactgtacggataaactacacaataaatttacgggcaaagtttcgtaaaaaaacattctttttcaaaaaaaaaaaagataacattttttgggtgtcattttcaaacagatgaataataagtacaatttcagtccagaaatgcataatagaaaattctaaaatttggcataccttatacccaactgtgtcacccacagactctcctctttccgcagagattctctcagcaactgtgtacatgagtcatttgactctcagctgcttaaacaaaaacaatagcaatgaaagagaagtcatttgacagaattacctgagatagctgatattcgccttggttgagtgcatacaatcttacatgattcacccttaccccacatatgatccaagatatattgaggaacctaaaaaaagaatggtacgatgagtgagccagataagcagaatatcattccaaggaaatcataatttaagaaaaagaaaggtgtccacatcattccatgggcactaaaacaagaagtacatttgactatcgattttgtgaaatttctcacaaatcaggatgttttaatacatataacacgataacaacaaacacaaagtaaaatatcaaaatagcagaaaataggcatagattggatcaattaatcaacacagagtaacagaatgagaagatacatctgaatttattgcaggaaatgtcacagtgaagttaattacatacaatagttgtttcatggtcaaaacagagcaaaacaaaagtcaaaagaactggcacctgtgttgttttaccacatcctgtttctccagaaataagaaccacctgacagggatgaaggtcaaattgttatcaggtcatgttaaaggaaatgttcattctggaagttggcaaatgtcaaagataagcatggatcaaaataaatagctaggttcaggaaagtgataagcattttcctgaagaggcatccacccattattggaaagcagtcaagcctaccaagaattgaaactactaaacaagaaaataatagtaatttcttgatttgtcttgaagtattacaaggtaatatatagaatgtcttgctattagccccgccaccaacagaaaagacaaccagcaccacctttgatgtatgcatcaggatgaagctcgagtgaagcaactttatttccataaaaacacaaagaacaatacctggtgattctctaaagtcgaagaaattgcatccttgtatgaggaaattggaagtttagatctatcttggacaatctgtataaatgtacaacactaagttcaattagataaaactatccaatataacatatataaaagtaggaattggctaaactgaatggcaaaaaggacaccatatcaagccagattgccagaatatacaaccttcctcaactgttcggatttatttactttcgatgcaagcatctccaccttcttcaatatatccggtttgcgcaatgctggcctacaaaatgcaccatctggcttccactgaatctttacagccttatcactagaattcctgacagtatgcccatttagctccgcatcatctgggggataatgcataaatagatcttgcaaaacatttctcgcttccacagaaaatccaagatggctaggtccttcttctgtttcaaggccctggttctgttttcttttgtaaacagataggcatcgtcgttccccattcctatagttaattaatagatttcagaaaacatcagatacacatagtttaatcctactaagataacagtcgctatgatgaatgaagtttaaaagatgcttattactctttactagaaccagtgtacggaatgcatcattccagaggtcaattagactatcactcacccagaacttttggatatcatgcccatttttctacacatctcatgtatcgccgctcgctcttgtttcgatatgccaggttcaaatttgtacactgcaaagtaaaattttgtagatacgtgactttttcagctgacagcataacagagaaaacatgtgtgtttcattaaaaagtaaagaaagagacaagtagtggaggaattgatataggagcctgtttggaatccaggaatttcacaagaataacaggaaaagttccccacataccaaaagaaacctaaacatgccatctaccatgcaggaccataatggggcagtaatgtgctaaaactcagtcgaggcaaacaacgcaagggaagaaaaaacaccacagcacagcacatgctatgacctactccctccgtcccagaatatagctacctttctagtttaaatttgaattagaaaggtagatatattttgggatggaaggagtagcaagcaatggctctgcaagggatgcacaaaaaatgtgaaaagaagatatacaagaaaacattgccaccatcagagtgtgcaagcatgtgtgcgggtggtcttttcattgttgttgggaggagggaggagggttgttatgagaagagaactaataaaagggtgctactttgaactaacagaatcctaatagtgttttgcttgagactcctcgttggggtttatgcaggagcttaattgcacccactaatatcagcccaaagagttgattctcatgcatatttacacaacagtctagtggccacctaggattactgttgcaaatcaattcaagtgcaattgtcaggttagatgccattgtagtaaaacctaagaaatactttctagtcagtcaacagaccaacttatctagcgacaaactgacaatcatgaaaataccatgtcacatattgtgagatacaatggtcaaacataaagtagacggtattcctcttcccttgttaccaaactcagaatcaactgtgaagctacaaacattggtgacgttagtgatcagtacactagaaggccagtaaagttagtcaatcatacattaggaggactaataaaaaatgcaacagagaagagagaacacaaaatgggcatggccgcgcgcatggcccaaaccatcgcctcaaattcaccaaaaccaagctcccaaagtatcgtattcgtgccactatccccaactcgctcgaacaccgcgatgacagatcacaccagacaccattgaatggaatggagaaattgggcaaacgaatgagagcgaaccctgggcgtcggaggcttggaagtcctcgagcactttcgagacgcgcaccagcgtcgcctcccgaacaccccctcccccgcccccgccgccgcttcctcctctgccgcctcctctgccggcaccgccgcctctgccaccggtgccgccggcgccagccgccgcgtccttgcccttccgccctctcctcaccatccttcctccctcctcctcctcctcgtcgtggagcgggggtggcttggttgctacgacgtcgggcgaggcggcgcggccggctcggctccggcccttcccgcaagcggtcgcttcgttgcttccgcgccgccgctgcgctctcccggaaaacctaggcccagatggcggtggctgcgcgctgcgtgcgagcgggcggcccatgaaaaccaggttcagacgggcggccacgcctgacgtgtgggccatgcctgtcggtgaggaggggaggccgtagtagaagcgaagccaagcctagccacgtgcccacgtgcgagcgcgcgactagggccgcgaccatgcgacgccgtactcgcgtgcacggtgcaccgcccaacaaatagcagcctaaaacaattggaggcacggtgtccttacgagcggcttatccaatcaaatcctccaggagcctgggagaatattcgcaccgcatacgctacatatgccaccggcggcgaacttcaaaagcggcgacaaggacgtcgtcggtttaactgaaatgaaacaaaagatgcagtaactgaaaagttggcactcttggtttcaaaaagatatacaattgcctatggatgaatccttttcctgtaatggttcgttcattcattattcagtttggtaatttacaaagctggccagtataacataccccgtacaacaatttttcatgctaatgcagttaataatactcgccgccaagaaactttcgccgcttgtcatttaccgtgatcagctcacttaaaaccggagcttcaactgctctcaaagagtgaagtaaaccggcggcggatgaaccacctccgtcttcgacatcgacacattcccggtgagcacgctctcggacatggcctcgtcggcctcaaaaggctgcacctgcgcgatcctttcagggatcgcctggccaccctccacacgagcaagaacctcgtagtgcgccctcaacttcttgggcttcgtcttccactccgggaagttggaccagttcacctctccgtcagcaatcctcttctccaccgcaaaccccatcttgacgtacgtttgggcagaagctcgcgccttcaacagcttgaacgtccccttctcacctgccttctttccaagaaccgaggccagcaactcctcaaacccctgcaggctgccatctgacccattcagtgacagaaggggccacaatccagctgcgtgtgatccatcaccatcatcgtctgtaacagcagggattgcacgcgaggagagctccacttggcctggggccaaccgtttgagcttgagcctgtcattgggagacatggaaggagtcgaggacaacgacgtcggaccttcgatgcggagggagagcagcggcttctggttcgaccgggcggcgccccgtagcgtttgcgcaatggatatcaagcttgacaaccggcccttgtaagtggtgcggttgagagggagcggtaattcaagtggcaaccggaggctcacagccttggcacccttcactgttaccacggcaccatctgatagcactactttcttcagcgtccctgcttccacatcatgctgtaaagaaaacagtattagcatattgtatttaaaatacatagtaagagaacagtattagcattttgtatttaaaatacatagtagataaagtaattcacccagtaaagcaatgttaggcatgtgtgtaacataatggttagatgaaccttcccatggttaaatacagcaatggcaaccaaatgaccaatcttaaatgaaccccaggccgcagatggtgttagcattatggcaaatgcgtaaaagtctataccaccaacttatgaggcaactattagaaataactatgccttgcaaaataatgtcaagtttctaaagagataggaattataaaacaacacatattgtacacacttcaaggtcttcttcctgctctgtctctgggggctctggaatcatcgcggtgatgtagttttcagaggagaatctcctcctctaaatcgtttagcaacaaagtgcatagaggatgctactctctgggcggaaagattgaactgtgccgacaggatagtagtagaatcctggaaacaaattctatcttctcccatccgttcaaatgtaccctgacttaatgtactcgatctctctttaaatcaaaattcaggtggaaaagctccccccccccccccgttgaccagtctaaaaaaaaacacatattgtaaatattcagagtttaagcctagcacaaaacagtatttacagctaactaggaatcacagaacctccagatgtgagacattccattgctgtgaaaggagtaggatattccatacagatttgctcaacattacttcagagcagaacgcgcaatgaagaagctactaatgttgtaatgaaaaaccattctggtgtagaatccacaatgaagaatactaacgcagatttgcagaacactgactcttgaactcaccaggacaaaaatcatcatattcattgctgaatgaaatcttacaatacatgaacacataagctcaattcaaatcattcttttgtatacgtgaacaaagttggtgttcgttattcaaagtctgcaagcacacaaatagttcagacttcagagcctattacgccagacgaaatgacgatgacgaattatcaacgtaatccaaaaattcacttccataatttcatagaactaaattgaattgcaatcagatgagacgtcaggtggcttaattatagcagcaactgaaactttgccttgttatcaagatgacatcagaaacctgaagttatgctctacaatctctattttcccaactgttgacacatttcacatttgaggtgtagaacgatgtattgttagctttgatacctaattctactttgtatgtttttttaaaaaaattgctgaaggaaaattcatcgtttttaaacacaaacagtactttgaaatataaactgaattgcccatcttccctaatattagtttttgggttgaactggttggtgcatgcaacttaataacaacaaaatcattccgatgaaaatatccttttaaccataagcacgagaagaaaaaaaaattctcttaccggcaaggcgagcctaacgtcgtcgccgtcctggatccagagctccatgggcccggcgagctggaacggtggcagggtcgggtcgaaggctcgcttcccgctcttgccacgccggatctcggcgagcgccgtgtcgtcggcgtcggcctgggaccggaagatgggcaggtcgacgaagtcccatcggttgacgtcctcgagcaggcgcaccggcaccaccttcctcccgacctcgatgtcgaactcgtacgccaccgcctgccccacgagcgcgtcgcgcacgtcgaacccggacaccttgagctcctccgactggaaccccagccccttcacgatcgcctccctcaggtcctgcaccgatcgatccgccacacgcgcgcatcgttacattaacatatcagaatcgttccgcgacaaggacgaatcggccaatcgggcgttggaagaggagaaatttcttcgtgtaactcaccgagatggccttggggacgggaggcttggccgccgccgacgacgacgcctgcctcacgaggccaggcgacgacccgaccgctaggagaagagcgagcggcagcgcgaggattcgccaccgagctcgagcggccattgctgcctccctccgattcaaccagcgaaattttctcctgcgagaggaggaagaacaccgcggcggaagcggagagattgaaaaagagggaaattcattttattggtccaaataaagtttttcttgagaggatgacccgtgggcccccgtgtccgtgggccccacctagagctacgtggaactctctagagcgcggccacgtgggttcgtttcgagtaaacgaggggaaaacgtgtatcgaaccaatcaagggcgagcaaacgattgcgtggacgcggggcccgggcggttgcagcagcggcttctccgtcggtttgcgaacagacccagataatttaaccgccaaaaaaacgacccgataaagcgataagccggccgcttgaaggatttcttagaattcagaaaattctttttttacgtccaaaagaaatcataaaagtttaaaactcgtcactaaacttttcgaaccaaactttccaataatttagataactttacagaattaaacaaacatcaaaccatcaatcgagatatcgaaactaataaaggcagagctcacgaaggtgtggccacgataaggatagtcgtgccaagccaacaacgagctcacgaaggtgtggtcacgacaaggatagtcgtgccaagccaacaacataacttgatacacattaataagtcactacatgaaaatgtaaaaatagggaaaagaagacaacataatcgtgttgcaaaatcaacttgcttgcgttttctcatattattctttttattcagccatacgcgtaggtaacaaaaagtaattgaatcaaacattgtatctctaatcttcatgatgtgtcgttccacactatgacgaagttagaaaatttctaagcctatggctcaagtaggacttagctgataagatatttggttttcttaaatggtgatttaaaagggatttaaacatgaatattgaggcaatcctagaactcaagcctaagctgttctaggcttgtctccgcacctgttccacatacaagcaattacatctcacagtgaaactcacgtaaataattgccttgtcaagatttcatgaagtatggttacttcaatagagagatactcccttcgtttcacaatgtaagtcattctagcattttccgtattcatattgatgttaataaatctagaatatgaatacggaaaatgatagaatgacttacattgtgaaacggaggaggaagtacgtctttgggtggaactagttgagcgatgacaaccaagcaagctctcacacgtgagggtcgcccattgcatggagcaatagaaggcaaggcccgtgcgatgtctgagctcgtgcttcaagaggttagaccgttgaacagaggtgcaacaggtgatctccatgcgagaccataaaaaatgaggttaaggcaatggcagaataaagcgcttggatgactaggctcgcgcaaggcaagccacatagagacagcttaggcccttcacagtgttcgtacgtggaggagtttcctaccgcgccagcttggattctagcgtacgtagcactgagaccctaggtgggagacacgttttctcgccgaaatgagggcgtgtgggggaaggaatcttgcactgcggaggtcattgcttcgattcggcgtgacctcgcctcctctttctccgcctttgccgccgctcgtcgggagaggtgaggtgagaggggagccgtgtaacgccccgattttcgttcgggattaaaaatcatttaataatgcatttcctagaaattaaataaaaagttaagcaatttaatcaagtgaattattgggagaattaaaattttcccttaaaaatcaatggccgggaatattttgtaatattctttgtgccctaatgtactctccggaattttccgtgaattttcggagctcgagaaatagttttaatggcacaaagttcatcgaatcaattaaaataaaaagaaaagaaattaaaatcctctctcctctctttgggcccctttcggcccaacccctcctttctctccctctcgggcccggccgccctccttttcccctcctcccttctctttgggccgtcggcccggcttgccccctcctcgcgcaagtccg

SEQ ID NO: 42265 - DNA, 20579 bp, Oryza sativa
  unsure (1)..(20579): unsure at all n locations
ccgtcgtttcggaagtccgcggtcgcgaggaaaagagttcggaagatcaaagtgaagaagcaaggcaagtcacacattccccttgagcatgttgatcccaatttataaatgttttaccgtttacaaataaatatgcatgttttgctaattacatgggatcagggtttacctatctgctcgcttgtgccatgtttacttgatatctgtcctttgtcaaccttgggtgataaatcgactagcttgtgttacttatgtgacctagctagaactatatgcttagccatgcttaattaccactagctcagtcgatgggataattacagttttagacctttctagtatcttgttgagctgcgtgctcgaaacacctggccatgtttcatggtcgtaattatccaactaaaatgcgactgaatggtgggctgtgggtgcatggtttttgtgagtcgcacccatggcaattaaggaccggttcacgggaaaccctggaagacttacagcgcttgccacaagcgggaatgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgcgaagggtctcgtcacaatcactcgacatggtgacgtgtgcatcatgggcacatgatgacacggtgacatgtcggtgggttgtgtcttgtgggtacagttgtgcacctctggccagagtaaaactattcgaatagccgtgcccgcggttatgggcgatcgaccagattcaccgtgattagtcccaccttaataaatcgacccaatgcactgtagtccaggtgggttggttgggcctgttcaacgtggtgtagcgttgatcagtggagattttaatgttactttaattactcaacagttttactgttttgctcaataaaatgttttacaaccgcctttatgcaaatagccacaaaccatccttgtatccccttgcacgtctgcatcattggtgtggcttgctgagtacggtggttgtactcagccttgctattattcccccttttcagaagtgtagtgcttctgagctgaagacgaagttagaagaccaaggctcagaccccagttgagttttgcctgtggagtggagctgaagccccgctaggatcgcctttttccgctgctgctgtttttgtttcggtgtgaggactaagtgccttttctgtaagtattttacgctttatttacgtttggaactgtatattacttgtcgttttgtgtaccctggctggtcctggacagggatttaatacacaaaatagtctggaaatttgggctaaatttctgggcgtgacaagccggcaaggcctcgccgccgccgccagccccaccagcagtcgcggcaccttcaagagcgccgttgcctccgccgctcgccccgaggccatcgtcgccgcttggccccgacgacaccgtcgtcgctcggccgccgagatccacctccgccctctcctcctagcgccaggccaaatctgacagccctgtcgagggtggcatcgatctcgtcgctcaagatacacatccatcggtcgggagatgaggacccccggcgagttggatctgtggtgtcgtcgtcgccctccaccgctcgaagcagggacgcccccgcgtggggaaggggagggaggaggggagagctcggctcggaccggaggagaggagagccgcgccggcggaggaggaggggagccggcgctgctggagggagcaagggagagccgacgtggtgagtgagagaggaggaggcgggcgtaatgattgagggagttggggatttggtaaagtagtatatgtgtgtcccactagcggtgcttgcattgtggagagagtgtctttgaagctctccaccctaggtgtcaccttgtggtacctcacaataggtgcttgcactgtgagtgcccttattgagatcatacagggagggggcatcaagctatatgaaacatttgccaagcagagaatgatgaggacgaaaggtaaggaaggagagaatcaatgtggatcttacttccttttttagtaaagtgcacgaaaagtctctaaacttgtgcgggtgtgttacctaaattcctgaattctcaaaatgcattttggatcccttaacttgtctcaggtgtcatatatatctaaacgggttccaacctgctccgtgtgctgacgtggcatgccacggttactcctacgtggcggtgggatccacatgtcactcacacagaaaaaagaaaaatttaaaagggatgagagtgagagagagagagagagagaggagaaaatgatgtttttaatttaaaaagtaaaatgaaaaagagaggagaaaatatatgttcttaatttttctatacgcgactgacgtatgggttctattgatacgtaggagtcaccggcatgccatgtcatcttaaggagcgggttggagtatgtttggacctatgtgatacacatgacaagatcgaggatctaaaattacatttcgagagtttagggacatagatgacacatccgttcaaatttaagtaccgcccgtgcacttcacactttttttttactataatgctagataagcaccctgtaagctttaaacaatctagttctagttatggatgaggggtgtaaggtaaatgatttgaaatattgtagtatgaacatcgtctgatatgaagagtaggagcagattttatgaaagttcagtgacttaaaatggattttttttcctttttaaaataattagaattatatttctatatgattgagatttgacatcaaatactcagtgcttcacctttcacagtttagactgcgttcgggagtgaggtttgggagccctcactccccggcacgcaaaacggagcagcgattagcgtgtgatttaattaattaattattaattttttttataaaaatggattaatttgattttttaagcaacttttgtatagaaatttttttttaaaaagtaacgtttattaatttgaaaaacgtgcgcgtggaaaacgaggaggaagagttggaacctggtctgccgaacgcagcccagttagtagtacaacgcttctatgaaatggcctcatggttatgcagtaagtttggaattccaaacataaaagaacacaattactgctccatccgttttatatcgtaacatgttttgatatttttggaattcgtacttctttaattcggtggcacacgcaaagactacagcagcaagcaaaaatttacgagaaaaaaaaggtcccaccgagatttgaactcgggttgctggattcagagtccaatgtcctaaccgctagaccatgggaccatttgtgacacaccgtgactttcatcctttaaattagttatttcttgagattctacctaagcacacagataaaataaaacaagagtaaatttcacgaaactacatgagtttatggttcaagttgcagaaaaccacacacagtttgacacttgacacttaagtacatatattttggtagtttaatttcacaaaaccacactatcgatgaatggattcatccgtgagatgacgtggttgttccatctaggatggggacgtggcatcctgttaattttgtgtgatggctggtaataagataccatgtcctcgtcctatgtgaaacaactatatcatctcacgagtgaatccattcatcgatagtttggttttgtgaaactacacgaccaaaatatatataattaaatgctaagtgtcaaaatgtatgtgatttttttgcaacttagaccacaaaacatgtagttttatgaaatttactcataaaacaaactcaaattgctttcgttgagagtcgaactcaagacctcccgcttactaaacgnnnnnnnnnnnnnnnnnnnnnnnnnnagctcttggcttaactgaaaattagaactaaaatttcctagaattgaaaattagaactaaacttgaggtccaattcacctcaaagacaaaaactataactaaagtttagctttaaatagcaaacttacatgctcaggttcaactgaaagcctcatatggttaactttggcatatgaacagacgcatcagacattgggcacacaagaacctgcgttagaaacaggcgtgtcacaggtggcgccgcccagcacgtcagcatctgctggtggtgatctgctactactgaggaggtcatcgaaaatagacttgagcgatctcaacgggatgagcaccgcctcgaagaggcgccgcacctggcggaggcgctccaccatgcgcgggatggaggcggccgacgcgtccccgccgcgcgacgccgcgaggtcctcggccagggtgacgtgggccagggtccacagctccgcgtcccgttccacgaacgcggcgtggagcgcgcggatccgcgccgcctcgcccgcggagacgggcaccttctcccccctgctggggaggccgccgcggaaggcgatgagctgcctgtcgaaggacttgaggagctcctcctcgaagctcctgccgatcccctccatcccgtagaaggtgacgccggagtccacggcgtggcaccggaccacgcccacgagcccgtcggcggtggcatgcgccgccgcctcgggcgacagcatccgctgctcgaggctccaggacagcaggttgatgaggaccgactccctgatcgccttgtcgatcgacttggagtagcgcgccaagcggtgaaccgggaaaggcaccggctccggctccgacgacgacgacgacgacgacgactgatttgcgacgctgttgggcgaggtagaggcggcgccggtgtcatcaccgtcgtctcgtcctccctctctggccatgatcgatcgatcgatctatctatctctgcaggaaaaacccggtcgtttcccgtattgttggcatatatgtacacggagcacaggaggccaggacggacacggtccaggaacaagttcttgatgggccggcctcaacgagcccatacacaaaatcaacggggcccaccttgaaagatcacgtgtcacccgcgccatctagtgagtggacaagtggactgcgtgagccgcccccacgtcacgatcacgtcataaagctccccttccgtccgcgccggcacgcacgccgccacctccgacgagaacgagctcaccgctgtccactgctcctccccaccacgccggcggcaaagcggccatgcgtccgctccctctcctcctcctaatcctcgccgccgccgcgtcggccctggcgagggcgccgccccgcttcccggtgccgcacgcgcggccgcggcgtggggtggtgggggccgaggaagcggtgagagggtacgactacgagacgcgctacttccggcagcggctggaccacttcagcttcctggaggaggagggggaggagggggatgggttcttccagcagcggtacctggtcgaccgcggcggcgggtgggccggcgccggcgggcccatcttcttctactgcggcaacgagggggacatcgcctggttcgccgccaactcgggcctagtgtgggaggccgccacgcgcttcgccgctctcgtcgtcttcgccgaggcaaatttatcctctcaccttgcaccagtcagtgtgttcttccttgggtgtgcgctgatcgtgcgagatccgatcccgtttacttgttctctgcagcatcggtactacggggagtcgatgccattcggcagcaaggataaagcttacaacaattccaagtccttggcgtatctcacagccgagcaagcgcttgctgattatgctgtactgctcactgacctcaagaagaacttgtcatcagaaggcagccctgtcgtgctcttcgggggctcatacggtggaagtaaggcttctctttaactggatagccttgcctgtgcaaaatctgtattccgtagggtcttcttgaatgtggcttggtggtctgttgggctccagcttcaatctgtatttctgtactgacaccattgaatgtatgattgctgcagtgctcgctgcttggatgagacttaaatacccacatattgctgttggggctctcgcgtcatcagctccaatccttcaatttgaagacgttgtcccttctaccatattctacgatctcgtgtcaaatgatttcaaggtgtttattttgcaacatttcctgtttccttattattctcaatatacgtgagtgacatgacagatgacacttattcactgtgttttagagggaaagtttaagctgctttcaaacaataaaggactcttggaaagcactggatgctcaaggaaatgggcaagatggtctgctgaaactaagcaaaactttccatctatgcaagtgagtaatttttctattcactacatcttttttacattgagctttattaatcggtaatcatatatgtataaaaaatgttttgcaggactataaaaaacactggggaactttcagattggttgagctcagcgtacagttacctggccatggtggattacccaatgccagcagattttatgatgcctttgcctggcaatccaataaaggaagttagttcctttttgtgataaaatttaatttgctaacattcatcaaccattatttagtttgtgttctcaagacccaacaaagaagataatctagagtatcactatatcagaatgataatttagtgtgctgcaacattctgaagccttacctgcttaccatgttctattttctgcatgtcatcactactccctacttactaggttatctggtttctctttcagttgtgtacaaaaattgacaatcaacctgatggaaccagtattctggagcgcatatatgcaggagtaaatgtatactacaactacactggtactgttgactgctttgatctaaatgatgatccgcatggaatggatggatgggactggcaggtcttgcaactaaaactttatgctgtttctatccattggatatatttgatactccctctaaatgggcaaaaaaacatttatattttgggacagagggagtatatgttaaggtacttgagttatctgatatgacatatctgccattattgcttaaaacaggcttgtaccgagatggttatgccaatgtcatacagtgaagatagtatgtttccagcagataaattcaactacacttcatatgagaaggattgcatcaacagctttggtgttgaaccaaggcctcaatggattactacagagtttggtgggcatgtgagttatagtatcaaaatctcaaggttttcataaagcatatacatttgtttttaacaacttgctctgctagatgatttgtcatcgataggaaactttcttaactaagaaaaaaatgtattattattagatatgttatggaatgctcaaattctgttctactccataaactattctgcttgcaatacaactgattcttcatatttttttcagccaaaatatacatgtgagagagtttaatgacttcttgttttttttttcttgttcagaatattagtctagttctggagagatttggtagtaatatcatattcttcaatgggcttctggatccttggagtggcggagggtaaacaaacttcacttgccttttgagctttatttcctctgatgacgatctcacctacacgagccattttcgtgttatgatcttgccgttatctgaacaatgaacattacagtgtcctgaagaatatatctgagagtgttgtggccatcatcgctccattaggtatgctgttttcctacacttccattcatcaatggtggtgttaatctgtactagactcaagtgtgtgggatactgggatataatggaatcaataatatacttgagtatactactccctccgtttcacaatgtaagtcattaacatcaatatgaatgtgggaaatgctagaatgacttacattgcgaaacggaagaagtacttgactaaatcacgttgatgtggtgcagtttgtaagcaagcacattgagtctctggtttgcatcatcttgagttattgaatcgtaaatccgctttgtgatttgcctttgcaggagctcatcacatcgatctgcgccccgcgagcaaggacgacccggattggcttgttaggctgagagaatcagaactgggcatcatatcgggctggctctcggactactacggtgcaagaagaggggcgctcctccagcgcgccgctcccatcccatggactcttctgcaccattcgtgacgatgatcggccgtgcgctgcaactcccaaccagacgctgattttcgcagctgcatttcccgtgtctaaccaataatgtacccagtgctggtgcctcgctcgctggacggctggagttctccaagctggccatgatgtcgcagtagtagtagtactagtacaccgttggtaaggtaggagcagaagctttcaccagttgttcatggactgttgctgccaacagactgggaagctaaaaaattcattagtggtaagtgtgactgtaaacccctccgtttcccagtttccacagctgtggctatcactgtggccgtcaaagtcaagggcacaagtttggtggggcccacataaaaaaccagaccaccccaccacccacctcggatgcgttctcactggcgccactcccgaactgagagacctgacctcatccccctcatccaaacgtatccactttttccgccatcgcgatcaccagctcaaacgagctgggcgccacgccggaaacccacccaactgaaccccgatcctcacgagtcacgatcgctcccctttcccgtgccgcttccatgtgggccccccgaatcccctgtccccacctgtcatgggcgatggtctccgtgtgcgggggtgctcgtcgcgtcgctacggcttttcagcggcagccgcaaaaggcagccggccgccggtgtcgattagtagctggggagactgacgtgtgggccacgagggatttggacctacgtgtcatgcttagtatgcgttacacctggtgacgttggttaattgttttttatttactgccgaaaagatctccgaatcctcggatgcttccgtggaccaagcctacagtgtgccccgggcttatgccaacggaaagcatactgtcatcttgcttagggcccgtttagttatcaaaaagtttttcccaaaaacatcacatcgaatctttggacacatgtatgaagtattaaatataaataaaaagaaaaactaattgcacagttataggggaaatagcgagacgaatcttttgagcataattagtccgtaattagccataagtgctacagtaacctacatgtgctaatgacggcttaattaggctcaaaagattcgtctcgcggtttcccggcgagttctgaaattagttttttcattcgtatccgaaaaccccttccgacatccggtcaaacgtccgatgtgacaccaaaaaattttctttttccgaactaaacacacccttaatttttttttgtcaaaagtagtactccatatatgtttttttactatactattttatctatatagttttaagaggaaaaggtctgtatagttcagcaggccaaatagttgacatttcaaggttgtttgtgaaaaaagtcattcaaatgttttttttaagcaatatgtatggcaagctaaagtctctgtttcaaataaacgacacgtttgatgggactccaatgtctaaatttaactccaaaacctaagtttggagtgaagttgtagaacaaaccgaacatttgctataccttttaaatttattctgtgagagcacttcagtccattcttttattttttttcacatgcatttaaatttgtttagtttggtttcagcttaataaaaagtagagtagagctgaaggtgaagctcagccaaatcggcctaaaacaaacccgatctccaaattaaaaattagagtacaaatggaaagcgaaagcaaagaaagaaagaatcttgccaataatcatcagtctctaatacggtagagcaccacctccataaacccggtccaccctgaactccacggtcccacacctcacccagtccctcgtccagtgtccacccatcaaaccaaacccttctccctccaccgaatcccaagccgagtaaaaaataataataaaaaaaacctccgtctcgcgcagcacacacgagcagccgcccaaaggaagagagagaaaaaaagctcgaggggaaaaggagaggtgtgcgagagaagggagagagagaggagagagagagaggaggcgaggagggagacctccactactcgcacgggaagaaagcactgctgcgcgcgaggggcgcgtgaccgggtggtcgccgccgccgccgccgcatcgtgccgtcgaatctagggttcccggcgggcaggagccatggcgagcccgcggtcggcaggtggggtgggaggaggaggcggaggaggaggaggaagtggtggcgcagccgcgggggacgacgcgatctggagtaagctccggcaggccggtttagaagaggagtccctcaagcgccgcgacaaggcggcgctcattgcgtncatctcgcggctcaagtccgaggnncccccctcactctctctctcccccctcctcccctccttgtgcgtgctggatggcaaggttcttggatttcttgatttgatggtttgactccctcagtagctagttcttggtggagggtttcctcctaggagaggagaaagattgatggccgagaagaatcggcggaacgtcgatgaagtcttcctcttggaatcattcgctgcgtgggttcttgtgtgactaatgtcgagtttggtgcgctatgagttatcgggaaagaagaaaaatcattttgggattttggtggttgctcagttctttgtttcttaggtacagctgacatgctggatgggtttattaatgattcaagaagctattttttttgcgttggtgtttagaatcgttatcttggaatgtttgtcatttagtttagcttgcttggattagttagtggctgaactgtaattgtataagtttgcttcttttatttttttttttacatttttacattcaacttatttatctatttctttcgctttggggtttctactgttgcaactatacatatgtattctgggttagcttgtctggattgaaatagtagattgctttatgcattgcggtagcatacgattaatgttggaagatgccatggctattattacattggtatttgccgaaaccattcattgatctgtatgcaatttgtatcaatagtaaagtctgcacatcagtaaaccagttagtctattatttacttctttcctattcaccatcggatgtatgcccaaatgttaaatacctacattgtcataagctatcatatttaggacctattgcacatgttgtaactaaaggcaaatttacacgttttgctctgcagaagaatggtaaataaaatatctgctttatcttattctttgcttgttttgttgtagatttatcaataccaacacaatcttggtcttgttttgatggagcggaaggagttaacatccaagcatgagcaacttagagctgcttcggaatctgctgagattatgcacaagcgtgaacgtgcagcccagcagtctgctttagctgaagcaaggaagaaggaagaaaacctgaaaaagagtttaggcatccaaaaggagtgtgttgctaatgtaagtttttatcccaaataatagctcagaagcaaaatttattatttatgtctatgagaacaaaagaaaaattcactgtacatgagacattctgagatttaatttttttatccaattcatatataatgataatgtggcccttattcaattttttctggtagcttgaaaaagcattgcatgatatgcgtggggaaacagctgaaacaaaggtttcatatgaatcgaaattggctgaagctcttcaattgatggaggctgcacacaagaaatttgatgaggcagaagagaagcttcttctagcaaaatctttggaggcagagtccatacggactcataatgcagcactgagaagtttacatgacatcgatgatcgcgaagatcagcttagaagagaccgaatttcttgtgagctcgagtgagtgttctatgttccaccttttcaattaaatcgtctttcttatatagtatagcttaattcagttcagtaaatcactgtcaaaatgcttttaatttttttagtcaactgtgtactttgtaagatattcttgcatagtttagtgggcatcttttattccttttccctaaatcaggcatgctaatgcaggaatgaggccaaagagaaggaaattagcctccagaggaaatcgttgaacgatatgaagaaaattttgcatgaaaaggaggaagtattactaaaggaacaagctctactcaatcagagggacgagaacatccttgagagattagcttatgttactcactcagagaaaagagtggaagaagaaaagaatattcttgaagctgaacggaaggttttgttagaggaaaaatataagttggagctgaaaatggaggcaatagtttcaagagaggaagtatgtatatttttctccttttattaccacctatatatcattgcgaaagttctgtctaacaaaattgatctcttttgcaggctctgattcagaaggaatccctgcttgacaaaagggagagtgaattattaattttgcaagagacaatcgcaagtaaagaacgggtaagattctccaatttcactattgacaatgtgtgttgtgacttaacctcttgtaaatcatcttgaatttctgctgcaggccgagattgaaaggttgaatcaggaacaagctatagccttggagaggagaaaacatgattttgaatctgagatggcaaacaaacaaatgtcttttgatgcagcaatggaggtgacaagaaatgcgctgcatcagagagaatgtgctctcagtgagcaggaatctgtggttgtgcaaagatcccagaatcttgaccttcagctagctgaattagcaagcaaggaaaaggcgttggcagggagatcagatgagttgaaagaggaggaggaaaagctcttgttacacagagaagccatacacaatgaacttcaaaaagaaagggaagaaatacaaaggattaaatcggatttggagaaggaaaaggctttctttgaagaggagaaacgggaagcaattcaagcccaacaagatctagcaataacacaagcagatagagatgagttgcttactctgcagatgaaacttaaagaagaaattgacagcctcagagcccaaaaaagggaactcatggctgatgcagataggctgcaagccgaaaaggaaaggtttgagattgaatgggagctgattgatgaaaagaaagaggagctacaaaaggaagcgatcagaattgctgaagaacgaagagcaataactgagtatctgaagaatgaatctgatatcatcaaacaggagaaggataatctccgtgttcagttcaaaagtaattcagaaacactctctcgtgaacacaaagagttcatgagtaagatgcagcaagaacatgcaagttggctgagtaagattcaacaagaaaggcaagatctgaagagagacattgatatccagagggtggaattgctaaattctgctaaggcaaggcagatggaaatagattcttatttgagggaaagggaggaagagtttgagcagaaaaaggccaaggaactcgaacacatcaattctcagaaggagatgatcaacacaaaattagaacatgttgcagttgaattgcagaaacttaaggatgagagaaaagaagctactttggaacgtgagaggagagagcaagagttgtctgagataaaaggcactattgaagccttgaataatcaacgggagaagctgcaagagcaaagaaaactattacattcagaccgagaagcaattacagtgcaaattcaacaacttaatgtgttggaagaactgaaaattgattctgaaaataagcaactgtctttgttacaacatgataagtcaaagcttggaagtgatataaatgtgaaagacaatcatcatgataactcccattcttcaccaaagcaacgttttggaaggaaactagacctttctccagtctcaacaccgatttcttgggttcgaaaatgtgctcaggtgatattcaaacggtctccagagaagagcgctagccatgatcaatttgtccagaatggtgtgccaaagaaagttggagactctgtggatgttgaagatgtgaatttggactttgcaaaagttggtcaaagaggcttaatcatttggtttcttgtgaccaaactgaagttttagagccaaaacgaaagcacagaaggagtactattcagaaagttaatggaggggaaatcacttccaactggtatgatttgtttttacactactatctgaacttttgaaagcagcgtgactattttaatttaatgtttcttcatgcccttcactaacaatctgatattgacagcctgtcagctctagaagagaaatgctccaagaatgaacatgatgaagccccacttggtttatccaacacctgcaaggaacatgaatacggcgataaagggccagagaaccttacaaaaccaggagaaccagcttcatctgttgatgtgccttacgtgaacggaatagtggataattcagattctgtccaagaggaaccttcggtggaggctacagtggtaattcctctttcagctgcagctgcactattctcatcatatgcttttagtatgtgccttggtccattgaacttactatattctgttttcgatttgcagtctgcaactgaaacatctaatgtagatggacctgaggacaacaatgactctgacgaggaagatgaagaggaagaggaagagaaaacatcttcagcgaagaagctgtggcgtttcctcataacttgatggagattagtttcacctctgatagataatacagagctaactgtaggctgacagttacctctcttataaagataatcactttagctgtattgctttcggcattgcccccctctcggattgaaaggggaagcctttgtgtctagttgtgtgtgcatgtggtattgtgagcagcggcagttttggaagccgctgctgagctgaatcctccactgtgttttccatcttcttgcctctgttgcttcttcgacttgtaaagtggttgtgtaaaaaatgatgggggcgccctggtaacctcttgctgttgtgcgaagtggaagcaaagttaacgtagatggtttgatattcatttgattcgtcttattggcttaaataccgttatgttataagtaaggccgtgccaaatttctcagtgtcgggtccatgtttcaggatgtctgtttcaactgaagattaatgaggatgtctgtttcattatatcagaaaatgattgttcatgaaattgattaccctttgccaagcttcccatttcattcccacctactttgggtaaattgattaggaagtatttattaggacgctgttacaactatgttattttgtctttacagatcaatacgaaagatttatagcaaataaaactctatttcaataagtagttaagtagtacaaaccctgctaaatattctgctaattttttagtactaaattgatggtcaatgtgaactcgtctaagcacgcagaaaacgttcagacgttctattagtgcaccccacgacggaaaatcattagtggtcgtctgcgtctaaaacaaaacctgaagtttagtcaaactcaaacaaatactactagcacgaatgacattgatgagcgacctaatgcaaattatttacataaagatgtgcgcctgaactcaaaagcacgtacgctgatcatgctggagctcctgctggatttgccgttacaacgatgcgatcgatttgttaattccatcctttttcccatgctcgcctctcatcacgatacgcaagtctgcgaccaacttacaaatcgccacgattaacacataaacaatcagctgttagtcattcgtggcgcagcaacaacactccccgattcttgggatgaacacactgtggctagtatactaatttaggactcctattgcagtgaagtttccgttgcccggttgtgcagcgaattattttgctggttgacagactgaatgacaatgtcggctgtcaggcagcctgtagtatatcatcaggttggcagcgacagacttacttatacggcacatctaaaaccatcgagatctgataacctgaaatttaagactcccttttggaggaattttagagtattttcgtaggaactgaactactcccggtaaatttccacacgaaaaactacagccttttcatgcttgtgcagcgtgtaagtaatgctactattgcattgcacggattgaaaaggaggaatcaatcagagcaaggcggcatgggtgatggatcgatcgagatgcagattggaatgattccttacgtcctccccggcaatggcagcacaagaacggattaaattaaataacaagcagcatcgtagtagcttatgattctcctactcgtgcgtggtactaccagtagtattgtagcaataggagttaataatggctggaccctcgctgcctgcatcgctgcatccaagctaaggtacagcaggcagcagcattgaacgtgagcacatctgaatctgacgacgctgccctcctgtgtgattcgatgcgatgcgtgtgttcttgccatctctgagatgctcaacgctggatctgtcagtgaagtgagcaaaccaagccatcaaagaagttaatatcttgagaaatgagaagggttaatcaaggttatctttaatcaccatgtgatagatagagtggggaaaaaagatctaccctacaacctgaactctgaactctgaagaaatagctaaagaagaggggagaccacacctggatatcttgagaaatgagaagggttaatcaatgaggttatttttaatcttcatgtgaatcgcgtgggcatatactctagtacaaccgatgatgcggtagcatggtacgatcagcattatttctcaggatttactgacccaatggtgacatgatggtagtaaatggggatttactgaatctttattaatagcactccatatgagaaacacaacaaacattcgccccagttactcagatgcaacgcggggtaggaaattgcctcttgccatcgtattccatttcagccatgtcagtgcagtacatgtcacaacggccaacttgatgcatcaacaaacagaaatactgaaaagagaggggggccatcacaccacttcagtagaagcaaattgcttactagtatcagtaattagcaagtgcagcttaggaaggagtaactaacagcgcaagcttgccaggttctgtagcctgcgtagagattcgattggcattgccaattgcccttttcttttcttattttttttctctttcatcagttatcatggatggatgtcgtaaatggggcatgcaaacgaaacttgtccctacctgaggcaagttgagcagtttcagatctgatcttggtttgtttctatattggctttgggttctgatcatgtgttctgtctttcatgggtggtctctgcttcctcctttcttcagatgttccgtcctgacaatgctttcttcagaagagagagagagagaatgatgcagccatacgagtttgatagcaagaatagaatgtgtgtccactgcttctcagcaagacagcagaatgtgtttcttgaaagttattttgagttttgcagggtcagtttttttttttaaaaaataatactacaaacataatactataagaatatgactttggcaaccagaagagcatagctttctgtattgaaaacatttcttttttggacagtattaatcttttgacttctacgtaactgcaggtgtctagcaacagctctgaaggagcagacaatggattgttctgaaaaaggtgaaaaaaaaacttatctgcttaatttgcatagggaatatgaagtctacacgcagtctgtaagctgtagtatacaatatatggaaggcctcaaacattcagtaaccgtgccacatgaatccagcaatgtgcaatctaagtttgactaaaaaaggcgatgttttttgcacatatatcctaccaaacatgatcccactatatatcttctataaattccttaaccattttgatcatatataatcatgcaatctccaagcaaacccaagtggccactggccagcatagctagatctaatctcccctccagtgcttcttctctctcaaataatttcgctgaaaaacaagtacggggcggatcctttgtttgatcttgttttcttctgactggatctcttcagattgttattcctcttctgctcggaccagacctcacataattttttttatacttccatctctgtctatatatatattatgaaaagttaatttggggagttttctgttgtcttaccagcttcagctttctgtcctgttttgtttgcctttctgtaaaaagttaggcatttccttttctgaaaattttaccttacatatatttttacatttattaattgttttgcctttcctatcaaaagcttggcatttcctttcctgagttattctacattacatatatttatacatttattattatttttttgcctttcctgtcaaaagcttggcatttcatttcatgatatttttatgtaagtttggcatttcctttccttattttgttaccttctatctctacctcattaattattatgccaattatttctggggccttgaaacatactctatccgttttaaaatatagcaacttaataatgaattagatgtagcctactacgaatttggacatattatgtctaatcgagtactagctagctatattgtgtctatattcattgtactagaacacaacgtagtactttgaatctggacatatatcatagtattatggggtgtctaatatggtacgttgctatattatgtccagattcgtagtgctacgttgtttctaatacaatactaaactgctatattgtattcggatttataatattaggtcgtttcgttttagaacagagaaaatgcttatgtactgagtagtacaaccctatagattcagacagatggcagctggaagaaatcacattctaaaaacgtcacattgctgcacgcaccactgatgatgcgagtaataatccacttgtactgtgcctcctactacgtgttttggtgtcggtataagtgctggctagtaaacggttggagcagtgtgtgtggtgggcacgtcagatttcccaagttggttcttttttccaacattttttttaacgtttgttagtatcgttatgtaggggagaacatactacagtattaaccactgtccggtttgcaacagaaaaaaaaaaaacctgaagaacattctcagaagtcactggttcactggctttaatttgcctgcaattttgctctctatctgttagaatcactctgcttgcatcaattatgaccgatgatgcgctgtaaaattcggtgatcatccaatccattcactgaacactgatttgcattgctgaaagaaacagagttgatttggatcaacgaaaacaaactacagtactaaactagtaaatcaaatgagtagcagtagctgtgctaaaatcttgatgatgaagtggtagcctgtggtaggatgagcaatggtggtgagcagcagcaagggggcggggcaacgtggtggcagagcagtaacgagaccaacccccgcggggaccccaaccaatccggtcgccaccgacagcgcccggccggctcggctccacgcaacgaatcaatcagcctccccccgacgtgctagcccgcacctcacgtgtcccgttgcactcgctgcctgcttccctgctctccttgaatctttgattaagccgcgtttatcagcttgcttaaatggagccgtagtcgtagttacccgccaagaagccgaagcatatcgagtcgccaattggcccccgatcccgagagcgagggagggactgtgttcttggcttaatttaattggaatgctccggcggattagttgattaagcttcgagcagcagcgtaaaggccgtcgtcctgtacttgctctccagctggaggagaggaggaaaaggaaaggttggaattttaattttttaatttttttttttgggtgaggtggtggtaatcataggggagtgtataaagaccgggcttgtctggagctgaggagagttgggattggattggatcgcgacgacgtggtgagctgtttgtttcctcttctgctcgccgccgccgccgccgcagccgcgtgcgtgtgggggtgtttgatgaggaggt

SEQ ID NO: 42266 - DNA, 23100 bp, Oryza sativa
gtacgcgtcctggctgcgcgtccgcctcgagtacctcgcgccggggctccagttcctcgccaaagcctgggtcgtcctcttcttgatccagagcgccgaccgcctcatcctctgcctcggctgcttatggatcaagctcaagggaatcaagcctgtgcccaaggctagcggcggcggcggcggcggcaaagggtcggacgacgtcgaggccggcgccgacgagttccccatggtcctcgtgcagattccaatgtgcaacgagaaggaggtgagctgcgagaacaaacataactaattccaattgtttgttgcttcggcatttgcgcaaggttgcatttttaggattgggcgttgagtgccatggccgcatctgtggtttgcagagaccgaaagattcggtctttgaactgcaattgggggggaactcaacaagtggataggaataattcggcagatttagattggggtatcttggtcgtagtgccactgaggcaaaatttggctgctacttgcatacttcaatattgggattggagtgatggttacatgctgggatgaaacggtttcgatttttgtccacgactcaaagtagacgatcactacataatctacattctggcctatgggtattcctgatatgaagcgtttggtgggttgtagatttaatttggggatttgaatatgtgaataagaagttaagaacatgttcagtttttttttttttttttttggggggggggggatgggggctttaaaggcactgttttatgtttcaaagttttgtatctttacaaaattcatttaattctcgtcaacaaaatgtataaagaataatttagaaaaacaattatagatataagatgttatactgatctaagctcgggagtcgggagtagcattacttttgtttcctttgtgatgtgttctatgttcatgacattcaaaaaaggctaacagaacacccatgttagaactacaattaaatttagcttattccttttaatttctatctttgcaggtgtaccagcaatccattggtgctgtctgcaacctggattggccaaggtcaaacttcttagtacaagtactagatgactctgatgatgctgccacctctgcacttattaaggaggaagtggagaaatggcagcgagagggtgtccgcatattgtaccgacaccgggtgatccgtgatggctacaaggctggaaatctcaagtcagccatgaactgcagttatgttaaagattatgagtttgttgttatctttgatgctgatttccaaccacaagcagacttcctgaagcgaactgtgccccatttcaaggtatagctgaaatatttctgatgttgtggacttgtgttacattcttatatgtgtccaaggcaatgaaaattatatttactgactagttgtgtgttggacctccagggcaatgaagatgttggattggttcaagcaagatggtcttttgtaaacaaagacgagaacttgctgactagactgcaaaacattaatctgtgcttccactttgaggtggaacagcaggttaatggagtattcctcaatttctttgggttcaatggaaccgcaggagtatggagaattaaggcacttgaggactctggaggatggatggagaggacaacagtggaggatatggatattgctgtccgagcacatctcaaggggtggaagtttctgtacattaatgatgtcgaggtacctgcatacatttccttgtgttttatgtgcgttctgtgttgtattcaaacttgtgatgacaattcaaattgttgcacacaattatcctttcagtgccagtgtgagctgccagagtcatatgaagcatacagaaagcagcaacatcgatggcattctggtcccatgcagttgtttcgactctgttttgtcgacatcatcaaatcaaaggtatggaccttctctcgtaggcatactccaaaagctatttttgacaacatcatataaagcatgccactacatggttaggttcatcccttattctttctgttgagaagattttggctgcattcagtaggataatctagcacaatcagttgttttgccaataaacatctgcaggatgcatagttgcaagggattgttttactatctaccagtacattacaagagcaacatcagactaatagttacatgaaccttgtttcgcttcaagttagttacagagcataagtttcatagactgatttcttcactagtaaaatggacctgcagctcatttagtcaaatgtttcatgacgtcaaacacagactaaacagcttcatctggaaaaaaggactgggtgtaaatagaattactctgcaaataaattgctaacctgagcttcatctggaaaaaaagactgggtgtaaatagaattactctgcaaataaattgctaaccggcaaattgttgatgctgtagataacttcacttctatcaaaacacagctacgatggaattcaaaattttacactaacagcatttgtcaatgttttatacatatttagtcgttgaaactgatcagaactatttttacttacctcaactgcagattggagtatggaagaagttcaacctcatcttccttttctttctccttcgcaaactcatattgcccttctattccttcacacttttctgcatcatccttcccatgacaatgtttgtccctgaagctgagctccccgcatgggtggtgtgctacattccagcaaccatgtccttgctgaatattctcccagcacccaaatccttcccatttattgttccctaccttctgtttgagaataccatgtcagtgacaaaattcaatgccatgatttctggcttgtcagtcgggagcgcctacgaggggttgtgaccaagaaatcgggccgttcttatgagggcgatctcgtttctcttgttgagaagcagcctaagcaacagagagttgggtctgcacccaaccttgattccctagcgaaggagtcccatccgaaaaaggattcgaaaaagaaaaaacccaataggatataccagaaggagctggcactctccttccttctattaacagcagcagctcgaagcctgctctcggtgcaaggcatacatttctacttccttctgttccaaggggtctcattcttggttgtcggcctcgacttgatcggcgagcaagtcgagtgatagaatacatgtggtataatcggtttctttttttctttggagggggatatgcaatcaaagagaagttctggtaaagggaaaacgatacaatattgatgcaaagacaagaagctctggtcccattgatggggggttacaattcatcggagactctgaattgttgggggtgtagatatatggcttttggagtcggcctgcaatgatggtctttgatgtctcaattcttttgtaagaattctcagtggttagaatgggttgtttctacttacttgacagtttaccttcaaatggagatactgttattttaaatgtactttggccgatcactatggatgcatactgtggtactcaatagtacaccttttgatgaaagatagtaatgagaaacccagcaatggatcactctatgcatgtattttgtgaatgcaagattgcaattatgtagtatgaattatgcatgagaggaatatcatgatgtacaattgtacatgaaagctgtatggctgggttatactacttcagtacttctagttctagcctttgtaatatacattcacattttcagagaaagatctgtttgagttgtgctgtgtcgctatcttggcaaggacagctaggcttaagtaccggggatttgtctcttgcattagcaacaatcccatgtggatgcaaatagagagggtatttagtgtacgattattgtcctgcatcttgacgcagatatgtttgtggccacttgcagcatgttattatactaatgataatttacatgtcttccacttgcagtacgctattatacctctattaatcaataattccgaaatgggatttatctgcctgctgatatttcacccctaatccttaaaaattcctcaaaattgtttttttctgaaaatcctttgagatactccctccgtactaaaatagttgtcgttttaggattcaaattttgtcccaaaaagtttatcactttacagtaactcttgacacatcaataacctccaattcaattttttttcattctactcctaaccctataccatttaatagggggcactatagtcatttttgctaaataatttagagtaacaactatcatgagacggaataagtatatggtactaaccacaaacgtagttcacttgttgatccaagtgatccagctcgagagatcgagctcatgcctcatgtatcgctttagttgatctgtcacaaatcaagggaccctgtttgtttccccgggagaaatcacacgtcatggattcattcatggccttggcctgcgtcgtactccactgcgtatcgtcccgatagagtagtagtacaactggacaaggacgtctcatctgcttgcttggttgctctgctgcctgcctgcgtgccgtacgtacgtctgtcttggtttttgtttgcaccatcgctctcgttctcgtacttggatgtcatcgtttcgcagtactccctccgtcttatgttatatgttacgagatgttttgactttacttaaagtcaaactgttttaaatttaactaagtttatatagataaatatagtagtatttataatactaaattagtttcatcaaatcaataattgaatatattttcataataaatttgtcttggttaaaaatgttactacttttttctataaacttggtcaaacttaaagtagtttgactttgaacaaagtcaaaacgcctaataacttgaaatggatggagtaattaacatttatatacacgtggtctacaaagttaacactgaaaaaaaatctaatctaacctatttaaaaagtctgcatctctttgttcgccacatcttttttagtccgtcattacaatttttcaccgcacatattgttttcttcatccgttattttcgttctttccatcttcctataactcaatgcgcaggtagacgcgagagccagacgaactccgcttcctttccctattgtttcctttccgttgcaacatatcgtttccaattctaacgctactttctttccgttaaagctgatcacatgtggaaactggaaacaagatacacatatacaagcaccccaacatattttccttccataatttatttgtagtaattgttgagcagattttaaaaccggcatacaaatacatggtaagctttttattttttaagttgaataaatcagattttgttcttgcttctggtccagtcctacaggtgccattgttgaagtgattaggttaaagctgtagtggttttcttttctatataagtggattggatttgagggtccggatgatatcgcacaatgcgcaattcatgttagcgtaggatctatttctagaactagattgcaacctgaaacatacatgaccatatttgcattccatgtaagggtctgctttcgattatatatgttcctcaatcctatccttacttacctctctctctccccgactatagtttggtgtgttgtcaaacaagcacctccttttttccagtttccacattgctgccttattcaacattctctatttcattaactttgcaacattttcttcctttctcgatttaattcaacagaaaatggtcgtggttaacaactctaacacgttaaaactaggagcgagtgaaaacatataggcaataggagtatatgatatactactagaaccattttattttacgagaaggttttttttccataaaatcttaggctgtgttttgttggtttgtgaacccttcactgtcacgtaaaacaaagccatggattaaggcaagattaattatatattagctaaaaaatagattaatatgattttttaaaaactttcatatagattttttttaaaaaagcacaagtttagcagtttgagaagcgtgtgtgcggaaaatgagagtagaagttgggaagagggatatctatcacagaaattatgtgttgatattgaaggtggtagtcaaggaatatactattttcaacaagttaccatgtccacgtaaaaatatgattttttaagggatatatatcataaaaattaaacccaaacttctaatatttattgtaacttttatttcaggatgcaacgcacggatattttttctagtaatatacaatgatcaagatcaatgctaaaaatagcgttttaatttgctatggctgataaactgaagaatataaactatggaaccatcaaaagtggctggaagaatcgtgctatacagtaacagccgtcgtcgtcatctatttggtttcatccttcctatgattttttacacaagcactctctccgtcctaagatatcctccgtaataatctataaccagattagacagtacacatagggagtactactgagtgatgaagctttgatcattcgtactgcatcgaattaatttgtttttctttttgttgtgaaattgctgcgttccaaacagaacatagcaaccattcatgttgacacttgacagcctatcgatagcctggaacgaacgtactgctgctgatgaaacaacggcaatcctagagatcgaagcagccttgccatatgcaaagtgagattcgacactagcttttttgccagagctcacatggatcggatggattcagataagctcgtcgatggtttagccgagcacatgcacgaccgatcaatcgatctccccgttctcccgtgtgcatggcatctagcaaacaccgatcgagacatgcgcgccaccggatgacagatcgaacaatgcatgttaactgtctgtgaagcacaaaataaagagggaaaatgacatgaagcatgcatgtcagagctacaattctagctagcacagatgaaaggaaaggcttgatcgatcaatcatacgatcatatccacgaattaagatgctgcagtgaattaaatcaaattgaaggagctaccgatatgattgaacttactggtgttcatcaagctgcattgacaattagttatacctgcagatgggtcgttgcaggaccaggagatagcaatggtagctaattagttataagatgaaatatggatcatgtatcatcattatttctttagaagcaatacctgctagctggctgcctcctaggtaaccataacaatagctcaagaagaaaaggcttcaaaatgtgtcatgagaaatgcaaatgttattgctaattaatccatgttgacagttcttgcatgtacatttatatatccagctgcatacacgccagacaactccagattaacatatatattagcatgttcttttctcaatgttcagaaaaagaaaaaagttccttatgatcctagaccatgcagcacgagtagccaacataataaggaattctagataaatgatgtaattaacaaaaagaggaaatattttggcttcagtcaacagtatgatcaacttggctagtcttcaaacagctagccagatgcccatatcgatcgcttggaagaacagtcttcacagccagtcaataatagagagaattgaagagcgaacccggccacattcccacaatcattatctgttcaacaaaagaatatagtcaatcgcattgtttttgttaatcaagtataacgaaatgttaacaagtgatcataaaaaaaacacgaaagtgtctcatttgactatttgtcaattttgagcaataactgtaatatctgaaatttaatgtgatgatacacttgactagtagataaatgggcattggtagcgcataatatgtatcttaactggtaaaaacttatgaatggcaatgtgatccatgcatatacatagtttaatttgctgtagcgacgagtggaagttcattacttccattacataaaaagagttaaaataaagttgtgaacaatgcttaagaacaatatatttatcaatatgtagtcaaattttgcctttatattttaaacaaaagaaatattaatggagatatatatgtaccaatctgaatattaattgaacacgttaatctatctggacctattaatttagcacacacgttgatctgcatttcactatagtatgcatgcattgttcttgtttatttagaaaccttgcataaatacaatcaattgccatgcatatgtccatagacaacataaaatgtccacttttatgtttgctgaagtgatttacatcccttattgagaaaaaaggagttattcgtacctcttaaggaccatataatcactcttaagtaccgaatactaaacatatgcatatgtagatctgaaaatgaatacttaagaatgacataaataaaaagcatatgcatgttttcaaaattatgttcttacaaaaatgagctggatcgacatgcatgaagtttaacaaacaaaggtgcataaaccttgggaaaacacctgacacccaaaaccgttagaaacttaacttgaaagtctctctatagagattatatatatctagccatttagatagttaattaagaaatcataattcttccctacctcactattacacacacccaaaaattcagggaagtgagtacatcgaactttgccagagcaaatagttgaaactaaataccatgagttcttttaaacaaacaagcaagatcgaagaaaattaattgaaggaaattaactaaaccacatacattgtgtgacagaactgtgacctgataattaggcatagattggaatggcttcacatcatcgcaccactataattagtaagtatgaaaaatatattttgctcctaggatttgccaacttatatatctcaatgacaccccccccaacacacacacaccccttttgtgacactgtgacttgataattaggcacgcattggaatagcttcacatcatcgcaccactataataatgtgctgcttgaagatacatcgctgagttttgaggcggaacctcaccacctccaaggtaggggtactggtaggagtaattagcagtgacaacattgatcacaccatcactcagtttcatcccaggtacctcgaagccaatatgagggttaaaagtactgccgacgacacaattcataggtgtcaccacatggacaatattaacgacgttgggataattagcggcggcggtaaagtttgatgatgtcgttggataaaacgggtgagcctgaactggcaatttgctagtgccagaagttgcattctgctgcttgggcattgcaaggctcacctccacccactggccatagaggaagtgcctgtccttcttgagcgccctcgctgcggactcctccgacgcgaactggatgaagccgaacccacctaggcatcttcgtgttaaggtcggtgaccaagattgcacggtcgacctcgttgaatttgctaaagtattctttgagctgctattcggtgacggatgtcggcaagctgccgaggaaggtcttcctcttctggtcacctagactgagttgtgggccgccaacgggaggatttggttgggctaacttgacatccatatgggagaaaaaacagtagagttgatcaacattgtatgtactagaaaacagctcatgtgtccaaatataattagtaagtatgaaaaagtgtcgcgcacacaaacacacacacacacacacacacatcgagtgagatcgatcacccgacgaagaagagaagagaagatgagagcatgtgtgtgcatgacaggaccagatctggggtgtgtgtataccgtggtgccagcggaggacgttgcggtcggactccgcggcgatggcggcgtcagggttcacgaactgcacgaacgcgaagccacgcgcggcgcccgtctacttgttcttgggcatgtcgacgaaggccactgcgccggactgcgaaaagtgggcatggagctcagactcgcttgtccccagcggcacccctcccacgaacaccttcctgtggctcaccagcttcctccccctcgctgtccgtcgcctcccgctgctgctcctccattgtcacggtcaccgtcgtatccgcctccgcctccatgatctctcggacgaagcaaatgatcgagcgaacgcggtgatcagaaactgatgcagtccagttgtgtaagtgcgaggcaacgcgaacgcagagcttgtgtttttgtaacaaggcgaggagagatatggtgtggtcgtcacgcaggcaaagcagcctgaggatgacttacagttgggggcttgggcccaacgtctttgcctctcggggaaagcaagacgctagtggggaccacaacctgcagagccaggtaggggagaggggatgcgagggtcagcgctggcgttagccgtttcggcggttgatagccacgtggcgcatgcgtgtttgaattgcatatagatgcaacgagaggcgagagcgagaaacgtgagctgtggttggggtggtggtgtggagtgcaatattttaaatagtgggtaagacatttagtggttagcttgtcaaacagttatatcaggctaaatgggctaaacgtgagacgtggttggggcggcggtaaagtttgatgatgtcgccagataaaatgggcgagcctgaactgacaatttgctagtgccagaagctgcattctgctgcttgggcattgcaaggctcacctccacccactggccacagaggaagtgtctgtccttcttgagcgccctcgctgtggactcctccgacgcgaactggatgaggccgaaccccctgggcatcttcgtgttaaggtcggtgaccacgattgcccggttgacctcgccgaagttgctgaagtattctttgagctgctatttggtgacggacgccggcaagctgtcgacaaaaatcttcctcttctggtcacctggactgagttgtgggccaccggctgatggctttggttgagctaacttgacatccatctagggaaaaaattagtagagttgatcaacattgtatgtactagagaacagctatatagctcatgtgtccaaatataatttgtaagtatgaaaaatatattgtgtcacacacacagagagacacacaaatgtgtcacacacacacacacatgcacatgagacctgatggtcctacatgaagtaaaatttgtgtgagtggcaaatcgatcctaaactacaactacacgcaagcaggctagctacgtatcaaattaaaggtccatttgtggtgtaaattaaaactttgggtttgggtgtacacatgcaaaatgtgttatttaattttggagatatatattgaatttgcgggctagctacatatgaacacatatcctaagctacatgtatattgaatttgctcagtcccacgctaaaatgaagatttgggtgcacacatgcaaaaatgccatcctcacacgtctgaccttgagtgccctaggccctagcaagcacaagaagttggagactaggaggtgttctatatatgcacccagccttagtccgaaaccctatcatggcatgatcttccataatttaatataaaattaaaacagaatgcaattcatccgtaacacttgggcacaacacgtgaaatcaaacaatcccagctagctacatgtactcttgttgacgacgaaccacattagcaaaataagtcacaaagagagaaattagcgagagccatggtagcattcgatggaacctcacagcaaatgggcagcactcggcaaatcggcctatcgacttcaattctttggggctgccaaatccgtcttctatcagtcaatctagaaggcctaggcgctgccgaagtgcaaattcttctcttggctggtcacgcaaaacagagtatggatgacagaaaggctggagaaaagaggatggcaaaaccaaaagatttgcccactttgctacactgttgacgaatcggcattacacctcctggccaaatgcagactcacaaagaggatatgggcagaaattcagagatggaccaggactgaccttcagatggacaattgggaaaactgtcactcagtcgatcaatgttggaccctcgtagcggagtccccaagcaccccgcgcaggcccctcaggaccttggtgattttaatcccgtggaaaatctggtgcgaacgaaacgcaagaatattccgcaacaatgcatcggcgccgtcctcaattttgacaaagatcaaggaggaaggaagagcatgggtcaaagcagggggcttcaatcctgcaggagtttgtaattttgggagatatcacttaatacctatttttttttgtcttcttttttgcgggttcttgctctctttcggctaaccctgtatatatctcactaattttctcctgctttattaatatatacaaggcaaagcttttgccttctttaaaaaaacaaagagagaaattagcagcaagaactaaagttttcgtcggaatataaaaaaaccttacaatgccttaaatattaatcaattgtatgagcagaacgaatcttacttttaccactaatctataatcattacatctaaattatgatgcaattaaacacagctcagctacaactcgccagctacacgtaaatttatgataccaaggactcgtatatagacagaattaacagagcaccaaaagcataccatttctaatcaagctctaaccatcacttagttaagagagttaactaatactgcggtcacctggtcacggatagcaacgacgacgacgacagtactgaacagaatcaccaacccaccgcgccgcgagcaacacgatgctacgagctaagcccaccatgcaacaaagcaagaagccaacctcgtcgcaggaaagcaaaaaatcgacgatcccacgctctttcacttgcacccgggcgcggaagcaaagcatgcatgatgcaagaggacaagaacatgtaaatcaaggacacatcgagtgagatcgatcacccgacggagaagaagagatgagacgagagcgtgtgatcgatgggaggaccggatgatctggggtatgtgtgtgtgtataccgtggtgccgcgaaggacggacgttgcggttgggtcccgcggcgatggcggcggcggcgtcgtcggggttcacgaactgcatgcacgaagcgcttgttcttgggcgcgccgacgaaggccaccgtgccgaactgcgagaagtgggcgcggagctcggactcgcttgtccccagcggcacccctcccacgaacaccttgccgtggctcagcagcttcctccccctcgccgcccgtcgtcacggtcaccgtcgacgtctccgcctccgcctccatgatctctcgggatctctccgacgaagctagcgagcgagagagcgagcgagcgtgatgaccagaaactgatgcggccgaattgtggaagcgcgatcgaggcaacgcgaacgcgcgcggagcgtgtgtttttgtaatcaggcgaggagagacatggtgcggtcgtcacgcagcacacgcgacgcacgcagccaaagcccaaagccgcctgaggatgactgacaggtggggccggcgtctccgcctctccgggaaagcaagacgcggagtggggaccacaccctgcagggccaggtagctaggggaggggagggaggagagggtcagcggtagggatgcacgtgggtcgggccgtgttgacccaaggtctgagccacggtggcttgtggtgtgatctgatcgatgcctgatggtgcattgtcagttcgttcgttacctgcagatacgtcaggaccaggagatagcaatggtagttataactagttagatgcaatatggatcatgtatcatcattatttcttcagaagcaatacctgctagctggctgcctcctgggtaaccataatgatagctcaagaagaaaaagcttcaaaatgtgtcatgagaaatgcaaatgttaccgctgattaacccatgttggcagttccttcatatacatgtatatatatccggctgcatatacacgccagacaacaccagattaacatattagcaggttcttttctcaacgttcagaaaaagaaaaaagttcatatgatcctagaccatgcatgcagcaggtacgagtagccaacataatcaggaattctagataaatgatgatgatgtaattaacaaaaaagggaaaatattttggcttcattcaacagtatgatcaacttagctagctagtcttcaaacagctagccagatgaccatatcaatcgcttgggaaacagccttcacagccaatcaataatagagagaattgaagagcgaacccacattcccacaatatcgatcaggagttttgttatctgctcaacaaaagaatatagtcaatcgcattgtttttgttaatcaactataacgaaatgttaacgagtgatcataaattaaaaaggcacgaaagcgtctcatttgactatatatatttgtcaattttgaccaataacagtaatctctgaaatttaatgtgatgacacacagttgactagtagataaatgggcattggtagcgcataatatatatcttaattggtaaaaacttatgaatggcaatgtgatccatgcacatatacatagtttaatctgctgtagcgagaagttaattacttccattacataaaaaaagttaaaataaaattgtgaaaaatgctttagaacaatatatttatccatatgtagtcaatttatattttttatgtagcaacagcaggaatattaatggagatatatatgtactaatctgaatattaattgaacacgttaatctatctggacttattaatttagcacacacgttgatctgcatttcactatggtatgcatgcattgttcttgcttatttagaaaccttgtataaatacaatcaattgccatgcatatagtccatagacaacataaaatgtccacttttatgtttgctgaagtgatttacatccctccttgagattaaaagaggagttattcgtacctctatcaaggaccataaatcactcttaagtaccgaatactaaacatatgcatatgtaaaagatctgaaaatgagtacttaagaatgacataaataaaaagcatatgcatgttttcaaaattatgttcttacaaaaatgagctggacatgatgtttaagaaacaaaggtaaataaaccttgggaaaacacttgacacccaaaactattaaaaacttaacttgaaagtctgtgtatagagattatatatatctagccatttagatagttagttaagaaatcataattcttcccgacctagctcactattacacacatcgaaaaattcagggaagtgagtacatcgaacttcgccagagcaaatagttgaaactaaataccatgagttctttaaacgaacaagcaagattgaagaaaattaaatgaagtaaataaaccacatatattgtgtgacactatgacttgataattaggcatagattggaacagcttctgagcttcacatcatcacaccactataataatgtgctgcttgaagatacaccgccgagccttgaggctgaacaccaccacctcccaagtaggggttctggtaggagtaattagcactgacagaattgctcacaccatcactaagtatcatcccgggtacctcaaagccgatatgagggttaaaagcattgctgatgacgcagttcataggtgtcaccatagggacaatattaacgacgtcaggataattagcggcggttgtgaagtttgatgatgtcgtcggataaaacgggcgagcctgaactgacaatttgctagtgccagaagctgcattctgctgcttgggcattgcaaggctcacctccacccactggccacagaggaagtgtttgtccttcttgagcgccctcgctgtggactcctccgatgcgaactggatgaagccgaaccccctgggcatcttcgtgttaaggtcgatgaccacgattgcccgattgacctcgccgaatttgttgaagtattctttgagcttcttttcggtggcggacaccggcaagccgccaacgaaaatcttcctcttctggtcacctggactgagttgtgggccgccggctgatggctttagttgggctaacttgatatccatctggggaaaaaaccagtagagttgatcaacattgtatgtactagagaacagctcatgtgttcgaatataattagtaagtatgaaaaatatattgtgtcacacacacaaacacacccgcgcgcacccacacacacacgcgcgcgcgaggcctggtggtcctacatgaagtgaatccatgtgagtggcaaatcgatcgtaaactacaactacacgcaagcaggctagctacatatcaaattaaaggtccatttgtggtgtatagagtcaatatagaaataaaatttagtaataattgaaattcaaaataaaaacgaatattgaaagaagagtatagagtcaatatggaaatacaatttagaaataactgaaattcggaatgaaaaaataaagaatattagacgaagagtatagagttcatataggattacaagtaagaaataattgaaattcggaataagaaagtaaggaatattggaagaagagtataaagtccatataggaatttagaattaattaaaatttgaaataaaaataataaaattaaaattagagtttagagtccatatagaaatataatttataaataactaagatttgaaattataaaatatatactggaagaagagtacaaagtccatataggaatataatttagaagttgctgaaaatcagaaataaaaaaataaagaatattgaaatatgagtttagagtccacatagaaatacaattagaaataatgaaaattcataattaaaaaataagaaatattgggataaaagcctagagttcatataaaaatacaatttacaaataaagaaaattcctaattaaaaaaaaggaatattggaagaggagtttagagtccacacatgagtataatttagaaataactgaaattctaaattttaaaatgagaaatataggaataaattttataagtaatagaaatttagaattaaaaaataaagaatattggaagatgagtctaaactccatatagaaatataatttagaaataaccaaactccgatactaaataattaataactatcatgtatatacaatacaatataaatattatacattggtagtttggtaaagttagtacaaaattaaaattatgttattattttaatatattttaagaataaaataagaaaaaatatatgctattatataagagaaaatataaggatgctcgctgcgcaatttctgtgggccactatgctagtttaatataaaagtataatgtaattcattcgtaacacttgggcacaacacgtgaaaatcaaacaatcccagttagctaataataagggacaccttttactcctgtggacgacgaaccacattagcaaagtaagtcacaaagaaagaaattaacagtaagaactaaagttttcgtcagagctaaaaataactttacaatgccttaaatacaatcaattgtatatgagcagaacgaatcatactcttaccactaatctataataattacatctaaattatgattcaaacacaggtcagctgtaattcgcagctacacgtaaatttatgataccaaggacgcatatagacagaattaacatatcaccaaaagcataccatttctaatcaagctctaaccatcacttagttaagacttaagagttaactaatactgcggtcaactggtcacaggtcgacgacgagtactgaacagaaactaacccaccgcgccgccgagcaacacgatgctacgagctaagtccaccatgcaacaacgcaagaagccaacctcgtcgcagcaaagcaaaaaatcgatgatcccacgctctttcacttgcacccgggccgcggaagcaaagcatgcatgatgcaagaggacgagaacatgtaaatcaaggacagatcgagtgagatcacccgacggagatcgaagagatgagaagatagcgtgtgtgattgatgcatgagatcgatcaggaccggatctggcctggggtgtgcgtgtgtataccgtggtgccgcggatgacgttgcggtcgggccccgcggcgatggcggcggcggcgtcgtcggggttgacgaactgcacgaacgcgaagccgcgcgcggcgcccgtctgcttgttcttgggcgcgccgacgaaggccaccgtgccgaaccgcgagaagtgggcgcggagctcggactcgctcgtccccagcggcacccctcccacgaacaccttgccgtggctcagcagcttcctccccctcacgatctccccctcgccgcccgtcgtcacggccaccgtcgtctccgcctccgcctccatgatcgatctctcggtctctccgacgaagctagcgagcgagagcgtggtgaccagaaactgatgcggccgaatggtggaagcgcgatagaggcaacgcgaacgcggagcgcgtgtgcttttgtaatcaggcgaggagagatggcgcttgtcgtcacgtagcacacgcgacgcccgcagcagaagcagcctggggatggctgacaggtggagcccgcagcagaagcaaggcgcggagtggggaccacaccctgcaggggccaggtaggggaggggacggggagggtcagcgccggcgttaggcgtttcggcggttgatagccgcgcggcacgcgcgtttgcattgcatgtcgaggcagcgagagcgagaaacgtgagccgttggcgtggtgtcgtccgcctccgctccgctccgtcgaggcgtcgagcggtttatggtccgctctgctggagttagcggtacagagactgttttggggatgcagatgtatgtcgacattggaaactgctgatgacgacgacatataaatcacgaatgttatcattagagacgagggaataccgggtagataagtatatcagcttcgaatttcgtatagcactagagtaagaggggaagtgtgtcgagttttgcgtagtgccagcttaaatgcgtcataagatattctaagacatttgacagcaaatgagaggatatcttgcattcagaatccagtaagtatgagtgctgcacgctatcgtggatatacagtgcacacgcaggtgacatagtgtatatatctatgtacaaaaagagagcgaacataaatacatcattacatcaacatgcaattaggatgaatccgtcactcagcaacaacacggttccctttgctgtagctgcagagtttcgatcattcagtaacagttgatgttcttcatgaagctagccgttgtcttgtgtttgcgacattgaaccgagggaactagtactggctgcgctgcttaagctagccgtctctcaatcatcctcttcatcctccagatcactgaaggatatgtcttcctcctgccctgctgaattgacgttgcctgttttgctggacacaggagccacatccttcagccagtcctccacctctttatcatcatcgtccgaggtgatatgcagattagccttctcagagtcagaaggtatactcttggtctcatttttcaccaccagctcttcttcaaccacggacttgtctattatttccacctcagcgactgaaatcggatgcttgtcagcctcaaccacattcatcggtacagaagttgcttcttccaatgaaggtgcttcagacattccactgttgtcacctttggtagatgcaacattccagttttgtgatgaaccatcatcaggtcccagccttttctttgtcggtgaactttgcaataatacttctcttgcttttaggatctgaatgaaataaaagataaagaaggtgaaatgcagcaaaagtgtatgcgcaatggaccttccagtggagtaaaaacaatgcaataaggattttctgttacaatgtactccctgtatcccacaaaaaaaatcaaatcctgggaaattttttttttttttgggggggggggtgcgagatagggtactaattacaagaaaattgctactgcatatatactgatagtaacttaacaacaaaatatacagtatgatcgacaatctatacatctgttacatgttctcaacgtgagctataggggcatgcatacatggactatatgattagtaatcaaacgttacacagccttcacatgtgctgatagcatacataattaaattgggaatgcagatctacatgcttagatgcataattccgaacatataatataaaatcagttcaaaatcacaaatacgaaggtctcaagcatatcctcctgctgttctggatactggtttagagttctacaacgtcactgatatttccctttggaaggctatgatttttcagcactgccaagtgtttccaccaaaagaattgacaagactggatatattcaacatgataattaactaaatatatgcctgtagtttagctttgttttgtcggttgaaacttgcaacaaattcttgatgctacaatgagaagtgaagaatgcccaattttgatgctataatgagaagtggagcccaaatattgattgtacgcttacacaagcataaaagtaatcctctatgtttatgctcccacactggcagccacaatctaatgcaacttttgggcttcggtaacttacattcttaagttcatacatagttacattctccttacacacctgacttatcatagtttgtaacttggaaacaagatataccatttggtaatatatatgcatagacggtttgttaaaaaaaaaaggttatggggctatgtgtaggaaagcatgcattgtaacaagttgacatgataatccgtaattacttaagaatgtttgccataaagacagaatatgctgaagagcagggaatatacctgtggcgttgaaagaagttcagcatcttgcttgctgagttttgagtgaagaagcacaaaatagatcttccaaaagcatgcttcactcatattggtagagcaaagctcggtcctaagatatgacaagcttggaacaacacgctctatagccaatgcatgtccatattgtgtgtctgacagttcaaaatctgtacgcaagaagcattgcagtaagcaaaggaattgaggaaaccagtcaggcacgacaagtaaggcatgactgacatgatggaacaatatacatgcatggcctccatttaacagtaattccctacatattgaagatggccatatgcatatgtaacaggttaacgagttctagccattccaatttccagaacacagttgttacctagtactatggcaagttagaaccaaaaggtataaaagcaaataaaaataggaaaccatggtcagcatttctgagagacaggggcaagtagtgatcatgctataaataacagaacattagaaattcatatattaaacccatgtaaaaaagctaatgtataataaatttgttggatgaaatatactttgatcccattagattttgcacatgtaatcacatcattagcgacgttgaatccttggatatagctagacttccacaaagtgtagggagcattcaactcttggagctatttgaccgaaatagtaacactaaaggttaaagtgatgattcgacagttgaattaatttgtgacaaaacccctattctgatgttgccttgttggttaggtgattaatcagattgcagtgttgtatgtgtgttacaagtttgtgtaatagtttgtccctcgtttaatttattgtttctcaatgtctccggtgaagtcgattatagcatacagcctctgataaatgcatagttaatactgatgtatcagcagaaatgatggtttcatacagttcttacatgtcaagtgatctaagtctcattagacatttttacaaaaagcaagattactgaaatgcgacattaaggtttgtgttcgatacttttaaaccttccttaattacaagccattcctactctctttttttcattttggcaaacgaactttctatttactaattatccctttgaattaatacaatccaaatgtgaaattttgaactacagccctagcgatactagagtaaaacaaacgattaacccacctcagttcatgtacctactctgtctaactaacatcagcaaatgcaaccacatgaagtaataaaagtttctattaacatgaattacaatttcctggcaaaccttcatacatgtaaacaaatgaactcaatttcaaaataacatgatcttaagaattgagtgccactcttaattgtaagtaactacccttcccacattaaaccttagtaaataaacatgactggagccaagctgctaaaattatgacagaagatcccacaatcttagtatcagagcgaacagagcaagaagcctaagcactgaagcaactggaaccaatggtctcctaaatgaatgtataatagaccaaaataaccaatccagcattctatgcaagcaaaccaaagcactacaaacgctgaagagatccaggaagagaagtttcatactactgcctcttaccatccgcgtgccggtcgttgacaaacaaggggaagtcgagccacgtctcgggatgggtcgagatgtgcctcacgaactccaccacctcctcggtcacgcccacagcctcggcatcgtcgtcgtcgtcgtcgtcctctccgggcccgaacggcaggagcgacgaggcgatcttggagatctccgccacggcgttggcgttcgagagcaacgagattccgctcctcaccctgcccccgatctccgccaggtcgctccggatcccggcgatccgcggcgaccgagccccatcctccccctcccccaccgcccccgtagccgtctccgcggcttcggcggcgggcgcaggcggcggagcgaggaaggaagcgacgccccagaggccgcgggtgagggagtcggtcagctccgacaagtcgcccttgactccgccgccgccgccgctcgggg

SEQ ID NO: 42267 - DNA, 2668 bp, Oryza sativa
ccgctgcctcagctcgccgccgtctccccccacagatcggcgccgacccggaccggacgcgccgctaccgccgccctccaccacaacgagcgggcgccggcggggctgtgcttgacgccgccgccgccccctcagctcgccgccccttagctagcccccgccgcacgcgtactcaccgccgccgcacgcacgcacaagtgagagagaggtacgcgcgagtgagagagagagagaaagagtcagaatagggtttggctttggagtgtatttttgccattaggaactctggaaacattttcttttttttttaaaattgaaccttaacggagtcagcgaaagagggtcagacggaagcttcgtactcgaaaaggagcgtcaaataagcaaagttcaaaaagtagggtcaaatcggcaattacagttcaaaacaaggtcaaataagtaattgcccctaatttatattacatgtttcgggttatgtatttattttcatattgatgtttgtgttcaggtacctgtttatagtgcgcagattagtagcttaggttattgtctatctgtgctctatatgatggcaagagagaaattgtagtataatttttcaaaaccagtacatgactatctgagatgtatcttttgttcagggaagttcccagcgattttttttgctgggctcttgctcagagcaagtgttcttgtccagaattgaaaggagattgcaagcacagaataactttcccaaaccaagaaatcctcagttttcgtgtgcactcaacaacacaattccttgttgacaaactcatcatcaactgttcctcaaaaaagagggaaaaaagcatatcacaatctgcatcaacctgcttatacgaagcaaaatttttccctcactttgtactattcaacagcatattctacaaaggttgagtatgagaaaagtaaaataacacacacaaaaagaaaagcgagagaggagctaacaggctctcagttttatactctcctgctaaccacaccgcaatccaatcaaagtctacgattttctaatcaattctctccacaacagcaacagatgtgtgaagtagaatctccatcgcggccagctccagtacgctggccttcattgtagaaatggatctgcaaattgagaccgcatgctgcagcacgggcagctcttctcgccaaaacacacaaaacaatgacatgagcagcagagcatgagacctcctgactttgcatagaattctgctctaggttgtggccgctctcactcgctctaaacgacagcggcgaagaagatttggttggtatcctcatccttgtcatctcctgtaaaagggacccgttacagtcaaattccagtcacgaatcagtaacaaagcatttgcaactaacggttgcggtcagtttccaatcacgaatcagtaacaatcgctgcaacgaacagcagagcaaggtagaagatgacctgtgtctggcccaacatgcgccgtccactcatcgatgatctgcaagcgcgcacacaggttggtaaaattatgttagatttgtcttgacgaatgactggaggaggggacggtgggggtgaattcacctggttgagattggcgtcggtggcggcgtcctcttcggacatggggggcagcccggagaggcgagcagccgctgcacggcgctgcgctgcaccgcgaggcttgtccgcattgcgtcgatcaactcctgtgcacgcaacgaacactataggcgtcagtcgcggaaaaaaaaaaaagaagggcggagcccgcgcatttggtggtcgattcgaagttttgggtaacctgcttctgggtgagcagatcgcggcagagtcccttgaccgccgctacctcttcctggatccgcttcagccgcgccaccagcttcaccggattcgcctgaaaaaaaaaaacgcagcacgcggggagaccgcgaaacgcatcagcctcgccgcgcgggggggtgggggagaatccagcaaggaggaggggctagcttactgacgtgatccgggtaggcggcgcggaagtcggcgtcgaggcggcgctgcacgtcggcgagggtgctgttggcggcggcgagcgtcgagagcacttcgttcaccgccgcgtggtgccgcggccgccgacctctcggatccgtggccatcgcgcgctcagataggctcggcgacggcggaggaatccacggagctcggtgcggaccgcggacgacctcgatggcggcggtggagttcaaaattggagttgtgaccgggaagaggaaaaaaaatgaatagggtaactgccactggggaagtgcccaaggggaattggaaggtgactgacagaaggggcccaccaccgaacggggttagcagcgcagcagaaatagcatgccgaaatgtttatgggagcttcagttgcaacttctccgtataagctccactaagattgtgtttgagaagaaggggattgagaaaattgaaaagatatataaaacgagataagccattaactcataattaattgagtattaactattttaaattttaaaaatagattaatatgattttttaaagcaactttcatatagaaattttttgcaaaaaacacactgtttagtagtttgggaagcgtgcgcgcggaaaacgatgtgcattctcactccttatcac

SEQ ID NO: 42268 - DNA, 2939 bp, Oryza sativa
gttttttgcaaaaaaaatttctataggaaagttggtttaaaaaaatcatattaatctatttttgaagtttaaaataattaatactcaattaatcatgtgcgaatggcttacctcgttttgcgtatcttctcaatctcctcaatcctctccttctcaaacacaccctaagggtctgtttgggggagtttctaactactgcaacttcttccaaaatcagaagctcttccgaacagtttagttttctggattctacaagtacagttatttagattctaagaaactgtacttgtagaatccagaaaatgaattagaagctagaagctgtgaaatccaactttttcagattctcagaaactggctactgaccaattgttttttagaattttaagctcccctaatacgtccaaggtattgttggaaattttaggactctatcagtaaattttcctgtctgtaatgttgtccaaaatagtttattttctctgtaaaacgcaggatcgacgatactcacgaatgtgtactggtagtggtaggcccgcctacatttctttttcgggctgtttccttttcaattatgaaaattttatggttcttaaaaaagtatcttgagatatctaaattttacataaattttttacattgaggtacttatctagaggtaccaaatttcacaatagaaagtgtaataacttttagtaacttttcaagaatggtaaaattacccaatgaattatggtccacgtactcttagccagtgaaaaaaaattatgtatatataacttttatacttacaaacttggcacgaattaaaacaattataaaagataaggcaaaatatacatacaactatacaagctgttttaaaaaacagcctaccaaaggggaccgaatttagaccgtgtaaactgaactgttttggtctgctgaaaaaggaaaaacgagatgatcatgaacccatgtaggaattcaaagaataaaaatgtaaaagccgaagactaccgggattatggccgtgtttagttccaaaataattcttcaaacttccaactttttcatcacaacaaaactttcctacacatataaacttccaacttttttatcacatcgtttcaattttaatcaaatttaattacaattttagtatgacctaaacacaccctaagaaggaatgagtttgatctaatcgcacgaatcaatcatccactagccttgtctacctcctccttggcctgcgcactagcttcttattctgtactctctcttaagaccaagtacacctataaatacatatggaggagtgagaaataaatacatgtggagtgagaaaagaagatagaacaaaaacgagcagtacggaattcaaatatattacgtttgtatgagaggtgggttaagtattaattgtgcgatatatatttaataaaataattatatgggtagactattagagtggatgtaaatgatgcgtcaattttttaaagctggcatttgactatattatgaaacttgttccctcacctcctctcgatgacaacagcctcgtccgctgtgctaaatcaagaccgaaccgaagcttactataggaacaaccaagaaggttatttattgcaaggtgaccgtcttaagacgcaccgcgaaaaggaagggcgcgatgataggaacatcgttgcagctagagtgggtgtcgttgggcaggctgagtggaggatttgtctcattgaacccctttaatgcattatatatggtcttcctcattgtatctctggtaatgtattacatctgtatcagaatataagaagttttagatttatatatagttaatgagaatgttgattggcggagaagggaaggtaaatggaaaattttgaatggtgaaggattatgattggttgagaaaagaatatttgtgaagaagttgttatattttaaataaattatgaaagctatcagttgttatattttaagatggagtgctttgcttaataaaaatcggttggcatcttttcgccagcccggaaaaaaaagattgagcagacggtttggctttggacaagagttcagacgttttatttctttctgagaactgaacagtctcttatctctgggaaaatttaacacgcgcattttgagtgattgtcttggtgcgaaatgtcaagctctggattctcgaggacaggtactcttcttcaagtctcaaaatgaaaaattctctgtgtcatcgaaacgaaatggctttacagaaacgcacaaaaatgaaaatgtcctggtaaagcaaagcttctcatcagtgtttcacttcatcacttgctcctagtccattccttaacgcgctcaacatttcttcgcttttaacatgatgtgacggcggtgtgtttttctgccatttttcgccttaggtcttcgcaattccaacatcaacagccagcttacggtaacttctctcacgggcaagaaagattagcatatagcatcataaagaactaataacatcgcatttcttccaacagatttgatgactcctttttaccctttccactttgcagttgcagcgctgaaacaagcaactgcgacggcttagctgaacgtaataacttaatcacatttccacacacactgttaacttgaactgactcagacaaggtgcacctcaccgctcaccgatctttacgttttcgacgaaaaccaatcgaaaaccataaaattttaaggttccattatgggatgaaagtagactccaagtaaaatttccgaattgttctcaatactttaagattaggggatttctctctcaggaatttagtttgaaacagtcaaattcaactaaaatttattgaatttaccgaggaatatcctaaattctcccgacacagctctgctcaaccttgccatctcgatcaatcgatcctatcccaaaaccgtggacgaaatcgagcaaaaat

SEQ ID NO: 42269 - DNA, 11116 bp, Oryza sativa
ttattttagatcacatttgatacatttttttttcacttttgtctgggtagtatatccaatccaagtatccaacttttcctcatgtacgggttcctccgtaaaaaaaaaaaagctaatctagaagaggatgtgacccctcctaccacaacgaattaggattgtattaggaggggtcacatcttcttctagattggcttttttttagggggatgaagtaaaagagaacatccgcatgagggtaccgaccgtaccgtcttcttgagactattgatgtacttgcaaagagagtttggataataaatggtggtttaaagtgttgttcactcattttattattcctaagttaaagcatttcgttagtttatgacattttaacactatgcgtaaggtttagtgatttcttctttacaaatcattgtcatctctcttctctccttaagttatattatattaattgtttctagcactccgagaattaatttatgttctacattatctttactatttctcttttcccatgatgccacaacaactaatttttaggttttttaaatgatcaatctatgttctaaattctctcttctatgaacctatatttccgtggcaacaagtgaagttccatctggtaaccaatatactgaatattctactctctccgttaaacaaatataaacactttttaactttaacgatcaataaaagatcataaatattgatatcgtgaaaatggtgttaatagtcttatctttaaacaaactattataatatgtaatataatatgagactctttttattggaaataatttggtgaaaatggcatattagaaaccatgtcaaagtttgaaagtgattgtaatattgtttagggagggagggagtgtcaatttttagtttgatcttccacgcacgtggatgacgtggattagcccacgtgtcaggtcagatcatgaccatcatttaaacatgctcaggcagggagccaagaaacaaccgtttggacgcctcacacacagacggccacacacccatgcgaattggcaagtggcaagcggatgcaaggcgatatggcggccggcaaggcggcaaccacggtttctgacggtacacggtacaccccattgctggttgattcatccattttgtgcattctctaagccctcttattagttttcagcattatcttctaatcactaattgtcgacgtttgatgtcacgatttcggtatttgcatggtatggggatcgttggtactaggatatacgtgagactgaggtaaaagagacggagacgaggatttttatacaggttcgggcccctgaattgtcaggtaataaccttacatcctgttggttgaagccagtattactcttattcaccataatcacactagtacaatatttggggtagcgtatctaactgttgtcgacatggtagtctgaaggtctgactcgtagtcgacaacagggtagccttcctccttaagttcgtgcccggcgagatcagagatagcgctttcgtctctcctgacagtacctagaaacaccgtaggggactagccgtgcctatctctgaagtcgatatctggcgtcttgtcttagcgtgtgttggcttgtatgttgtggcttctgtcttgatctattgttccgtagattgtggtgggtgttgattgtctcgggtgttgatcgtcccctctcctcctatggggccttgtatttatacccataggtgtccctttgtccaagtagaactaaggaaaccaatatggatacaattcgagtaatccttgttgttttcatgtagaactcaggttgtctttccttatcaagaacttctcctatatccgcaggttgtttccgtataggacatggtatgtggtgggtcctgccgagatttagtcaattactattaggtatatggtatcataaccctgacactgacactaataacatatgtatataaaatgtatccataaatactttttatacaaatttatttatttattttagagaaggggatttttgtctggcatccgcatccaatcagatatacgaggtcattcaaattggtaacttaggctatgttcgttgctctttgttcccaaccatttccctcgtgttccgcgcatacgcttttcaaactgctaaatggtgtttttttgcaaaaaaaaattatatatgaaagttgcttaaaaatcatattgacccatttttgaaaaaaaaaactcatatttaattaattatgcgctaatggactgctccgttttttttcggagggaatgagttcccaagctagagaaacaaatgcggcgttagtcccgcaaacaactcagtctgaaatttactgctaaggagatttgaactaaagactttgggatatatcaatctaaaattcactcatatgaagatttaaactcaaaacattaggatgttactcaggtcaccataaccaatagattatatcccttttcacccttttatactgatacatcgtacgatttattatccgcataacagtcggccagcaagtagcctactagacactagcaccttcgacttaagtttactgtagctgcttgcttagctggaagctgcttggaggctgtgaattgtgatgtacaagttcatgttcattgcaaccggaaaagtactcgctgactttagaagggaagaaaaaaggaagcaagttgaagcagcggtattaacggtacaagggaaacggtgtcatgctcttggattctactaattcaagtgcttgtcgtgagcgccgtccttgtagtttcttactgtatctcgtaagcccagtccttgtactaatggaactaggagtccaggggaatggcgtcatgcatgctcttgtactaacaattcagtaatcttaattcaaattctgcaatatgtgatactgtaagcaacaaaccgattgaaattcccgtgaatttttgaagaattatgcatgttcggtatggaccctgccttacggtcaatatccacatcatcatattcctgactagggcagagtttttgttatcttaactcatattcctggtgttatctggaagacatatcactaaaccaggtgcagagtgttacaaggacactaacctttgctgctcaattttactactgtatgtcattatcggtcaaagtacgaatagtaaaatgccaatttatcacttgtctgtgatgcatgagcataagatgagcttggacatgtactacgaggaattcaattggctgtcatagatttccttagacgacgcgttccgcgaaatgctagctttagactctgtttagatgggactaattttaagtatctatcacatcggatgtttggacactaattataaatattaaacttagactattaataaaaaccatctataatcttagactaattcgtgagacgaatctattgagtctaattaatccatgattagcctatgtgatgctacagtaaacattctctaatcatggattaattaggcttaaaaaaattgtctcgtgaattagctttcatttgtataattagttttgtaagtagtctatatttaatactctaaattagtatctaaatatatggactaaagttaagtccctagatccaaacaccaccttagccgatcattacggtgatgacgtgacgacttggagatgacttgtttttttaaaaaaaagcaaaaaattgacgtgaagttttgtactctactgactactaataataggctatctttagttcagtgtaaagtttggattttggttgaaattagagatgatatgactgaaaaattgtgtatgtatgacatgttgatgtgatggaaaagaactgaagtttgtatccaaacacagccatacactaacactatgcaaccataattctggaagcgacggatatggaacaaacgattttgatggtgaaaacggacaaacggttatttaattttgaatatagtatgcaggatatgaatcactcaaccaaaggtaaactattttgcttccgtaaaatgaacagcacgtagctatcttatctgctccatttttcttcgcgcatggtagacatttctcgccgctgcgtaccgcccacggttattttgaatatttttcagctgacatggtacaatatatgagccgtttttttcaagtgctcgtcattgtccgtgacaattaatctgcatttgtccatgattgatatatatgtgcagcgatttgtagcgtttagtcatcactaagttcactatcgatcgatgtacgctcgctgatgcctcacccgaagcaatgaatcaattggcgtcactgtcggcgacatgcgcctctgagccattggccgccgtttgtcttgctgtcgttgtaccgtactagactagtctgagattaattacgtgacatatactacatgaatatttgccaatctagaaagtatgtttcttttcattttgtctggtcatatgtagagaaggcaaagacaatgtactacaccttctaattgtcaaatggcgtcgtaccgtcgcgtgaacgaagcagaaaaatgagtgctggacttcccgcttggaagatcaaccgaacatttccattaagggtctgttcggtgagctttacattctaagaaataggatctgaaaaagctctgaaacccagcttctccagcttctgttttcttagttcattttttagtatatgtaactatagattctcagaagttgtggactgtttggggcagcttctagcagaagcagcttttgggctggcacaagctcccaacagggcctaaatctcggtcttcacagttaagctagcaacaactcgtctcgactcaaaataaaccaatctaaaaaagaattagataatctaagacaataaatctggacaacctctaaactccatattacaacacttacacctgtttaaacatgattacgatttttgcaaactgctaaagaatgtatttcataacaaaactttatatatagaagtggctttaaagtatcatataaattcatttttcaagtttgaaataactaagactcaattattcatacgaggggatgacccctcgttgtttgcatacactcaaatagtttataaaaaaaattgagaagatgtattatatgtgatatatcacttcacaaacattcaacttctacatatcacaacaaaaaaacaaattaaattatagctagttaacgtatattcacaatcaatttttttgcgacatgtacaagttgaattttaagttgcatgtttatagagtgatatatcacacgttaatacatcttcttattttttttcataactatttaagtgacattgcaatcaatgacggacgtccctcgaaagtttaagattcactccctatatgctaataacttttgttttatgtacccgcacttaatttgctttcggcatgttaaaacgggtccttaatcatgtagatttacaaaatcatacttgtcacgcccagaaatttagcccaaatttccagactattttgtgtattaaatccctgtccaggaccagccagggtacacaaaacgacaagtaatatacagttccaaacgtaaataaagcgtaaaatacttacagaagaggcacttagtcttcacaccgaaacaaaagcagcagcagcggaaaaggcgatcctagcggggcttcagctccactccacagacaaaactcaactggggtctgagccttggtcttctaacttcgtcttcagctcagaagcactacacttctgaaaagggggaataatagcaaggctgagtacaaccaccgtactcaacaagccacaccaacgatgcagacgtgcaaggggaacacaaggacggtttgtggctatttgcataaaggcggttgtaaaacattttattgagcaaaacagtaaaacagttgagtaattaaagtaatattgaatctgcactgatcaacgctacaccacgttgaacatgcccaaccaacccacctgaactacagtgcattgggtcgatttattaaggtgggactaatcacggtgaatctggtcgaccgcccataaccgcgggcacggctattcgaatagttttactctgatcagaggtgtacaactgtacccacaagacacagccccacgacacgtttccgtgcgccggcatgccaccacgacataccggaaagaggccgtgacaggacccttcgcataaccccctctaaccaagcacaccacacctcaggtttcacccccactcctcgcaaggcagcgggcagtcccctctcgtgcctaggtgaatccggaagccgcataggccgtcgcagggcccatccaaactccatcacgcccacccttgcctggatgcgtcggctagaggaaagctacactacaagcccagccgttgcccacgctggcttgtggtaagtacgataagttcttccagggcatcccgcgaaccggtccttaattgccatgggtgcgactagcaaaaccatgcacccacagcccaccattcagtcgcattttagttggataattacgaccatgacacatggtcggatgtctcgagcacgcagctcgtcatgtcatgatactaggaggtctaatactgcaattatcccatcaactgagctagtggtaattaagcatggctaagcatacagttctagctaggtcacataagtaacatgagctagtcgatttattacccaatgctgacaaaggacagatagcaagtaaacatggcacaagaaagcaaataggtaatacccggatcccatgtaattagcaagacatgcatgtttatttgcaaacggtaaaacatttataaattgggatcaacatgctcaaggggaatgtgtgacttgccttgcttcttcaaacaatcttccgaactcttttcctcgcgaccgcggacttccgaaatgacggattctacacgctggcacgcaaaacgaggaaaaactctaataaaaaccaaggaaacagtacataaaaactaaacaaacatgtagagctcaattttagatgaattttgcaagttgaatggctcaattcggagttcgaatgaattagatatgaattttagaagttttgagccattttaatggatttctacaattattaccgatttattgcgcaattattatttaatttttcaaaggaaaaagcttaagcgctgacgtcatcaaagagggccggctgccgacagggcggggccccacacgtcagcgggtcaagggtatcggtccaccgtggaccgagaccaccgaggcggcccaccattcagtccacgggaaccgacggcccggatcggcccaaagccgatcggacggccacgaggcggcgcggctggggcacgggcgcggcatgaaaccggctcggccgagcgatagcgcgcggcggcgtacggccagacgaccgccggcgacagcggcgcatcgcggcagcgggcacggggagcggcggaggaggaaaaaaaaggagaagggacggtggggattctcaccgaggacggcgacggcgagacgaccacagggaggcggctggcggcggaaagagatggtggcggccgacacgggaggcgacgggaacggcggtccgacgacgcccgaccatggcggagccgcggccgagggccggcaagacctagggaaaatattggagcggttagggagagaaataggcgaccggagcggcgagaataccacgccagagaggagaggaatggtggggctcaccggcgaccgagagataccccgttccggtgggtttccggcgaagaggggcggcggccaaggtcctcctcgtccttgcggagctgagggaggcaacggcgcgagtcgacgtcgaccgaagcggcggcgcgacgcggctggaggcggtgaaaggggcggcggcctcgggtgtgcggtgggagtggtgctcgaggggtggagagggggaaataagaggcggccggacttccccttgcggtggcgaagctggcggtggcggtggctcggcgcggcgacggctgtggcggcgggaaacggcgaccgaagctcgccggagtgtggcagcgcgtgggtgcggcgtggggagagcgagggagagtatgccgggctcgggaaaaatggggaaacggacaaggggagcacggggattgattttatagctcaaaggggcgaggagagggccggggagcggcggatttcgaggggaagtggggcggcgtcgtgggggaagagagagacgcgggaggcggcgacgtggccggattttgcggggagagtggggggaaacggcgcggacgtgggcggcgaggtcccacggacaaacgcgcgcgcgcggggtggaggaggtgggcggaaacggcggcgacgtgggcggttttcggcggccatggcggcaacggcagctgccggcctgaggttggggatgaccccgacaggtggggcccacctgtcggcggctcggggagaggagggaggatgagggaggcgaagcggacttgcgcgaggagggggcaagccgggccgacggcccaaagagaagggaggaggggaaaaggagggcggccgggcccgagagggagagaaaggaggggttgggccgaaaggggcccaaagagaggagagaggattttaatttcttttctttttattttaattgattcgatgaactttgtgccattaaaactatttctcgagctccgaaaattcacggaaaattccggagagtacattagggcacaaagaatattgcaaaatattcccggccattgatttttaagggaaaattttaattctcccattatttcacttgattaaattgatttaacttttatttaatttctagaaaatgcattatttaataatttttaaacccgaacgaaaatcggggcgttacaatactccgcccggttccatatataattgttgatgttttggacaatgacacagtctacaaaatatatatttaaccttgattttctaatataactagaaaagatatccgcgcgttgcaacggtaaagccaatttaatttgtacatatgtgtcggtggataaataatcacaacccattgtttcgttttattcatgtgcttatccgaatcatttattactaaataaaataatatatgtgtgcaaatattttatatatatgttcttagtgactcaaaaactattatggtaaaataaagtacaataaaaaaccaaaaaatcgaatccaaaattaagttctaaagtttaaatttagcttataagaataagcataagccaaataatgaggccttcaaatacgagtttgatttgtcatccaattttatctcaagtcgggcagggaccgatgacggacggaatcaacaactttgatcctcctttatttcgattggcatgttctttttgaaagtaaaaatgattcttacagattattgtaatggtattcctggtaatacgtaagagcatgtgtggagactgacttgaactaacaggttgcttgttcattttggttgttttcttttttcctctatttttttcttttctttctttctatatggtttataagggtagaatggtcatttcatttatatagttgcattcgagaatgacttggcatgctaataaggcatattttgtgggtctaaggactatgttaacccaaatgattaatttggagaacttgtttttgaaatctcaataactaaactgagcccgaagtagaaatttaggagtagggacagtgttggctattcagaattatgaaatcgaaaggaacatatactttctaaactcttctcgtaaataggttgtgtttagttccattcaaacttccaaaaattccatcacatcaaatgtctacacatatgcatggagcattaaggtggtgtttgaatctcctgaagatgaagatgaagattaagtgtttcatgcaaaacgaggtggtaataacgtgtgattaattaagttttaattgttataaacttgaaaaatggattaatctgatattttagaacaactttcatataaaaagtttttacacgaaacacaccgtttagccgtttgaaaaacgtgccacgaaaatccaaaatttaatccacttcttgtagtggaaacgaatatgaaattgtacagtttgcatgtaaattgcgagacgaatcttttgagcttaattacaccatgatttgacaatgtggtgatacagtaaacatttactaataacggattaattagtcttaatagattcgtctcgcagtttacgggtggaatttataatttgttttgttattagtccacgtttaataatttaaatatgtaaccgtataattaaaaaaattgaaaaggaactaacacggccatagtcgtcttcccttttctgcaatggcacgtatctcatcaatgctctttggccgaagcttcgggacatcggacggcagctatcaacttatcaagccacttgccattgccccgaggggccgaggggctcccacgcgggacgggacgaccacgcccgtccgaccgtctgtttcgtccccgcagtaggaagaacggagacgggctcgtagccgtccgcttcccaaccgtcgcagtcgcagtcgcagcatccacgccacgccacgccacgccacgcgtttgtgtgtttcactcgaaggctcgctccactcgaagaccgaggcgtccaccaccaccaccaccactcgagttcccccacgatccccaacccttcctcctccgattcgccgccggtagctgccagcgtctgctccccggctcgccgcgcgccggccggcgagtgcaccgcgcgcgggcgcttggtcgacgctatctccggagtactccgcgtggatttgggtgaatagtggctcgtttcgacagggtgacttgtgctgtgctcgatcgcggtcgtcgcttgctgttgatcgaccggtccagatccgcgtcgtttacacggtgcgtggctgttcctcaatctacgggtgagtgttttctgaacgaatcgatcctacctgttcgggattgcttgtagaagagacaaaaagagagtgatgttgtttcacgcaaccgagaattaattaattaaatcgtctggcatggtagattttgctgcgtgcgtagaaaagagatttcctaaatttggggatactagtggacgatcgatcgagcgcgtattctgtc

SEQ ID NO: 42270 - DNA, 26493 bp, Oryza sativa
  unsure (1)..(26493): unsure at all n locations
cgtcggtgagtcgtcggcgaccgccgtcgatggcggcggcggcgccaaggactcgggcagcttcgagtgcaacatctgcctggagctagcccaggaccccgtcgtcaccctctgcggccacctcttctgctggccgtgcctctacgagtggctccacgtccacgcgcactcccgcgagtgccccgtctgcaaggccggcctcgaggaggagaagctcgtccccctctacggccgcggcaaggcctccaccgatccccgctccaggtcggtggccggcgtccagatccccagccggccggccgggcagcggccggcgacggcttcccagcctgatcatcaccacgaccatttgccgcaccacgacccgtggttcatgggcggcgccggcgcccctgtggccggcggtcgctgggggaactacactttctcggcggccattggggggcttttcccattgctgagcttccaggttcatgggttcccgcaggcggcggcgtatggacctgccgctgggtttccttacgggtatggacattcgttccatggctggcatggccatggtttcccgcaccaggcaccgcagggccagcatgttgatgtgttcttgaaggtattgcttgttctggttggtgttcttgtgattgccagcttgattgtgttttagatgtgtgcagttagctatggccaatcctcggtgatgagcctgtatgaaacggttttattgtgtcaatattaggtagtagctcccacgggttgatcagtgtggagagatagtacaaagatgatgcttcagtagttactagtaggattctgtgataatgagtggtagctgataatgttgtcgtgcttctcgatatattacttgtgcagttgcaagtcttgtttgtagtttttaagtgaagtttgaatccttgttatcttttcataatgcatttgcattccaaccttgtcctgtggctgtcgcaaggataatatcttgcattatttgtgtcatatatggattcttgattgtgcatatacatcaatacatcattggttgtatctgaaatcagcacttggaatttgtttctgaatttaaaatattgtaccggacattttctactttctgttctctttatgtgcacatggccttattttatcccatacaagtactatatgaacttgaagtaatttcttgaagtaatatctgaatacttacttcttactgtttcagcatagtttgtttaatccgagtcaccaaataaccataatatctaccttgctttgcatttggtgatctgagataaaccaagatggtaataaaactttatgtaccttaatggcgatgtatgtaacttgtaatattcttccccgatcagaaaacgaacttgcagtactattcaataatgcaaaaaaaaatcaactaagattatcttttttttaccttgttttttagctggtgatccattgagtgcagaatctgtgcagtataatttagacatttgtagttccataaaacagtagcaatttgacctgtacttttttttgctagcctgtactcgctctgtaaaaaaaaaagagcaacttctagggatgagttcagattcatccctaaaagttggctattttctcgggcatatcaaaggtccaacagtaatatcaattttgcatttatacactcagtttcatttgatggaaaatttgtttgaaacatgagtactatagatgatgttggaacatacttattctgtttcataaaaaaaataaattctagatatgaatccagacatcaccaaatactttgattttttttattggagagagggagtaaatatctcgagactcctaaggatgctttcagatattttggtcggctgttggcatactgaatagtagatccatgtagccatcaccaaaataatttgtacatggagctccataatccataggcctctcagctctgagtttgatgtttatccaaccgtgtttctttttctcgggattatccaactaattcggattaatggactagtagtaatcttactaagcttgattgttgcagtgagatctggcgttgaatcagccactcagcaagctgaactcaagtctagttcatggtctctctcaaaaaaaaaaaaacctgttcatatggtccgtttcttttgggccggaaagttactgtgacttacctgtgggctgtggcaatataaatactgggactggacttatgagttagttcagtggcaatatctcgggaaagtgatttcaccgctcaggggatattcctcgtgtcgagcatgccacctaaatagtcataaaaaatataaaaaattttggcaacatagattaatatgaaatatatcacccttttttaagggaaacactgtaggggaagcctccacagttaataaattaaattaaaagaaggaatacaaaatatttacaaaaggtttatccactgagataaggcttgtctctcaaaaacttttaatctaaagactaaaagggaaagatcaatcttaaagagagctttccaggaaacaaccgaaggtggtacattctgaaaaatgaaagcatttcgttgcttccaaatgttccatgcagcatagagaattttttcaacaaaatgagtggatctatatgagatctttgcctgcagcagcatatcatcaaaattgagagaaaggttccagacaattcccagttgcgcccaacaatctgagctgaattgacattgaaagaaaaggtggaaagatgtttcccttgcttgagctggacaaaggacacatgctagattagaattttcaggagggtagtgccttctctgcagcatatcataagtgtttaatctgtcaattaggagaagccaagcaaacaccttaactttcatagaacatttgcttttccaaatccaacttaagtacccaggggcttgaacatgcatgaaatttattgcataaattttctgtgaagagaacagtccattcccccagacataagcccaaacatctttatcaccagataataagttaaggggtctgcttcactcatggattcatattcctggaaagcttgttcagataaaggcagagcaaaaagctgtgctatgcttttagtagaagttatgcttacagagtccttgtgagagagggcaaaagagtgaattctagggtaaacagctgacctgactttaccattccaaaaatcactccagaacaaacaagttttcccatcacccactttacaacttgacagacttatgaaaatatctagaaattgcaacacatccttccaccaaaaggaacctcttgggcgaatagcatgtggtaatttatcagagtaataagaggtccaaatcaaattaacccaaggaataggatgcctgttgtaaaatttatgcaaatttatgaaatatatcacttcataaatatgcaagtttaaattcaacttctacaagttgtaacaaaaataacaaatatagttacaaataactattttcaatttaatttgttatttttgttgcaatttatagaagttgaatttggtcttgcatgcttgtggagtaatatattctgtattaatctatgttgtcatttttttcaatttttttataactatttagatgatatgcaaactatgagaggatgtcccattgagagatgaaaatccacgtcccaatatcttcagttttttgttctcaactgtgcatatcgaaatgggatctgtttttacgccggtggggatttgaacagccctcgacaattcggcctttcttctccagtgtccagattacctggatcatcttcagaacctttgctagtgtaagcggactttatttgcattgccccagatatccacggaggcctagctgcctactcttttttcacatacgcgcaaaaaaatcacgtcatattagaagaaaaagaattttagttacacaacacaatcagccagaccggcttatgttaggggaagggagaaaaagcaaatgaaaaataaactgaagcttagagaaactacggtggctaaaaacagacttcaagcagcgggaaggagccaagccacgctacactcctaacaaatcctcaaaaacggcgacgccagttaaagaccacatatggcattccgaatggatggactccagaaccacaaaaactgaggagagaacggagtcgaaaaccctagagtttcgctcatacagttgccaagagaccaggagcaccaaggagtcgaagctgtcacggaggtgctcaggtaagcaggccctggaggacggccaccagtcctggaaccagctgccacgggggagagagggcagcccagctaggaggcgacaacactcaaagccagatttgccgagcgaacacgtggtcgaggaggatgtggttcgccgtctcgagatcctgggcgcaaaaggggaaggccgagtgactatcgatgccacgtttctggaggagatcagccgtccaggagcactgttggaatgcaaatcaaaggaagaacttgcatttggcaggattctttgcgtgctagagaagatcagcacaagtaaaggaatgctggccatagaagaatgcctggtacgcctaacgcgctgagtagcgctggtcagccgtctagcgccaaacgagacgaacacccggtgagagctgtacgtgaagcaccgtatcccaaataaagagaaactagaaaatgacaggacaacgaggacaccgtggatattaaagacccataagttgttcgtcaggcggcctagctgcctagtcaactcagattcagcattcaggagaagatttctgggggttgataaacttctcggaggcacaccaggtcaccagcacgtgtgcaagctagagctactgagctaactaaatacgcctctgcagagtgtcgtagtatgccacaccggcacggttgtacatcggctggccgcaacagcgttgcacggggaaatggattagacgggcttatgtcggaactcaggaggagctctatccactggaagtcaggggtggatctacagtataaacatcggtgtcaggcgacaccgacgactttcggtaaaacctaaaataaaactggttatccatatactataacattatgttctaagtataattagcatactatgatatcgatatacacgttatgatactaacaaacagattttctggatccgccctgtaagtccacggccacctactccatcgtccacgttgcgcgaccctaaacgctctccccccccccacacctcagctagcatgctgatcgatccgccgtgcaaccgcatccacagtgcacgcacgcagctacaaagatgtcgtacgaccacgaccggtggcttgtctgctctacgttacactgtgcgtggcttgtctctgctctatatgtgtaccgcgtcgtcgtgtgcacacacacacacacacaaccgtactgagggtggcgcgcgcacggggctgaggagcgaaatggcgccgccggcggggacggaagcggctggcgctggccaccgcaagaactggcggggcgagtccgggaacctgtggcgcatcgccgggccggtgattctgacggagatcttccagttcctcatcgggttcgtcaccgcggccttcgtcggccacatcggcaaggtcgagctcgccgccgtctccgtcgtcaacggcgtcgtcgagggcctcgccttcggcctcctggtaaaaaatcacgccaggacggtcagtattgatgtgatcgatcatcgctaggcattttgttcatggcgcctgtcgcgctcgttttgatcagcttggcatggggagcgcgctggagacgctgtgcgggcaggcggtgggggccgggcagccgcggatgctgggcgtctacctgcagcggtcgtgggtcatctgcctcgccacgtcgctcgcgctgctcccgctctacctcctcgcgtccccggccctgcgcctgctccggcagtcggcggccatctcgtcggtggccggccggtacgcgcggtggtgcgcgccgcagctgttcgcgtacgccgtcaacttccccatgcagaagttctaccaggcgcagagccgggtgtgggccgtgacggccatctccgccgccgcgctcgccgcgcacgcgctgctcaactggctcgtcgtcgccaggctcggccacggcgtcgtcggcgcggcgctcgtcggcgacgtgtcctggtggctgctcaacgcggcgcagttcgcgtacctcgtcggcgggtcgttcccggaggcctggagcggcttctcgcggaaagcattcaccagcctcggcggcttcgtcaagctctccctctcatccgccgttatgctgtggttcgtagcattgtacatgcagttcaagttccatttcacggtgaaaattagcaaaatatttttttcatggatgaattggtgcctgcagcttggagatgtggtattacacagcagtgctgattctggtgggttgcctgaagaacccagagattcaagttggtgcgatttcaatatggttagtacatcaattagcaatgttctgatatttttatacctggcaacgattgaacattaagtttaaacgattcaacttactctgtcgtaaacagcatgaactatcagctctggacactgatggttgcagttggctttaacgctgcagtgaggtaacgcacttatcctatgcgttgcttccactcaactcactggtaattttctgagctcacacacatgctttgcctgtcacattttttctgtcagtgttcgcgtggcaaacgaactcggcgcgaaccacccgaaagcagccaaattctcggtcatcgtcgccgtggtcacgtcggccgccgtcgggctagttttcactctggtcgctctcgtggcgaggaagcagctgccgaggcttttcacggacgacgacgtgctcgtcagggagactgcaaaactgggctatcttcttgcagccaccatattcctcaacagcatccagccggtgctatcaggtacagaaccattctataatcaagtgaaatatatgctcaaattgcttcaggatttgacacttgttgatgcaactatgttgtgccattggtaaatggcacaaattgcaggggtggcgattggggcagggtggcagtcatcggttgccttcgtaaacattggctgctactatctcgttggtctgcctattgcagccgtttttggcttcaggctgagccttaatgcaacagtaagacagacaaagccggcggtctaaacttttatttttcagtgatgattttcttgcagggagatgtggtaaccgttgtgtactaaccaatgcaggggatttgggtggggatgctgatcggaacaatcctgcagactgttattctgcttgtcatcctctacagaaccaaatggcagaaagaggtacagtgagctcgcttcatcaaaggactagtcgaagctgatcgtctcggcttagtttcaatttttttttcaaatgtttttggacggcaggccatgctagcagaggagcggataaaggtgtggggagggggtgttgagctgccaaccattcaagaagcaagttgaagcgaaaagattctaactacacatactacagatataatagaacgctacgcgtgtcacattgtttgctacgattccattgcaattgtgcatgggctgcggtaagtatgaatgtagtatgatcgttttacagcagagcagaataaagataaagttggtcaatgttcagctactcagatctgttcgactccgtcgaccacatggctgcgcgacatgttcacttacggcaagtacagattacaaggccactgtatctggccgtgacaacctgactagcttggtgctcgtctagtgttcagatatgagctcacgacagcgtacgtctggggtaaccggcgtcgggtgcaccgcgcacgccagaaacgaccgggtttcgcgacctcgatcaacgtacgaccatggcctaagcaaacaccgatacaccatggatcgtcagagaagagatacaaattaactgatgtaattgcataagacaaggtacggcgattcattacacggatcaacgacaccgttatcatgggagtggtgacttgtgagcctactgaagctgaattaacaatttaaaatgcatctatggctagtttgcaccagacggcgatcagatcttgttggtcagcttctcgcccttgatgagcgggttggcgcgggctatggcgtcgcggctggcgcccttgaagtcgaagccgcaggcgtgcttctccgggtatcggtgcgtcccgcagtaggtagccccgcatcggcatgcgaaccccaacagtcccaccttcttcttgcacgacgcgcaccggttcgcggcgccttcttctctactaccgtcgccggctcagggttgttcttggaggagaatgcggcgccattaacctcagcggaaggcacggagcaggaatcagacgtaactgcgccggtcgcgacggtagcggcgctcgcggcggccacggaagagaagggccccgtcgccatcgtggcgccgttgaggagccagtgctggcggtagcagacggagcacatgtcgagggtggcggggttcccgtagaagccgcagccactggcacagaggaccggttggccggcgctcgcctgctgctccgacgacatcttgatgatattggcgcgtagaacgatcgtctctcttgctctcgggaggaagacgtacgtctccgggggcgccgagcaacaaaacgatcgatcgaagcctcgaaggcgattgcgcgtttcgattgaggcgaacacgatagcgtcgatgggcctcgggggacgtggctttatagggccttggttggttacgacacggagtcgtagtccgaaatcgttcacaacacggactggcaatgattccgcgattctgttcggagtccggccacttctagggccctcttgactcaggtaggcctccctctttaccgacccaaacacatagcggcctgctagcccaaacacatgcaacgcggcaggctccggagcaaagaataaaggctatattacctccttgtgctgactccagctagtgatgactccaagtctgaatttccttcctcacccacaaaatcaggagtcccattttttttgcctaaactagacacgccgtatccttacatgtcaaaaccagttcaatttatctttttttctctacacagtgatattatccgatacgataatctatttatacctaattaaaaataagtaaggcttccggaacgatttttcgtccatcgttgtcatcatccactacattattttcttccaaacgaaacggatgactaaactgtaggttcgcttgtttaggatagaactcaatttcgagctcgatacgaagcggatttgctctgattcttgagaaaacggaaagagtaggagatgaggatagaaacctctcaattaagtttggattatctccaagggtacggctggattttacagaggaggcagtttcaggcggcgtcaggcacccgagggagtccggacggaggttagggatgatactgtcgcgatgggtccacgtgacagtgtgagagagaacaggggagaccaattagacattcggttgcttgctgggccgaacatgtgctcacgggctgaggtggaggagagaataagggaggaaggtgggctggctcttgtgcgggttgaggaggaaaatgagctataaatggcccatatagaaaagagggtttttatttagatttttatttaaataaatactaacatggtgtttgtattattagaattagcaattggcctctaaaaattccaagaaaaattcagagagtgtaattaggctgtgttcttaagtctatgtttccaacctcactctctcgtttaccgcgcgcacactttttcaaactgctagacgatacgtgttttgcaaaaaaaatctatataaaagttaatttaaaaatcatattaattcatttttaaagttttttaagctaataattaattaatcacgtattaatctatttctccgtttttcgtgtcggaggtgagggttcccaacactcacataagaacatagcattaatcatggataatttaacaaaagttaaatcagcatgcaattttatttgtcacgcttactttacctacctagttagaaataccccagtattccagaaaaattgtattttagttaattaaataatgtaaatctttctcaacttcttctcaattttcttgtcttttcttccctttgtaacgcacgggcagttttttagtccagttagaaaaataaaagatacatgtttcacataacgtatttcttcctcctctatctgtctccatcacaggataccttgtggcaaaggtaacccgcagatgggtcggcagtgctctagtcgctggcactactggcgacaccagataagtaggccaactcagggcctaccttattgttgctgttgagacgagaagttgcgaacatggtgttagcgcccatctcagccttactcacatgcgtcgcttcacctacattgatgcgactctcgtgctgcacttgttgtcccattccaccacactctttgctctctcatcactaggcatgacttgtgtatgctagcatgcaacatttgtcacggtgaaagcttgtcggaggatgtggagacgtttctgccgcacggtgatgtgcacggttgtggacctacgactggcacaacgatgcgaggaatatactcggtattctcgcgtgggtgtctctctggtggattgataacgttgccatcgccgaatgtaccctagctctaccatcatgtttaccaccctcattggggtggctttcattttcctttatttttttggttgattggatccccatgtaaatgtaacgtcaaatgaaacccctgtcaaaaccatccgggaaggtttattgaatcggttttaatagttggacgatatgctattatatgctattatgtttgatattgtggtggagtgaggaaattcagatgctcgttctaagtaaagggtggtggactttttttacgggtaagggaggtagattttttttccccgaacaaatcacgatgttggttcgtcgtgatggacatacaactttttcttccccttggaccagcagcacgaaagcaaaacgtcgttccggtgcaggcgcagctccgctttaaccacgcccagcgcgagaagcatcagaacaggtaacaaggcaagttcccttcagagccagcggctcagtagtccatcccaggctcagctcccatgctcagtagtcccggcaaaaaggggagcgccgaaacttaccaaaggccagcacacgcgccagccgcgcgcggagacgaaaaactctcacaatcaggaatcagctcgccatgcgggcgcgcgctccggcaaacgagtgaaagagcgaccttccaaagggagacacgcgcggagaccgaacttaactggaaagctgatgagcacttttctccccgtgtgttgggcaaaagttggacgacgtacgagtaaacgtcgcacgaaacgcctcggtatccctacctagaggcggtacatttttcgatcggaaggccaatgctgtgcataagggcattagcagtgcgcggtgagtttttatggagccttcgtatgccaactaagctcaaaaacacccaggaatattgttagctacatgctacacagtgcatactcctttaagtgggtcccactgtctaccctcacttttcatctctcctctatctattccccaccagccgaaggtagcgaggcagtggcagagaaagcgaggcggcgaccggagcggggcggggcggtcgagcggcggcggcggcaggcgtttgagcatcggcggagtggtggcggcaccaagctccacgcctccatctctcctcgtcaggcctggaggcgacgatgcggcggcgtggcccaagcttcgaccgcaccgggtgaagctccccatctggcgcactgccgcttcctctccccgtccggcctcctccctcggtggcaggcatggatcggggggcggcgcggccggtgagtctcggccggcgcagattggggaggacgacaacatcggcatcgacgcttctcccctccctccctcttcttcacctcttctcttgtgggccccaaagctgcgattctgacgaagaacggggagccaaaattggcgaggctccaagctatgcctaggtggaggggagtctctgagctggctgcatgagagagaatgacatctacgtgcactgtgaatagcctcagtgcgtgccttccctccaggatacaatgcgaaagagtattttctgaacggaattgctatacatcttacgacagtttttgaagggaaaatcttttgatttttgggccattgatccatcctgacattcgtgcatagatagattgggaaaaaaattaacagggatgacgtgagctaaggggatcaatcccgcttgctctgtcactccattgaaccatcctcatcactgtgctagcactagttttacactccacaaatctacactctagttatacatcatgtaggtacattgtactatagtgtactatactgtaagtgtagttatattgtaactacactaacttattaaagtaatataaaaaaactccgcattcgctctcacggcatagaaatctcatattaatcggagaaaaaaaataaatttcatatagaaacataatttaaaaattacctaaactcggaacaaaataagaaatattagaaaaagagactagagtccatacatgtatacgatttagagctaagagaaaattaaagttcatatagaaataaaattttaaaatagcctaaattcaaaattaaaaaaaaaaagaatattgtaagaggagactagagtccattcaggtatgctatctagagctaattaaaatttagaattaaacaataaggaaactaaaagtagaagttagaatccatataaaaatataacttagaaataactaaaattcgaaattaaaacataaaaaatatttaaaaaggagtctagagtccatatatgagtacaatttagaaataaatgaaattcggaattaaaaaataacgaatattgaatgataagtttagagtacatatagaaatacaattagaaataatggaaattcataattaaaaataacaaaatattataagaagattctagagtccatagaggaatttaaaactaattgtaagccagacttaaaaacattaatttagagaaaactaaaattcaaaataaaaaataaaaaagactaggagaagagtctagagttcatatcatataggaatacaatttagaaataactaaaatttaggatttaaaaataagaaatattaggagaagagtttatataggaatatacagtttaaaaataactgagatttagaattaaaaaaatattaaataagagtatagagctcatatagaaatacaatttagaaataacttaaaaaaagatcattgacggaagggtttagaatctatataggaataaaatttataaataatagagagcaactaaaaagtaagaaatattgtaagagtagacaaaagtccatatatggatacaatttagaaataactaaattaaaaattaaaaatagttaataactatcacgtatatacaatacaatattaatattatatattggttagtttggttaagttaatacaaaattactattttaatatattttaataataaaaattaaaaatatacgtattatttgaggaaaaaaaatataacaatattagccgtgcagatttcgcggctgtaacggactctcccagggcgggctcgcttacatctgatagcctggtgtgcacccgggaacaccaggaagaatttcccggtcggtcacccatcccaaattgctccaggccaagcacgcttaaccctggagttctttggagattgacttccggaaaaaaagttgcaacttgttagtatgagtattctattaattctattaagccctaggccgggatgttacaccctcgcccccttaagagagatcgacgcccccatcgatcaaccccaggccaggaacgtcctctcttggccacgtccatgtgtccagtgccagcgcatgtgccatgctgtgtaaccactcccggtcgtcctctcttggccacgtccatgtgtccagtgccaacgcatgtgccatgctgtgtaaccactcccggtctataccagccatgcgcaccatgcttgcgcaactgcgacacacgcgcccatgaaaccgactcacgcgcccatgaaaccgcgagagtcggctctgataccattttgtaacgtcccgcctctcccaggccgggcccgcttacacatgtcttttctttgtcctcactcgtgtgcacccgggaagaatttaccggtcggtcacccatcccaaattgctttaggccaagcacgcttaacccgggagttctttggagattggcttccggaaaaaaagttacaacttgttgatatgagtattctattaattctattaagccctaggctgggatgttacatcctcaccccttaagagagattgacgcccccgtcgatcaaccccaggccaggaacgtcccatcttggccacgtccgtgtgtccagtgccagcgtatgtgccatgctgtgtgatcactccgggtccacaccagccatacgcaccatgtctgcgcaactgcgacacacgcgcccgtgaaaccgcgagagcggcttatcatcctagttatgtcgtaactacattctaatctttatatatcttacatataaagattagatttgaagtttttcactcaaaagcagttttttaaaagtaccttttctaaataggtgcatttgcagttttgcatctaggctagggtactgtccattgacaagaacaacgctttttttcaaacccctcgattaggcgaacagtgtccattgacgtttctaaacccctcgagtggtacttanaagccaaattaagtgcaagtgttccccgcaaaatacaaaaattgaaaaaaaacgttcgtcaatggacactgttcgatatatacatatactctatgactaacgtcaaagaattaagtgcaagtgtgcaacatggtctatatatatacactctataattaatgtgataaactggtactagtaaatatctagaccagcacctatcacggtgcgatcagtgacaaattttacaaccttatcttccggcacatcgtaaagctatatgcacgtcaccagtaaatttaaccaaccacgcatgcaactatgcaagagtatatgcaactacgagctgcgggatcgcaatttttttgtgggcgttgcccgtgccatgagcccatgagtcgtctctcccctcctcttttgctagcggaggaagcttcctctcgccttcctcctgcacggcctgaccgaacacctgacgttatctccctcgggcctctgctcgcctttccggccgccgcgagtagtggttcaggtgagaattgtgagatcggtggtgaacccgccccccggcgacgcatgcaacttgcgattgatcattcagaaaaaacgaaaaaaaaggttgggtacgagtgttgtgtgattgctgcgcatccacctgacagatgggaacaaacgcagccaacgtatgcgtgcatggtcaattgcgataaacatgtggccatttgatcggcaacatgtacatgcatgcgtgcgaggatcaggtaaattgagcgcgtgggcggctgctttgtgccatcgaccttgtggcgatatctgattgggattttgcgagatttaggaagtaaataattaatcacggcagcaatttggtataggaggccggccgcctttcgaattgcagctctgtattggagagggatagttatacgaggaataatcacgtaatatccatgcatgattcctcttgtattcacggcttgcgtcttgcatgagcatcacaccacttacagcggtgtcctcgatgtttcaggggtgtctgatcgaaccagcactcgagcgcagtattttgtggttttgtctgattggtatcttacgcgtgtatatctatatatgttagtgtactccaaatgtccacaactccacatactatgctaagcactctctgttgcaaatgttaggaacacatgctgcccaccggagatgccgaaaccacagaaacaattcattatctgcataaatgggagagttaatttatgaggggatatacacacattatttgtatgtcatttatatggtttagaaaataataacatagataattgtgcgatgtatttcctccgtttcatattataagactttctagcattgcccatattcatatatatattaatgaatctagacatacatatgtgtttatattcattaacatctatatgaatgtggataatgctaggaagtcttataatatgaaacggagggagtatcactttatcaatatgcaagtttaaattcgatctgcatgctaaaaaaaatcttttgtttgcgaggaagaaaataacgaatgaataatacttctactactcaatgtgtagattgtttctcctctcatcctatgaagaaaattttaagttattcttttgggggtgatagttcattaatgcatcaatattatcatttttaagattttgttataggtatttgggagttacaaacaaaaataaacataaggacatatctttaggggggggggggggaaaccagttccccacgaagcaaatggtcttccaagaaatgcaccatgagaacttccaacctaataagttagtaataacttgccatggttcatatctatactattttaaatgatgttagtggtggtgtccaagtctacaccaacaccagaaactcaaactagctatcataaacataaggtacccacaacatgtcaatgactctagaattattaattcaagaaattataaggggttacatacaaaacctttaaattcacctttcatctacagatgaattataagcttctaatcttgtattatccgaccgtacgtataacttgtggaaatagataaaaagaggtgatctagcagtatatttccgtagggttgcttgtgaagatgaaattatatgcctaattaactaactatactataaacctgtaatttttgcttttacttttatctttaaaaatatccgttgcaacgcagctagtttctcaaagaaagaacacataatgatacttctagaaagaacacatatttatgcttctacgtatggttattctggtttgatttctagctagtgattgtcacttcattcggaacctcaatcactttctgttatttagaacgagtcatttctcattaaaaagagcggaaaacaaacaaacttttctggctgttacctgctagtgaccattggtgactaactcgccaaacatgcatggactgatgggccattggatcggtcgatccttctgacggaaagcaagaaaaaacagaaaaagtagggtgaaacttcccctgctgcgtgctgccggccgccgtaaaatacagcacttcgcattgcgagtctcgcgccttcctccgctatatatacgctcgcacactcacgctgcctcctcactagctaagctcgggaatcctaagtaagtgaaagcttagctagcttcgcataaatccagctctctcttgctaatggcgggcgtcgaggtctccaagccgtcgaggcgcctgtcgccgaaggggagcttcaagctgagcctgcccagcctgctggcgtgcgggcagtgcaaggccacggccgtctcgccgccggagtcccccacgggcgtcggcgcgaggtcgttctcctcgtcggcgtcgtcgtcggcggggacgtcccgggggagggagcgcgaccgcctggcggagctccgggagatcttcggccacttcgaccgcgacatggacgggcggatctccggcgacgagctccgcgagttcttcgcgtccatgggcgacgactccggcgccgccgccgccgccgccgcggagatggggctcgacggcgcggcggccggcggcgagagcggcggcggcggtggcgggctgatgctggcgttcgaggacttcgtgcggatcgtggagcggaagggcggggaggaggaggagcgggaggacctgcggcgcgcgttcggggcgttcgaggcggtgaaggggtccgggaggatcacgccgcgcgggctgcagcgcgtgctcagccagctcggcgacgaggcgtccgtcgccgagtgcgaggccatgataagcgcctacgacgacgacggcgacggcgagctcgacttccacgacttccaccgcatgatgagccaagactaagctatagctccgccgtgcgtgcgtgttccgcgcgcgccgtccgtcgccgcgtcgtcacgaggaaatttgcctccgcgggttcgatcgtgtctgttcgtgtgtgtgctgttgtgtacgtgttcgtgcgggttgtgggaggccggctgtgactatgtgagatggagtgtgtgttttggtcgcgtgatcgtatcgatgtgcgtgcgtgcgtgcgtgcgtgcacgccgcgcgcggcgcggcgtcgtacggttgtctgcttcgatcggtcgatctatgtatatggtgcacgaacgcgggacgccttagcaatttagctgtgctttgtttaacacgaagccagcatgagtactagtaaaaaaaattcccttgtacctctagctaggggcagtatctgttttgtcttcttccactgatcggggcaccgatgccacgagttgctttggctcgccatgccaagagtccgtgacttcgccttagtcgaggtcgtgctttcgtgaggctacttagtgtcttgcagagggtacgggtgccctggttgagctaaggtcattagtcagggtttacaaaaccgacaacattctttctgaggtcatagccaacgctccagcatggagcgtggtctcatccttcctgagacgaatattcacgccagcttgatcgataccacaccttggcagagtgccgcgacacgcagtagagggccaggtagtttcatcagcttatcgttgtttttgggcgaggaacgggcaaggagccgcgttggggagatgcctcaccccaagccgttgccccgcgtcgttgttgctcctaccccgagaagaagatggagagggagaggagagtcgccgtcggggagggaagaagagaggagaggccgcgatgccgccgaggaggagagctcgagcagagggaagagggtggaggagctcggcggagctcgaatggtgaagtaggacggcgtggggagaggggattttggggtgttggtgggaaaaagggggagggaggagagattttatattaatttctgtatttttaggtgtttagcgtaaaatttaaacttctatatctctattttttttacttaaaaaataagagttgcttccatcgtctgtaaaaaaaccatgggagaaaaaaaccgtgcgaaaaaaaccggaccaaaaaaactatgtccgataaaaaaaacggacgaaaaaaatccgcgggcgaaaaaaaccgtgtgaaaaaaaaaccaaacatgtccgataaaaagggcgaaagaagggaaaaaaaatgagtccgatcaaaaaaaaagtagggacgaaaaaaaggaaaaaaaaagaaacgaatctgactcggtctacacggtaaaaaagggtgaaaaaaggaaaaaaaattaaatgaatccgactctgtcgacgcggtaaagaaaagggtcaaaaaaaaaaagtacatgtccgattccaaagaaaatcgaatcctattatatgtgacatggcgtggtaaaaaaacaaatcgaatccgattccatcgacgcggtaaaaaacaagcgtaaaattttttttgtccgattccaaaaaaaaaagttgcgaaaaaagttttccgtttctctctctatctctatctgtatctctatatctactacttaaaaattaaaaagtatttccatcgtccatccgtgaaaaaaaagcgtgaaaaagaaatcgggcgaaaaaaatcgaatctgattatatgtgacgcggtaaaaaaaattaaagacgtttttgacatccgtagtaacgaaaaaagggcgaaaaaatgaaaaaaaaaagaaagtccgattcaatatctatatattcctaattaaaaaaatttgtatggcttatgggttatagttttcatccataaaaaaattccatcgcacgtgcgatcgattccgctttaatccctctccgatggcaaaaaataaaaaaagaaaagaaagaaaaaaatgagacaccgtatcaaatttggacctaaattctaaagaaaacactactacaagaatacaagatcagattcaagaacaccaagaaaacgccgacaccggaaggggagggtgtcgtcgtcgctgctgaaccgccaccgccgtcgcagggatgtcggatgtcgggccgccaccacattgttttgagagaggggggaggggaaatgttttagggttagggtttgggctgttgaacttttatataggtcgggatgaccgtctatcagatcggacggctctagcttctctcgtgtcaggccgaacgccattcccaggccgcccacacggaataagttcactttatgtcatttaagttgttcctacccgattctattcccaggccacccacactattgggccgcctcatggaccacgtgtacgctccgtataaaacaagttcactttaggtcacttcagttgaacttttttatttcattataaatatattttcttaaagagctcatatcatgtaaaactaaaccttaatcatataatatttttatatttcttataattttaattacccatcgcaacgcacgtgcattttttctatgtcaaaaaaaaaagatcacgacatacgagtgagagatatatatcacacacacccgcaggctcatgtttaactgaactggcaacagattttcaattacaggtctaattgttttatttaggtgattaaatttgttttcatttatataattagtttgctctatttaagccttttgaaaattgctaaaatttgagaataacttttcctacttcgtattatattattttttgctaatggaattaatagaaaattaattatatatttttatctttttgaccaaaggtcactgcaattttattttattaatattattattatgattatgattcctttatttttgttccaccagtatacatgattaaaattacctttacccattgcaacgcacgtgcatcattgctagtaaattggaaaattgtgagtactaaagtgaaaaacactaggggctgaaataaaaaacgagactaccacatgaagcaacttgcaccgtgggaaattaattagctttttgggggggtgttgccccatctacttgagcgtatcccttgcgttggccatgccttaaaagctataggctgggtttgaggttgtgtcgatgttgtgaacagatatactccctactaggttgttatatgatataaactttggtgggggaggagctcccttttttttttgtgagggcctggaatgggaaatagcaaatggcaaaagttttggtgacaacaaaattggcattgcaaaaatactagttagtgtttaaatgcatcttaaagttgtcattttagcactaaagagagagaaaaagagagagggtgtggtcccagagcactttttagcaaaatttgctaccatgaactagcaaatgccaaatatcaaattgccaccttttgctgttagtgtttagatctaaaatgacaaaaagaactctaaaatatcaaaagttttactattttagagtatctaaacaggccatgagacttgctggttagctgctaaccccagcgtgtgtagtgttttttttaacttaaatcagcgtgtgtactatttttcttttacttaaatcagcgtgtgtactgttgccttgggtttagctgttgtaaaaaaaaatgtttatttattttgggaaggcttggtttctaaaggtaggtaatggatgtttagctgttgtaaaaaaatgtttatttattttaggaaggataaagtaggagtaaggggtgtttagataaggggtataaagttttagcgtgtcacattgagttttatatagggtgttgcatggggtgtttggacattaaaaaaaactaattacagaatccgtcagtaaatcgtgagacaaatttattaagcctaattaatccatcattagaaaatgtttactgtagtgctacattatcaaatcatggagcaattagacttaaaagatttgtatcacaaattagtcgcaatttgtataattagttatttttaagcctatatttaatattttataaaggtgttcaaatgtttgatatgatagggtgaaaaattttaggatgagatgtaaacagtgcaaacttctcctaatagaatccttgtgtttctgagcaatttctctgcaattctccgaagacaagagtgtactcctactcggctacttgcacgacacaacacgtgcggctcgaccgtcgtccggactcatgacgagtgtcacacggcgcgcgtataaaaaccgcatcgccggctccaacggtcggcaagatccaaaccggttcaaatccccaagccaccgtctcttcccatctccccatcatcccacccccccgaatcgacacccgccgccgctccgaaccatcaaatcaaccccctcgccgccatggatttgcccaagcgagttcttccgcatggtgagtgggtgctgccgcccggatctaatctaatctaagtctcctctccgcgtataattcccctcaattttcggttgcttcgtcgctcaatccgcttttacgcgccgtgtgcaggttccccgcgaggaagtcccatggcgacgaggcgaagggacgcggaggcggacgagaacgtgagggcgtggagcgagaatccggggcgtctcggtgccgtggcggagtggaccgcgtctctggagaggaagaagtgctgggtgagaggaacggcggagcgacgggagcggggaggccgcgtcgccgccgcagttcttctcccaggcgaagcccgcgacgagcccgccgtcgctctcctgccggggcgaggggccgtacgacccgaagacgaactacaccacgccggggccggagttcctgggctacaaccccgagaagcgccgcgagatcctcctccggttggagcgcgaggcggagaacgagtcgtccagtgccacntnggccacccccacccccaccccctcggagtgcgtgtcctccgggtcgtcggtgagaggcggcgaagccgaactcgaccgcgccgacgccaaggaggaggagattgagattccgtctcctcgtggtctcgaccgcgccgacgccgaggaggaggagattgagattccgtctcctcgtggtgggtgggcacggcggctgcttcttctgctcgtcgccgcggcctgctcttgctgctacatctattgtatgagctcctctccctttcctacctcacaaatggggctcgattttgctggaacaactgggagcgtgcatgatgctagcgctcatcaagtaggttctctggagttgcgagcaccaactgagatgatgggttcacatcatgtgtttgaagaagctacagatcaaactgtgcccaacggcagtgaaaatgcagcccaactgtatggccccatgggtggttctcgtaaaaacttcatggcgattgctgcgatgggtttggcagattcatgcccaaatgttccattcggagaatttacatgccaaattggggacagagccgtggaggatgtgcagaattccaaggaagattttcaactgagtgaattgatggttgcaacctctgagaatgccgagcaattgggtgaagttgtaagcctgaatgaaaatgtcactgcagattccattggttcaacctacaccgctgatatggtggagggagagtcagggttagttcatcaggaggaggcaggggaggatcactcgcaacactcccagcagttggcctccatggagaagacaatagaacaagaaaacaacgaggtagggtatgatggagagggcctggaaaatgacagattggatcaggcaaccgagctattggagtatgagaatccagctgcagctgcaaaggcaatagtagctatggtaaaatcactgtggccttcaataaaacttcacttgatggagatcttggcgtgcttttctgttgcagcatttgcaattgcagctgctatgctcaagtgtttccagaggtctcctaagggtgcatcagtgtcaacacgtaggcttgaacaatcccctttagctccaaatccaagattgccagtgctcccttcaccacaatctgtgctacaacctgtgcaactgacagttcccaaagtagaaccgcctgtcaatttgaagatccctacactatcacctttgcacaagcctgacctatttgccagcttcagggaacaggtgccattgccagagcccataccagtgtcatctgtcaacctcaataatgctgtgcaatttccactgcccaagcagattgattccgggaatcgtcctcagaaagttcaccaagatgatgctggcagtgctaggattccagacagctattctgttggccgtagagacattgacagctcgagacctccagtggtggcattgcttggggagttctcacttgtggatgcaagtagctcaagaggaagctcccggaaaggatcaaatgaacatgctggggatgttgcagttcaggaaccatcagtaactctgagaaaagatgtggtgaagatgcagaaggaaactacagcaattaaaagccctagtgctcgaaaaacgaaaaaggaggtaaaattcagtgtcctcaaacacttatctttacacctacaggctacacatagtgttcagatgcttagataagtcttttatcatcatactgctgacattaatatgtttccataatggtcaagcatttgttttagtacacaatatcgagctgtgggtagcagtgctacttattcacttccttttgttttctgcatcaggaaaatgctgcaaaggtggagaagaaggatgttaccacgccaactccattgagacgctcaaatcgtctccttaaccgggtgacttctccttgagccagaatgacacattaacactgtcaacagatgctgatccttactgtggagtggagagagtttcgggactacaactcctggctgttacccaagcaagttagcttttcttctgtagcacttcgcaagttagttgacgtacaagactgcagtaataactcatttagtcctcttctctcaaagtacccgcggaatctcattcgctatattcatgatgctttgatgttcatgtactactcattttctactcctgacggtaaaaacctgtaactgatggatgtattggatatatggttgtgtcctggtttacctaattgagtcaatcaatatgcttctgaatctgctgatcgcttaatgcgccgtgtaaagactttgagaagagttggtcagtcgattgatgtaccagtaacaaaggattattactgtttacctgggtatttattagtgtagtaggtatggctaactctatggattagagcggactgggagtataactaaccatatcttcacagcccacggattttatttcaattttcatgtcaatgcgagggacctagtccaaaaccacctgtacactgttctctctaaaaaaacacagccgtatgtggaagtggaaccctggaattggcaacaacattatcccgaagcgtcccatccacgcgacgcggcacaacctcccgcgcccaacacactcaccattccggactggggacatgtcacggggaatgtaaccgaatcccaatcccaccattccacggtacaaaagagagaaaaaaacacccgccgcaacgcaaacacacacacacacaacaacaacaacaaccaaaaatccaagaaaaaccccaccgtctcgagaggccgctcagccatggagctcgcggaggccgtccgggacgagacagccatggccatgcgcctgctcggccacctcgcgcgcgccccacgcggcggcggcggcgacaaaaacctggccgtctccccgctctcgctccacgcggcgctggcgctcctcggcgcgggggcccgcggcgaaacgctcgaccagatcatcgccttcctcggccccgcgggtggccccgcccacgcggcgctcgcgtcccacgtcgcgctgtgctccctcgccgacgacagcggccccggcgatgaccgcggcgggcccaaggtgcggttcgccaacggcgtctgggtcgacgccgcgctccgcctcaaggccgcgtacgcgcgcgtcgtcgccgacaagtaccgcgcggaggcgcgcccggtgtccttccgagacaaggtgagcccccgcgcctgactaacaaacctctcctccatctccatgtgattcatccatccatcgaaatattttggttcttgccgcaaaaattacg

SEQ ID NO: 42271 - DNA, 4158 bp, Oryza sativa
  unsure (1)..(4158): unsure at all n locations
aaagcaagttcgacgcccggtccacgagcgacgacgtcttctacctccccgacggcggccatgtctccgcgccgttcatgtcgagcggcaagtggcagtacatcgcctgccgcgccggctacaaggtcctcaggctcccgtacgcgcgcggcggccgcggccgcggccgcgacaccggccgcctcttctcgatgtacatctacctccccgacgagcgccacggcctgcctgacatgctgcgcaagctgtgctccgacccggcggcgctgatcgagagctccgccgccctgacggagaaggtccccgtgggcgccttcatggtgccgaggttcaccctgtcgtacaagacgaacgcggcggagacgctgcgacagctcgggctgcgcctgccgttcgagtaccccggcgccgacctgtcggagatggtggagtcatcgccggaggcggagaagatcgtcgtgtcggccgtctaccacgagtccttcgtcgaggtgaacgaggaaggcaccgaggcggcggcggcgaccgccgtcgtcatgacccttggctgcgcggcgccatcggcgccggttcacgtcgtggacttcgtcgccgaccaccccttcatgttcctgatcaaggaggacctcaccggcgtggtggtcttcgccgggcaagtcaccaatccttcgtcctcgacctagattccgatgtggtgaagtaagcagcgaagagaacacggagcggttcgtcagatcatgtccctgtagtgatctttgcgtgtaaaaattccggatcaccggtcaattctgtgatattgtagcaactatatatcagttatgcagcaaaaggaataagtacagtattggtgtctcgtcaaaagaaaacatgaaaatttgttaactgtgcacgaaactggaagcatattattcataagcagctgtaggaacttagtatcattcatgcaaaattgtttactgtgcacgaaactggaagcaacgaggttacggaatgtgtctacgcgacaatcatgttaggtcgcttcagcagtcgtctcctttggcaaaatcagtgcaattaggcattcggtcggatggggcggaagttctagcatcccacaggcctcaggcgtgggaggaaggataaatagtagccttgaccacaatggcttgacagatggaatcttgatcacaccggcgcattctctctgtttcagataggatataaaatcccggaactgcaagataaacacacataagtagtgaagggttaatgtggtttcatataaaaatagatattcaggtagtggggttggcagtgtatataataaaatcatacccctttctgatcaccattcgaacagggtaatagccgacagacctctctctgcaaagtgaaataacaaacagtaaacattattcccctgcgagatgcgatagataaaagtagctcgagattttctctctgcaccacactgaaatacatcagccccatcattaatatatgagtaaatttcacactgcaccatatgttttgaccaaagtttcacaatgggcaagggccaacccaaccttttcacttagcaccacatatctttgcactagttggcactttggactagggttgagcaaatcaatggaagttgtcagagaaaagctagttcaaatcatcatttttagttccatagtattaagataaatatctttagaaagaaatagaaaatcacaaaacaactttgttcagcaaatcacactaaaataatgatgcaaacatgtttaaaagtggcacaaaatgatatatacataggggcaaatgaataaaaataaaatactagaaaagagttaattaccactcacactaaaaataaggaagaaaacataaaatgttttgccttttataattatccatgtgtaaatcatatgaagttttctcacattcccttgctttgctcacccctagtccaaactgaaaacttatgtaagatgtatggtgttaagtgaaaacaatgatttaaccttagtccattatgaaatcttggtcaaaatatgtcgcccaatgtgaaatttactcttaatatattaaaaacctttctgtttaatctagataaatcgttatatggacgcatttgccccacaatgagcaagtacttaaattgtactccaaagaaaattcattgacatatcaacttccacatctgaaacatagccatgctaacctacaagtggcttatcatcattgaccgcacaatcggctataaattagctgctcacggcttatggcttaatagggggtaacttctagtagcaccatcccattcctaacgatctgctgcttttcatgcatacatagtgaactgaactaaatagcaaaagatgctatttgccagatttcaagttcagagatatgaccatgcaccattagctgaattaaatatcaagaatttcaatttaaaaacaacatagaagtattagcactgcatttattaaaaaaaatctcaaaatagttattcccttacatccaggtataaaatattcacttattacttaattttagctcaatcatctcaaataaaaccaagatgataaaatggagatcccttatgcaatgaacttgtgccaaattaacaagcatcaatgctgaggatcctggcacctaaattcatatatatcaaggacaaaatgtagaaatgttctcatggtgcagtttagatgaaacatggtataaacacacaactataaagcatgattggtgaaaatacaagaacagtcttcagaaaagttatgccaacagaaaaaaagagactgaattatggtgagactacttaaactgtaaaattacactaggctagaagtatttctgaaatagtacatggccttctagagtcttactttgctaggtggagtattggagaaagttgtcttcacatgttggtaatccgttcgctttgtcacatctaatcttgaaggccacctaaatgtgcaaacaagaatgttttaggagaatatgtaatgttgtaataatagaatgtgtaggctggattgatgtatctcttaccctgtcggttcagaaactgcatgttcatatctacaagcatccaactctattctacttgcatagattgaacagtaatgtaaaccactttttgaaagagagccctgccatcgaggatgagaacgttgcttttgtgagtcagaagggtcagtagcaggttgaagcggaggaggggaatttgggggtggtggcacagaaggtggctgagtaataggtagtggtggtggagatggtggtgggggtggtatatcttgacgagtaaatggtgggggggctacatttggtggaggtggaggtggaggtggccttttctcagactgctgtgctgaacctccaggaaactgtgtaagaggggtaacagaagatggtataaaaggaagaggagcaggtggattcatacggaagctacttccaggcatcattcgaggagaagcgtgactgaaggatggatttggggtagtattttcccacggacttcctggaccaggatatacaggacggacaaaagaagtttgaataggtggcggtggtattacaggaccacggtgtgcagaaacaggtgggcatggaaggatgccttgtggagctctgggagccgatggacctgcatgtcaaccatactgttacatggagccaactcatgcacaaactcgcaaaatttgttaaattaaagaatactagacttaccataaattggtcgctctgttggtactgtgaagcctgcattataccctgaaacccttggattcctgcagatttgattgtttcatagatgtgtaaaattaaacaatcaattgcatacagcagcaatgtgatactcccaaggtgcaagcaacaaatgactttcaagcactcaaaaccttaatttaggtatacaaattactaaaatataagcagatcgtaaagagcagcataacaaacaacactagttgacataatgttctaccatgagctcaatggaaagggaagacatacaaatcagtattctggaaaatatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 42272 - DNA, 7544 bp, Oryza sativa
  unsure (1)..(7544): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacctgtgaagcagctggaaaatttcaagtacaatctcaacttagggaaagttgtgattgagggaggatgttagataatgttagttagtttgttatagagatagattagttctgttaccgcatgtactttcttgtatctatctctatatccaggattgtctcaggttgttgagattaatcctatcctttgtacacgccacggtagaggctctttctgcctatatcaacaaaggtgcggccccgtaaaggggttcaacgcttctcattccgttttacaatcctccttcttcctcctggtgttggaaattcgttgatcgagttgaaactctcatccttcatcatgtgctgcagaaactaacgcgtgcacagatgatggatgggtgtggtgtgacatgaaagtggatcaatgacacgcggcacatttaggggagtgtgtcgtgtcttgacttcttcatgcaaaagtataccaaccctgtataaggccagtcacaatggctagtgtcattgcacggctacccaaaatattataccatcttctctcaaatgaaatcttttatgaaacaatccccacagtggaggggtttcactttgacgtttccaagactaagcaaagcatttaattgatacaagttgctgggatcatttgtacccaaaatccggcgcggcgcgggagaatgcggaggtcgcacggcggaggcggacgcaagagatccggtgaatgaaacgaatcggcctcaacgggggtttcactctgttaccgaggacttggaaacgacgctgacgagtttcaccaggatgaaactctttccttctctctcatccccatttcatgcaaataatcattttttattcagtcttacccctattaaatgtgcatgacacaccagtgaaacccccattgtgactggcctaagcatctttgtgcggtgctgatgttgctgtataattggctctgtatttatgttctggttggtgttatgctgaatcgctgataagtgataactagtttagccttcgggctggtgtgttcaacaaaaccggtatgggactagtattcggacccggactcgcgtcggactcacaggctcacagccggtagtttccatataaagccgagaccaaccacgcacaatagcagcagatcgatcacgtattcacgtctcccgtagtcccctcttcatcacacccggagaagaaagcgatcgaccgaatcaagcgagaagatgcaggccgtcgcgcgggccgcgtctcgctggtgcagccgctcgctgctttcccggccaccgacggcggcggcggcggcgggctagcgcggctactgcggtggtggtgatgtgcggtgccgatgcgccaccgccgggacgggcgagaccctcgagacgattgcgacgaggctgcgtcggcgcgaggcttacaccaactgtgccgccttcgctgtctccggcatcgtcacggcacaggtgctgcgctactgtgatctcaccagcggcgaaggaaaatcgcgtgctcgcggtggaggaaaatcgcgtcctccactctacatccacctggtaacaggcgttgttgggctagcattgatattcaaaagctctctttgaagtggagatctaataatgcttttttagataatagttttttcattaatccgatctctatagatatacacagccaaagagacctaataatttaccttctgttcttgtgctcactgttattgttcgtctaacaaaatttatactactagtgtgctcgttcttactacgcgttttgtacaagagaggactggaaagttggtggagacacgtctcaatttctattctttacctgtttaagccgggtttataatataatacatacaatttctttcagaacaaatataatatatatgttgcacttgcatccaactaaatagacatttattttcaggactatattgaccattcctctctccaatttataccgcatttgaggcctaaaggacctcaatttccaggactttacactgtccactcctttctctagtatataccacatttgatgcgtaaaggacctccacacaagcggacatatacgcatctaaccaaatctattgtgtttctaagccgccacatgtcaactctcgtaaattagaaaaatcttaaaaattctgagaaacaaaagcatagccgccacatgtcaactctcgtaaattagaaaaatcttaaaaattctgacaaacaaaagcatagcatatctagtcatttattttcacttcaaccgatgggtccactattttagtccacactactatgggactaatcttgaaaataaatcagcatatcattacaacatatcatttttactcgcatttgagaaagttcaatgtttggtctcttatagtattagcacaagtatgaattgccgttgagccgcttcttattatcaaagtttcactttattactttcaactagttaacttttatgcttattgtactttggaccaccttaattctctattttctagcaatgtttagccttacttttaggtcaaaactaatttaattataaaacttttatgtgttcgtagtgatttaaaaatcaatgctgaaaaagaaattacgttgaaaatatcttaaaatcaacatcaaaactaagattgaaaatttaaaatttgtttttttttctttagcttattagacagccaatgtgtggttcttagcaaagataagtctcccatatagggaggaagtttgctgatgtgccagattcgacttaagatcgttgatgtgttaaaaagtggtttaggagggtcaaaattaggacaaaggcaaaattacctagtccaaaatttaaaaagtagaaaaaaaatggtttaaaacaaaactttgttaataaaagatggtcaaactttcatatactcttaatttaatatagagggaaaaaattattatgttcattttgaattctacgaaggaccacaattattgcaaaaagaagatacatatagtacgatcttgatggtccaaagtataacaatatagattaatcgatgaagtggtatatagaataattgtacactatttattaaatctcattctatttataaatcgagctttatacaataaaaaatccactagcctgttttaaaaggacaggacagcgaatgttggaaggccacaatttaacccccgctgaggagagcattcattgcaaatttgcaacacatgcttttgcatgacaaaataacagtacgatacatggaaccttctcttactagcaagaaaagctatgtgccagaatctaagagtacgcgaaaaattcagtagtctatttccaaagacaggaaatggatttttttttccatcgagggacatctttcgttttatgcatgtgttaacaaccaaatttggtaatatcggcatcggagaggaaaatgggatcgaagcggaatcaaagataaggattgtcgtataaacagagtaagaatcggcgggagtccgaatcggctacgattaggatcggctaagtctgggtcagattgggttaaataattcagccgattccgacaatacgacttgtgtacgacatcgggttcaggttaatgtgcttcaagatgattaccacgcacggatagagtcctgggaaggcaattgtatctattaattaggatattttatgtaaattccttataaataaatatgggcaaaagtctgccacaaagacttatggtatcttagagtttcttagagataatagtcgtatccggtatggacatatcttgtaattctcgggtataaatagactccgagtcctatgtaattgataacacacacgttcaatacaatttcggcgcatcaccacccttttgctttagttttattttgacgagttcttgctttcgggttgagctgcatcggtttcgatcttcaacaagaggtaaaacttgttatgacggcttgtatgctcgggattagtgcttccatctttatgatactctaatcttgtttatgtaattcgtcgagttatcatatatcttacataatctctggcaatatcactatctaacctacaatcggctaacatccgttagtagagggcagccgattaggttagattttgacgttgatctagattatataagatatctaccactctatgaaacttccatcggtttgattgtctagatattgtccttcttttcatacttaatgctgcatcagttgagtttgatctattaagtcgtgcttagaatatagatctctagcctgccttctggttgtcgattagggtagcatcggagtttcagccgatcttatctgatttagctatatttgttttatatgcctcattaacatgttaaatcttccctttacgtcaagatattgctatatttaagtatattaagattttgcttgatatattatacttgttttaatatcctgatatagagtagtatcggagtattagccgatacatgctaggtctatctgatcggctatgctataaacatatatagtcccgttattaatatatatttcgatctaagtgatttatactgtctcggcatggcgaccgatctatcccaatcacttgatttaaatatatatcgatataagaactatatattggtaatatctacagccgatcgagtaggtttagttctttattatctatctataaccgccgatcgattcacatatgacatcggctcaaaaataaatgatatgtcatcggcacctagccgatcggctatcatttatagatttaatcacggttcctttgcttctatttcttgttgattacaggatcaaatcaaccggcatgctcatacatccgaaggcgagctttggatctgcactggagttaagcagatctcccaggccacgtgttttctgtcaacagcatgtcgttcaaagttattaaaaatattttaaaaaatatcaagatatatcaatatatgatatattttttcacaaacatgcgagttaaaattcgacttatccattcgaaacaaaaataaaaaatttgaccagtcaaatttgttatttttgtttctacttgtataagttaaattcgaatttgtatgtttgtaaagtgacatatcacatattgatatatcgtactttttttttctaattttttgataactttttaagtaacatgcaaaaatgaaggaatatcccttaagggatgaattgagttttccccaaaagacaaaggaatggatgttggaagaccacaatttatacctttgctaacaaaacactgattgcaatccatgcataagaaagacagaaaaaaaaaactgcggtacaacgcatcgaagctgatcttactagcatgaaaaaaacccgttcattttcaatccacaaggattcctaacacgtgggatttcgttccacgcaaatgagtagcgtgcaaaacctccattgatatgcccctgcaggttcgggttcccctggcaaaaagacgctgtgctacggaaggaaagaggaaagaaccgtctccatcgaacgcgttctacccattaaactcgatcacgaacacgaacacgagagcagcttgcgctgctattctgaggccatctcgggcgtcctccggcgggcggtgggagcgccgttggtctggaggtgatcgtcgggcttcacgccgagcgcccgccttgccgagtgcggagtcctcgccgccgtgttcacgggtttcaccttcggctgtggccctgcaagcgaaagtatcagcccaatttatcatctcgcttgattgcgctagctatgatatcgatgcgaaatgatgtgaaattgtgaatgatctaaaggttcttgcaaagtgaagtgctttctggtacggtgatagctactccaacgatggcaaaatggcaaatcagatatgtagatgctggtgtgcaagaaacatcggaacggctgtaccataaatcagattatccgaatcactttttgggtacggccatccatcatatcatacgccatcttaccaaacaatgcatgcattccatttgatgttctacaggaaaactgtataaattttatggattttcagctgaaaatcatacgttccaatgaattctatttgcagttcatggaatgagatttaaaaaatgtggtaggataaatacctgcttgcctgggcgccttgccgtccgccttcttggccgtcggcaacctgccgtcgctgctggccggccgcgaccgcagggtgccgttcgacacggcggagaaggtgtgctccggcgacattgcaccgaacccgttctcgtcgccgtacagcgagttcccgtcgctgcccgaatccgaggccctgtccttggcgacgtgcacggcgccggcggccttctccctctccatgaccctgtacgcgaacatctggaacggcacgtcggcgacgcgcggcgcctcgccgccacgctgccacgccgggagcttcttcagcagctgcgcctcgatgtcgaggtagtcgacggccggcttgggcgcgtcgtcggtctggccctgctgctgctgctgctgctgctccgggttcaggatcaggaaccgcttgacgtaccggaggacgcggcagatggaggcgaacgccagccgctgcgccgggtcggcgtgccagcaccgcttcgtcagcgcggtgaggtacttgggcgcctggaacgggaacagcggccgctcgccggcgcagatgttcttgctcgtcttgtcgccctgcaggtggttgtcctcgaacggcaccttgccggtcagcagctcgaagcagatcatggcgaagctgtacacgtcggccttctcggtgcacctccccgccgccgcggcgtccgcgacgccgtcggacctgagcacctccggcgcgtaccagatgcaggagttgtcgttgccgttggcgttgccattggcggaagcttttgcgccgccggtgtgatgccagctggctgcccatatccggcgaccttgacatgcacgtagccgccatcgggttggcgcggcttgacgagcacgttggaagggttcagctcgccgtggtttatcctcttcgcgtgcagatactccatcccgcgcgcgatctgcagcataatgtcgacggcgacgacgagcgggaacgggatccgccgccgcgggcagctcacctccttgacgtagctcccgaggtccttggccatgagctggtccatgaccacgaagtactctttcttctcctcgtcgtggaagcagtacgcggcgtgcgcgacgttcgggtgcgccaccgaacacaggagcgcgacctcggcgccggcggcatcggtgtccccgatgaaatgcttcatcgcaaagctctcccccatccaatg

SEQ ID NO: 42273 - DNA, 12910 bp, Oryza sativa
  unsure (1)..(12910): unsure at all n locations
ttgcaacgagctcttgggagaccagatatagcttgccgaacgcgtgctcgaacagcttgggatcgagcatgtccctgtcgtacttcctggcgagcaccagccgccccctggcgagctcgtccgggtcggagccggcgatctcgccggcggcgtcgatggcctcgagcgcgacggcgacgcaccacaggacattgtggaggtgctgctccacgcactcggtgccgtgcgccatggccgcggcgcgcgcccaccagctgccgcgggggtccaggcactgcctgacgtacgcctcggcgtcgcggaaggcgcggtggagctcgcggagcggcgcctcgatggcgcgccacttggcgccgcgctcgtcgaagcggagctgggcgcgaacctgccccgtgacggcggcgagcgcgcgcgcgcaggcgtcggcgaggaggcggcactgccgcgggttgatgtggaggtcgtcctcgaacgccatgagcgcgttgatgctacccaccgcctcgccgagttgccggagctgctccatccctatcggcgatcagccttgcctgccgataggacgatggatcaagtgcgcgcgctcttcttgattgcttctttcttcctctgcttctttggatggcacggattgaattcctttcctgacaaggataaaaaaaaagggaagaaactgatgtcaaacgtgcgaaattttcatccaaagtgctttgatcggcgtatgaacacgaacttgattgtggtttgatgatgacaccaaaaatataaggtaataaatgcagaaagtaaattttatacatttctgaacattttacagttgttgtttccatctgtttcttccagcctccaaccattttaggaacattttggtgtgaaccgagaagcatcgaatcagcaaaacaaaacttcatcaacactgcacaattcagtacttttcatctgaacggaacatattcaaacaccaaataattcaacgaaataaactaaaaaactattcaatccatcaaacacaaaaaaacatactgtaggaaacaagaaaccaaaagatgaaatcgaaacaaagaagattaaaaaaaaaacatgcacatgaaagatgccactgaaagataactcacacaagcttgtaggatcgcggcaccagggcagcagtctgaaatccttatccgaccatggaccggcgtcttgcttcaaggatcggccagagaagaaaagcttaagagagaggtgcgagagctctgacgtagagatcccgcaagagagacaacaaggaaagggggaggagtctccaaagcaaaaggaggacgatgaccaggatgccgacgaggagaaggagaagaaacaagaagaaaaaggagcaggaaagcgccgttttggaggggcttaaactgcagggagttatggggagcagcaaagcaaacgcggccgtttccttcctgaatcgtgcgtgctgctgctaaccgcgagaggtttttcgcagccccatttttaagcagcacacagcagttgctaaaaagaaaaaaaaatctctcccgtttctttcttttttttggccatcgctgtacattgactggctaatactagcacgcaggcgaatggtgtgctgtcactggcccaaatgctcaattgttgcctgaacttgctgaatttaccgtgatgagaagagtttcccgaataggcgttctaggtaggtttcacatgcagaaattgcatggggtgtgagccgtccgatcatgcatccaacgggctctaaccactatacacaatacactaacacttaagtattcagtcaggttcaggctgttttgagacttgcgacaggttgctctacgctgtttgctttcacaaactgtatacgtgatggtggataacgtagccgtcatcgtcaggtgctcggtcgcttggcacgtctccaatgccgcgcacgaacggggtaagtgtgtgctctaactaacggctttgtactttctgctggtgtaacctcctctcctaccgcctttcagccgctgatacaagtagaaaacgatgctgtacactgactctgtggcacggcactgaccgtttctcgcgctgacgaccaactctgaactctgtaccattgaccggtatgatttaaggtatttaatttaatccatgccaccacgcaaaaaaaaaaatcaaatatgtcaacgttctccacttctcctcccagaaataatgggagagaaaaaaaaactatcggactatggaactggagtagattatctagtgaagcaaatatatttagttctctctttggtgacattttgcgttgcttgtcacggcgccacttttcttgctcacggcacgattaggccgccgccgccgccgccaccgcgccgagagcacaatgagaggcagcgagggagcgccacgtggcggctcacggcccggacgacgtgggggagggggggaggccggctaggttcgttggtatccgttgcggtagttgacgcgtcctggtccggtcggttgccggcccaaccgcgcaagaactgccctttccgtgtggttggcaggcagcaccaaacacaacggctcaggtcacagaaaagtcgcgcacgacgcaccccggatcaatttatatttcctttttctgacttagctcggtcagcagagtaggtacaatagcaaactattagccggctataaacatattttaatgtaataaaagataagggagaaaagcagcggactatagatctatagccagctgtagtacggactccaagacacagtgtgtatgactggtggaaccatatattaataatatagtaaacaactattatatgaattggctattagattgactatagataaattgaagctagtagtagtggactgtacacttgctctaaccgctctggtgcgatcacaggcaaccaaatggaaaaggatttttgaggatctgccacacaatagtggtttttgaggacacatgaactacgccgattccaccatactcatggacacatgaagtggcaggccattaattagagtctgtttagtaaggtttaacttttaaatttaactctaggagttgaatttagagtgaagttatagaataatttgaattcagtttgacctatctagttcattctctgttactagtatcttatcgagtgaagctggaactaaagctatactaaatttgtccttgttcaagcttctctaaccacattgagtggttaactacattgtaatataatcaatgaaactctatgtaaaaaggtactttcgaattcattctggagaaccttattcgtacaatggatgtcgttggatttcctacaccgactcttagcttgtcgatagtagtcatttgctatttcacaccttccgtagctgcatatgggcaagcgggcaatcaatttgcagttcagttgtcctctgatgataacttcatctttgacgcggttgctatgtcactactaggaaaacgatttttcatggcgttggtctataattttcgctgacggaaaaataccaaaaccgctagcaaaattgtaacgagggggtaaggggcaccgaccgccagcgaaaatagatctttgctggcggtcgcgttataccagccgccagcgaagatatgtctattatcgctggcggtcacttaggtgcgccgccagcaaagatggataattttcgctggcggttgtgttatacagaccggtagagaaaatgcaattattttttctggcggcccacttaagcaatcaccagcgaaaatagattttcgctggcggtagaaggacagcttgcatagatggaccaccatctattaatatagaccacgtggcccaccacccacccgtcccctctctccagctcccctccctcccttctctccctcgcgtctctcctccctctcttctccaccgcctccggcgccatccatcctcaccaaccagctcctcccaccccacagtcggcggcgacggtttaggcgtgacgacgacgacgcgaggtgggcgtgcggcggcgacggtaggcgggtgggcaacggcggcgggaggcgagctcgggcgcggcggcgctcgggagcgggcggcggctcgcagggaggccagatccgctgtcgctgggccgcggggaggccggatccaccgcctccgtgccgcggggaggccagatccgccaccgtcgaccttgctccgtcgtcggctagatttgattttttttctttttgcatgttgttccagatgatgcacatgttttgatctgtgtaaatcatgtttgattgtgtaaatgatgtttgatatgtgctgatgataattttgtatttcatgtttgaatttggaaatgagcagcgaatctagatgttgatttgaaatttgaaattaatgaatcactgggcggctgcatgagtattttcgctggcggctgtcttaagccaacgccagcgaaaatgtatttttgctggcggctggcttaagannnnnnnnnnnnnnnnnnnnnnnnnnttggcggtcaataaccgctagcgaagatcttgatcttcactggcctttgctacattttcgctggcggctggcttaagannnnnnnnnnnnnnnnnnnnnnnnnnntggcggtcaataaccgctagcgaagatcttgatcttcactggcctttgctttgtggcggctgcaaattccgccagcaaaaatccaaaatggccgcaacgaaaaatggttttcgtagtagtgtgtgatgtcacacacaacatgtaggtttttcaccaactatagaaggtgtgtttctgtgtgttccaaattccaattaattttctttgttatccatcaaacaaaccgtgatcggtaatacatagtcggttgaactacaaactatatactaattggttgtaacctctttgaagtagagaccgaaatacactccattatccctactactataaaagggcagtcgtatctttccttcatcacattgcacatacaactaccccatcctcaagaaaatcaggaaaaacaaatcaaacgattggttaaaaggaaaatcagaaaaaacggttgatcttagagcaatcggttagatccaatcccagtatactcactcatatcacatgagccagttgcaatgcacgggcggcaaaacgtagagaaaaccgctctgtctctaaaaaaaaaaggaaaaaaaaaaagaactcttaacgaaacaaacaggccagcttatataaatgctactccattaaaggcccaaagccacgaccgcaaattgggcccaaaggcctaaccgcgttaacctgacggcccaaccaggcgaccgctctctccgttttcctcctttcttgcgacttccacctcattcctccccctccgacgactccgatccgtagagatggaccggttccgaccgctcaggcggatccaggtggaccccgagcccgccgccgccgccccgcccccgccggcggcggccgcggcgaacggcggcgcgggggaggacgtgtcggcggcccccgcggcggggctcctcatggcgtcaagggtgcggcgccgctcggcggtgtaccgcgactgcaagggcgactacatcggcgtccccaacgacccgtgcctcaccaagatcctctccaagcaaggtgccccccgcccctcccgtttctttggtcggaaattcgtgtgctgtggcctgcggggtgcgatcttgggttggtaggttcggatcgtgcatgttgcggtggttcagttgcttggatctgatccgtggcggaggtgtgattttcttttacccctccgatgtggcagtgctagtttggataataaatttgtcgtgaattgtcaatcagctattaggtgttgattcgatcgatagctccatatacaagttaagcccccgtagcaaagtgattttgattgtgcgatttgatgtgctgaaccatgcagagattagagctgctgtgcagtttctctctgatttttactctcttgagtgacatatagaattggctaatactgctcaatagttggttgacaacctgatttgatgcaacctagctgctaaaggcgttttaaatcattcgtttgcgtgaatgctgtactagtttctaatcattgatgtttaagagcctattgtagcgtgaagaatcatctccaagcagaggaaattgtttgcggcacggcaattgttggttcctgctgctaaatatgttgtactatgcacagcatatgatattctcactgtaccatgttctttttgtatttagcatcaccagatttctaaagcaggtcatgacctttgatacattgcaggggacaacaaagttctgtttgcagataaggtattgaagttcactcaatcaggaaagatgaaaaggcgcatccttgtgatcacagattttgctctctaccttgttgatcctgatgctgatatattgaagaggaggatagcgctcgcggctgtcgataagctatgtataagcaagctcagtgataacttctttgcaatcatcgtgccaactgagtatgattgtttaatggccagcactagaaagaaggaaatagtggatattataattaaggctattaagagcaattctgaatatcagcctcaagtggcttcttctaacaggtatatggctacggtctttgtgatgaagctttggtatcccatactattaaccataggatgtactctgaacaacatctcacatgtagctaatttttctgggaatgcaaacgtatgagattttaaatcccaaaaacacttggaagttagaactgctattgatatctattttcctattagcatctactttatgagagcaaatgccaactgtcgtgataacattattcgtgattagttgctactttttactgaacctctcagcattggttagtgtcgttgggttcagtcttctgatctagcacctcagatgcctttagacatttactgcattttgttgccagtctatgatagtctaatttgtcaggttcttctctctgtaggtttgaataccatgctgctgctgaagtgattaaagaagttgagtttgaggaagctgaaggtatgtatctcatccttcatgagcgctagatgatatcatttgcttggttattgagaaattggaataggtctattgtagtgattctatgagttctacactcaatcgtgtgcattttcttccggtgccattgctgatttttgtttagctaatgctggcgatctatcctgtttccattaaaatttaaaagaaggatgcaatgcgttcttagatgttattgcttcatacttgacattagattcgaaacacttttgcttgatgaatgctcacgttgctgatttttcaatacaggaggcgttaaaactaggatcacgcacaaggcgaaggcgaagtcatgattgagaaattatgtatgattgttccctgtaaaatgtatagttcttcgagtttcaagggattcttatcagcgctctttatgcaaagttcaaacagacaattctttgatgtattgtgccttctattttctctgatgtttctctgggaaaaaaaaggtgacctgtcgctgactatatacactatcgctagatttttctttttatcataggctattgccacatgcttttgtgctattggaatttcgattttggctctgttcgttacctggagttcccaactcccccatctcattttccgcgcgcacgcttttcaaactgctaaacggtgtgttttttgcaaaaagtttatatacgaaagttgcttaaaaaaattatattgatccatttttttaaaaaaaattagcaaataattaattaatcacgtgctaatagactgcttcgtttttcgtaccggagggatgggatcccaactcaacctgtctgttagagtcttgacggctcactcttttggagaatggaataatttattcatggctagctctgtttgtagtcaacactgggccacataaccattgatacaatcgagaccaaagtagaaaaatggaatatgtggccagctgttaaactgttccagactttggcacaccacctttgatttgggacgctgttccaccaacttatatgccataaaatatctgcaaatggtgcgctaccacactgtataacaaaggctgtccgtccaatgtctgtccagatcaggggagaagttcatctggagcactgcttcttatttaatagtaattcattttttttctgtataaacaacacaatcacaaccaagcatggcaaattagatattgggtatagatgctccgtgaaagctgccacgcaactccgcgaattaagccatgtttaagagcgtacagctgatctgttatttattagtcgtacaaagcatgtatggaacggccacttagatgagatcgtttcactctgatttcccagagaatcactaatcaccttttgattaagtaaatgacccctattgagtgagtcacttgtccttgctccgtacttgcctaggattagaacagcatgattcaacgaatgtgctatcaagtggcaacgtttgcatgagaaaagtcactgaactatatggtttcttaaaatattcattcaaggagctcaaagagaagtgtgctttggctagctagtctcgcgaacgcgtcgtcgttggctcgttccagttccactgcacgcgacgccacaaaattgcatcgcatattcgcatgcatgcatttttctcgtttccagctaattaaaatagcaaagtccacagtctactgtattttagaaacacgtatacaagtcattgaccatacaagaagtacgtcttttccagcaagcgtatacactattttctctgatttctttttacgataacataatacatttgtcttaaaatatagtaacttagtactcgattaaatactacataatattatgaataatgttaagtggtatctaataaaatgctggattaccatatattttattttaatacggagagagtatcggttggaggagggatctgctaaagtttatcacacgtcgagatcagtagatatgtgccctttttcttcatcctccagacagatatgtgtctattggtgctacagaattccaccaactggatcctaccaatgagttactaccctatcacgagcccaaaggccatcatactcccatgcatcatgcatgaacctgaacttcctgaaagaacggggagaatattgcagagggcgaccacgatcgaccacataaccgcggggaaagaaaatatcactgttgatctatctacgatctccacatatccatccatcctttctttctatcctcggagaaaatgatggaatagaagcgacgaacacacatcactagccctgccaacctcacgaacacaagatcgccttgacagggacggccaccttcgcatcgcaacacattggcctcccttttgatgcaaaccacttgtgaaattgtgatctccgccttggagttttgcgatgaaaagaaaaaaaaaagagggagatgaaaagaaaaaaaaaagaggtagagattgattggtcaaattgcgttctggtttgcttgctaatccgagcctagctaccgagattttcagtaggagtaatcgttaagtagtagtaagtagtacttcctccgtgtcataaaaaaccaacctagtactggatgtgacaaatactagtactacgaatctagatataactagacatatctctgttcagatttattgtactaaaatatatcatatgcagttctagatttgtttttttgacggagggagcagtacctaaccagcgttcgatggaatgtaaccatgcaatattcaggccagagtgatggaaatacgagttgatggcacaagaaatagtggtagtgatgctgacagcacaatatccaaccaacataagcacatagccttatgatatcagttgctctttcaccggttccaatcaggttcccaatttcattagaatttcgtcgtacaaatttcgaagctctcttaaactgcttgtttttttttctatcgaattttgaatgaaatttggcggagttcattcagaattcacgaaatttgacatctcggtagtcgctgggctcgcattttaaccccagaacggaattgtgaaccttgcttccgacatggtgatgagtagcagagccatcactctctggctctctcgctcatgagaaaattcaccaatggataaaggtaactgaaagtatatgaaacagtaagcagtatatttcttgtccgggatcagagaaaggagtagacagggcagcagcagatagacaggcaccatgtgtatcaacagcaacatatacagtacatgtacagaaagctaacatggaaatctgcacatttacagccaaagatcagatcagccagtttttttttcccttctctgttgccatcttgctatcttttgacaaaactaagaccttggcatacatactatcaaaatattatatccaaaatactttccaacacgacaagatcaggagctttttggcctacagagttgccaatgaaaggggttataattttcttgcatatttcttcaaacgataactcagcatatataaagtagcatgccactttacacaaatgcagatgccacacggctcatctgcattgtttgtgcgtgggttgtggttgttctggggtgggtctctcctctggccgctacagctttcggctttggcctgactctaatccacactaagagatatcctaagcatattccttggagattgggtgagcaaaactgaaatagttaaagtgttctttcagtaatgccaatagacatgcatgccaaatggaattttagcatattccttaggctatgtttgatactacgggtatgtacagattggtgtcaaaataaaccttagcaaaggggctgttcagattgatgctattttcaaccatacatttttttaagttgccaaaaaaaatctacgtttagtttattgccaaatttggtaatacataacaaatcctgtcaaaattttagcaatattgttatcttcccaaaattttagcaatgccaaaatttggtaaaagtttattttggctacaatctgaacaggcccacaatgccaaaattttggcaaattggcatcattgccaaaattttgataggattggcttaataatattgccaaaattctatacacatagccaatatttggtaacaaattaaacgtacccacataattgtcaattttaccaaataatgatatggatgaaaatatcatcaatctgaacaagccctacaagttggaaattaatcctccatacaagtaaaacatagcaacttattagtacataagcaattaagtattagcttaaaaaaagtgaaaatagattaatatgatttttaaaacaactttttatagaattttttttaaaaaaacacattttaacattcggaaacatgtgtgcggaaaacgaagtagtaaaggttgggaaatgttagtaccgaactcaatctaagtactactacctctgtcccaaaataaatgcaaccgtgggtatccgtgtccaacgtttgaccgtttgtcttatttgaaaaatttatattttttttaaaaaataatcatacataaaatactattcatgttttatcatctaataaaaagggtgaatagtcaatacggtccctaaagtttcgcttcgggctcaatttagtccacgatgtttcaaatcgtccaaacgagtcttccaaattaattatttgggttaatatagtccttggacccaaaaaagtgccacgtgagcacgccaagtcatcctcgcatgcagcggtatgaataaaatgaccattctacccttatataccatatagaaaagaaagaagagacacaaacaaaaaaataatagaccagcccaagcctagcattgttatggatggatggcagacaaaggaattacacgatcaatgcttggctacagcaatcataagtgacaattctaaaacgatcatacacatgtaaaacatttatcttctttttttctttcttttatatatggtatataaaggtagaatggtccatttcattcatacctctgcatgcgatgatgacttggcgtgctcacgtggcactttttgtggatccaaggactatattaaaccaaatgattaatttgaaggacttgtttggactatttgaaatcttaaggactaaactgagcctgaagcgaaacttcagggaccgcattagctattcaccctaataaaaataaaaatagtaatcataaaaaaaatttcaaataagacgaaaggtcaaacgttggacatgaacgcaaaactgcacttattttgggaaggttggagtactaatatagtgcactgtacattatggatccacagctttttactccatttgacgataattttttatgtttaggacaagatttagttaaattcttaaaactttatacatcaataatttctcaatggttagaaagaatgagtaaatttgcctttaaaagtagtataaagtaattatattttataagattattctaatacaagatcaatcgtcaaatttatgcatacctttttttattactccctccatattttaatgtatgatgctgttgactttttaaccaatgtttgaccattcgttttattcaaaatttttgtgaaaatataaaaatatttatatcatgcttaaagaacatttaatgatgaatcaagtcccaataaaataaatgataattacataaattttttgaataaaacgaatggtcaaacgttggactaaaagtcaacgacgtcatacattaaaatatggaggtagtactaaaatataccgaatgatgcattcgagaagttatggatggttgaagtctcaaaaggttgccagaaacttatcgtagatgtcatatatctatggaccatgagtgataaaaataatctaacttcagggctcctttggaacaaaggaaaaaggaagact

SEQ ID NO: 42274 - DNA, 16796 bp, Oryza sativa
tgtccaatgcttttcactatggtagactccaactcctgccatgtctcatcctgttttctgtttttttattttacttgaaaaaagaatatgagacaagctagagattaaaaaaaaacagaaaagggaaaaaaaagaactcgacaaggccttcatggctgtttttcacataaagtgatccccatcatcatcgacatgtccagcgtgaggaagattcttggtatcgcgcacataataatactaaatgatagggggaaaaagacccatgtgagcggaggaaaatagtaaccttgaacactatatcaacttatttagctttaaactctcaatttagtcaagagcgagtacaattagataatacaaacaggttataaaagctgccatattaaatttgtgctaaaagtgaatgagagaggatgcagtacgtatctataactaactattgtattagtagctaggggtgaaaacgggcaagtacgattgaattatgacattcacatatcataacccatattatcttttaaattcagagccgggtacaggtagtaccgaataacatatcactcatcctatatcctatcccacactatttccttccaattggattcgggaacggatatcaatttgtatctctaattcataggtattaaatataataaggtaattaaagtattaaaagagatgcatcaagaaaaaaaatatataatattacatgtgagcacgtaaaataatgattaaccaatatttttattatgttttaggtggatttataataaattttcatacatattttataatacgagacatacgggtatatacatgtcttcccgtatcctaacccatattttcctaacaaattcggattcgaatcgggtaccctattttttctctcatattcctcccgcaagccttgggtcgtgcgggcggtcggtcgggaaatacctgcccctatttgactggtttaaaattatgtgtcttttttttatagcgagcagtattattgatctagttcctagaaatttaaacagtataaattcatatattagttatatgtacatatcttagggcgtaaatcacacaggactctcggataagttatttcaagagtgtttccattggtcaaataaaatgttgttttacgatttatcagtggcctgattttttcttatccgtcaggttagtcacctatacttgcacaggttatgcaccaaacttgaacgatataaaaaactgcaactctcgtacaaatgaagtgcaactttttgcttgttttatatttttggattaatctacttaaatttttatgtttatataaaccatactaatttttagtttcgtaatggcaaaaatttacagggaagcctttttttaaaaaaaactttcaggttagaaaagtacttgcttcaccacaagaaaacaattatcatacgtgtgagttgttgatattggtctaatgttaagaaaagagagtaaaatataggtctggtccttaaacttagactaagaatcttaacaaggaaaaaaagtcaattgcttaacaaataatctttgagttaaataacttagaagagggtttattttaagaatattaaagttgaaatttaagaataatttccaatccccttaaaaaactaaaaagaattccaattgaaacatgatatatctgttttgtttcgaacttccaagagatgaggcatcgaagaagaatatgctccagcaggaacccgacgccgctcactttttactccgaatttgtccacgccaatccttaatatattttttttaacctgtcgtgttggctcatctgatttggacgttcaaaagaattaaagaattactaatactagtacatgcacgtcgagaaagaaagatcttggaagtcgcggatgaatcgctttcagcgtatatataccaatgaaactgaaatatttactgtaccgatgtggaaagagttcattgcgatatcgccaagtacaacactgaaacaaatcttaattttgttccattctttttttgcttatcttgtggcgccctaaaagttttctaacaaaatcacttgaaatacagtttgtgtggctcatgcatgccctcgtggcacaatagtgcacacgaaaacgctggctatgaataatgagaaaagcataatcaatgacaaacgtcctgctgagtgcgagtgatgacaagggaccggccgtagcaccgttttcgcgaaaatcaagcaaaaattgatagtttccaaaccaattttaaaaaccaaaatttgaattcaaatttagagtaccttgaaatttgagtggtttcaccaaaatttctagtgaaaatagatttgggacctaggttggcaaggtcagttttcatgaaaatcaacccgttcctatcagtaatgaaaacccttcattagcaactcaatttacatatcaaaatgaaaaaaaaacatgagaaagcattgtcatttttctctatatcttgcccttgtttttaacatactcttgccatgaggtatctctcttttataacaaccatgtatgtactttttgaagataatgttttggcctttatcttaaaaaacgttgcatacaattacttatagagcccgtccgcaaattacaaatcgcatctcaattaaaaaaaaaacttaaaactctagtctagagagagataacttctattgttaaaccttaatactctctatcccaaaataagattatttttactccctcttatatttataacaaaataagtttatctttgagtaatcatcgcatcggtgtttataaaagtataggatgaatgtattggaagtagagaaaataggggatatttgcattatgatttaataaaataaaggtattttttatatttgtttatgcgtgagatgtagctactcctatcgcgatcgagcggttgatgatggactgattggattcgcggctagctattgctagggcaggctctcgtagtagttagctatagctagcttatcggatcagccaaggattggcgtgtggtaagctcacgctagaattggagagcaaagataggagcagaatttgttcggtcgccgcggaaacacaaggcgaaaagggcggtcctggattgctgatcaacgggagccatcggtgttggtcacaagggtaaacaacacaaaggcacgtactaatatggccttgtttagttctaaaaacaaaaattttcacccatcacattgaatgtttggacacatgcatagactattaaatatggaaaaaaaatcaattacacagtttgcgtgtaaattacgagacaaatcttttaatcctaattgcgctatgatttgacaacgtggtgctatagtaaacatttgctaatgacgaattaatcaggcttaataaattcgtcttgcagttttctggcggaatctgtaatttgttttgttattagactatgtttaatactttaatacttcaaatgtgtatccatatatttgatgtgataatcaaactaaaaaattttccccaactaaacaaggcctaactcgcgtatgtacgtttggcataactatgatctttatatatacgcgtgcgaattgttcaccgtgtacagtgaaagttgtccggacatcctaatacgacaaatccctctttcaatatacgacgatattgactttaagatattagttagaccatctatcttatttaaaaatttgatgaaaacacatgaaaatatgcttaaagaaaacaagtcacaaccaaataaattacttaacatatttattttcgaagaaagataaacggtaaaacgttatatcaaaattgaacagtgttatatgctccattctcggatttcatattgagatatttgatttgagattagaaaactgggaagaagaaagaacatgttactaacgtgttatgctggcaataaatcacaccggatcgatgagtggcctctacgcgtgacacggcagtcgtgacagacgagtgaataaaaaataaagaaaaaataaacgaaaagtaagcgcatgtcatccaatccgagccaacggacgcggcgccctgccgtccggacgagtccatggtccaattcttgtctgttaaataatcatggtggctgcgaccaaaacagatcaaaactagtacacgtcacaaaacaaaagaaagagattaaggtgatgtttgtttgatgtctaacattgccataactagttaaagtatagtggcataagtgtggcttagaaatagttagccaaaatgtggcaagcttaacttcaaatttaagagtatgacatgtgggtccttaaggttatgaaagtgtggcataacacaattgccatagcgagccaaacacatacctaagaaattgtggcataactaaagtgtggcgtagcaaagtgtggcaaccaaccaaacagccccagtcccattactactaggtctacctccttaaaaaaattggtttattttgaaaatatccaaatttatgtatgaaagttaacatattttaggatagagtaattaattaatgacgtacaggtactaaaacacctttcaaatttttattacgtgtactagtactggcaataagagtgtacgactgtacgagaaatctcatctggtaatcccaaaaacatagcagtgataactcagctgaaaaaaagaaagtaaaaaaaaaagtacttccaaaacaaattttttcaccctgccacattaaatatttgaacacatacatgaaatattaaatatagataaaaaatcaattacacagattgcgtgtaaattgtgagacgaatcgtttaggctaattgcgccatgatttaacaatgtgatgctacattaaacatttgctaatgacgaattaattaggcttaataaattcgtttcgcagtttttatacggaatatgtaatttattttgttattacacaacgtttaatacgttgaaaatgtatccttatatccgacaccttaaaacaattttttttctgccacgccttagcaaacagacaggcaggaggggaaaaaaagaattgaaaagaaaagaaaaaaaaaaagaaggtggcagcacgaggccacgagctttggggggccgtgggcggtgggccccgccccgcatcccccgcccagcccagcgcaccacggacggtggcgaggcgagggcgcctgccgcccacgtggaccctgacgccccgcgtgacgtcgcgccccgaggccggaatatgacacgcgggcccccccttcctccaccaccaccaaacggggcgcgcgtcggcacgccaccccacacaccacgcgagtacgtacgggacgacgcggcgcgcggctgctcgacggcttcggttctgagcccagcgcgcgcgccgggtggtttggttggttggttgggcgaagaagcgatcgaagccgggggtgtagtacgctcctcacccgactcgtttccgtccgggcgccgcgccgcgccgcctcgcctcctaccgcacgcacccccaacttgcgcccgcctacgctcagcgcacccgtttgagtgtacccggacgggaacctgggcggataaatggtggccttttttggatggatggtgctgaaagggccaggttcaatgaatcttcgattcgtgcgtgctggagtatactgtacagtgcagatcaggtgccactagcaaatgtttttgacaagtaaggtttggtttggatttcggtgattgcttggagtggcgcattcttgtcaaatgagatttaatatatacatataagatatggattttttcatgtggatgcaaccgtttctgttttcacgtggattcttgctaaatgagttatcctagtatattttttttccattgttgtgttcctcataaccaacatcgccttgtttggtagccaccgttacaattgttaaaagtcgctaaaagctgtagcacttataaaactgttgcaaccgcaaaatatcgtctaaacacggcctatattggatttttctaaaaaggcatgattctactttgtttccattaccttttctctaataagacaggtatatgcatctactccctccgtactcgtaaaggaagtcgtttaggacagcgacatggtcttaaaacacaactttgacttcttttttctataaaaatatttattgaaaagtgatatatgtatacttttatgaaattatttttcaacacaaatctattcatataatttttatattttcaaactcaacaacttgagagttattcatgatttatattcccaaggtttgacttaaacattgtcctaaacgacttcctttatgagtatggagggagtactaatatttaaaatccacatactctaaaacttcatttttgttataaacaaactttatattcgaagtttgcgaaacattcatatgtgattaaaattgtcgcaaactttttgttgcaagaaataaattttgttaccaataaatattcattatgtttttggaaggatgcatatttcattgaaaagaagcaactttcctccaaaataacatatcatttccatcatgttaacgcgaaaacatctattatataattaaagaaatagaaaaaggagcctccacgttcgctctcatggtctagaaattctcacattaatcggagaaaaataaaaaacagagtccatatagaaatacaatttagaaatagctaaaattcagaattaaaaaaataaggaatattaaaagaggagactagagtccatatagaaatacactttagaaatagttgaaattcggaattaaaaaataagaaatattagaagaggagtatagagtccatatagaaatataattaagaaataatagaaattcggaattaaaaataaggaatattagaagtagagtatagagtccatatagaaatataattaggaaataatagaaattctgaattaaaaataaggaatattagaagtagattatagagtccatatagaaatataattaagaaaaaaaatagaaattcgaaattaaaaaataagaaatattagaagtagagtatagagtccatataggaatttaaaactaactaaaatttggaaaaaaaaaagaagcctccacgtttgctctgataacattaatcagagaaaaagaaaaagcagagtccatatagaaatacaatttagaaatagctaaaattcggaattaaaaaataaggaatattagaagaggagactatagtccatatagaaatacaatttagaaatagctgaaatttggaattaaaaaataaggaatattagaagaggagactagagtccatatagaaatacaattaggaaataactgaaattcggaattaaaaataaggaatattaaaagtagagtatagagtccatatagaaatacaattaggaaataactgaaattcggaattaaaaataagaaatattagaagtagagtatagagtccatatagaaatacaattaagtaaaaaatagaaatttgaaattaaaaaataaggaatattagaagtagagtatagagttcatattggaatttaaaaccaactaaaattcggaataaaaaggagcctccacgttcgctctcatggcctagaaattctcacattaatcagagaaaaagaaaaggcagagtacatatagaaatacaatttagaaatagctgaaattcagaattaaaaaataagaaatattaaaagaggagactagagtagttattacacattagtagttttgaaaagttattgcaaaatttaaaattatgttgtcattgtaatatattttataataatataatgagaaaagatatatgcttttatatgagagaaaatataatgatgctagccgcgcaatctgcgcgggccaccatgctagttagcttctaaaacatgagaaccgtccaagattataagcaacaccgaagatgtaaaaaagctgtaccaccattcgtacttagacagtatgtcgtgctaggtgcaaaactaacattcacattcacgaccacattcaccgccacgacactggtatttttaatgaatatttttggcacttttttcccatcgcgtcccatttaggtgcacgcccgcggggtggcctcagcgattttgtggtgcccccgtgctgcctctccatctcttttatagcaacaaccagcgtatgcgttctcggtttttctccgcggcgctttcaccgctctctctctctctctctctctctctctctctctcctccgcttcttcctacaaagccgtgggcgctgctcgccgcggcgggtctctctcgcgcgcgcaacaacagcagcctcaaaaccctagctgccctcgcgaccgggtcagggccttcgattggatcggccattcggttcgttcctccaggtgcgcgggggctatcgaatcctctgttctctcttccctgttcatgttgattttttttccgagttctttttttttaaccgtttgatgcagcggtgggtcggggctgttagtttttttttgtcgtttcccctgctcaaatctgtgtatgttcttgtttggatctcgtagagtttgtttcgaagctttctgggcgattctttttttgaaatacaggttggtgttcttcgcctcagcctcttgtaaatcgagtgatttctcggtaggttgtatttttttcctttgcgatttgtaatagtacaagtttttgttcttttctttgtatttacaaggatctttttgctcttaaaagggccaaatttttatgggttccctttatttggacggtctgtgttcattccggaccttttccttttgccctcttttatggtttctgttcagggtgagcaatttggtgatatcgccaccaaatttgatggtttggtccttttctctcatggttctaggtcctttttatgaatccttcactgcaggatgtgcaaattcatctgatatgtttcagtttctacttgtttggggttacttacgttgatttgatgacaccactcgtaagagtggcaaatagttaattattccatttgatgagggaagtggaatatcatttgcagtgttaatctgctgtgctaaatggcactataatatattatagtataatactcttaatattttcggtaaaaacaaaactctttagtagctgatagaaaatgtcacttagaatagtataataggtataatgcctttaatagttgatacttgatagaagtgagtgtttagtggcttcacacacctactgaagacatttgtttgtttcgatggagactgcaaaactgatagatgggctatctagtattagttctaatggaatctgaaaagaatttggtgttcttctaattaccctgtggctaatacctaaccagttatgctgcacaataccatggggtacaaataacctgacttatatattcgatgttacatagattttgccaattccctcctcctatttactttacaaataaacgaaacagtgttatatacaagtatttgatataagtcgtaatgttttgttactgatattcacaatatgcttttttttgcaggatattgttggtacttgcattcctccgtctgttattcaagaaagccagtttacactgagagaaccttgctttatttggtaccactcacctttcctatcttctattttctgcccagagtagctacaattttcttcattggaccattggtactcacatcgttaatcatggtttcacgttatatgcaacgacacactaatctcagttctttgtgctttcaataacaagaaaatgtgttcatagtcgcggttaaagttgccaagagtaataacttgatatggtacccatagtcagggttaaaattgcgaagctgttaggtttagctacctgttaagtaagtgaaaccattcaattcagtccagatggcatctaccaatggagcccaactttgagcattagcatgtccataatattgtatgcatgaaaatgataccgatatagaagtatacattataaaagaatatcatcaatcatagtatttgaaactttcaatcttttgttaacatatgcatgtaaccactaatggttaaagttaattgtggagacactaatgtccgaaatgattcacttacagacgaatgcagtatatttgagtaacggaatgttgtacatacacaaggatttgctttaaagatatgcaaacattgaattgaatccaaattaaactgtaaagaccatttaccatgtgatctactagtgttgatcatgtcaaaagtccactgaattttttaaatagattttggtttccctttgttcttcaactgtcatgatccttcactattatggccctctgtagacattattttcaaagcattgcacaggatgagattcttgactgtggcttaactttttaattagcaggttcattggccttttgttttgcctgagtgaatgcaattggaaccttctgggtagaagctgaagcttagtttggaacttcatcatactgatttcatactcagaaagtggcgagaaatggatcgtgatgatatagctggtttcgtaagtggaggttgcaaggccttctgagttttctgacgaagcagatgataatagagttatgatatacagaagtcaggcaactggttcttttcatttactatttggttgacgtttgaagtttgttaactggaatggacaaagcatcatgtggccttgggtttggtgatagtatcaactccttagacacgtcccgtcattggagcactgttcagcatacttctgggcttaaagctactacaattgactattcaacgtattccagtttttctattgcaagctcaaaaacactaaaaaggaagcgaagtgctatggcaggaccagaaggtactggaaacccattacttactttgggtttagggcactcaccaagttcatctgacaatagcaaagttagttctgccacagcttatgcaatgtctccatcttcattgaaagaggctgatgaggagtcatcagctgatcttggcctgaattttgagctttgccttggcaatgatatggtacattgtcaaaagaaatcccctgttggtgctgagaattcaccattgacaaactctcataaattggatcttcagctgagtttgtctactggatcacctgaatcagctgtcaccaacacaaatatggtgtcaccgattattcacggtggcttggagatacctgttaccaactgttcaccagctattataggggaaggatctgtaccctgtacttgggttttcgagaagtcagtgatttcatcttcgtatgcctctgaagcaacatataccttcccattttcgaaggtacccaaaacaggggatgctgctatgtcttctccagtcatatcgtcaaccttggtaacaagtatgaaaagcccagttgcctgtacttctgggtcaattaatccccaacaacgcaacagtatcactaaaaactgtcagtttccaggatgtgttaaaggagccagaggggcatcggggcattgcatagcccatggcggtggtaggagatgccaaaaacctggttgtcagaagggtgctgaaggaaggaccatatattgcaaggcccatggtggaggaaggagatgccaatttcttggatgcacaaagagtgccgaagggcgcacagaccactgtatagctcatggtggtggtcgccgctgcagtcatgatggttgttcccgggctgcacgtggcaaatctggcttgtgcatcaggcatggaggtggcaaaagatgtcagaaggagaactgtatcaggagcgccgaaggtcattcaggcttctgcatctctcatgggggtgggaggcgttgccaatttccagaatgcacgaagggtgcacagggaagcacaaagttctgcaaggcgcatggtggaggaaagcgatgcacattctcgggttgcaacaaaggagctgaaggcagcactctcttttgcaagggccacggtggaggcaagcgatgcttatttcagggtggtggtgtgtgcccgaagagcgtgcatggcggaactcaatactgtgttgctcatggtggtgggaagaggtgtgctatttctggttgcaccaagagtgctagagggcgtacagagtactgcgtgcgccatggaggtggcaagaggtgcaagtttgagggctgcgcgaagagtgcgcaggggagcaccgatttctgcaaggctcatggtggaggtaagcgctgctcatggggccaggttgacttgaacttcggtgtcggcgcaccacagtgtgataagtttgctcggagcaagactggtctctgttcagctcactgtgctttagtccaggaccattgtgtccgtggtggtacattaggcgctgcaaccttccagttcgcaactgatgccaaattcgacgagatggaagtcaccccagtgaagggagatcctcacgcgcaggcaagcagcgacgaccagtctcatctcggtggtgctcatcctcctgctgtaccggcgatcacctcggatcgattttctgaaggaagagtgcatggtggtgggctactggccttactttcacggggtggaaaccatgcgaatgcaggtaactcaaagaatggcgcccttctaccatgatgacatgggagtgagattctcttcaagaaattggtggctcgcagttttgatctgtttccaagagtttgtgctgtgacggacgggaaaaactagtgttttcacatttcaccagatgttcttgtgatgcttggatttgttgttatggccctctcccgtgtgctatatataaataaggagctcgtagagcgtggagtaccgggctttctgtcttccgtgctattgtagttgatgtcgttgaactgcccttctgtcagaattcatgtaatcttggtacttcgtgtttatttgtattgtcagtgatttgccttgctgctttgctgttggaaaattgtcgtgtatttttgttgatagattatatatattgccttttcgttgcaagcctagctgttaatacgctcgtttcttgttttacaattattgcagctgatcgttctgttctttcttgccgaagaggctttctcatagatacagcaaggccataatacaattattttttctttgcaatttagcacggacagttgagtggaatctcccgttattgagttgataatcttcggtccagagaatgacaagaaaaagtatgcgagatcaacacaaggtccggcgcaaagccaaatctacagaatctaggattgcaactcgatgtcctggatgatcacacccatcaaatgggcaaatttacaaagcctcgaacatcagcggggcaggacaaaactggacaaaaacaatcacacccatcaggttgcgaccggttaggacattagtcgaggcaaagaatgaacaaaatttcctgctgaaagaatcatcgccctaagtatgtggttaagtgctaccgatctaccgtcctagtatcattcaagctaccagcgtcttctggcggtggctttatatacctccctaaagttttttgtcgagctctcttcttgattctctggatcttgtctttgctctgctgcttcctccgctccttctcctgctgcctcatgttccgctcccgctcgtacacgccttgccagaacacttcgccggttttcggccagagccacctccggtcaggatgatcctcgtcgaactcttctgccaggtcctcgtccatgctcttcagagtggcgagggagaaccattggattgacatctgacctctcctgccgttgagcagatgttgctcctgcatcgcaccagtctcggggtctacataaaccatcctccttgaactgtggaatgcccaaacgtttacgatcaactcaagaacacgggagtaacagtgttggtcctgtgcaaatcaacagagcaacgagacagaattagagaaggccataaagaaaactaatggaagtataatagtatccattcgaactctcactatgttttgaaattttcagatctatacatgacactacgtgtgagcatatttcattgaattcagctgaactgcgctgcaactgaaagaacattaaaatgaaatttgtttcatctaaataaagtaagagatggacgcaccctgtgaagactcaatatgcaatgccctgtttcatgatgtttgtcgtacatttgtgcatccagagcatctacaaacattctggaaaattgcagcatatcagtagtggcaaccaagtagctaaaactgtactacctccggtcacttttatttgtcgtttcagacaaaagttttggcttattttctttgtaaattccttgtctcaaacgtcaactaattatgaccggagggagtagattataagacaatcacattgggtggggtataaaagacgagcaatgcagctatataacaaatcaattgaagaaaaggctatttagatgcctaccatgatgctactatagcaagaattactttgaccacatgccaattgaaattgaaagagtttactttagaccgcccaatatctgcccaggtaatcacaggctacgctgtaacatttgaaagtattcatgttaacattcattgccaccacaccaattctgcgtactttaatgttatacgtttcagcatattgttaatctctaatttcagtctctacagcaagcttatcactgtgatacaaattctaattttacaagtttttaaaaggcaacagtagttggtggcagtgaatcctattacactttagtctttctaaatattgctaatttcatatttccatccctaaaactcaagtttatcaaggaaaggtccatgattacaaaatcatcacatatacatatcacagaaatggtaatttgcaattagaacaatgtaaaaagaagttaagtgctccctataataacaaaagtaacaataatgtgaagtgtgttcactgaaaaaactctttgtttcaaacaatattatcacatgtacgattcatttttctctagtagaaagataacaggcatttagctattttgagcaaatattagtagcagtgttggtgtacttgtgctttgaaatgtatacaccaacagttagctagtgacatcttccacttaatactgctatgttgactattgaattccaaaagagataatgtgcaccttgagaacattacaaattccaggaatgatctcgtaggcaaaacccagctttgcatcacagaccaagtgtctccatcattaggcattagtggcagggtatgcaaatcatcatcaagctgcacgccatacatcctttgaaaagctttcagaacagctgaccttcaagatagtaattgtgtagtggattagttcatccataacagcattcagttcagtttggcagcatcatcggaaattctatatgatgaagctaactgcttttggttggaatattgatattcataaacagaaaagtaatgaaaaaagtcttgcggtttagtaataatagtagaataaacttatgagttatgtccaatccaaacaaaatcattttaaactggagcatttgtaatactggaattgcagtctatgcagcatgtataaatggttaacctgcaattcccagcattgatcgcatcacagaaggaccagaaatcttggcttgctaggttcctttcatcttggtccatccgaacccaaaaatagaaggcatctccatgcttttgagtttgaatagcttccaaaagtgcagtttcagcctttttcgacaagtttgcctgttcagtataaattgttggcttaatcattatgcaagacctctctgctttgcattcttaaaaggatcaaagcatatgaataacatggttaaccaatgattcattcatcaagtaaattcatgatttaccaatcatacacgtcgattaaaattaagggggcttaaatgcaaataaaatttgatcttctacctttcttgctgtcactctccacgactgaaatcctatccaagaatttttatgaattcgatcaatcctgttggctagagcaaagaaagctccaaattcaccaagaatatctctgtagtacccattgttcagcagtggaagacgagaagaagcatcaatgtcatctgcgccaggccttcgaccttttgaagactaatcaaaaaaataaacttcattgatcaatgtaagtcattggaatatttggaaacagtcaattatatttggctagccatatatatgtttcatcaattacccttttatgatacatcattcttctcagactttaggataaagtttagatggattagatatacagaagcttgagagctaaatggatttataattctggaataatcccctcaaagattgagaaatcatgaggatctctccctcctgaagtggctcttcaagccacatgcgacagtttgcaagttatctccaagttaacatttagaaatactgttaggttttcatcaaaagttggaaattcccactccatattaggtgaacatatgtaacaagtcatgaaatcaggtatataccagtttagaaaggagtggtccaaaattttggaatctacaactactgctctttttttcgtttataacatcagaaatggtttcaatgaactcctagttcgaccattcaggtaaagcgcaaagagacaacaaaaacttaccagaccaattccacgataaagggagcttctatgcagaaagggccaagtcccctccccaaagaaaggttcgtatatagaaagtggctgacctgtccgctccagctccttatcatctctttcatgcaagtcattcttcatcctctctactcttttgacatttctatacacttcctcccatgttccatgaggctgttcactcctctctgggctgcaggaa

SEQ ID NO: 42275 - DNA, 8971 bp, Oryza sativa
atcatcgatctttgatgcattactgtgatgatcttccatttggttgctgcgccacttctcctctagtttctggagtatattgtagccagccaaagtcccattcatatggtacaagtgcttcacatcctcaaaaagatgccatttccactcttgtttcaaagcaacaggaatctccccagcagttaatggggttagtacttcagcaggaaacttgataacgttttccaatagcacagcatacccttcaatggtttctgaagccataagattcttggcatggacctttccagctgatgcaattttttgccccagaacagatatcttcccatttgatactgcttgcaatagaacttgtgttaacttgccaatgttcttacttggaaaaagaagtgcattcatcccatcatcaatctaagacatcaagataaatgtgtcagttagcatcttaaaatctacaataactggtatttgagctgacaagtacaatcctgatagaatatgatatgtatccgtgaacatacatattttctgataatttcaaggtctggagctataaccagcttctcaagacacatagcttggactagcacactcgggaaggattgctcgttaaggcaagaaccatatataacaaggtcagatataccaaggaggttgtccttatcttcagaagcaacatgttccactgcaccccttggaaagccaacatttaaagaaacagcctataataatcaaacagcacaagcaattagaccaaattttaaagctttaaaacttctgaaaagcaaatttagtgaagaaaggcagaaggagcgctaaataataacctcaagggccatcctatgcttctcagttacgttttctgccaagattctcactttgagttcaagttgtgtgctattctcagaaggatactgttgtaacagagaccctactgcttgtaagacaagtgcttcttccatcaaaaaaccaccatatgaaaattgactaccaacaatagaaattacaaaatcactcggacttaaacccatactgactctcacatcttggtcataacttttggctgaaattctatcttgaaatggtactgcaggggaacctggaatcacgaaatagttaccagaatcaaatgcagcatacatcacctgcaggatgcaaatacagttaaacagtctatttttaggtcgtacgactatattcaatgacaataagttatatgatccaaaagtaaataccggcaatacatagttggggaaaacaataacattcgccctactgaaggcctctttccaaccatctaagatctggatcattccactagaattatattcactaatacgatgagcaagagaactttcttgaacattccaaatgacgggtatggatttgaaaggctcctgcagaagactgtagatagtctaaatcaaacaatagattttgtgtaaactttaaggtatatcataatgctaaacaaatcaacaaacagctatagaacctgttgtttcatacctaccttgaaaataccggtcttgcttcaatagaatttacaagtatgccatcatagctgcagaaataatgcaaataaacctgatgaggaaatgattacgaagtgaggctgaggccacatgttatgcaattgtacaaagcgagaaaaaatgtattgcaggatacaacaaaatgagatatatacttcagaaacttactctagccaatctacagatatatgtaagtctgtgtcctcaggtaaaaggtcaactgtgaccccgatagttctccaaatattagtacaaggaccatccttaaatgtgaaaacctgcaacaataatttgtaaagggggtcaagggcaaaatcacaaaactattttttggcgaaattatagatcaaataacaaatgttaggtcagattctagcacccaacatgctacggatgctaccagtgtcagaaactcatgcataatgttctcattcagcacacttctcttcattccaacttttttttctttttgcaagccagaagcccagaactgacatattagcatatgcaacttttacattactggatactatcacaattcacacatgatggaacctgaacttattgcaaagtatagaatgcgataacaaaagcaaaagcaacaatatacccaacttctacgataataaaaaaactaacggaaaacataacaagagacacaggttgcactcatttcgttcgaccggtaagttcactacgcagtaatgaattcagagcgaaccagttcagcacgcaccttcatttcgtagcccatcgcctctagcaccgaggcaacgctaaccatctgaagctgcattgcaccgggagagagatccccaaacacctacaagggagtccaaacacaaacagcgaacgaatcaaaaaccccacgtcgcgagaagaaacttggcccaaatcctccacccacaacaccacacaacccagctcaactcctcaccatggcaagtcgcggcttccggaccccgaacctcctcacgggattcccgagcttcgccaagccgtcggcctcctccctccgctccctcgcccacctctccctcagcctcgtcggctcgaacgccacgccctcgcctgtctccaccaccccgaggccgcggggcagcagcgcctcagctccccctcccctcccgccgccagctctccgcgagggtagcagcatcgtcgggcgctcgaagacggccgatccggggaggaaggcgacgacgaggatggtgacgaagaagaaggccgcggcggtgccgatccactggaggtagtccaccttctcgaacagcaggaaccgcgccagccgggatctcgcgctcccccgccgcgtcggccccaccacggagcgcagcagcggcgacggcggcggcgggtggccacgcttgtatccccccgcccccgcacccgcacccgcacccacaccgccgccgtcctcgagggaccccatggctgctacgctagggcttagccgaagccatgaaccagtagtagcagcagcaacagcagcagcggcggcggcagcggtggtggtggcagtcgactgtgctggactcgtgagcagtacaagtctctctctctctcttctctcctctccgcgaggcgttccgttcgctttggtcttggagatggggatgggaggaggaagacgaggaaggtggtggcgtttaaggcaacgcgagcgtggcgaggcgagctcgcggccgtccgatctcgatccgacggctcacggcgggggattcccgcgcccggagcatggaccccgctgtctcgggaaccggatggggatgggggccacacgggccacggccgcctggggctccgcgcgctgtcgccaactcgcctcgccggggtaggtatggcaggtgggaccacgcaccgtccgggccccagctgcagtgtctgggtaagcccgtgtagcaggtgagaaatactactcgcggctcgggcgggggtcacgtttcggtcttttcgacgagatgtttttctcgagcagcgctgtggtggaactggaaggtgatggaaatggaataaataattaatccgggcttagtaagataattccgtgtcattatcgtttcttggcacgcaatggaaaagtgttactaccacgaactaaatcttgagaggaaaggattctgcaggtggtggcggcagctttgattggtccgcccgtaaagtttttcagcggggtggggtacacgggggtttagatctttatttttcggggaaaatgaggctgtgactgtgaaagctcagcacagccacagcagaagcgtttctgtgaccgaaaggcggaaagatcgcaaccgtggccgtgccaaagtgtggatgtgcaggcggccggccgatgcagagcgcaatggcggctggagaatgtgtagaaagcatcgcctttgtagtttggcctccctgggaaccgaggaatttagcggaaatttcaaaagaaacaaactaatttctgttaaaagaaagttatacaaaattcttgtgttctaaaggagactttttttttagaattacacagtacaatgcagacactcacaacgcacgcgcattcatccctatgaaaatatgcacgcaaattctacccctacaagcatcttcgaagactgccggcaaatcctgaagagattgacgaagtcaccacagacgcctcgctgtcgacggatacgtcgcctaccactgaaagcacaagtcagcaagaatatactaacatggattcaaacttaaagagaatccgctggaaatttataatcctgcagctgtaagtgggcattttagattacgcagttcattgtctttgggaattaagaggattcgctcattagactaaactaagtgggacggtacggtttgggcgttggatgcttagttcttaatgacgttagcgactaacggagtagcgtgttaacacgtgcaaacaaaatcttcatgggtttcctagctactaatggccaatatgagctggagaatataagcatgcaaattgcgcggtcatgtgcgtgttgaatgccaaagcgtgcaaagaggaggacctatctgcacggcagctgacattgatttgctcatttgcatagtggtagactggtagtggagtgagattttggacaaaaggggctccatcacaagtaggctagagattgtcaccatctcttaggcagcgttctagagggtgagagagtgagtttgtttgtttcgtttttcgcgtacacgtttcccaaactactaaacggtgtgtcttttgtaaaaattttcaacggtgtgtcttttgtaaaaattttctacagaaaagttgctttaaaaaatcatattaatccatttttaaaatttaaaatagttaatactcaattaatcatgaactaatagctcacctcgttttgcgtatcttctcagtctcctcaatcccttcttctcaaacacacccttagatctgctcgcactaaaaccactcatcgtcgagactgatgtatccgatcagtaatcagtttgctttacaatcaagtaaacagtcagtttaatcatggcaatccaagcacaataattaagcattcaacaatgcgctctcccatcatgaacgtgtactgtagatcacaacagtctattcaccgccccagtcgtgtgctgcagttctagaccaacggcagctcagatgacagtttgcaacagaatgcaatacattctcagtttctcacaggactggtcggaataaggtctcctttcaagcggatgaattttggagaattttttttatgaattgaactaattcatgcaaattcttgtaaaattcatgcttggttatttacgacccacatgtactaatcatgcaaagttgaaaatgtttgtggtaaactaaccagtaatatcaaccagaccaccaggacgctaggaaaaagcaaatggagcaggtagggcaataccccacaggaatcaaaatcatatggtccattctccgttgtgctgtttctgaaaaggcaatcatatttgatttatcgagacaaagacaccaaggcgattgacccacccctcttaaaagttgccgacacttgtagttcctgctcagcggcagaaccacaaatcgcggacaccggtggcaaatatcagtatatctcagctccgagcttatcctgcactgtagcaaaattagcttgtggataactctgtatatccagtgattctatttcagcccagtcctggtcagcattccacgagaatccaagctcatgtgctgggaacagatgctatcaaacatcaatgaacatggcaattttagtatgggactcaaatatgagaccaaatgctatcaacgagattataatttttcttaaagaaaaaaacatatgttagttgcaaaaagggcatcagtcttacaaagttacctcatccattccaaattatagggcgttctctttttaaagtaaatcaaacttgataacttttaactatttatcatactaaccatatacatgctaagtattatgcatgttatattactagatatatattttaaagtactttcatgtgatgctaatttcatatttattaggaacataagttggaataaattaatggtcaaattatatcattgaagaccgtataaaaaatatagagcttataatttcaaatggagggagtataatctaacaaagaagcccagtatcaaacagttattaggcacaatgagataacaggaacttagaggaaaaacaaactcaagctaatgcatcaaagatgtataacaatgcacgactgaaagtgacgtgaacttggtacaaaggcagtaaacattttcttttgtttagttgttgcatcatccttaatgtccaaacaaatggccaaaacgaaagaacggtgatattttatacttggacggcatgtcaacacatgggcatctgacactggaacaaatagtttcacaggtgatctggtactaatctaattaatgttaggtaggttaaaatataataccagcgaagaagatatgctacaaatagcagtaactgcagcatattcatcctagttccaaacttgaataaagacagatgcaacgtactcaagaaagacaaatggacaaaacaccttgaacctactctggcttttcttgtaaaaccaggtggcatgcctttttgtttttgttttgtggatggatgaaggaatacagctattaagagtaatgaataaaattgaattgacctggtcacgaatcgtgatattcctacaaagacatggccaacaaaaggagcaacatagcttgcagacaaaactacgatggtacaccatggatcagctgattaaaaaaaatatctgacaattggccattgttaagcaacaggctccaaaacttcagtaacacaaccttggaaaagtgtgtcatatctcaagctcctcgtgacatcaaagaaatgagctacagcttcttctggtgtttttacaagaacaccatggcccaagtttagtatatgaccttttggaccagctgatttgacaaccctgcagagcagaagattgggtgaagaaccattagcagcctccagtgctggttccagaaatgtatttggaatgtaatgaatgagtagaaggttcagtccatcaacagatacaactcctactagaccacaaacaaatatcaagggcttaacagtgagcatagctgtatttatacatgtttcacatttataccacagtataaaaaagcatgagatttgaaattgtgaaataactatatggttggtacacctaatccatccaaaatatttaatcataactgagatctgtaactatatggttggaactatatggctgctatttaatcatatatctgagatctgtggttggatccttaccaccaaatccatcctaaatatttaatttgtacatcaatcctatctcttgattaagtaatactatccagcacaccttgacaccacccacctgacacccagtgatgccacccacacactgagcgaaaccaacctaaacacctcctcacccctcctggtgcccatatccacatcgtacacctccccctctagtgtattttcgttttgctttattttcttggctgtgcgttccgtgcgcaagctgactagtaataataaaaatgcatggtgttcatctattacttgttctataatcaagagtttaagacattcaagggaaaatgctgcaaaagaaaaatcattggtaaaccacaaaacacagatcataaacgaattcacttgcgcaaactgtacatatatgaaccaagttaatcaaagatggcagcactagaagatgaatgatatgagtgccataatcacatgatacaaaaacacagtgtggacaatttggagacctcactgatgaagcattctcaaatgtaagtattagaaacttaaatgaacagaaaatgaaaatgcacaatgaagttttaactaacctatgaatttcatcggtcagtactggtaatggagaaaatagaaatgctgggtcaacattcccctgtacactaattttgttaccaaggcgtctccttccatctgccatatccactgtccagtcaagaccaataacatcgactcctgtgtccgtcattcgctcaagcaagcctccatttccatttatatagagaacaagtggtacattggggcattcaatcttaatcttattcacaatctgccaatgaaatggttccatgaaattcaaagaacagaatgaacaacaaaattcaaactcacacaaactttacaaactggaatgttttggagggcaagatgccaagatcaatgggaaactaagtcaatatgcagtcttgcagatcagctaaactatagtgaaacattgcattcaaatgcatgtatatgacaacgtgaagctagcattagcattttacatttgtttctgattgcttacaacggattggttctttatgcactccttgtttatttatgtgtttcttcacaggttatgtagtaacttgcaaccataaccataccaagctcgaatgcgctgccagaagttgtgtggaatccaatcaattgataaagtatttgtttaaatacatagaggcatatttctcaacattttaaagaacttcagaaattttagggggtatgctcattgatgcagtactatacattgtagatccaacctgattaaccttagagcagccacccatcatgaaattagtcataaggattaaggaagcaaacaggaccgagaaaagtaaaagtaagctacctgcttgatatatggttttgaccactgctcccacacatgaggtggaagttgtccaccccatgaatcaaatatttgtatacattgagccccagagtttacttggtaaataatgtattcagatatggcgtctgcaaggtgagacaaaagtccccttaacacatttggtgctgtgtggcacatgctctttatatttgtgtaagtgttggtcatccccccttcaacaacataagttgcaa

SEQ ID NO: 42276 - DNA, 36920 bp, Oryza sativa
aaaactgaatggaatccaatacactctcacagaatgatacttatacattgttgatgttcccaaacagttatgaaattggagaaaaatatacaagtagagcagacaccagtaaccaaattaccaatgtttggtcacaacctggtctaacctggtctgcaactcactggttgctggaaggatttaagtgaatcacacaatatcatgaatcccaaaaatttaaaacaactattatcacaaacattcaaatcaagcatagtaaaggagcagactctggaaataagcatgtgatcgatgtttagaagagacggtgcagcaatgataggtccacaaaaatgtcaagacttccttaacttgcttagtgtttatgaaagccaaattttcctgatatttaattttagtcagttgtcaggaacggcagaagaattactcgactctactaatgaacaccgggtaattccactaccgttttgttttgcagatgctacacagcgggcttgataataattatgcactattgattccaaatcaccttagtctataaacatgacacgctgccagcaaatacgcatactatatttcagcaccacttgcaccaacattaacaaaattgtatttatataagtaggtgagtttagtggcgacaatacaacgccactagcctaacgaagtagctttcgtgaatcagctaactacgccagcatagaactagaatgtaaaaaaacctctatcccctattagcattttcataaaaataatgctgaaccaaattttacttgaatcctgtaaaggccaacacagcttgtcgttttactttcacaataactgccagctcatataactagatttacattgtaccaattcatcatgagcccccaaaccgagtttcatacaacaaattttaacagaaagggggttttccataccacaaaaatggctgcgcattacctcagtgcgtagaatcttgagcgactcaccgacgaaccggagcttctcgaagtcaatgggggtgagctccctcacctgctcctcggacctcacgggagactggatcacaggccccttggagtcggagatatcgaatggcaccccaatggccggcagcggcgtgagtatgtccgagaacaggatgacgccgtcgggcgcgaaggcgcgccacggttgcagcgtgatctcgacgatgagttcggtcgtctcggaccgctcccggaacgaggggtggcgcttggcgagcgcctggtactccgccatgtaccgcccggcctgccgcatcatccacgccggcggccgcggcagcccgtcctcgcccctcgccgcccgcaccagcagcggctcctctggacatgcgggaggcccagatgcaggtcagattagggcgaaaatggaggaaaactggaggagagagagagtagtaacagcagggcggttggttttaccagtggaggaggcggttgcgagggacgcggagatggcgggaaggccgctgcgccggcggtgggtggtgcaggaggaggaggaggccggcgccgcggcgaggaaggcggcggtggccgtcgcggagatcatggcggtggcggcgacttcgcggcgtgggcttaggtggctgttttgcttatctaatcctgcttggggtcgggagtttgggtttgggtggagaaggagcaactgctggtgcggattccgcctccgcgccctcgtggcctcgtgggccaacggggaaggacctggcatgccaccgtggctagtacgaagagaaaaaaaaactcatttcaagcctttatttattttgtattacaaacatttcgaataaggtccctttttacattggccctaatccattttgttgccaaaatttgacccttttttggacttttattacgtggcattggacacccacaactctagcaacatactccatgtgttgctcttatatgtggaaactttttgtaaactagtacttcatccatcacaatttattcatcacataagattttagagatattctcaaaaaaattattattttaacaaaataccttatgtttatttataaatgtgcatcgtggaataccatgcatgcgtgcaactatatgcgtgtagccaatcaatattaacttgaattggttcaactcatgcaacatgtagcgcccgttccgtcatggcgcctagcgggaaaactatctcttaaaaaccctatttgcgaaagctgtttctttgcttgtgatctagtgtccgtgccatctcagatctcaaatccccgatctatcgtcgaattcaatcccgaatccaaatccttccaaatcaatccctccgcaaaagtctatttcgcctccctcgggttcgatgggccgaatccctctcggcccatctcccatctcctctctctatctccctctctctctccgctcgcgcgggcgtgcgcgtgagccgcgccgagcgcctcctccctcccctcgctcccccctccccgcctccatccctggcgagcaccccgcccgcgaaatcggcccccgcgcgccgttgttcgcgcgcgcgcccgcgtggtcgccgcccgtgccacgcctacgccgtctgcgtcatccggccccgcagccctgccgcgcctgcccgcgcctgtcgcccgtgtcgccgcttcgctccacaccgcccccgccgtcatcgccgtcgtcatcgcccggcccccgccactccacgcgctagcctccaagggacggaggcagagctccttctccctctgccgcgtcgcccccgctcccctcctccttttctcaaagaggcaacgggcaagccccctttctctccctccttttcccttttttcctcccgccggcgtcatcctccctccgccctgtcgccgatttggccgctagccggagcgccagctcgctggcttgaccgtccaaagtcggttcccctctcccaaaccgacattgccatcctataaagcccaggcgccctccctctcttctcctctcgttgtcccatcgcctccactccattgtcgccgcctcccgtgctctgttcgccgtcaccgtttgtcgtcgcgcgtgtcggaggagccgacacgagcgaggacgcggaaggggactccgggcgcgccctcttcttcctcttccttggcccgaggccgaaacgatcacgtttcgcgccgtcggctctcgtcactgcgcccgcccgcacggtagtgcatccctccgttctccctcctcgttccatctcctccccttagactcgggtagtagcacgagtagcctcttcgtagctagccagcgccgccccgacctttgccgtcgctcgccgtgtgctcgccgctgtcgccgcccgagctcggaaacgcctctcgtcgccggccttcctcgatgcgtttcctcctaatccggcgcaagggacggattcccgtagccgcgtagatgctctcgccgccgggaatcggcccctcgtgacctcgtcgccgttttccccttttctctccgctggtggccgccgccgcaatccgccgccgtcgagctccctccagcgaatccgagccgttggctcgactcccctcgtcccgcgcaacttcccggtgtgctctctttcgcctagatcgccgtgtttcgctccgccgctcgccaccgccgtccgccgtccgttccggccggcgtcttcttcaacctcccgccggcccgcgttgctgccacgtaggcgccagctcggccaagaccgggtcgagccgaccccggtcagccgctccctccggccccgctcgcgggcgcggtccaccgcgagccgtgaggctgcgcgtgggcccgccgcatccgcgtccaccgcgaaccacgcgcatgcaccgcgccccgctccacaccctagcgccgcgccacgtgctccctccgcacggtgagccgagccgctggcaagcgggtcccacccgggaccacgcgagatggactcggtccaccggcgccctctctctcccctccccgcgccctattgggccgtgtcctcttgggccggccggcccatttagctcggccgagccgccccttttctctcgggccgcgccctagccgcccgagggaagtctacttcccctccatcttccttttcttttccaaaagggtttaattaaatcctttttcctttagaccaaaaatctaataatcttagaaattcaatatcttcccaaccgtaagtccgtttgactctgttcaacttccaaaattcctcgaatctcgagatctatctaatggcacgctgagaggtcattaatagggccttattttcgccgtttgttgagttgtcccgtttcgcgtgtagtttcggagcccgaagacccgcagtgcgaggatttcgaggatcaagctcaagatctcgagcaaggcaagccacctttgaacatcttgagcctataattgaacttaattatgttgcttgaaaaatattatgcattgataggatcacacttaatctgcttgtcccgtctgcaaggcagattggcggacctacctattttgttgcattgatccttcctctgttaattgctatatcatgttcccttgtaaccacatagtcgtgcctcggtaatcgtgcactctgcacgagtatcgacggtcgccttcaaacttaaaatctgaaaaacatattgggtaaaacttgggttttacaaaagacttggaaaacccgacacctgggtcggtgcttgcgaactaaatgaatttccaaaaccgcggaccggggaacgtaccgggtgtacggtttcccgctcttgcacttaaggatcgtttccttggaatttcatccgaacataagacaagtacgaccacatgggtggaatgggacacccctggctgagtaactagcttatcaggggagccttgatgccgagagacatgtggattcaccggggtggtgtcggggaggacccccgggcttcctggcacagtatggtctgggacctaacctgttgttggtctgggacccctctcgtcggcatatggtaaacctgtgtcggctttcgaaaatgccttgtcatgaaagcttggaggtctcccgacgtggctgatccccacgggctgggtgatccaggttagtaatgtcgtgtgggtaaagtgtacccccctctgcagaggttaacaaactattcgaatagccgtacccacggtcatgggcggatgtgaggtgattcctagcgtagttttgttttactactgcttgtgaaattgctgttgtggaaaggggatcgatgtttggaaaatctgcagctgatgggatcagctaggctcgggtggccgtttgaaagttgtaggcccgggtggccgtttgaaagttgttggccgggtgccaatcttgaacaattcaaaagactgatacattgcacatactccgaccggacgagacgcactgtctcatccgtgtcgtttgagaagcactcacttagttgatttcagaaaagagttcaaataaaatcaattgcaaaaacaacagcctttccttgaagcctgcattaaacacttatttctcatggcttgctgagtactcccgtactcacccttgctctatataaataatcccccccagttgctggagaagatgaagcggatcccgctgacgaggagttcttccaggagcaagccggctacgatgagttttagggtttcggcctagttcccaagtcgcgcctgtgatgtttggtccaagtcttggcttccgcttcccttttgtaatgcagttgtgagctcgggatctgtccgcagcccaacatgactgtactcctactctataataaagagacctctgttgctgtgatattctgtcttcctgtgataccagcactgtttcctgggactggtatcgattaacaggttaatttggagcgtcacgggctagtctcgctcggggctagttcagggcgtgacacaacatttaaagtgtaagttattttttattggaacgaaacaatagagaaccgccttaaatcaatttcaaaatgatgaatgtttggtgtcctttcgttgctctttgtttatggaatgatcaaaatgggatggatgggactatttgagatggccaaaaaaatatataaaaggtttttttatagacaatatggctcaccaaaaaaaccttcaaaatgattattttcttgttttagttcaattcaattcttccatgaacaaaagaaagaggaatccaaattactcatgaagcatcaaggttaactaagctctggggagctttggtgctttagattttttttcccaagagaaaaactactgtcaaacatttgacatgctcaaaagtttcaaggatgggattaaacttgtgttagtggaaattactaaacacatgtaattggaaggtgaaaaacaagaaactgttcaattattgaagatttgtgaaacttgtccgattttttttaataaaacgaatgaccgaacatatgtcaaaaatgttaactgtcttatataaaaaaatatagtttatataaaaaaatgaagacagtataaaggagtataacacagataatgtttcggatgaaatcggttatattaaaacctactgggaattggcgagctgagagcgattcggagcggcgtgttcgtacgcagaggcatccacgtcgcccgcgagcgctgggaggcgggcggaatccgcgccctctcgtgcgtccgcgccgtgcagctcccagccgttcgattcgtcgcagcgacggctaagatcgatcatcgtcaagagtgtggtggcaatttttcaaaaaaaaaaccctccgttgcattgttaatgtgtttagaacccaagaaatacggtgcgacgttgtggtcttttacgtataagccctccataaccaagaaaatcttacatgaagaagagagaaatctaaaaataggaccgcgctctgaaaaacgagcatcaaagggcttttttgaaaaacaatatatacctataccccttcccccaaaaccctagaatcattgctttccttcccctctccgccccattgacgccccgcgccgccgcttcattctccagcaccaatcctcgcccctgtcggcatcgaaaacggagggaagtgcgcgtgctgatgtttaatcatgcgatgccaatgatgtaagcgcccgacactgccgcgccctgctgcccgtcctccattacctctctctctctctccttgccgttggttcctctgagctcaagctcgatggtgagaggccgtctccgtccgtcggcgacgagtcagtctatctggctttcaatcgggttaggtcttcgtcctctgcatcacctcgtcgtcgatttacctgtctccacaatccaagcccattctgccttcagatctggtgacggctgccttgcagtagccggatttggcgagctcggggggagggggaggagcccacgacgatggtggagctgaagcggatgacagccaccgtggtggtgtagactgattggcccaggaggcggacgcctcgagcttgcgagaagatggcgtcggcacggtgttctccaaggtgggggtccccctcgcgcctttctctcgcctgctttagacaatcacgagccgcctcgcatcgcctaccgccgccgctgcatcctccgtcctcccctcgctgcttcatctggtgccgcctcccataatccagaggagggctccatatggtggtgcagcgcttgatccggagcagctctgatgttggacacgatggcaagccaagggattttaccaccagcatctcctggccaccctcatcacccccctgctgcctcctctaccatctcctgctttgaatcaggtttgtccaaatcttttgcttgctccttatattccatcgatctgtttctctattcttaattggactatatccattaggaaaaaaagttgtattagcttattgctaatcttctacaagtagaataatataggttggtttcccttgctctagaatgatctagcatctgctgttatgcatgcttggggtactgcattttaatagttggctgaaagcctttatctagctttgcagtgtaatgtttacattttcctttgatcaatttcagattttttttaaaggaaacaatacacggtgtactcaatctctgaatgatgaggtcagtgacaaggtaccatgtctattgataaatttgtgccacagtttcagatttcataccgaactgtgtcgataaacctgtaaactcctcaccatcaaaaaatattgtaaagataggggactaaaacatatgcaaaatagttaatatggacttatatttttcagccgcctaagattttctgagtacaccaatcatccaactgaattttgaatttactctaagtaccagatgtgcagggtgttcattacacttaagattgacacttaccatttattttgtatgcatgcatgttttatttttggtcatgagctcagagaatcgatcattccttttctgcatggtcaacaaggcctttaattgctagcttgctgatgatagtctagcaatttggtccagcacaaaaatgttaagtttatgaggaatctgtttatttggaaaggaaaaattgttgttagtcatagatggaggctatagcccaaactaatgtttttttctaaagaaaagatttctttaatttagtaatatactagaaaatagacgtggctttgccgcataatggaccaaccagtataaaataatccatctgtttcatattgatcaacgtttaacacaaattaaaattttcaaattgatcatcacccccttcgttagacatgtaatattattgcatttaagcatcaaaattgagtttgcgcatgaatgtaggaatttgaggtagtaaagctatcatttcttatatatggggctcagaaggagttaaagtgtgcgtgtttcttgatttttccctatcacatacttacattaaaatgaaatataggaaagttaatactttttgttggtctaggtgaaaaaagttatataataatcaatatggaatgtagggagtctgatacgtacacctaatttctttatttatttaatgcctcaaatgatgaaactttacccttttattcatatattaatttaaagcagcaagacattgaattcatggacataagttggaagtcgaatatatgcgcaaaaattccaaattcctatgaaccaaagtaatgaaacggcttattcccattttatctctcctcacagtggcggagctagaaagatttttaaccctaagcaaacttcacttctagtaattgttgtataaatttcatcatcaattcattcaataacatataaatttagtggagtttttgtcggtgagcatgcgcggccacctgggctagccaggcggtggctccgcccttgcctctgtatgtctataaaaatcgagaaaatctattattttaataacacaattcgaatgcatctgtctataaatgttatgcaattcaaatgttttctcaaaggatttttttcttctgtaagaaaatactgcattaagttttaatgcagatatataagtttttggtagtagcatttttttatggtgagaaataatgcattacattttgaatgcacgtgtatactactgtgcattcaaaatttgcacgtgtatattactgtgcattcaaattttaagttattattaagaacattttttccttgtgcaaaatgtacatagaacacaatgcatctatatatgatgctgtaaagataaatgtattctgtgttttctggcaatgtcgtacatatatttgccttttgagcaattcataagtgttgcaatttaaatctaaatttaaacccaagcaactagtactcatggtacaacaattttcaaaaagcgggagaactctgaaacaaaagatacattaagagcatattttgaaacgaagtacaccattttttttgttgaagaaatcattactacgcaatactctgcaatttgaatgtactttgggagatcatattttttattacatttctgaatgtttgtatgcactactatgttaaaatgattttttttgtgatataaatgtatctgagagttcatttggtatcagcataatatatactgttcatggaaatgtatttcacttccacattatcattttttaacttctgtgaaaagggcgtatggaaaatgtatatatgtgcaccttggctctaccaattgggtcattgagcatttgttttttaacattattttaaatcatgcatcatgcacaaatacttgtactccatttttgcacagtggtttgtatacgcatgcaccgtggtgcagtttaaatttgaaatggccccgtcccaaagacatgggtcccaagcctaacaattgaatctaatcgcacagtttctggaattacatgccactctacaacactttaactgctcattggtataaacaagcacgtatctcaaagcgggctaaatggtcaggataacaggtgcaactgcagttgggtgctcatcggcgtttccgtgtaggaaatggtgcgggagagagcaaggtgacacgtggcagattttcacgagaggcgaagcttgatttatatgacgctacgtggcccaatctctggtccgggttaaaaccctgaaatcggtattaaagaaagatatgtgcatactttggagggtgaccatattttttcctcatagttcctagcaaatatatagaattgtcctctttgtttaaacttaattgagaagacattatgacaattttcaagttaaagcactaggggcttcccatttggaggtgtgagtccccttcacctctgtttctccttgacgcgatctacacctttctttttttggcttccaaatcttctatggtctttgctctccatcctgatttgttgtatgcttcttctgtgcaatgaagctaacaaaaagtccaaagcagagctttgcttcagagattctaaattcagttattttagctattgtaacatgtaatagtcatttgtttattgtgttcttggctcaacgtgcagctctccaattatgttccctttttcgttacaacaattcagtttaatgtggacccaggttctagaatgttttatgtataatgtttttagttgaataaatatccataatccatatatgactatgcataatttccagtgaagaaagtactattgattgctactacaaattaatagtagtgtcatgctgtaggtttaggattcaaggaataattggattgcgcttttgtaaggtaaccagagttagatagtagttatcttctttctgaaaatgatggcagtgccaacatccattatttctaaacacacatttctattctttcagttcactcccatgatactgaaggatctgattctgattgcaaactagacaattcaagggtataccctttgttttctcctttagagaaggaaactctgaaagattttattcactatcggaataataatagttgttattctttgttacaatccttacaaaaataacatggtagttcttactttatacactcaacctatttgtaggtatgtttagcttgaggatttttcattttccaaaaaaattactatgcattttatattgtgttgttgtaggtttgtagaggtaaagtcgatgttctttacagagtttgccctacttgcaaggtgtggcacatctttctggccgatctcttacaagttatagttatgtggcataagaaagatgtatcagtttttatgtatttggtcattggattacgaatgatgtctgggagattttataatgatacaacatatggagtgcaggttttattttttagattcatctccaaagagacctgcaagatctcccttttgaggtcatgaagctcccctttcttgcctccctaggcttggggcctcgactccctctccatcgatggaaagctactgaggcagccagccgacagaagacatagagttgatcaagaaacaacagcacatgcataacaagtgatgattgttcttaaaaaaaaagacaagtgatgatagaaatctaaggatgtttgggcatatgctatgctgtatatgtattatgttatcgtttcattggtttttacctgtttttcttttaactgaaggtggttggtatgtcaactccgctgctaccacaaaagataatcttagcatgactataaaaccccgatagagcgcgcatcgcgtcgtaatgtctagttttgtaaatggtaagggagattttacccttagccgtcgctggcggcagcgtccaaccggaccacaccacaatacacttgtccgtggcacacggattcgctgtccaagaaaatatccacgccgagtcgctagtcgtcaccacccgccgcggcccgcgagcagaggaacagcgaatctccatcgacaaccgcgaccgcacccacccaccaactccccactgactccgcaaccccaccaccaactccccactgactccacgaccccaccataccctggaggccgggaccacccacgcgtttccaccccacccccacccccaagccagatccgaacgccacacgcgatcccccgccggcgtcgccgtcgcactccgtccgcacccgatccccactgtcacaactcgcaagtcgcaacgcgcgcctcgtcacgcgataaccgcagcggcgggtcgcggtcgcccctcggtcgtctccgcggagcgcgtctactactcgtgcgcttctgcttcctgttcaaacccaacgctccaccacatcgcctgcgttccccaccccgactgacccagcctccagtagccatgggcaaccgcacgtcgcgccaccaccgcgccgctcccgagcagccgccgccccagcccaagccgaagcctcagccgcagcagcagcagcagcagtggccgaggccgcagcagccgaccccgccgccggcggcggcgccggacgcggcgatggggagggtgctggggcggccgatggaggacgtccgcgcgacctacaccttcgggcgcgagctcgggcggggccagttcggggtcacctacctcgtcacccacaaggccacggggaagcgcttcgcctgcaagtccatcgccacgcggaagctcgcccaccgcgacgacatcgaggacgtgcgccgggaggtgcagatcatgcaccacctcacgggccaccgcaacatcgtcgagctccggggcgcctacgaggaccgccactcggtcaacctcatcatggagctctgcgagggcggggagctcttcgaccgcatcatcgccagggggcactactccgagcgcgccgccgccgcgctctgccgcgagatcgtcgccgtcgtgcacagctgccactccatgggggtcttccaccgggatctcaagccggagaactttttgttcctcagtaaaagcgaggactcgccgctcaaggccactgacttcggtctttccgttttcttcaagcctggtgcgtgctcgaggcttcactatctcattacagaggaatggatcgcgagatatttcattgttccagtgtttgacttcatgaggattttgggtttacttagatcgagttgttgggtttgacaggtctgaaagtttcaccgttactagaattaggggctagatgcaacgctgcaagtgccattatgtttatacttatagatgttccagatgcagtgttctagttagcattggatccatccaccttactccactatagcttgggcaatctctgtgtttgcgtttaccgagatggcattgtacatttgcatgatttgcactttaggcactggatattttccccactggtagctaaatgctggcggcatagcatgcaagatcttcaaaaatgcactcagcaatatcagaaatgccatctgaacttagtgggtgaagcttgactcttcattatgcagaaatgttggtgacggtggaggattttgttgttttagtgtttttcttttacaatgatggtgggggattcttcattctgaacttggctttatttttcttacacttggcatgtgcaaactgagtgctatatgtcccgtagggcctcgttgctaagtgctacaagatctattgcactggaactcgtggttatggacccgaattctttagtatggaacaatgtctttccaagtaaaaacccccagtatatgaaagaatggaaaggtgttttcgttcttttcttgtggaataagaagcctcataccttagtggaaggaaaataagattttttttttcaattaggtatttgaccaaataggatcgtctggttcctatagaacctatcactaaaatactcaataggactaagtggaacgaaaaggattttccttgagatggtaaatgaaaatgcctattgtggatgttgcaggggagcattttaaggaccttgttggaagtgcgtattatgttgcacctgaggtgctgaaacgaaactatggagcagaggctgacatatggagtgctggcgttattctttacatccttctttctggtgttccacctttttgggcaggtgaggtgacgtttgccgcttcttatttcagtcaactttttttgcttctgttgctaacatagatgttctaccttcattttttcagagagtgaagatggtatatttgatgccgtattacgtggtcacattgatttctcgtctgaaccttggccttcgatatccaatggtgcaaaagatttggttaagaagatgttgcggcaagacccaaaagagcgccttacttctgctgaaattttgagtaagtccaccatagctctttaatggcattcttatcaacagaaaaatgcacacttgtctagtagttcagtagcaaattgagatcaaacaattcttctggtttcttcctattgtactttttcatgcaaaagccttgacctgtagctagtagttactgtagtatctcagagcgaagacgctcacttttactgtcccatttttttttaaagagtattcgggtctttttaatagataatttctgctcttgtttctatataaaccgagttatcatttttactgtttgcaaatatagttaatgcacctaatactttaaatatacagaccacccatggattagagaggatggagaagccccagacaagccacttgacattacagttatcagcaggatgaagcagttcagggcaatgaacaagcttaagaaagttgcattgaaggtgtcttctgagtatttattttcgctgctaccaactagtattgcatcattagataattctgacccttttgtttataaaactaggttgttgcagagaacttgtcagatgaagagattacaggcttaaaagaaatgttcagatccttggatactgataacagtgggacaataactcttgaggagctaagatctggtttaccaaaacttggcaccaaaatttctgaatcagaaattagacagctgatggaggcggtatgtttttgctctgcaggcagacacttgagctttcaattgattttttttttagataatggaatattaatatcccagtcactgcacccatagatgcacaaaactataatcacttattacaagttttccacagaaagcgaaataaattaaacataaagcagcatcctgccgaagtgtttggcctttacttcggagcgcccgctcatggcttggtttcctatcgctcctatgtagtggtcggccttaaaagtatctttggactctggcaatcatgtgtgactgcggagcgcctattgcgtgcacgtgcgcgtgcacggcgagagagaatactagttatgctttgcccaaagggaccggaacagtctagtctctagctacctagcttcggctatttcaagtgcctgctgagcttcttccggatcaatgttagcagctgatcctacttagaatgaagccacattaagcttaatgtagactgagacagtaacaacatgctcatttgaaaggaatggttatatggaagaatttgagtatttggcagtagcatgtatacacaactgttctggtggttccagcacatgccatcatatcattatttccttgttttcccaaacaggctgatgttgatggaaatggaaccattgactatgctgagttcatatcagcgacaatgcacatgaacagattggagaaggaagaccacatacttaaagcatttgagtattttgataaggaccacagcgggtaacttcaaatcgattttttttgggtcttgttctatctgttgtttgttagttctcattaatttgctaattttaaatctctctgagcagatacataacagtagatgagttggaagaagctctgaagaagtatgatatgggggacgataaaacgattaaggaaatcatcgctgaagtagatactgatcatgtaagtatattccgtaacacatcttaaagcaagctctttgataacaaaatgtgcatgtcccaaccatcctacaaggagaatgccaaagatttccaatcctaaagtacctttcttaagtagaatttgagctcaaacacaggctgcgaggcccatttattacagtgctaatttttccattttttgttttcacaggatggaagaattaactaccaggagtttgtcgccatgatgaggaacaacaaccctgagattgctcccaaccggcggcgcatgttctaacttcctttacaattgttgaaagaatactgtttggacatctttcctcattatattccaagaacaccccttaagaggcttgatcatctgagatccatacacctgttgccagggcttggacccatttgtactcaaatggagttgcgcgatatatcatttgtagatgcctggaccatcatggatttctgagtgctgctttgttattcgttgcctcatcattcaatttggagtgtaacctcaacgggatgatcagttcaactgctcttccgagcgtgttgcgacttgtgactatatgccacttgatcgtttgtattagatcaggtgttgtaaaacagattttagtgataagatcaggcaaggttatattattctggagaaacagtttaatcttgcttctgaatttcccggccgtatgagaacgtgctattcgagctgaaaccgttcgatctgtccagcagtattgctctcgctgttcttgtcaggacaaaccttgcgcttgcgcgtttactggagtttcgctttgcaccatactctcacctcacactgcgcaaagaacaatttggtcatctacagtatttaactatttatctaagcacgcgtcataaagcaaccaatagatccctcatttccgagcatgcttcaaggaggcaaaaattcagtagtctgcttttcttttttggctttttttttcttctgtacaaacacatcatacaatctacatgaatgaaaatgatggttgacatactccttttacatccacttatactgaaaactgttattctatacccatatattaaacatttaagtcatcagaaagatgacattaacattaagatataaaaactttatccaaaagattcatctctagagcactaatatacaagacacagacatattgtagatgtaatctgaattccgtggttgtacttcgttgtgacagggctggacaaactggaggcttgaaattgatcaacgaacagaaacgtttttcatctttcccgacttgtgcttgacaaagaaagcagctagcatacttttggtacggaggggagccttttggatttgacgccctcttgggttgtcaaaagaactaaatgacgatagatgcctgacaccaggttgatcctgcaaatacagaacatgtgatttcacattagtgggaaatgataatttgaacctggaaaattaagaattcctagagaatgtaatgctcatttgcaagttttacagcataaaaatagtcaggtcttaaaccactcatcaagttgtttaccttcatgccaacattatgcatagcaaaatcagagctggccaagtttgtctgcagatgcttgggcaatggagatgttgatggttccttacctgaaacaaaagcaattccaaatgaggtgttagccacctgtacaaatattataaactatccagaagtctgcctaagatacactcagtgccaatcatgaaagtaaatcacactactggggtgtactaagcaataaaagcaattaaatagaatggtggaaaacctctcgatgcaggtttgtagcctttgtttcttctaggctgaaaaaaatagagacaacagaattacacaggaagaatcatagagtaagcgaccaacttcacaataggcaaaatagagctggcatgcttacacaaattcagattggcgtgctccattggttttggagtttttctctgaagccaaatgccagaaaagggtttttgctgaagagaaaaaaccattttagtgcaggtactttatatcaagatttaattgtgtgctgagtgccaagaaattgcacctgagggataaggtctaggccttgagtcaatatcagcatcagtttgcatctcagagaaagcctgcattcttttgttcgccaaagctgagctcatagagaaaaaatagcaagttaaattaggtgctaatagtttcttcagtagagaattacatctttttttacacgtccttactcggtacaatgtaatgtttgtgatgtcttgtggcggttccggtcatctgctgctgcctaatgccttctttatccgtgtaagtttggcaggtgaggacttgctagatattgagcaataagaatgtcagtttaactcctggtctgcatcaacacaaattcctgagttaaacagcagtacctggttcaagcatgctactttcagctcaagagtggaaacttctgaagcctgttgttcatacaggtctgtcagtttgtaggcaactgtgccaaggtggtcaaccgcattcaccaaagccctcacagcataatccttcaagttgtctagaaccctgacataaataagcatatgaaatcagatcagactcccaatgattgtcacattttcgtgtactcaaatcctagcagccagatgcagaaaatgaacacaaccatttgacagcaagtgatatgcagtgaggatatcagaacttagtacaaagtagactgaaataaacaacggatggattattgcaagtaaactcaacatttccagaccctatgctgcaccaagattaattatctaccagtgtctcggtaagggatcgttatgaatgcaggaatttcgcatgcaaaaaaaaaaattcagatttcgcaagaattatttaaggtccctgtgttccaactcgcaaatgtggcccaagtttctagttcacaagtaatttcctcatccatttctgctatttgtatatgctcagctaactctgaactgattcaccatttaaacctactacacaccaaccgcaacctttctagcaccaaacgagaaactatgtggatagagcaatcataaacaagttcatggtcccatagtagcatcaagcaaccaataatttgcccacacgcacaaattcttgccacaaattttgcctgctagagctgggattcgaatcgcagtagaaacgaaaacgaaaacaaaaaaaaaaactcacatctgcttctgctcgctgtggaggtacgacttctcgcagtactccgacgccgagtagagctgcggccgcaggttcttgagctcctgcgcgacatcagttcaaccaaaagaatcaagaactgcaattcatttcagagaaagaaaaaaaaaacgagcctcgcggcgccgcgggatctctcccggatccgggtccccggccggccggcaggcctacctggagcgccttgacgaagctcttgctccgctccatggacgcctcgtcgacggtggtgggagcgggacctcccccgccgccctcctccccgaccccggcgaccgcgaggccgccaagccccgccgcccacgcctgctgctgctgcatatcccctcgccttcctcctcccgagtcgctcgctgcagttcttgttcggtaggaagccggctacttagcggcgggggcaaggcacgtgaggaggaagcaaggaagcgatgctcctcctcctctcctctccctgccggcgcgcggcagcagcagcaggcaggcaggcaggagaagcgtatcggtgggggtggtggccgcgtgcgcgagtgggagcggaggcaggtgggggcgcgcgcggatggcgacggcggccgcggcgtggtggtggtggttactggtcactttaagccgctcgtagtaggagtaggagtcaatgcttcgcttcgcttcgcttggcggatggcggtagcgagattagggaatcgattgcctccttttccgcctgtcgatggatggatcgatcgaccagctagcttgcgtggttcggttctctgccggtggatggatcttgattcttgcggccactagaaaaaggcgcgtgtttgtctctcctcgtcatctcgacgacgacgacgacttggagtgaggagcgcatgatttcgctatggccacccaggctatgagagcaagtttcacggtagaggtgatggtcatatggcctggcctgtttggtagagctccaaatcctaaatttagttacaggagttgggtctagagtagagttgtggagctacctaaatccagctccacctctctagtttattttgtgagagagctgaaactgtttggctagttatagctctaggagaagtagagctggagctggagctagagctgtgctaaacatgcttctaattttataaaaaaaatatgactattagggaaagacctaatatcaaataaatagagctaaccagaaaaccctataggcgtttctcctaattttacacacaccatcttcttattaattaggagatagtttatacgaaataaggaattttatggtccttcagaaatctcttttaaatatgtgattcgaattttgggcctacaatatattcggattagtttcctaatagaagttgactattaggattagtttcctagtatgactctaagtctttccccactaggactcctagatttctcctatatatagggcctgtttggttgggtatttcaacttaccacacctcaagttagcacatgccaaaagtgtggcgaacgaaatccttgccatagctttggctcaaaaatgtgtggcaaagcagctagaagctgcctaactttctttggcaggctaaactatggaagcaaaacaaacaagggctaagcggttgtggctgactaacatgaggtgcggcattctgtggcatggatccaaacagccccatactcttgtaagccgcacggggagggtgcgacagtccaatgtaccccatgcgtttgtatccaactcctctgtagtgatcattgccggtcggcgcccgtggttttttcctgcaaaggttttccacataaaattcgtgtctccgttgtgtatctattttattaacaacctcgaggtaactaaattttactctaaatttttttggtactttaaggtactcagtgcctagaggcaccaaatattacactagaaaatatggtacctctaggtacattattaaggatgataaaattacccatacaacatattgcctctaatgcacttgtcccaatatactactcataccttattttttttaattcaatccattgatttttttcccttatctatctaggagtttgtatagagactaccctttacataaggggtggcaactcctctctttctttctttttttctcttttctatctcattatgtaattttagagcctcatcggtatgcctaataagccaaagcaaaagggcaaaatatgaactttcaaacttgattttgaagcattttcaatgtaatttctttttagtattggtttttaagccgttacgaacaagtgtataaaaatttacctataaattaattttattccctaataagtctaaacgatttattaagtaatattggcaacccatgaggctcttacatggtactcccttcgtttcatattataaaactttctagcattgcccatatttatatatatgttgtctagattcatatatgtgattcattagtgtgtgtgtgtgtatatatatatatatatatatatatatatatatatatatatatatatatatatatatatatatatatatatatatatatatatatatatatatatatgaacggataatgttagaaagtcttctaatataaaacggaggaagtactatatcaaacaagaggtatgaggtccatagtacttgttctgaggagggaggagcaatgtgtcctgggcgtttgggccacttggctgtagcagtgcagtggtagtactagttcttgggttggagtaaactacaagctgcagggtacaagcacggcgagggagagctgtcaaggggctgctggagattagtccatgacagtacttatacctcgtaacagaggttttaactatgttagcacagtgagtgtaaaagagtacggggcctcctttcaaacgttgatttaaaaatgtatgtgatctggtaccaaacctcttaatgttaattcgtattttgaggaaaaatataaactctaaaacaatggcttttctaggtagtgctggtcgtggctactgcatattacaagaagaaaaagagtattgttcaccattttatttctgaaatgaactggtttagagcagcagctaccacagcgaaaagaaacctaaaagaaacaactgaaataacataaacaacattttgttcaatttctacgcatttcaatgtttatatacactgaacaacacaacagatgactagagcaacgaacagttaaatgaaagactagattgtcccatccttggtttcatcttttctcccttttagctatgatgcccttctagctcccatttcatctcttttccaccatcagcctagcctcttgatgtcatgtaactatgatgcggcgcacctaaccacgttcaagaaatagcgtagatgggtatgcacgagatcatggtgtttgctcgtacaatctttatttgctttggtatttgccttaacttgcatgattagttaagatttctataaaaatcctccattttaaaggacactcggctctatatattgtgtattctacgtactaatagaaaagtcaggtatttggtaaaaagcccaggcaacaaacaactagcactacaacccatgttttcacggcagttaatttccgacgatgaaacatggttagagcccggtcagccgttcatctagcctaagaaacggatccaccagtgagcgcatgttgcattattgaattggagtcctaccaaaaagtccaacgggacagtcggacacatatattcaactaattcaaagtccatgacttaccgcttaaaaaaaaattaagaaagcacatgggttcagagcaaagaaattttagcctggacagtgagatgatgccggaccctatgtacctgcagaaatagccaataggaaacaggttttaatttagatcggttgctgaaaaagcaaggaggggagtcctgtcccatgtttgttgcaagtacaaagtttccatggggcaaacccggtggttgccaggtagagtagttcatgaatgctcttggttttggctgcttgatggattgactagatgcatttaggtgcacctaatcccgcaatgacatttaagaactcatcaagtgcagctttcattgtcaaaacaaaaggggcatacactattagtatccgttactgttcatgataaatacatttcaattcatggagtaaaacagacacgtccaaaccctatagaagttgttccaaaccctatacaaaatctgggttgtgtttagttcctgaaaaaagttgaaagtttgagaaaaaattgaaagtttgaaaaaaagttagaagtttatgtgtgtaggaaagttttggatttgatggaaagttggaagttcggggtagttaggggtgaactaaacacggccacacggccctgatgatgtggaattccctagctcaaacgcatattagatctaagtggattttgaatggacaaaagtagttacacaaaacgccacaacttagttgagaaaacgaacaatatgccactctataagatgggtgggataaaatgccactcaatacaatgcaccggataaaatgccactcaatacgttgcctaccggatgaaatgccactttagagatttttgtgcccaaaatgcccctagagagagagagggaacagagggagaggggagggccggccgggcggcgtggaggcctctccgggcggtggcggcagcggccggctgggaggaggatagggcggcggccggtggggggatgaagaggcgacggcggtggaggcgacgacgcgggaacgcggcgagcctacccgcgcgttcgccaggaggcggcagcggcgggggtagggggaggatgaggaggcgacgcatggggaggagcgctggggagggccgggctggcggcgccggatgcctcgcgcggacagcggcggcggcagccggcggggacgacaggggggaggagtacagggtggaggaagagacgacggcgatggagcctcagaccgtcgtccccgtcgccgcgccatcctcctccccccgtcatccttccccacttcggcgccctcccccgatggagccggcactgtcgtccccctggcggcgcagtcctcctccccttctcgccgcccacccccgcacgctcgctgcccaccggcgacgagcacgaccgacgtcgttcgtctctcccttcctctctctccatagtaggggtattttagtctcaaaactactcaaagtggcaaagtatactgatgataagctattgagtagcattttatcctttgcactctaatggatggcattttatcctttgcaatcttgtggagtggcatattgtctgtttttttccaacttaattcaaaatttgagatatgccatcatgacccacatgtcattgacttatgtgggtcctacatgtcattgagatactgatggcatatctcaaactttgcaaaattataatgacattgttccaatttaccctttaacctagaactagaaggcatggtgaaactctagctgcagaaaaaaaaacaaaacaaaatgtgtcctaccaacaccatcccttgagggcaatggtgcatacagtacattttaaacttattcacttaattgtaacttttaaccttattaaattttggctttataaaactctagtagggtaacaaaccaaacatatgttagaaatcttagtagtttttcacatcagctatgttaccaaactttgataattctagatatttgcacttttcaaagttcaaccaaattttagtaaggtagagttgagagtggctacaaattggacaagtcctttattctatgtcaatcctaggctttcaattttgttttttttttgtctacgacaagatttaataattaccaaaactttaacgaagttgtttggagtgttccttttttttgggcaagatcaactagccctagatttgtaatattgtaaagaaatgaatgtcaaataatttttcaataccatttaaaaaaacaaaaccaaatggatgatagattttttacagggataagtccattttacacccccaaactcttatgtttgcctaaaatataccccgaactacaaaatcaggtataatatacccctaactatcaataccaatcattttacgccctcgagcaattttaagactggttttgattcatttgaacgccacatcagcatagtcccaccagtcaaaccatctcaccggtcacgtgtggagaggggcaaggaagaggggctgtgatgaggaaaatgaggaatagaaggttggaggcagccaatgagctccctccctccactccccgctagcccatccatgacaaggcacatgcaacggaggggggaaaagctacgtcaagcggcagcgcggtatctgacaaggcatcatcgcctggtcaaggacaaggtccagctcaagctccgcatccgcttcttccttgtttagctcgaactcctcatctcaaagcctagtcgccttcgctgaactcggcatccccaagtagctcgagctcgtgtttgtgctccagctcaaggaagtgaggcaggatgttggatctttagcttgtgctcgccaacgctcggcccagaatggggcagtgacaagggggcggcgacgggggagggtgatctagagctcaccggctctcagaagggtagttgggagggagagatcaagctcaccagcgctcaggggtgcggcaacaaagggggagtagagagaaggggaaaaaagcgctcatcgtcagccgctcttgaagcctcactagccgcactgtgtggggtaagagagacggaggagagggagaaaggaggaagaagatgaagtgggtgagccctctattgtttagatgatgtggatttattgaacagttggcatcctatgagatatccacgtgtagcaaaactatagtaaaacaactcgagggggtaaaatattcagtattgatagttaggtgatgcattatacctaactagcatggtggcccgcgcagattacgcggctagcatcattatattttctctcatataatagcatatatgttttcttaatgtattattcaaatatattaaaatgacaacataattttaaattttgtactaactttacgaaactactaatgtgtaatattcatattgtattttatatgcgtgttagttattaattatttttaatatcaaattttagttatttgtaaattatattcctatatggactctagactcgtctttcaatatttttttaattccgaatcttcgttatctgtaaattgtatttctatatatagattctagtatcttcttccaatattatttatttttaattcttattttttttattatttctaattatatttctatgtggactctaaactcatctttcaatattttttaatttttaatttcaaatttcagctacttctaaattgtatttctatattgactttagactcttcttcccatgttttgtttaaattccgaattttagttatttgtaaattatatttttgtacgaactctaaactctacttttaattttattatgtttattccgaattttaattagttttaaattcctatatggactctatactctacttctaatattccttatttttaattccgaatttatattatttcttaattgtatttttatatggactctatactctacttctaatattccttatttttcaattccgaatttcagttatttataaattgtatttctatatgactctagtctcctcttccaatattccttatttttaattccgaatttcagctgtttctaaattgtatttctatatggactctagtctcctcttcctatatttcttattttttaattccgaatttcaactctttctaaattgtatttctatatggactctagtctcctcttccaatatttcttatttcttaattctgaatttcaactatttctaaattgtacttctatatcaactctgtttttctttttcttcgattaatatgggaattttaggccgtgagagcgaacgtggaggctcatttttctatttctttaataagttaatagattttgtagctaggaggtgtatttagataaacaaaaagcttagggatgtaaaatgaacttattccttttttacctggttcatttgggcaatgaaccaaacatgcccataataaccgtagtcataatttaaccatgatggcttgccatgtacgaataatattgagcatgaagatacacatgtatggtcagtgtgagcacatcgtcattgaatgtgcccaagcaaggcctacacatggcatatgctatgctccacatgcttgcgctctcgtacacctacgcgtgcccacttaacccagtgtgtcagttttttttttaaaaaaaatacccagtgggtccaaggctccaagcctaatgaaaattaaaacgtttcaaaaaaaaataaataagagtaaatttcacgaaactacaggtattttggtcaaattatcagaaaactacagatttaacatgatgtattacaaaactacagatttaacactaattttatcacggaactacagatttaagataaaatatctcaaaactataaattttagtaacaaagatatcacaaaactatatgtttaatatcaattaatcataaaacttgaacattttcaactcaaacataatattagtgcaacgaatttaacccccaaaatatgtagttttgtgataattttattattaaatatgtagttttgtgataattagtcttaaacatgtagttttgtgataaatttgttgctaaatttgtagttttgtgataatttggtcaaagtatatgtagttttgtgaaatttactcaataaataattttcaccggttttctagaagaaattagcaaaagtatattattaccgctgaagagaggggagggggcgagttttatatcaggacttagcgcgatgagtgctcggctttgcacgaaggaaatcggacggatgcgaactcacagcactacagaacgaacttgcacgattaaataattaattaccatcataagcaattactccctccgttctaaaatataagcatttctagcaatgagtctggacatatatatgtctagatttatagatagaagttgttatatttgagaacggaggtagtaatcaattagccattattttttcatcacgtcgtaagcatttaattaatagctaatttatcctaagacgatttcgggccttgtggctgacgtggcgtctacatagcaggtttgacttggttctcgtcctaatataaaaattaaaaagtcagtcagtcggtgacaatggagctcgaggatggccgggaggaagagggaagaaggaggcgctgacgtgctatcgatcatggagatagagatgagggtgggacccactgacatgtgggtccaacttttttttttatcttttgtcttacatactatttaatctttataatttgcttccggtgccatttcaccgtcacgtaagacaagaactaagtcaaattagtcatgtaagtgccacgttagccgaaaccgtcatccaaaccacattggaatcttatttgcactggttttgactgttgatgtatatggtaatttggttcaggaacgaaaatcgaactcgctgtcaagttaaggaccaaaaatgaacttactccaatccacatcgttataccgcggatgggccaccatgggcctaatataaacgggtcagacattaactgcaaaagacaggcgacagaagcaaaccagaacgacaggacagatcgaacgttccctttatttcctgacgaaacaacaaacaacacctcaatcagcaagaacactgtacaattcctcctgatcaaaatttccctacgccctaatttacaccatggaccttggtcaggtccatgcgtgcagcccacgctggcaggcacgcttcaaccaacacaaggcagaacgttacaacctcgcaaggtgcagcgacacgagaacgccgacgaaaacgtgccaactcccgacacaaacgcccgcgccgacgccgacgctgggagcagcagccgccgccgccggcaagccgccggtgttcctcaggcggcctcccaggtgctgcgtcgtgcggctcctgacgctgtcgcagtcggcgacgccggccagcgcgacgacgccctcaaggccctgctgcttggcgtcgtagcagagcccctcgttgccgccgacgcggagcttcttgcctagccgccacatcatctgcttcccgaacgggatcggccccaccagccggttgccgtccacgcggagctcgctcgcccgctccagccgccggaagctcgccgggatcaccccggtgaactcgttgttgtccagccgcagcacccggaggtggcccagctccccgatcgactccggcaacgacccttccagccccatgccggagaggaccagcgtcgtcagcgccctgagcccggcgaagatgtcgccggggaccgtcgtgaactgcatccggttgtcgccgaggatgagcgaccgcagcgacgacagcctgccgagcgccgccgggatcgggccggacagcgcgttgtggctgaggtcgagcaggatgaggtcggacaggtcgccgagcgcgtcggggatcgtgccggcgaagcggttctggctgaggtcgaacttgagcagcgaacggcattgccctaggctcgccgggacgccgccctgcagcgcgttgtggctgaggtccaggatgcttaggtgctggaacttgaagggtggcacctcgccggcgagctggttgtagctcaggtcgagaagctggaggtgcgcgagggactggacggtggctgggatggcggatgtgaggttgttgccatggaggtcgagcacccgcagcgccgtcaggttcccgagctccggcgggatcgccccgacgtggccgttctcccggagcaccagcgaacggaacgccgggccgaggcggccgaggaacgccgggacgggctgcgggttggccgtgaagcatcggtagaagaagagcgacctgaggtgcggcagcgcgagcacggccggcgacagcgtggcccgcgccgcgtcgcacgccgggaaggcggtgtcgtcggagagcgcgccgaaggagagcgacacgacgtggtacacctccccgcggtcgggcacgcactcgatgccgtgccaccgcccgcggcacacgtcggcgatgcccgacgcccacccgttccccgtcgccgccatcacctcctgcaccgcgcgctgctccgccggatcggtgcgcgcccggtccgacagccccgtctgcggcgcgttcaccagcgccgccgacgacgacgagtccggcaccaccaccgtgaactcccccctgcacaccgcaaccagcaccgccacgacggccaccaccaccgtcgccgccgccgtcgcggagagcgcagaggccaccatatcaccttgcacgctcgtgcgacgcgatgcgctcggaagggtcacgaccgttgggaatttggagggaagagggtggcagaaggcgcaggttttatagtgtcagaggcgcgcgcgccgaggccgccgactcgcggaggccgcagtgttcgtggcgggtgaatgcggcgagagacgagtaaatggtggtcacgggatatgggggagaaatggagtaaatgaactgaggatttgcctgcattcaattggtttcacgggaaatcggaactgaacaatattgcgcgacatcctggtggcatggagcagtgagagcatgcctctgctagcaattttgatctggtaattgtattgtttcgctacaggcgacctgcggttcagcggttcagtggcagtgtaaacagttgctgtttgttcgatcaagacgttcgtgcgttcgcgaaaagatcaagacgttcgtaatctggagcctgaagttagcgttgtggatgaaaaatcacaagtaggcagtagttgagatgcagaggaaaggttaatgctgttcttgcagactgcagagtactaccatccctggctcactggtctacctgactgcatttcgttttactcccagctcgcattttcatgagaaaattgcaatattcggactacaaacatgggggcttcgctgttttgagactccgagtggatgataaatgggcccatctatgtctatgaaatgtgggtccagtgtcattatagcaaaggctaatgtttgcagtgtcataaccctattgatgaactgaaatgcagatggttatttcaagattactattacagcaagactgagaaataaatgatcaaatatttgatctttcaagccatactgacgaagacatgggcaaaaagaaaaaaaaaacctctgataagttattcttcctcgttgtcctatccaaatgtagaaattcactagttccttcctcttcacaggtcatcctgacgtttcagtctttcaggtttgcttgctgcactttctcagaccccaggtcttcagaattcagcaacgaggaaaacaaacgaaaatcaacgaagagaaatgagaagcaagaaagccaggtagcccaataagaggcccaaaggcctccagatcatatagctggctcaatgggctcagctatggatcaagaaacaatagttctccgttaccttacagctatatccatcctgaatccttgatttctgaacatacaatgatacaattaatatcttgtcccctacactgtattcagtacttcaagacgacactatgtgttcagtatctttcaagaggactattttcgttgcaaattttctcgaagcaattttgttttgtccccgtttttttcgattccacctggtaatctggtgtgccgcaaatgtgtagcctctgactggatacgcacctaactttgtgaaggggctctgaacctgagctaatcactaatggaccgatttgcgcgatctcatgcttcatgccttagccatgctgcccagtgcccatacagaattgtgactgtcacccacagggactgccagactagacaaagaaaactcatcctttggttgattactatcccgctggacaacactacctgaaagtacagaacaatcagcattaggtaaactttggagtgcagattaatcagccttgacagtacagtcgcacgtgatgacatcaattcttttatccttatttaaaggcctccttgcccagtcagacagctcgccgaaaatatgccaggagaaatgcacacatccaagggtccaaccgatgccaaacgtacactgcagagaaatgcagtcaaattaaggctgcgtgttctagaattgggaaaacgttcagggaattcatcattcagtcattcagtacggaggataaccatgcatgcagaaagtgtttttataaagcttgtttagcgtgttgcgacacacaacacattctccatctgaagccggcgactttgtcagttactacagatcagaccatcatcagcatctgctagatttccacaagaatttggtcgttcactgttcagagagatcggttgctgcagtgcatgtcaacagcatgtagtagtgcactactcgggaacgcactcaatgcgtgctaaatgcttcgtgctatccggctgtgctcagtccactttctgatttctgaaccaggaaacatcgtctttttttgtatgtatgaatcgattcaactaaaagaggtcgcaaacttgaggtccaagttatttactccctctgtttcaggttacaaaacgttttaactttgattaaagtcaaattacttcaagtttgactaagtttgtagaaaaaataatatcattttcaacccaagacaaatttattatgaaaatatattcaattattgatttaatgaaactaatttgatattaaaatattactatatttgtctataaacgtagtcaaacttaaaatagtttaactttgaccaaagtcaaaacatcttataacctgaaacgaagggagtagttgccaacttcttgtccccgcgtcgctctcgcgcgggcagctcgggggcgaaaccctagcctcccacgccgccacctcccaccaatcctcgacaccttgccacccctggagctcgccgctagaaaaccgggcggcaagccaggaaggcggcgacgtggacaaggcggcccacgaaactcgtcctcggcgcgggaggacggagcgtcgccacgacggctagagatggcaagggagcgacggatccggtgctcccggagatggatccggtgtttgccaagacggagacgcaggcggcggtggagcttggtcgcgagagcgaagatgacggcggtagtgctggatctggagctcccagatccagtttctgcggcggcacccctgctcaatcctaggcggggagcagccggcgtgggcagcggtgccgatggcgacgcgcggcaggaggtcgcaacggcgcggcgtggacaggagggcatggacgggaggtgcggtgcggcgtgcccgtgctggtggcggcgcgagggcgacgccggtggagtcactgtgacgccgtggacggcgatgcatgaggctcgtagcgacacgtggccatgcctggcaggggtctgcgtgaggaggaagccggcatgggtcgcttgggtgctagcagtagcggtggtgactgacgacggtcattgactgggtttgggtgctaaagggttggtgtggtggtccgacgatggtcgttgtacacgatggttgtgtggacctttgaataggaatcaccggtgaaagccttgccaggccatgggccggcatgacgacgacgccattaggtgtcgttccccttcttggaggcgtcgttttggcgttgacatctcctagcatcaagaacctttcgcgcacaatggtagccatcgatggactcctgcaatgtctccaaagccctacaagtctagctgtttgacgaggccttcgctgccttgcttccgttccttgctctaccgtgggtgttcagcattcttatttggttgctgctgggtagagtcagagctacttcattgtaagggtgcgacaaagcttggcaacgatgacacagtactgcaatctctttataggattgttgatgctagttgcgtgcaggaaatggttctttggtagtttggactgatgtccttcatgagtatcgtttctgtttgctctttttggcgttggagtagcattgcagtgaagtcgaagctgttgtgtcgcttgggtggcaagcttggcaacgataacatatgtgggctattgtgtcgtctctatgacaaacttggcagatgccttgtgtcggttccgtcgtggtagcttaggttagattagctgttggtgaggcgttgtaattatggtttgctcatttttcccaaattaactgggcactgtaaggtttggtctcgtttactccttaaaataggacaccttattcttaatataaatcgtcggtaatggcctgtccgttaaaaagaagaagcttgaggtccaaaattgagatgcacttgatagtgtagtggcaaaagatgtgtggtttcaaccctaaggtctcgtgttcaatatctaaattgctcacaattgttttataaaaaatgttcggagggatgtctctccctaggtctaagattgatattataaggtcgtaggaaaaaatgatcaaaattaattctcttattaataatataattcacatagctcacacatccgtagatttacaaactgcccgttcgacctctatatcctcatcatcacgaacttgctccaaggatattatactatatgtgatcgtattatattatattactaactactcgtaatgtccaaccatattaaggcgatgatctttgtcccaagacatcataatttaaagaatttatgtacagctaacgacgagatagctatacttggggtcgatttagggctccgccttgactctggtcaccgacggatcggtcacggtggtggccttggacgacaccgacgagtcggagtcggagctgggcggcttggagatggagagcacatactccttcatgtcggagctggatgagcggaagtgcgcgaggatcttgctgaacttgggcttcttgcgggtgatggcgatggagacgtcgttggggaagaggtccttgagcacgaaggcgtggaacatggtggtgaccagcaggccggcgacggtgacggtggcgatgccggagaggccgatggagagcgccctcgtcagcacgttggtcacctccgtcgcgtacgtgatcgtcgcgatcgccgcgccggtcatcgggaacgtgtacgcccaccacgccagcgagaatcggaatcccctgaagaagttgatcctcacagcctggtcacaggattaagacattgttaagtacgcatgcagagcttagtaatactaattaattacgtactgtagtagctagtgtgctcgttgcacgtaagtgttacgtaccagtgacatgtagaggaagagggcgatgaagtaggcgatgcgggcgccgtagtcgaactcgccgaggatcttggcccaggccatggaggcgacgctgggggcggcgacgaagaggaagaagacggggtggagctcttggggagggtgacattggtggggaggcgctggtagagcgtgacgaagaggaccatgtatgggcgaggccgacggcgaagtagaagatggggccctcgcggagccccatcttggcgccgagcagcgcgccgacgaagtttccgacgatggagaggtggttggacgggttcgccaccttggacagccgccgctggccgccggacatccactgcccgtagatcttgagctccaggcagaagatgggcgccatgagcgcgtaccagacgccgtggtgcacctccgtcaccggccgcggcacgccctggacgaggaagaggcaggcgatccacggcgcgaagaagaagttggcgcggatcgggtggtagaactcccgccgcaccgcctcgaagtagaaaacgaccttgagcaggtagatgaaggagacgaaccccatcagcgccagcgagatccaccacagcacgtggttcaccaccgggctgacgtgcaggaacgacgtcggcggcgccgacgccagcgtcttccacagcatcgcctggctgctcaccccgaggcacatcccgaacgcgctgatcgggaaccgcagcaggaacggccacttctcgtccttgggcagcaccgtcgtctccgtcgccctcagcgtctccagctcggggccctccagggcgtcgaagtagcggtcggcgccggggacctgctccgtctcctcctcggcgatgttcggctcgggggcgccctcgccgttggtcatgtgctcctgcgccggccggccgcgcagggtggagagctgccgctcgaggcggccggagaaggtcttgaactgtcgaaccgcttgtcgcgcgtgctgtcgcaccgccgcgtcg

SEQ ID NO: 42277 - DNA, 18521 bp, Oryza sativa
tccttgctctgctcgctgagcgtggccgtggccgtggcgtcgccaccgccgccgacgcagtcgaagccgtcgatgacctgcgaggggacctcgatcagcagccgcgggagagcggcttccccggacgattgctcgctctccccgtacacaccaccgtccattctgatccggacgtcgttgccgaactccataccgttcacgaaacctgcacaccatacaacgacagattgactcgtttagcgatcaatctcccaagtaaagcaacaaaaaaaaaagcaaagttttaataatttctcaagaacgtaatcatcaagtaccgcagtaccagatcacacgccaattcggccgaagcacgggtgggcattcccgtatggcgatcctggccatatcaacctatcctacctacagttaatcttacctggatttctctctacttctctacacgcgttcagcatgcaccatcaaaacagttcacagctcgctaaacgcaaacaacaagtttttctcccgtacgcttccggagtttcgggctcgattttggctcagctcggcacggcgcgaccggtgctcgatttatagagacgcgcgcgagtaaggggaagcacgaggccggaatgcacgttggctacgatattctcctttcccgcatgcgcgccggggtgtgctactgtgggtgcatgccagtggagcggcagagcacgccgccggccggatgacggcgacgggacggtgacggccgttttcgtctccactgttcgtgaaggttcagtgtaccgccaataagcacatcgccgtcggcaatgggaaaaatgaaaaagaaaaataataacagttgtcttttcttgtcaaaattcgacacttcttcctccttgactgaaaagtaggagtaaaaaaaaaaatcttacagtctcccctggtacagtacagtacatcaaaaccggaataaatcagtcaataactaatcggcttggacaagcagggtacgaacgtacgatcggcctccgtcgctggctctgcttggtttgacattatgacatatcgctaattccaaaaggtttttcgttacagatatgagcccggagaccaagatgagaatgtgtggtcctagacggactcgtgtggaaaccgaacatgtacgaccggctataggcggaccggccagtacgtcctacacgattgtgacacacggacacatcaatctcagagatcgatcacgctgagaatatgtagatcaccagtacgacttttttgcggtcgatctccctgactccctgagccgccagattaccggaaaactagctgctgttactatgtgacgcaataaactagccatggaagaaaacaacatgcgaattaacgtcgcagtctaagctacggggcagcattggaccgaccgaaagtgttgaaccgggaccctcccccagatgtgaccgagagtcccccggacaccaccaaacatcttgcctggatgctgggggtaggttggcaagctatccatcgcgtacacgtcgttcttgcacagccatatctgagctagacatgcccatgcaacaacgaacagagaactgactctacaggacatgaggacatggacacccgtgctagaattagagcagcttctaaaaccaaattagacctctcaaagctagcgcaggcaaagataaacttcatcttctctaccgacagggatgacaccgaaacacgggaaaacgccgctgcagagttcctaaaatcatactatactacatactcctctgcatactttaccttgggcctaagaatctgttcgtcagtgcgacactccacggcaggatctcttacgatgtatgaagctggaactggaagaggatgaacacagatgaaagagctcgcaaaggaagcagagcctctagcccagcactcagcagaggaagctgcttgctatgtgctgctgaggaaggtgatagccgcaaccgcagctcaccgagtatatatagaagtagtcaagcagggcacccagggtgtcctcaccattcttaataaaagacggaaaaaaaagaatgggagaaaaaaaaatgagtgacctacagaatgaaaagagagaaaagaataagagggcgcagagacagcgtggaaatacaaaaggtggcgagtcaaagcgcgagcgagagcgcacgcacggacgaacaacaacccgcgtactcctcgggggggggggcccacgcacagtcgggcacagtctccctccccgtgcccccgccttgaccaatcgcgagcgaccgttcgcaccgcgcgacgaaaccaccaccacgtgctccctacgctttcctacgattcctccgccgccgtagcagcgtccccgtctcccgtgcatccgcgagcgcgcgagagaatgagagagatcgcggcgtagcctctgcttgcccgtgtaccgggcaccggccaagggggtacgagaggcgaccgcgagccggttcgtttccgagatgtcactggggcgtcgcgtcgaggaggaggggagagagagagagagagagagagagagaaaggaaaataaaaactgagggccgaggcgcgcgcgcgaccacgacggccgaggcaaacgtaacgtactcatcgtaccctctcccgagaattttgggaggagaatgcactggtgtcccatcgccgcccccgaagaaaaatgggtgagactgctacagtaacaggggcagtggaaagtagaaactgaagctctaagcgatgatgttttcagttggatcgttggaaaaatatgtagtgcaaaccacatatacagtgaacttccaaggtgacgtggatgaattttggacatcaatttctcgatccaacgatagtttccaagttttcactgtatatatggtttgcactgtatattttctctcgatcgtttacatcgtcctaggttcccacgacagctttcctcgcatctcgctgcttctgactcttctattatcagggattcaggggtgttcggagcaagttatctttttgttaaaagaaataatcaaactttgaaagaaaatatcactttcgattatgatcgatacgcagctgaaccagccggagccgtagtgttttgggttattactttaggggtgattgctttttggactgatctggaatattgtacatggttgatagttatttcgtcttaatttgaaaaaaaatagcaaaacttttcagtcgaggaaatttgtgcctgggaacaagggttcacgttggctccagaaaaataagaataatgttttcttcgtgcctgcggcaaacgacggtccacgtacatcattttagccggacaggctgcgtggtttcattagtctttggctacatggtcccttatgtcatttcaagcttgaaaataagtgaaagtacgattagtgcgtctgttgtgaactcattctgccattatgtcaaaattgtgattaattgtccattcaaggacagttcggaaaacgtgggacaaatctattctgatagcatatagttgttgtactctgtcctacacaatttttttaaaaaatcttgttaattaagtcctgataggagcttttttacttggtcttaaccttggagtacattttctagctgttttttttccggaggggagggggtgtatttaaaagtgttggtattttcaagaacagatttggggtaaactcgatattatctgcatatactgtagcagtttttttttcctcggtttgtcctgaatgagctttcactcagacccgaccttaatagtctatagttgtgtgttccatgatgcagtggacaggtctgtaatcttcctccactaaatacttgtggaaatagagaaaaaaaatgttgcaagctctagaaggaaatcaacagtctaacaaggaattccaaatccatcatgaaccaatcctttcaatctgtaccttgttcctaaatgaccctccaaacattcacgtcgcagtttttgtgtgaccaatatttaaatatgctgaaggaattccagcatgcattctttgaaaaacaagtggcacacatgaactccaatgcataggacctggagtactactaagttaattagaaaaatatacatgccgatttattttctttacggtactaactgcaaatgcataaaaatcagcgaagagtatgtataccctggagtactaattaagttagaaaaatatacataccaatgtctctcctttatggtactactgcaaatacataaaaatcagcgaggagtatataccgtccaaaacttagtacaaaatttatatacaacatcaaaaagagatggtttagtgtagtaagctagtatactagctactccctccgtttcataatgtaagtcattctagcatttatcacatttatattgatgttaatgaatctagatatatatatctatatagattcattaacaataatatgaaatgtggaaaatactaaaatgacttacattgtgaaacggaggaagtagtatggatctactatggagtatatgtcatacgttaccgtcatagacgtcgaccaacacaagaaggggacttattaattattatagcttgtatacttgctaaactcatatgaactgattaagcaacttaaaatctgctggcacttgtcaggcccatatatattttttaatgctggaacataaacagatctggatcaatttaaatatgaaagaaggacccttgagtcgatccatctttgaattcagcggatataaaaatacgtagctctccgaccaaccatacgcaaacaaactatttgaccacaacgtgaagctactatctctaattaatttattctatgtatttcggtaagactagtagtactatacgtagagacaaggtgaatgctactactacagtatcagagtcagactccgaagtctccaaggagcttacaatataattacttaagtattttattagtcgaaaattgaaaatgtgcgttctcattaaatattgttgccgaggttattttaggcggcaaaagccagcatgggaccaattaggcttctaatttagaagttacttagtagtttgctagtgctttggctttttagttacaaataagtatatggagtattttatttacgctgattccggatatccaaaacattttcagccaatcaagtgcttaaaagagaaaaatcatgtaattttaaatttagcctatagttctcttttaactttgaattttactaaataacctagaaatactatatttatctttaagaacggagggctagcttttttctttttccttagctgacaatgggagcaaggtcagcagctgaatagatccaaccaagcaaatatatactccggatcgacctagctacatcatctgaaacatgactagtagcaacaaaaaaatcacctacccgtacactatataaacatcagtggtagccgtagcttctatactagctaagctagcgtacgcagctagttgtggacagctatgacacgggattaacttaagagcaattgccgtacgatacacttaactaggctccagagcctggaagtaaacccagcacgatcgagcaaacagacaacaagccgaccaaatccttttgtgaaaacggactaataaatcgagaactcggcaagcgacaagcgggggccgtcctcatctagccatgcatgtatggtacaatacataccacagataaattagaggttcacgtccatgtcttatcgcgtaagcaaacggcagataaattagctagctatagctagcttagcggcagaggagttagaaaaactggggaatgaatgaagtcagtaagtaatatacttcggcgtatatccgtacgtacctggctagtcgccgcccggccgctagcctccaagcgtagccgccgctgctctgcggttacgttgacgacggcgcggtgccctgcccgcgcgccagatgcgcgaaaacgacgcgacctcgacgacaaatcagcgaccacctgccccgctgttggtagctggctgcgtgtgcagttcttggctgctgctgctgctgctagctgctgccggcgccgccgcgagatcgctagagagatgccggattatggatgggattatttcgcggtgaatgcggaaagatttaagcgaagcaaaaggcagctagctagtccgagctaggcagtggtcgtagtgcttctcgcactctgggagctcgagacaggccgccgtttttatagggtagcttggaaaaaaaaggtgaactaattaaagtagttaattaacttaaaacgacgaggagaaattgaattaccacaactggtctcgacgtgtatggtggtgtgtatctgatgtgtgtttgggatggagggatggtttaattaggtcgtgcacgatggcagccatatgcttgccgatccttcgatctactcctacctcacgcacaaaaggaggatggggggccctctgctacgggagatatgcgtcagccagtcggcaaagatagtggccaccatcttcgtcagcggccattggtcagtgactttgtgatctgagctagtgccatgtaggaacggtcaggatctagccccggcccctatactaccacgcctgtagcctgtgctcgcgacgaggcttctactcgggcaggtgaattccgatcggcgatcgctcttcgatcggttggacacggacatagggccaaggaaaggttatcatcatcagtgattctttttgatgaagaggaatcatcggtgatcctgacatgatcaccgccaagtagtactcaagtgcgtcgtggagcgatgtgtaaaaggtggtgttcgtactgcgtgctgtactgcagagtgtgcaccgcaactgttgcaagtggggaggctagctacgatcgattgatttcgatcatgggcatgggtccggctcatgggttttcccggaggagaggaggctagcttgcaattagcatgcgccagaaccggtccaaaaggcgccactctgcagcctagctttggctttgtatgttgcatggtggtcaatataatgctgaaaatttgcctgggaaacacccgttttcagcccaagttggatcccatccgacccggcatggttagccctagcttgggagctagggatgaagattaagtgcgcacgtgaaacgagacaagttattagcatataattaataaagttttaattattaaaaaaaaataaaaatggatttatttgttttttatagcaacttctatatagaaaattttcacataaaatacaccgtttagtagtttgaaaaacgtgctaacgaaaaccgaggaaaaatcaggatgttgttgaagtttagaacaggaatatcgaaccatatgtgctagtgcggcgtacgtaacagccacggggagtacgtacttcagcgcatataacacgtcagaatggaaccaaattccaaggaacagattggacacatgtggtcgttaaaaaacagtacgactgtgcatttgatatgatcctgtgaaaattcaccgaaatgttttctccttttccttattctccccggccgaccgatgcatatggtgtgtgtgaaaatgcatgagaaaatgtatatctgcttttctttttttttcttgagatgagaaatcgtgtctgctttccgatggtaattaaccacactagctagctagtgcaccggcacctttccaacataccggcgcggccagcacggcggaagaggcggccggccgtcgcagttggaccgagacggccggaaagcacacgacattgtaaaagccacattgccattgatcgcatgccgcgcccgacgcgcctgactcaagacccgaccgaaagagagtcaccgaaaaccacttcgtgcgattcatcagtcgatctgtcgatcgggtcacaaggcggctcgctcacggaacggcgccagggacgccgtgtcgatcgcccacctgaccgggcgtccgcctgatggcccccgaacccggcagtggtcaggcgctgcagacctggccaaaagttggaaggccgcgcctggtgcgcgttgcacaaagatggcacgtacgtacagctagctggggagtagggttgatggattttttggcgtggaaaattgaccacatcgaaatatttgataagtttgtgttgcattagtatggttcaatggttgaaagctttttcggttgccttttatctgtttcatattacaagtcgttttaatttttttctaattaaacttttttaagtttgactaaattcataaaaatatttagtagcatttgaaacaccaaattagtacccttgaatgtaacattgattttttttattatatgtatattttgtgttggatatactactatgtttttttataaacttagtcaaagataaaaaaaattaactattaaaaaaatcaaaccgacttataatataaatcggagtgagtaactttttctctatttctcgttgaataaataatttatattttttatttatagaattaagagactataattgatttcaccagtatcagaataagtaaaacaatgactttatatgtttatatgcgagattgtttactagcagtctttagatgtgaagaacatacagcatgcatgttttttttttcgtgtgtgtgttagatgcagccatgcaggagtctccataaaatcaatgagttttctccttattttctatgttggcaatgtgaaagagctttcattacgtagtagacaaattccttagtttttactggttcagggttcacaaagtcattacttggatccaaaaccactacttagtggtttcatcagaattcatgaaaaccggtgaaaattcagatattcttctttaaaaaaattgaactttactttagtttgattttttttagttgaccggcttatatagcgcgcggtttataccatgatcttgtgaactctgctagtgtctcgctcccattctgctagctacgatacgaccggggcccggccagaacaggtaaagcaatcgatctgacccaacaacgccaacaagaagtgggcgacccaattaacctggccactggccagacataccgaaacagacccaggatcaaagcagcctagacgcttacttaatccctactatatatgaagctggtagtttaattaatcaaccatcttattctttctctgaaatatcatcgtatatgtctgcatgggatcccatgtagaccactagttccgtgcatgtggatgcacacctcaactagttaggtgattattaggccctggtttgcttgcccctgctttttgcacactttaaactaccaatatatattcacatttgtggtgaccagccggtgctttaacaaatcaataaagggcaattttagattaggactgggtaaatcgtaatggaatcacacgtaaacttcaatttgggtggtgcaaacccatgatgcaaagtaagaatgaaggggtgatcaaagtgccatgtggtattggacaagctggctatagcctacaggtgtacagtgtgtgttagggctaccacaatgttaaacaaaagaaggtaagatgcattgtgggtagagacaataactgctactgggctattgtgctactgccggtaacaaaataaagaacaatatttttttagatatgtgaatctttttgtgctagcatggttagaagagatagtttaacaatgattctttttaagatggaccccaccttaacttgcataagagcaagtttaatagtataataacccactactatctccaattcatctatagccaatctaatagccaataattgcttactacactattagtatatggttccacctgtcatacacacattgtgtcttggagtccatgctgcagctggctacagatctgtagcccgctgctcttctctctcatcttttatctcattaaaatatatttgtagccagctaataatttgctattgtacctgctctaataggcatagcacattgtgagctttgtaataactgttaccacctaaacccttggcccacattattatctagtttagtaggatacattacggttgcttgagaggtactaccaagaagtattaatatctgtagtgcaaattttggtattttttaataccaaagataataagagatactaaattttacgctataaaatgtggtatcttttggtaccttctaaaaactgtaaaaatcattcattagtaatacgtttgtctataataatatttcgccaaatcagatctcagtgacttgcaccctagctgttggattgatatctaacggttagggactcatcttcaacctcccgcacaagacatggaaaagtggagctggtggatgagaatactcactatcaatggtgactccctcgaccgcgcgagctgttggagatgcgtgggtggtgaggtagcccaagacaacctgccaatactattagagggtgaaggtggcgccacggaataggaggaagaggaagtatatgaaagatagtagaatggggtggcgatgaagtcttgttggcaccgatacatgcttgcaaggcgaagtgagtcaacgtgaatgacgtgcacatctacgatgagtagcggtggggtctaggtcaggagcaacgggtggaggaaatggattgagatagggttacaaagtgagatagggatcttgatacaatttaaaccattcaacataaataatggaataagattaatcatgcaactcatgaattaagaaatccaaaaacaggtggcgttaaccatatgtacaaatactccatttagtcttaaataaatagatgatatagttgcctttttacacatatatttgatcatttgtcttattaaaaatattgcatatcattttttttacttgtttttcatcgaaggtaccttaagaatgatttatatttttcatatttacgtaacatttttaaatgaaaagaataatcaaataaaaatcaaccatatcatttattaaaacctaatgggagtataataaagcgatcaaaacatgacgacgccgtatgcatatccgatggatatgatctacttccagcctactttccatcccgtgtaacggccggtacgtgtaagtgcaccatggaggatgagtatatatttagatctgatcgatcagtaaacaagttaagatgcatgtgccacaaaactcaattaattaattaatcgaacgtcatatatatcgatgcatgggtagcaagatgcatgtgaccgcacaaacataataataatactatacagtaatagagtactactagtggagtactacaatgccaacgttagtttctgcagatattgcaggataacgaggtgataagcagatacgtgcgcgtataggtgagggtcggtcgcgagggttgtggacaggtggcgtcccggccggcacaaagacactagcccatgcggcgtgtatatcgtcgcgcgcgagaaatcgatcgacagccaagctggtgtttggatccccgccacacattgcctcgccaaacatgcggctgccacaacagtttgactgatgtttggttaatacgtgagttgtggcagccacactttttgctagttcatttgtatgcttattttcgccacagctgtggcgattatttctctcgccacaatctctggcgacgccacaacttgatggctggtttgggctgtgaaccctgagcgtttcgtgcgacgagatatactaaaccggccgggcggcccggtgcgcgcgcgcgtgctgctcgatcgatcacgtcgcacttgttggtcctcgatcgtgatgcgttacaggtgcaaaagtgtacgtggttttgactggttttccacgggggaaaaagagcaggcgcgcgtcgagcggtggctggccgggtttgcgcgtggccgccgctgccctcgtcgcggccggagggtttcagggacgacgacggccgcgtgtatatgccatatagatatattatcttgatcatcgagagagattgcgagtcggggatagcaccgacaggcgagtcttggagtgcacacactgtgtgtacacatactcctacaggcgatggtgaagcacatgtttcatccaatctatctcgtagaatggcgtgtattcacgtgatacctgtggtcgccgtatgtacggtaggtcccctctgcgtacgatcgaacctgcccgttgggcccgggccgcgtcttctaacgacgagtttctgacacagccgtgttgaactggaaccacacagccgcgtcgaactgggctaggagtgggaccactccttcagatatgattgcaattcagtggtgtgtacacccgtacttagcaacaacggtagatataggctgtgtttagatctaaaagtttgtatccaaacttcagtttttttccatcatatcaacctatcatacacataactttttagtcacatcatctccaatttcaactaaaatctaaactttggatccaactaaacacaaccaacccaaactttcaatccaaacttccaactttttccatcacatcaacatgtcatacacacacaactttttagtcacattgtaacaatttcaatccaaacttccaacttcgaaagaaactaaacacagccatggcagatcaagcacccatatttactcgtgcttggcagatcaagcactcattccttgtgcgcggcgcgttccggtaaaacgacaagcgccgaagcgcgagctagaggcagacagccaccggcatttggcctggcgctttgcgtctcgtcgatgaatcccatgctcatccgcaggagatcgaagaactggtaccatgaatgctatccgctaatttcgccggaatgggacgcgcactcgagaatggatcgtgcgcagtagttgtacacggccgtcgtacgtacaacactacaccactagcgcgcggatggatgcatggatcggcaaaatactttccgtttcttttcgtgcccttttatcttcgctttttacgcttttgtctcacacgctttcgacgtcggatgcttgggagcaatgggggtgggagagacagagagatggatcgaatgttcagtgggtcgagcggacagcaacctctcatcctctagcgtttcggcgcgcggcgcccggcccggactctgcgcttttctccggtccggagaaagttccgtatcggaaatttccggcgcagatgtttttgcgtttcgcctttcttgttggtgtcttaagctagcgtttgattcggcaaatcaaagcatgcgaatgagaaaaggttactttcctattttagtaaattttagcacctaaagtttatacacctcaagtttacacatctaaagtttagagaccaaaagtttataagtcaaaagtttatatatccgattcaaatttgaatttgaattcaaatatttttttatatgtagtatttctatacatctaaagtttatacacctaaagtttatagacctaaattttatagacctaaagtttatatacttgtttcaaatttgaatttgaattatatatgattcaaatttgaatttgaatttaaatattttctatatatagtatttctatacatctaaagtttatacacctaaagtttatagatccaaagtttataagtcaaaagtttacatactggattcaaatttgaatttgaattatatctgattcaaatttgaatttgaattcaaatattatctatatatagtatttcaatacatctaaagtttatacacctaaagtttatagacccgaagtttataagtcaaaagtttacatacctgattcaaatttgaatttgaatttaaattgtttatatatagtatttctatacataaatttttctaactttttattttttaaaaaattttatggtgtagaaagagaagaaggggaggaggaaaggggagaagagggattatagggggaggagagcgccgggtgatcgcgcgcattagcagtttcgatggaatagtcggcaagtaaccacgatcgcttcgttggtccggccggtatgcttgcgtagggatcgtggtggtatatttgcaaccttttgactcggcaaatggacactattaataagctagctgggatttttttttcttttcttgcggggagctgggagttaacttagggtgtgtttagttcacgtcaaaattggaagttttgtcgaaattgaaatgatgtgacgaaaaagttgaaagtttatgtgtgtaggaaaattttgatgtgatagaaaagttggaagtttgaagaaaaagttgagaactaaacaaggccttacacagttacacgtgaatgggtgacctttgtcatcactcgtcagggcggacccagaaaattaaaattatactgggtgtgctcattctagcgatcacgctaccatatatctattaactaattaaagtaatgaaaaaaagagccccacgttcgctctcatagcctagaaaatagaaaaacctaagtatactaggattagaatatgaaacggacaagaataaacaaaaatccaaagatatataattataggattgtgtggaaacggacaaataatttttggaaaccgtgtgaaacaaaataaacacaaaccaatcgcactatagatttatatgggattaaaaaactctaatgaagcactatagattatggtcagtttagattaatggctgagatttaatcagttttgtaagcaggtttagctctcggtcatgtagaccagcctaacaatggtcatacacagcagtgtgaaaatcgagagggatcaatgaattgagatgaactaaattgatgcaccactgaaggggtgactagcgatcacatctaggccgcctgtcccgacagcatggagaggctaatggtctcgatggctttaagcaacacgactaatgcattttccggagtagtaaaaacaagttgattaagtttcacaaaactataattaccttcacaaaaataaagaataccaaaagagtctaagagtatatataagaatacaatttagaaataactaaaattaaaaatttaaaaataattaataactatcacgcatatacaatacaatataaatattacacattggccagtttggtcaagttagtacataatttaaaattatgttgtcatttttaatatattttaataataaaatgtgaaatatatatattttagtatgtgagaaaaaaagataacgatcctaggcacgcaatctgcgggccatcatgctagctttttttaaaagaaaacacccaattctgatagaagaattttggcagattttgatcgaatttttcaaagttctattcatgaaaaatctataaaatttagaacaatcaatccatgtcctaatctatctagctgtttttctttttccccactgtttctcttcatctagtccttttctcttcccttgatttgatttttttgacgattacaaaatctccagacaattcatgatcattcgtgatcattgttatattctattttctggtaggattttatttttatgtcctttgattgcatactacatcctagtgtttttccaaaaaaaaaattgggtatgccagtgccaaccggcaaacccctaggtccgcccctgctcgtcaggtacgtaagcttggtatgtgagagatgcaaatttaaataacgaaattgctaaaaagtaactgttgaattctttttcaaaaactttcaaatgtaactacagtgtaattatattgtagtaagttacactagaattgcactatatttatattaactacaatgtaactatattgtaatatatgtataacttacgtataaaattgcatatatatttttaattcttatatacaatttatattaatttatattgtagttatagtatacttgtggtggaatttattacaactatgttacatttaaaagtttgtcattcaaaaaaaattgcggcaatttttttatagtccctttaaataaaaaacactagaaacttcggtatgattgcggattgaaagatatgtcgccaagtattcaagtcaatgtgtaccacatgcatgtagtgacaagtatgttagttacaactcctgcatcacttatcggtagggtgactcaatacaatagccaacctagtgccatcagtgcctcattctcttgccgttaacatcattgtctctagggttccaatggtattactgatttcttcatccatgggagtggcatcctctcaattcgatcgacaagggcacatggagatgcggagctcgctccaaccatcggagcgtgcatgatgatcgaagggaatggtagcgcctgatcagcacttatgatcggcttacgcctaaatggaggtggattggtgagtcaagctcttcgctagtatatggtcatgctcaacctctaccaagaaacgaaccaattaccatcgaaggcaactgtatgggtagtgccttggtttatgattgaaatattagtcaaggaaaattcaaagtgccttcatcgagcacgatccgcctaggcctgaatggaggtgaattggcgagtgaagcacttcgctagttagtgtttgggttctgattctacaaaaacaaccaaaccaatgacaatcatttagaggtaactacacaggtggtgccctccatcattatttggagcgttactcgaggtcggttcaaagtggctaagatggttatggaagattgtgtgaggttttctttgattgtctttatggtgggtggaagatatcaacatgctctctttgttcgtggatgttagcgaggtactgagtggggtagaaataccggtctggtaattatctgggttgacggcattatcatttatttgttattttgttattaaaggcctatggacgaaaatccattactaattttaggttggttcgaatgatatcaacaacaaacgttaagtctttcttgaaagcgcaattatggagagctatataccttttcatcttacttataagagtgttagctgtcactagggaccatgatatttttgtgtcctcttgtttttttatgtgtaatgaaatgtccatttgcatcgtaaaaatgtgatactccatctagttataaatatttaacatttaaaatcagatctaatctaacttttggaaatatgagcaataataatttctcaaatgcttaatatacacacgtatggttgccttaaaaatacttgtatttccatacgtatgcttaaatacaggaatcagtttctcaaaagtaaacttgtcatactgtcacatgctgaaatactagatatagtttattgtgccaatatttcagcatcctgattcctgttcctgatgccatgcatacacgtatttttagtgtgtgtgtgtgtgtgtctatatatatatatatatatatatatatatatatatatatatatatatatatatatatatatttgctttgtagttttcttgttttttaattaagccgcgtagttttgtaattgataaacgttcttcctgcaacctatattataataattggttatatatattttttaagtaaagcatggatgaatttcattatctaacacaaatttgcttggttaattgggggaactcaccttaattacatgtcactgtgacaaagcatgagtcatctaaatcctaaatgaaccctgaacaagtggacagcgcgctaaacctcctactagaaattaaagctcctccttttttttttctttaagcacaacgctccgcatatcttttccttgataaattctaaataaaataaagatcaactttttcttgagagtagaaaagatcaacttgtagaattgaatagaaaagcgatatcaccttgttaacctttgccaatatatgcatatgatgaccttatatgcttcgactttacgtgacatgtgtatgaaatatatatatagttctggccgggctctacttatatatctatgtgggatatatatcagtatacataaatgtagatatagactagacaaataaagccctaaagcaacttccgtccattctgttttaatttcttttctttttttaaccattgttaccgctttttttttcacttctctttccggggacaaaaaaacaatgtgatgtagtatgccgttcgtgatcgactcgcgctctagcctttccttcacatgctatctcgtgttggtctactccgttcgtattcactggtagagaaaccatctttggtcggtcgacccaaattcacaatagtcccggttccattaaaaaccgggactaaaaattcactggtagagaaaccatctttggtcggtcgacccaaattcacaatagtcccggttccattaaaaaccgggactaaaaataatttttagtcccggttaataagaggaagatctttagtcccggttgttgttaccaaccgggactaaaaatcatctttagtctcggttggtaactccaaccgggactaaagttcatttttaggcccggttgattccatgtcaggccgtgtcagggccctaggatcttaagtcccggttagtaacaccaaccgggactaaaaacctatttttagtcccggttggtgatactaaccgggaataaaaattaaaacacactatataatccatagtaccgatcctcttttaccgt

SEQ ID NO: 42278 - DNA, 2578 bp, Oryza sativa
tggttcctttcatgcatgattatagaacatgggtcctctgtatatgtttctgtagtccgcaccgcttcgctgtctatgacctaatctgccaatgaagtttatgaattatgaagtacggagtatagtactcagacttcagcatgcagcaaggtagtaccgagaaatttattatggatgagatgtgaggcatcaccgagaattcccaaacagcacaaaataatcattttaatcagatccatcgctagcagcaaggtagtacattgaggcatatatcgagaggccagaataattgcattgtctacattatctgttttgtctttagataatggtctacgtacatatctgttcagtcggtgcaacttgattacaaggataaaagaagaacaatcgaacaaaattacccagaactaaccacctttgcacctgtaatgctgttgcagatacgtacgattggaatatgtgctttgtacctacattcacctgcctaatacaatctggcgaacagagagtggccaattcttttttatcgaacagatttttcctggactcccatcatcgatgtagtaatccaattcactttcctgggtcccgaagacttacggtcgtcacacggttgagcgtgcaactttccagtctccgctgtagcacgcgtagcacacactgacgactatgcgtacggtgggtactacagatcgaacactcattttacccccattttttttcccaaaaaaaaaacagagagagagacttggacgaatccgatagtactgcacgtcatagctcttaactagtcaagccactttccaaattccaacaagtgatgctctctgggtcatatttgtttacatttactcacgaactaataaaccatgtttagaacagtaaactatttattagtcctctcgtttttattctgtgatactcgtattctccttttccatgtgtggtgacgccaacacgagaacaggtgcgtgatctcctctgatctggacgtcacgtagtggacggaatgggccccttaattttgacctaaaaccatcttaatcacatcgccggtacggaacacaatatgttgcggtccacatcacatggcacgttccgaggttcaagaggattttttttccttgcatcctcttctttttttttaccacctttttgcttattttccgtcgtgccttttgggagccttgaagattctagagactttgatttttatccatgctgaacgggtatgaaaaagatttagtcatgtcttaaaagatgaaaaatactaaagtattttaggacttcatgcctacgcgaaatgctgtgccactgtgctggagctgaccgtgcagaatatgttcttagcgtgcagaatagattcctctgggaacattaattgaatttttatttgctcttacaggtttttgggcaattttcatcgacatttgaaattccaatatttcaaagagtttgttactcccgccgtctcattttaagtgcagttgtgggtttctatgtataacgtttaattgtccgtcttattcaaaaaattacaaaataactcaagtacctaataacaaattactagtactactatgtcctgggatcttactgaattcatatttgagaaccgtcctacacgtgaggattttagagtccacaaattcgattcaaataattaaaaccgtcttaacccggccctacatttaaggcactgtttgtttcaatttaaaattattgtaatctagattattgatccaaattactataagctgaattataataagccgatatagaataaattgttagctgtttgtttctctggcttattagatgtttgttagctgttaaccatccaataattaaaaaaacatttttagagtagattatcatattatagtaatctagtttatagataataagctatttgtttgtttcagcttacttctaataattcagattataataattataagctgaaacaaacatgacctaacttgcgtaaagatgtgaaacccaatcggaccaaagctccaaccgtgaacgcatgaacggcaaggcgactaggcgagcacagcgcggcaaaagccccatcgattagccatgagttgattagaaaccaatgacttacttatatatgtaccattgattgacttaaaaggtaatataaaaaactacgtgaaaaacatcctaaaatcaacttcaaagctaagttttgaattttgttttttagcaacgcctggacttcatataggagtataggacaaacgatgagcctgttacttagtttggagcttattgcactttagtgtagtgcgcatgctccacctctaattcgaatgcccattccaccgttcgtttcgccaacttgcgatcgagttgtgatgtctcgtatcgttctcacctgtcctatatggcaagcttatgagccatgcaccacagtaccaacagagtgcggcgaatacggcccatgatctactcatgtccacacagcccaattgattccttcacgctatataaagtttgcactggcattcaaaggaaaagaaaaaagagagtacatcgaatagttgctctcgtccacaaagcacgg

SEQ ID NO: 42279 - DNA, 9265 bp, Oryza sativa
  unsure (1)..(9265): unsure at all n locations
tcgctgattgatcgaatggttatagttttcaaaaagaaaaaaaaactgaatggatatagagtaggagtatctaaggctgtgttcgctgtggggagtttggaactaaaatatctgcaccgaaaacggagcagtccattagcacatgattaattaagtattagctttttttcaaaaataaatcaatatgattttttaagcaacttttgtatagaaacttttttaaaaaaacacatcgtttaacagtttgaaaagcttacgcgcggaaaagtagagaggtgagttgggaaagggggattctgaacacaccctaaggctggaacccttccttcccggcacgcaaaacaaagcacgtattattgcatggttaattaagtattaactatattttttgaaaaatggattaatatgattttttttaaaacaactttcatatatagaaagttttttataaatcacaccatttaacagtttgaaaaacgtgcgtgcgaaaaatgagagatgtgggttgggaaaataggggaagaacacaacctaagtatctcttagaacagctatgtggtaggcacgtacgaagcgatcgagaaaaagatagcattattccaggaagaaggctacttgacaagctattattaagtgtcacgttgtttagagcatcaccaatagtgtctgtatatgatttccaatcagatttttgttcaaaaaatgactccaacagagtccctagcgaagctcccaatagttggaaatcccgattctggattgtttgctctccacttctagggacgaggtctgcctcccaatacatcgtacttcactccttcgcgcgtggttggcgacatgttctcctcttcgcgctctcgtacaccgccgtgtcgatctatcccgtcaccagcattgtcttcccgtggctggctggaataagtctgtagctcccccatgattccctagtgtcaatttttcttcctcgtggcggcgcatgatatggtggcaactgcacttcagccgaagcctggcagtggacagccgtcatcgctcccccaagcaccactgccgcttcgattcgaggcgccggtgtgaatcagcctggtgccccactgcctgactctcgagttgggttggctcctccctttcctagccaaccgcgatgtgtgctggtgtttagatgatgaaatcacttagagcaaggtcaatagtatagctagcagctggctatacccactgccatgtcattttgcagtaaattgtatgatcaaccagtacaattgtgctagctgcatcttattaatcaaacaattaactttggcgacaaagaccagggaggaacagcagacctgttgatggttgcaagttgcagcctgaacaagaatattataacaacaaatatttaaaggaagtaaatggtgatgtatttcctataggtgttaaggttttgaccatagcatttggctatctttccttgttcctttgaaggggaatgaagattacccagcaagggcaaggagcagaagacacaagacatgcagagaacaagggaagctacaggggaactggagttgggaatagtggcgtagctagaatttagagtaaaggtggtccatctatatgtaataggtcaatttaataggtagtacactatataatttttattatattaactagcacatatactatagttttaatctcgataaaatttttaggtggtccatggaccacagtgccacctaggtagctacgccactggatgggatcgatcatgctatatcatatagagagggccgacaccgatcggtgatctagcacgatcagtggacgcgtggctggtatgatctcatgggagggagagagaagccaatttcagttggtaatttttcatgggtccactttttagttcttaggaggtcagttttagcaagtctgtttgagggaacactatttttatatcttaaattttatttaggattcccataaaaattatttggggatagaatatagagatacggttggtgatgctctaaacagcttattagcaaataaaaaagtatttgcgagtaatacttttgtgtacgtgttcttaatgactcaaaaataaatattgtaaaataaactatgataagaaaatgaataaatttaaaattaagttgtaaaattcaaaatttagcttaaaagcacaagcataagtcaaacaattaagtcttaaaccgggtcgacatggataccgttatctactgtgtccctccctcatgagtagggagaatggacaagcgtgcatactgtacttagggtgtggaaataggtctcaaattttagtgaaaattcaagggttagataggatggactaagttttaatacacatttttttaaaaaaactaaggactatatagtaggctgtgaaagcactataacttgatcctacgtgacgtaagggtacgttaattagctagtaagcctagagtccgtgagttgcaacagaaaacaaattaagtttctagcttacttatttagtcttagtagtactatgatttttcttattatacaagtagataattttaaaatttgaggagcctataatgaaatgagagaggacttgttcaaagggtgtaataatatatattatgggagccaaatgttaatggtaggaatgatgtgagaatagacaccaccattactatagtatagactgttacattagagctgccgaaacactcgtggagacgagcgcgcgggctgagactagtccacgcctcacgtacgggagagggctaatagncgaatgatcacccacagcgatccctccccctccccctcccccctcccttccctaacccccacgctcctcctcctcatgcaccataaattaataaaaaacaagttagaaaataaaataaaaataataatacccttatacacgtgcatagaacttataaatatataccgtaaatttcgtacgtataaaatatatatatatatatatatattctatataaaaaatatttaaatttaaatttgaatcgaatatataaacttttaactntataaaattttggcgcgtaaactttaaattaacctgaaaaaaaacatatgtgccaaaagaaaaaaaggaaagtggtgggaaaaaaactaattagcgatctcgtcacatacgcccacgggacacggcccatctatcgccaacctcgcaatcagatgtccggcccgcacacgcgacggcgatcgatcgagctgttaacgcgtaccgcgtacgtgtggcctgagggcctgcaccgtgcacacatgcatggccgaacatgcgcgcgtgccgtgaacgcagatcctctgatgcaagcagagggaataacaaagtcacaacaccgtgacttcgacttgaggagttgagatcaactgttcgttagcatctagctaacgtcccacgtctaatagggattaaaatcctcaaacttacttatttttaacttgtgtcactaatatgtggattcaaaagtcactctaagtcagaggataataagtcagagggtccatttccggtctcatataccaccgtcctgttaggagatatcctgctcccgtgctccgtttaattaaatcgagaactcgacaatcagttggagcttccatgtcgtgctgaagcatcccgtcctgcaatcatgcgtgatttcgcaggggagcatctctttattatcatcaagttttacttccctccaatgatatattggtttattttgatacggggagagagtacactccagtttcttgttgttgacgcttgacttcatttaaacagacacctatatatctatttaggcgagcgggcaccaaactctagttgacgcaacctatacaaaactcttaatttggatatacagacaaaccgcaactccgaacgcaatcgttattatggcttttcaatcgttcaccaacaaattaattaacgcgttccttagtgacatggctcttaactaaacgcgcgtccctaaccctaagtgcggtgggtggatgggtgggtgatggttttcgctggactacacaccgcgccatggaccatatgacatgctgggccagccaggccaggtccggatccataccggaaaaccgacctccctttcatggtggcccagcgtattgtagcccaagagaacacaatctcccagagccgcccccacttgcgagcccaacatgacaacaaccaccaaatgaaagacgatcgttgcttcgggaaacgtgcactcgatcggagggagaaacgagcacaaaactgtatacgagccccaccgcaacagcgacggtagcgaagactcggtttcgtccgcgcgatggaccatgccaatatgccaacgccagcggccgcgcccgtacgtacgtgcgcacccgccacgcgcggcggagaattcctgccggagacggcaggccggccgcacgaacgtagtacgtacggcggacgcggccggtcggtcgatggcccttgccgctatggggttttacaggggcaggcaggaccacgtatgacacatatcatcctgatcggatgtcgatcgagtggtcgccaactagctaagctccaacggggcaacaaccgtggacacgcaccgaacaaacgttgcaggattagcaagcagcgctagcatcatggatccatggtggactccaccacacacgacacccaacttagtctctgttcctagcttttctactcaactacaggagaaaatcgcatccgtatcacgttgactgactgactcgccgtgttctggtcgtcgcgggtaatattaaaacaagctacttgtatgttagcgtgcacaagagaggtgaggaggtaaacgaccgggcggctgtaggatagcatcggggtgatggtgatgataggtgatagggattcggtgtatgtgtacgcatgtgaaacctacacgacaaacgaagtcttccgatccctcaagtaaacttgggatggaagaacatggatgattgcaggcgaaatttcgttgcatttgttacttcattggatggtggaggtgaatgttggagtccgtctgtacatcatcgtcggagccttttgcggaaaggtttccacatgcatgctctgccacgtcggaggcttgtgcagaatatcgcacttatctctcttttatatgtctttttgttggtgtttctgaccggataaggactaaggtactagtaataatcacagtgtactacgcattttcaagttttcctattccttatgcgacgaagagagtacgtgttaagagataaaagtatgtttctagtgacaaactggtaatcacgagatatatattatagaaaataattatatggtagtacataacctcatcttttcgcttatgcttatcagtcaaaatttgaattatcaacgatataattttggggtttttctcatcgaagtttatttttcagcttttgcttttaaattgctaaaaacatatatatatatatatatatatatatatatatatatatatatatataaatataaaagttttattcacacattattttcgtttgcaaatatgtcatttggcttaagcaaaaggatgggtcccataaattctataggtgatacctcaaacgacatatattagggaagtactataaagaaaacctttannnnnnnnnnnnnnnnnnnnnnnnatgagacaacttttttacttctaaaaatatcagtataaattcagacactctagcatatcttaccttaccttaatagatcctgtaataaatgagacaaccctttaataccggcgctcactagcatatctcatcattgccgtgcacgcgcacgcgcacgcgtgtgtgatgtgcgcatgcgtatgcacatgtgttctattggctagaaacagtggcagagtagagaagaatactacaccctacccttacttgcccccctccccccctccccccaaatcattccaaataagctcgggtctttctaggaagggtgctagaccccgtgtcttaagattggtaaagtcagaatgcgagtactcatgtcaactatcaagtttattacttaaattcagatggtatgttccaccaaagaaaaacttaatcagttgaaatatagtcaatttaatgagacaatttaactcttatctttactatttaatagagaaatatcttttctttttcttctcaaacttggcaagctttcttatttttgacctaaaagttgctactctatgtcccataatatagcaatttaggatcggatggaacattttaggtagtgtttagttgcaataatgagatgggataggacgaacccacttttaagggtgtttggttgaggggtgagtaagatgggttggtccctagagaggaatattcctctcagatccgggtccaaccgatccgggaaaatgtggtggacgaactcgtcccacctgggacgagcgaacggcgtgacggcgccttactcgcgcgctcgccctcgagagcaacggcaaacagctcgggcgacagcgacagcgatggcgggggactcggcgacgatggatccagtggtggggagggcggcggcgacggatccagcgatggggaggactgcggcggcggattcggcgatggggaggagcggcggcggcatgcgaggaggaggttgaggggcggcggcagatccgacgatagggcggcggcggattcggcgatagggaggagcggcggcggagtgcgaggaggaggtcgaggggcagcggcggatccggtgatggggaggtgagcaagccatggttctcttcctgctcttgctcttgctcgctgccagctcttcctcttgctcttcctccggcgatggggaggactgtgggggcaaatcaggtgatcgttgatcccctcgtcccttcaaccaaacaaaaatttaggatcatcccatcctacaaaccaaacatgtaagtggaatcatcccaactcaaaaatcagggatggttctatcccatcccacatagtcccaaaaccaaacactaccttataatacaatgaatattgacaagctcgtgactaaattcattgtactctgaaatgtttcacctgattttaggttgttatattatcgggagtagtattcttatctggtcgccactgttttaaaatttcttcttaaatgccattcacgttatattagcttagccgttaatcacatcgagaagcacactagccatgccctcctcaccttttcccttcatagtggccatcccatcctgtcggcgtaatttgccacagttctcatgtcctcatcctgtggtaaagcccccgacccacccaggagctctattaaacatcatcttagtgaaatagtgatgtcatgcatggtaaaaaaaaataatgatgatgtcatgggcaactgtagtgtcattattagatcaacaaatacggaagtgaaatgaagttcatccatgcatacacaggggttattgtataggtttgcggctatccatgacgatagatgattaaaaaatagcgtgtatgtcagcttcacaggcatagatatgtaatgttcatctcttatttatctgagagtgacagaatttgcatctctttaatagtgattgacatacgatgtggtccacgcaaataatgggcccatggtaagatccaaccataaccatgactaactaggtgtggctgagggagaccattgagcgagctagctattcaaccatcgagagtctaggggtggtaagcccaatgacgtgacaaaagggtcgcatcgccatattgctcggtggtcttcttcagacacgctcgactagtcatggttatgattggacctcgtcgtgggtccaccgccatgtggatcatgccatgtcgtccactgattcttaagaaagggacacaatgtctgcctcagaaaaagatggtgcacagggagcaccccttgccatcgatgctaacacaattcgaagaaaccatgaaacaccgtccgatgtttttgaataggatcagaagtccgactactcatcatgtcatgttgagatatatagagagtgtttgggagagagggactaaatctagggacttatttttttggagagagggactattagtacctctcccaaacaccctcatagttacaaggaagatacctctgcctagaattaccctgagaaattagcataggctggctcgggacttgtctctgggctgggtcgctcctgctcccgccgtggttaaacagtggaagtgtggaaccaacggtagtttcgaactttcgatgaataagaatcagtgtcacataatagtcttgatacaaccatccaaagacgttatagcaagaaagggaaatctcgcaaccttcaaacaccagccgtgatgcacgtttgtctgcgttacgctcgaaaaggaagcgagaagcgaactagtggtccccaactcggcaaaaaccatgatctcatgacatccatcaataccgccgcccccacgcgtctctgctattggtggtgttgacagcccaaggcccaagtgtcacacgcctttcgccaatctgccgtggtgctaaagcgtacaactattctgtcaccgttaacattcggccaaatcagaaagcattaaaaagaaaaaaaaaacccagagggaatcgaatgacggcatgacggagttacaaggcggagaaaaaaaaggtgctacttttaccctagtgatgaaaggagaattttacatagacttgagttttacacatagaccaagtctatctagtatagcgaaataatagaaataaacaataggaatcggccactcgatccgcgacaacgagattccgccgccgagaggtgtttgtgcaccggaaatttcacccctcttttttttgggccaaatccgcgtcggcatcggcatccgcgaggcgtcccaatcccaatcggcaccaccccctcctgccccgtgacgccgccgtgccccgtgccgtgggctcgctcggctcgatcctggccgcgacgcgacgggaccgacccgaactctctccaaccctcctctctataaataccgcccctccgtgtctgtgccgttcgatcgcacccgtaccgaatccgcgcccctgaaagttttgcatgccgctgtcgaagtcggcttccgcgtaggtgtggtcgtcgtgtcggcggcggcggcggcggcgggaggaggaacgaggaggacacatggagcacgggagcatcatcgcgtcggccgtgggggtgggcgtcggggtgggggtcggcatcggcctcgtctcgtcgcggctgaccgggttggcgactggcggcggcgccacggcggcggaggtgga

SEQ ID NO: 42280 - DNA, 3942 bp, Oryza sativa
  unsure (1)..(3942): unsure at all n locations
gggtaggatcacatgatttaattactgatcccatgaatacgcgttgcgtcgtcagtagaaatcaatgcggtgtttggtgaagggcggctaattgagcatgtgtttcccatggttttcttgcagcgagcagtcgaagctggccctcaccagcacggcgttcgtgcatctgagcccaacgatcctgcccaatcacatccgcgtcctctccgcgtccagccgcaccatactgctctgcggcccatcaggttcgccctccgcttcctgaaccgcaatgtgcgttgttcgttttcgccaaaagcgcgatcttttttttttctcacagccgctgtttctctgttgcagaggcgtaccttcagtcgctcgcgaaggctctcgcaaaccagttcagtgctcgcctgctgctgctcgatgtcatcgacttcgcgtgcaaggtcagttagatgcaatttgagaaattttagctttgttgtcgccctggcctcttatgatcctaaactgttcttttcccgattgccattgcagctccatcataagtacggcggtccaagcaatacacaggtctgtatcctatttctgccttctttttctaggtggtaactggtagttccatcttgtatagcacatttggttgatataccaagcgacatgggaaattcaggattttcatttctgtttatcagtttggccttttttttttccttaatgagtcaaagtaaaacatggtgtccctgttgaaacaatgggtacttttctttagattatggaatagcgttttacgattccggcctctgcacaacttaaacggggtacttgaggaggatagaacctagtctactctgtccacactgaacaatttagctagtagagttgctgaatgtgcagtttttttcgaacaggagcatttgttacaattttgtgaagtggcgtggatttgtctgatgatttacctaatcaattctgatctgttcataacacagacccgtgagagatccatgacagaggcagccttcgatagagtgtctagtttggttggagctttcaatctgtttcgcaagaaggaagaaccaactggaacaggtaccctgtttcttcctgttgtgcactcaccgtttctttgcctgtttactttctgcaatgctttatccttctttctctcaatcatgattttgaagcgatgcccatgctccaacttttctgatgttctgactgtgtcttcatgaaacactaatgtaggaccattgagccgtgaaacaggcatccttgatctcaggactaggtaatatctctgcctggatatgcaactagaggtattagatattgattttctgagcattttatgctattgcttttgcagcacttgttgtcctcataacacaccttcagtacgggttcagttatccttggtacctcccgagaaggaccatgatcccgaatcttctaaataccttggtgagtgaaatccatttttttatgctctcttgtttatttatgccccaattgcacatgtgcacattagatgtataatgcatatgttgccagcttcaactagtttcagacaacccaacatcctcatttacctgtatattcaaatgtgcctgcccatgagggttcctccaactgaaatctgcagttatcctaacctgcctagtttttagctatctgtagatcaccctctcttttgatgcagcatcagttaaaccatgctggagtttgaatgagaaggttctcatacaatccctttacaaggtaactcagttattcagcagtatagtccaaatttacgtgccctatttgtacaagctgatattggatggcttttgcagattatagtttctgcttctgaaatcagtccagtcattctttacataagggatgttgatgacttgcttggaagttcagaaaaagcatactgtatgtttcagaaaatgttgaaaaaactatctggacgggtaatcgtgattggttcacaattcctcgatgatgatgaggatagagaagatattgaagaatctgtgtgtgctcttttcccttgtattctggagacaaagcctcccaaagacaaggtccttcttgagaaatggaagacccagatggaggaagattcgaataataacaataatcaagtcgttcaaaactacatcgcggaagtgctcgcagaaaacaatcttgagtgtgaagatttgagctcgatcaatgcagatgatgattgtaaaatcattgtggcttacttagaagaaattataaccccatctgtctcttaccatctgatgaataacaagaaccctaaatacagaaacgggaatcttgtcatatcttcggagaggttagctaaatttactttgagtttgaggtggtccattgttgctttatctcgcttttgctaacatggcactttcacagcttatcccatggattacgcatattccaagagagcaacgaccttgggaaagatacagtggaagcaaaggatgagacagagatggtaatacattgtttcaactacaataagttataattaagtaattttcctagtttaattacatgtttaaaattttgctattcttaacttacaggtcgttccagacaatgagtatgaaaagaagatccgaccaacggttataccagccaatgaaataggagtgacatttgatgacattggagcactggctgatatcaaagaatgccttcacgagcttgtcatgcttcctcttcaacgacctgatttcttcaaaggtggtctcttgaagccatgcaagggcgttctgnnnnnnnnnnnnnnnnnnnnnnnnnnnnnnnnnnnnnnnnaggccctagcaaacgcagcaggagctagcttcttgaacatctctatggctagtatgacatcaaaatggtacggggagtctgagaagtgcatccaagccttattcagccttgctgctaaacttgcaccagcaatcattttcatcgatgaggtagacagcatgctagggaaacgagataaccatagcgaaaatgaggcatcccgcagagtaaaaaatgagttcatggctcactgggatggactcttgtctaagtccaacgaaaggatattagtccttgctgcaacgaacaggccctttgaccttgatgatgcggtgataaggagatttgagcacaggtatgtttcgtttatgtgtatctaaacttctatttgattaaattcagcttctctagatgagtttttttatgagtcatttgtgttaaatagaatcatggtcggcctcccaacgttggagagtagagagctgattctgaagacattgttgtcgaaagagacggttgaaaatattgatttcaaggagcttgccaaaatgactgaaggatacaccagcagtgacttgaaggtctgtacactgcttttggacttttggtattataaagaagatttattcagtcgtcactctctgaaatattaaatctgtacttttttttcttcagaatatttgcgtgacggcagcttatcatcctgtcagagagctacttcagaaagaaaagaacaaggtaagacccaagaggaacggataactataatttaacttttccctgatgaaacctgcaaactccattaccgggtgcttgataaagcgaatcatcatctcacagtgactaatggcaattttgattctccaggtcaagaaggaaactgcaccagaaacgaagcaagaaccaaaagaaaagaccaaaattcaagaaaacgggacaaaaagttcggatagtaagactgaaaaggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 42281 - DNA, 84435 bp, Oryza sativa
  unsure (1)..(84435): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnntcttcgtccgctggttagcttattagtcgcaactaaaatttaatttttaaaacataacttttagttgattttaggggtttatttttattgtggtctatttttcagtattggttggatgacatataaattatttttattactctgttcaattttatagcacttattagccgttgcttaacccattagagccgaacacaactcttttgcttgcccggcactaaaaaattgtatttctaatttctacggtgcaaaatttgacgaggtcctatttatatgatgctctgggagatgaatagttatagtctgtgagattttttcatactgagtgaggagggcatggcattatcacaaagtagctcaatattcgtgtttggaacacccgagaaaattttgaatgctctctgttttcgtgtgaaatttctcaggcagggatcaattcaagtgtggttcaccttgtgctgcaaaagagagccacacaagaaaggctcccaaagattttgtaatttgtatgcatgcgtacatgtacgtgacaaggattggaaaaatcttctactgttgtggcaggtatgtacaagagctggtagaggctggggtgcagtttggctgttcgtccagccaaccattctgtccaacccaacatcgtcaggataatttggtaaggatacctgaaagttggtaaatgccaggatctttttgttatttatttgttagtattaggtaatgtattttgtcttgaattaatcttgatggatttaatcgtcgtaatacccaaagtaaatatctctctcgcagtaaataagtggaaacaacagtgtcaaataacccccgaattttgctctatgatgtaaccatggatcatgagtttgatgactcagacaaatggcacgctctaaacagttaatagaggtatgcactcccgtagtttacttttccgcttacaagtcactgttaaattttaaaatttaaagcttatttttggacttgatttttttctcaattatagtttgtttatttttcagtatttgcttttgaactgataaaaaaactcacataaaattttcatttataaactattttttggttgttatgatcagcataatcgaaacggtgactttcgatggattatttatgattttttttaaaaaagaactttctacttcagtattggcttagacaatttcccacgaaccatttgttagctcaattttcctcggtttcataatctatccaatccaaaatcacccagttagaaaacgtccaaaatgtctaaactgatgtccccaggcacaagaagaaatcagcacacatacttcatttggttatgtacacaaacaccacgtactatgcgtgtgtggtaaccgcagaggatataggacctcacatctcccaattcccaagaacagtaaaaaaaagattttatctatttatctatctatttatgcatggacaagggcacaagtctaacgagagaccacgcagggcgtttgtggagagagacgggcggcgctgccaagtagggcattcccgccaggtaaattcccgggctttttttcttttgcttgcttcctttgcttgtctcctttggttgcggcgggaacaaaaaaagaaaaaaaaaagaagcgcaccgcgcagccgcgcgccacctccacctccactcgtcctcctcctccactctcgcaatctcgcacatatgcgatgcccgccagaataaaaccctcctgccctctcgccaatggcggccgctgaagctacctcctgctcttcttcctcttcgtcttcggcgtagctccatccctgctgttgcatgtaggattcgatcgattcgtggtggaggtaagtaatatccaatctcttcttgagtcttaatttcttggtagatttatctcttctcgatctcctgttgttaatgatgatgagttgccggatgcctgccgggacttcgcttgcaagcagctgctgtgtgcgtttcttgcgtgggagtcttccttggctgccttcctctactacatctagcagattctttctaattaagtttcgatcaatatgtgcctttgtgatttgtgatatatatttgaatggtagattaattagttattcggttgattttgctggatgcatgcatgtagctaggtgagatggatgaacaattgaacccctgtcagtttgccaagtttaattagtcaccacctgcaaatcagattgaaatagaggcgaattaaggagatagtttcattctgctcaagttctagactagaacatgaggattaattagatttttacttaacctggatgaatccaacaagaaaagattctggtattcagaactgagttcggttcaccaacgtgtagtactctacaactatagtcaaaaaaggaggaggaatattgttatgcaacgaaatgaaatgacagccagaatactgtagatcagcatattccaatattttttttgaacgaacatgtgctaattttattgaatataggagaagtaaaagttacatgtataaaaaagaaagaaccgtacaaaaggacaaaggcctaaggaattaaaagcactaggtgttttgctcccgattccaatgttttgaaacaaatagattttaacaaattatgtttgaatatttaaactattccaaaccaggatcataaattcataacagatcggcaaatagcgtgcccgagatagcaggaagatactagcaccaacgcaatcaaatatctgaaaaaaaaaattctctgattcttagctcacacgtcacacaagtagtagtactatcaatctatcatttctcaggggaatttaacccaaccagacccttttgctttccacattccacaccatctcataatatgctttcatagctttactgctttactctttttctacatacatccaaggctgctgctggtcatcagaattcagaatgagaaacatgccaatgttgtgtccttctcattcttcagtgagtgcagtccatggagctatgctgatctctttttgtccatctttaatcgtcctaatcctgctttaaagccaaccatgtcatcaagaattgatcaatgttcttttgaaaacctctttttgtttagtatgtgttctttcatgtccctgtcaagacagataaattgcacagcacaacgtgtagccttctgcatgcagtccacaggccttggaagaaaaccctttgatgatgagtgatgttgattcttgagcagatttacacacaacccaaaaatactaatgatgaaaaggagtaagattaagtaatccgttacacggctttcttttattaaacacaagctttcttttcttgcaaacattgttctactagtgacataagttagttactaattactagttagttaatggttctagtacggatttgatgtttttatgtaatggtcaatgcgagtcaaagatgatgaaagctgcaggcatttgcagtgggcttgcctacaaagcaagacacggacaaacaaaaacaaacgctctcatttgggagttcatgtctttggtgcaaaggaaacacacgcatgtacgtcgcgatcatgcgtgctcgatcggcgagctatagcgcgctaacggacaatctcatggtcacggatcgagtgtgatcgatgcgaaaaagcagcttgcgggcgcgatttctttctttgtctgcctaattcagttgatgaatcttgcatatggtcttttgtgttgtgtactgcaggagttgagcttgtcaggtgttcgttcttggggatcgatgacgctgggcagcggcggcatggcggcggaggagggcggcggcaatggcgaggcggcggcgaggggggagaggtgcgtggtggtggcggtggaggagacgtgctgcgcgtgcgcgcagctcgtggtcgggccgccgaacccgatgatggcgaggtacgtgtacgccttcgtgttcctggcgaccaacctgctcgcctggacgctccgcgacttcggccaccccgtcctcgccgagctccggcgactccgcggcagctgccagggcgccggctactgcctcggcgccgagggcgtcctccgcgtcagcctcggctgcttcgtatcctctttgcaattcaattcagatttcagtctcagattcagcttgcattttgtgaggtggatttttgtccctggagggacatcccctcgttttatacatgtcatttaaaaagttatcaaaaaaaaatttaaaagcaattgtcaagataaattaatatatgatatattttttcacaaacatgcgagttaaaatttgaccaatacaattcgaaacaaaaataacaaatttgaccgtatattaagcgttctattcatacttaaatttgttatttttgtttctatttgtataagttgatttttgaatttacatgtttgtgaagtgacatcacatattgatttatcgtactaattttttttcaaattttcaatgactttttaagtgacatacaaaaatgaggagttatcatcttaagggatgaattgagttttcctgcattttgtgaatttgatgtccttgacgacggcgatcaccagctgttcttcttcgtgatgttcttgtcgacggtgaggacgaggaagacgcacgatcgccggaattcatggcactccgagtggtggccggcgaagatcgtgctgtggatgggcttcaccgtcgtccccttcttcctcccctcgcctctcatccagctctacggtcagtgttgccattgtcaccctcctcagctcctctcacccacccgttcttgattcctctttgctcatggtgttcgtctgaattttcatattttcagggaagatcgcgcatttcggagcagggtaagccccgcatgcacattttcttttttaatataaaatactataacttccggcctcttgcatcaactagagatgcatacacgcaaccaacacacgtttttcagcacgttcagctgaatcgggtctcgttatcgacgtaaaactgatggatcatatgatgcgcaattttgacagggcgtttctggtgatccagctcgtcagtgtcacccggttcatcacctggctgaacgactgctgccggtcagagaccaacctgaagagatggtacgtctactgatcaaagccgctgatttctgttccataaaaaagcaaatccagttccctccgtcctaaattataagacctatattttttttacacggtcttcaatgatatattttgatcgttagtttattccatgctatatatttccaataaatatgaaattagcatcacatgaaagtattttaaaatatgaatgtaatgatataatatgcataatacttagcatatatatatatggttagtataattattaatcaaaagttaccgagtttaattttccttaaaaaaaaggtgcccaaatacgaaggaagtactatgatatgtcacatcaaataccgagtacagctcacctgcaatggcggcgtacgtctgacatgggttgaggtggtggtggtgcagccatatgcaggtgcaggtggtgtcgatcgcggcgtacgtgggctccatcctgggcgtggtgctcatgtacgtgtggtacgcgccgcggccgtcctgcaagctcaacatcctcttcatcaccgtcaccctcgtcctcgtccagatcatgaccggcgtctcgctcagctccaaggtcttgtgcgactaatttgcttacttctatccggatcgatcgatctcgattggaacaagtgttctcgtgtctgaatctctgaatctgaaatctgcatttgctctgttcttggattggttttgggtttcaggtgaaggctggctacctggcgcctgggctgatgggggtctacatcgtgttcctctgctggacagcgatcaggaggtgattattttctttgaaagattcattcggatctcagttctgaatttgtgatctgatcatccatggaatcgaatccattttataacacaactttggttcttttgttttttttttgggccatgaacagtgagcctcacacagagatttgcaacaagaaagccgaggttgcaacgagtgcagattgggttaacatcgcggtaatcatccaatcaactgttcagaaatgaaatttaacaaaatcgaacaatgtcatcatctgcttaactgctgctgtataaatctgaagaatgaaatgtccaacatctgcagagcttcgtgatcgcggtgatcgtcatcgtcacggcgacattcgctacggggatcgattccaagtgcctccaggtctgtcacttaactgaactcatcagtgatcagggttatgatcatatcgccattgatgctgaaattgctcgagaatctgcagttcaagaaggccgagagcgagcagcccgaggacgacgacatcccgtacgggttcggcttcttccacttcgtgttcgccatgggcgccatgtacttcgctatgctcttcgtcggctggaacgccaatcaaaccatggagaagtaataatcccagccataacaacttccactggtctttagcttaataacttgataatccattcaaggagatcaagtaaccataatccggtaactgattacaatttgttatgatccggttgattgattgcgtcaggtggacgatcgatgtcgggtgggcgagcacctgggtccgggttgtcaacgaatggctcgcggcgatcgtgtatagtaagtgaaccaaaccatgtactcctttcattccaaaatataaaaatggttagttttcaaaacttatataccataatatataagtatttatagtaccctgattgtgtgtacacacagaaatccaagcattttgaaacaatcagaattttgggaagagagcctaaccaattcaaaacttaatcaatgatacaagtgaaaataaatcttttttccgccacaaaccttaatctttactaaacaggctagaaatacttacattttaaaacggagatagtataacaatatctagccgcgcaattgcacgagctacatctgcactagctactgtatattactgacaaaactgccgttgcacctgcactttcagtatggatggtgattgctccaattgtctggaagggagggcaggtcggctcatcgccagagggcacatgacacaaggagaacaaatcagaattcagaaatggagcttcgtcagatgatgcagcgataaatacttggtcagcgacaaacacgtacgtagctgcaggctgcatgatcagggagatgtacaggatgagaagaacagttttgctttcgttgcagctgctgcagagaggcatatgcaattggcatccattgcccatacgagtgtagctagctagctaagctagatatttgtatgttcagtttcctctcctgttactggagagggcaatgcatcgaatcagcaaagcatattgtcaaatgacaaactgctgctgaacatgcaaaaggggcagcaacccttggaatatacgcagacttcctgaaacagtgactaatttctgtcatttggaatttcagttctgatctgaaactgggtactcattgcctatctctctctctctctcatgattcaatatttatgtagggtactcctatgatgtaatctgatcaggttacaaagcttgaagaaatcttgtttgagtgagagggtgactgagatctctcatgtgatgcatgcatctgatcgattctgatcaggtcggccagggacatgaaagaaatgatttactccctcacttccaaaatgtaaaaatatagtattggattaaacattttataatactacaaatctggatatatatataaaatgtctaatctggtacttcctccgtttcacaatgtaagtcattctagcatttcccatattcatattgatatctatctagattcattaacatcaatatgaatgtgggaaatgttagaatgacttacattgtgaaacggagggagtaagtaactcttaaaaaattaaatactaatccatacaagagatcaaacaaaaggaatagataagcatcaatcgttggagtaactcattttctgatattgccatgccctgatttctgaaattttgtcctatgaacaaaaaaaaatgtgtatatgctctaaattacgatgttatgatggaaaatggatcatacttcgccttttctgcggcttcctacatgcctcctattcgctggttgttgtttcctcacgctactcctactctatacacatttgcatgcaacctaatgacccctcttgtttgcagcaatattgtactgatgtactctcccgtccttaaaaaaaaacttaacccaggagaggtcatacaacgaattagacaagtgtcacatcccttctagatacacatttcaatactcgtggtacgtttttcaaactgctaaacggtgcgtttcatacgaaaactttctatatgaaagttgctctacagcgcggaatattagtttgagcactgcacaacgccctctccttctggttttcctgttttttaccacaccacttttcctccgcatcccacatttcctcggtttgttttttttcgtttctttaccactccactttccgtgtttcttttttctcttttccatctcatccgtgcttcatccatgggcccagtaaaatattaaccatctagattttttttttcgttccttatttgtagtttttctattttcgcgttttagtaaactatttactgtctagtttttctttccgagttttccgtttttctagtatctccgcacgtttcaaaagtaacaaatttactccatttactccgtggagtttttcatttactccgagcctcccacatccgctcatttaaaagtaacaaatttactcgcatgaatgcctccatacgcaatacctagatggtcgtaaaagaattactaccagcttacaacgctagtaattcttttaccaatattataaatattgtttagatttcatggtctgtgagtaaaacaattactaccttcctttcgatatagcccatgatctcgtagccaccctatagtaatatatttactgatgtgttcaatacacaatataagagtaaaaaccgagatttcctggtatgcgactatgcgagtaaaacaattaccacattcctctcgatatagccatgatctcatagccacagtgtagtaatatttttactgatatgttcaatatacagtataagagtaaaaatctaaaactaagagtattgttgatctgtatcacaaaataatcgtataaatgaaaaaaattactggctcaatcacacacaagcgataaaattactcacaaaattactcacagctgaatcaaactagaaaaaaaaatgattcagccaaaaatccatctggtggctttgctggatcttgctataaggatgaagagcacggtctatgtcttgtgactggtagtggagagggcaaccgggtggcgagcagtagtcgacgatggaatcatggaaggatgtagcggtgtggtatagagatgagctcgacgttgcgcagtagcagccattcatcatctagcaagcacgaaaaaatgcaaaaacattctcgttcatgtcaatacagatgacgagcaaaagaaaaatagcaaacaacttccatcaccggcggactccaccctatcctctgcagccagccacatggagcacgatgtgcaaatgtaggacctgtgcagcccatcaattgagatcaggtaatattgaagattgcacgttaatttgatttgcaaaaaaaattagggcttcatgcgtgaagttgaaggagagtatgcatatgcaaatcagagtgtcatttccttgcttgttctatcaatgtcgccgatgtggagcagccgctggttgttgctattggcccaggtgaacacctctttgctggttaaggtgatacctagcgtccggcagcgaggcccgaagcgtgccttcgcctcaaccgtcgccggccactgccatcaaccaccacggtgtcatcctcctcctccatggtgtgtcgccgatctgtggggtgggatggtggatcgatccagatcccaaaaaaaaggaaaaaaatgaagtaggggcgagagtggttggttgggtacgggaaaaatataatatataccggaagcagagaaattgtttttatcgcagttaatcatttactccgataatggtgggagcacgatgcgggacgtggggtgggatcggaagcagtggagttgtttttattatcgaagtaaatcgtttactcgaataaagttgggtggttggggcgcgcgataggagtaaatcgtttactccgacaacggtaggagtgaaatgacggaacgtggggtggggtgggcctgggctgatgcatgtttggcgcttagaattctatcaaattaatctatgtttcaagtttgtaataattaaaacttaattaattatacgttaatattacctcgttttgcattaaaacacttaatttttatctctaagagaaaaaaacaccacctaaattaaattttttaagcatggagaaagtacatattttttgtttttacacagctggtagatgtgtagcaaatccaaaataaaatccacgaggcaaacgcgtccgtggagcagtcgagccgaagcaaacgccgcccgcttccgagttccgagtcggcgcggcggacggtatatttatcatcatcctgcccccctgcaaaatccttcctacttttacgacacctccccaccccccgtctccttctccctcgtctccagatccgtgggtcgaagcagcggcggcgcccgatccacggcggtcactccctccgccatgaatcccgagtagtaagcactcccatccctcacctcctccttccttccttcctatggttcgtgatctccgcccccggtttcgccgtgctgctcgtttggttaggttgcccggatctgagcgggatcccttcgcatggtttcgatccggatctcaacttggtggctaggtttttcgtcttcttcacacgtggttttgacgacgcgcgggttgttttttttgttgacgatgatctcctcattatcacgtcaattgcaaaagggggaattcggcaatcgctcatcacaccatgatttgctgatgtctcatacatatttggggaatgggaattggattttattctaccaggaaatttagtttataatgttgccttatgtgcgtgccaatgtatcatatcagctcatgtccgtctgctctgtagttatgtgtaaaaacattgccatagttttgaatttggatatcttccacaagtactaatactaggcatattggtcccgtttggatatcaacatacttttggagcagatgtatatgcatcattattcagttacttttacctgcatatataagggagtcctaaataatacaatggtctctattgacatttattcatgccatgatttgatagttacctataagggaagttgacttttgggatatggaaagataacattttattgtaaataattcccactactgtaggagtgcattactacatgtgataaaacactgtgttgaaatgaagaaggtagcagttgtatgcatgtaattgttatttcattttctctatgtactgctactgtaacactagttttttcttttggtcaatttcagcgactaccttttcaaacttctcctcattggtgattctggtgttgggaaatcgtgcttgcttctcagatttgcggtacgagtttaactcattgtctcattctcctaattgtgtttttgtactaagtcattctggaataaatagttcttatatgtaaatgtgcttcagtagaaacatgcagtgtaggatcatacctcactattgcaatagcaaagtggttatgataattatgcaagggattccttccattggtcatctttttgttataaacatgaactgtaagatcatgaatccacaattcactcgtattaaataataaagaatcaagcatgaagcttgactaaattttctgttacgtagattgtgaatgttattgatgtacttgcttcctgtgattaggatgactcatacctggacagctatatcagcacaattggagttgattttgtaagtaatatattgttgatttacttgagttaagtttactttttgtagcacagcaataagttgtgcattttgtttgcagaaatacggacagtagagcaggatgggaagaccatcaagcttcaaatcgtaagattactgctaccttttcttcatcgcttttgatcccgtattgttttttacttgtgctagacaaattcataaataaggatgtccagttatgatgcaatggttattgtgaatgaatctagaaagatatgttctgaaggttatgttcccatatttgtgaaatattggtgctgctcatcggtgaaatttcattttccttgctcgtaatagattctatagattcttgagagtaagttatatggtgtgccctcattgtcaggggtgaaaattgttcagtttatgattttttgcggttgtggcaagatctggtctcagaggatttaccatcttaattgtgttctctttatccaaagggtaaagtctatttttgggccttgaactttgctaagcccatttatcaccctgaactacaaaactggttattttttcaaaacattcaaagccagacacaacaccctgaaccatatgttatggtggttgtcatgaactttaactaggtaagtttcatggtggtggaccttaatatgcataataagagtctgaattaggaaaatcatgtctatttcaaacaaaaccactaacaaattatgtctcagggtgtcttttggctggtttaaaagttgagggtgaaaaataatcgatttctttgtagtttggggtgaaatagtttgaacaacaagttcaagggctaaaaatggaccttacccttatcgaaatatgcatatgatatttttttacccatatttgaatgtgttcgaatgctgaacgttgtatcgacacctgaactcaattctggcaagtatatactttataatattaaaacccagaattgaattcagatatgggctatggagtgctttggtatgtccgtcattgttattgcaaattgtgccactgatgagaaatctttaaatttgtttagaaactattcttttttgagtagcaaactttgagaagtacattaaacttggtgaaatgtgatccatatccatagagtaatctgaagtggagcaatagtccaagtgcatcatgaatttagtatttgaaaatattgttaagactgtggtatgagtatactcttttactttgttacagtgggatactgctggacaagaacgtttcaggacgattacaagcagctattaccggggagctcatggaataattgtaagttggccacatgatccaaccgctattttctgcaaagtattggccatcttgtccctttcattaaactaattcatcctatcttgtgcatgcagattgtatacgatgtgacagaccaagaaagcttcaacaatgtgaagcagtggttgaatgaaattgatcgttatgcaagtgacaatgtaaacaagctccttgttgggaacaagagcgacctaactgccaacaaagttgtgtcatctgaaacagctaaggtaagctctccagagtcatttgattgaatgtgtattggctttgatcgactgtgtattggctttctcaccattgtcatgtgatgctcttatttatacgcctttaacatatctacaatcgttaaaatatcccgcaggcgtttgctgatgagatgggcatccccttcatggagacaagtgccaagaacgccactaatgtggagcaggccttcatggctatggccgcatccatcaaggacaggtacaactttaaatccacatgagcagtgtagctcttgtattaccctcatatctgggtagattttagtaacgaacatcccacctgtcatttttctcaggatggctagccaaccggccgcttcaaatgcaaggccaccgaccgtgcagatccgcgggcaacctgtcaaccagaagacgtcgtgctgctcgtcctaaagataaccaagtctttccttccatgtaaaattcgacgtatgttactactgtttgctcactacaacgtatttgtgatattcatttgaacgcccttgataccatcttttctttaatcagatggttaggcagctgcaaatatatatgtaaccttgctttgttgctctttgctcacgaatcgagaggagcaagcagaaccagtgtattgattcttttcacgcttacatttttcccatttcattgcatacaagtattctgtgttgaggtttagttagaccggaagcggactgattacaacaattttacaacttgtcacaggtgttggaaagttaattttgcatcggtagaaagactatatctttcattgagtgattaggtccaattattttgttccttgccgtgagctgggtcccatatttttatatctaatcccatgaacgtcagtgttgttctggattccgaacgtctcacacgatcgcttcgggcctcgctgataacgcttaggttcacgacatccgtggtgccctcagtagtcatctcccaattcttggcagtctgggacgccgtgcttcccacctagctgaccctaggaatggaggaccggcttgtcagacttggatgagcaaccgacaatattcggcgcactctgcctaccaggcctaccttctgggcctccactcttttgcttgcgccgacctgcaatgggatgctaaagggcctacctaaatgcaagcttttcctctggtttacactccagcagtgttgttggacagctgatattctgttaaagtgtagagtcgacatccatttattgtgccccttgccccttctgtgctcaggagtttgagacgacaaaccatatcctactccactatgtgttcgctcaatagatgcggcaccgcgtgctatccacggcaggctggactggtaccctacctctagagctcgccttctagagcagctttgtcaaggctttgactccttgatcttgctggtgtcctggcagctctgtaaggagcggaactccaggattttcaactccgctcttttgtccatccaggttgtctttgactcgattattcaagattttcaactccgctcttttgcccatccaagttgttttttcaactccagtcgaacgctggatggcttatctcgacattttgttgggaggatagcagtgctcttttacttgcttgctcgtgtcttgcctagcttctaagccttagtcctctaagtcccttttcgccagatttttgtgctagtttttttttctcttgtacctcctccgcaatggcctctgactgttgccttaaattccacattcttataatatattgatgtgtaatttttttacgcgttagttaaaaaaaagacacgccatggcgcgccccagcacatgacacaaggagaacaaatcagaattcagaaatggagcttctcatcgagattttgaaagtcacacgaattgaatggcatattctgaaaacggtgtgaattggatggcatatactgaaaaatctcttcgtcagatgatgcagcgataaatacttggtcagttatacagacacgtacactgctgcagttgcatgatcagggagatgtacaggagaacagttttgcttttgttgcagctgctgaagagaggcatatgcaattggcatccattgcccatacgagtgtagctagctagctaagctagagctttgtatgttcagtttcctctcctgttactggagagggcaatgcatcgaatcagcaaagccaaagcattgtcaaatggcaactgctgctgaacatgcaaaaggggcagcagccttaggaacaaacagtgactaatttgatttctgtcgtttggcactgtatgtaatttcagtatatatttcagctctgatctgaaactgaatactactcatttgcctatctctctcatgcttcaagatttatgtagggtactcctatgatgtaatctgatcaggttattttggagtattaacatatctgatcgaatctgatcaggtcagccagggacaaagaacgaaatgatttaactccagtgttgttgcggtgagctggagcgtgcgtgcaggacaaactaaaacctgaaaccgtggggcgtagtactactgtaggagtattacgtatcgtgcgattgtttgtagcgccgtctaaggtgagtacactaggtgacaggccaggtacatcgtcatggcaaacgtcagagttccagacatacatggcccagaaaccaatccaatcagttgttcgcttgtcacttgtggctgtaattcagttgcaactgacctggctgaacccctcatcgtttggctttatgttctctctccgcaaaatatgtacacttcatccgttctaaaatataagaacctagaaccagatactacgaatctagataagctgtctgtctagattcgtagtaataaaaaagtcctaaactcttatattttataggactgagtgagtaagaaataacatatgcttaaagaaaaaatgtcctaagttcttatactataaatctgaataaagagaggtatatcgtttcatgtctacaattcgtagtacaagatatatctcattcaaccaaagtcctttatattttgggacgcacggggtaagaatcatccgctgctaaaatttaaacctaaagtttattttaggatattttaatgtagtttttaaattagattttaagtcatcaagaacatatgtatgtaaaagtttcatctaaattattgtgacttgcatataataattagattttaaattattgtttttgcatatatatatatatatatatatatatatgtgtgtgtgtgtgtgtgtgtgtgtgtgtgtgtgtgtgtgtgtgtgtgaaagtttcagctgatagtgaatcgacggggaccttagcctaccaagtcacatcggtcacatagatcgacaatgagtgtatgcaactgcaatcgggattgtgcatgaatgaatgattggtttcagatctgcatccatgtcaagcttcactcttcttgtatgttttggccacagctctgggcctcatgctaatccgttttgccgctcgcagttcacgtggtttggcaatacatcaatttggcgtcctgcttattgatccggaagcagtactgctcttgttgtaaagcgaaccgtttcaatactgaaacttgcaagcaatgattgatttatcgatcaccacctactatagttctctttatgatgagattgctaataaaagcgggcaaagtagtccctcggtaagaaagacttatgagaaaggctagtaatcatgcacgtgcaatccacgtttgatagaatatatcacacacaatatgcatctatgtgttttaataactgacaaaactaagaatttgttggttttatatcaattacaatagactggagtacataattttgcaaaatattattgcatttgtgatttgcaggggattggagctctggccaaaacccacttcagtccatagctttgctaataaaaagatccaaaattttggagaaatgagttcacgatagtgaagtgagttagttcatgaacaaaatcactaaactaaatatattttaacgaaatttttgagcatactttacctcaacggagaataaaactctcagcatagtcatataaggatatggtgtatatgctgagcactcgcatattgtagctacaaaatgctttaccttggggaggaggcctgccctttcggtccaaaagcgcttcaggctgccaagctgaaaatataaaatatcaattattgaatcaatttatctacaatagtgcttcaccttggggaagaagcctgcccagaaaacttcatctcttagttgcaaaatatagcatttaaaatttgtaaaaaaaaacaacttcttcgtctactttatcatctcaacaaattataagtatctcatttaatttattcacctatttactcaactcaacttaatcataatcatcatatcccacattaaatttgacctctcctttaaaacccataaatgtttttattttaagacaaaggaaatcggtaagggcaatgttaacaatagagcaaactgctagttctatctttagctagatcatgtaatgtcaatataatgcatactatatcatcaatatatgatctaccttattatctcgtaacactcatttgagtccatgctggagttgaatacagatctatggtttctcttttctaactcaacaaaaatttaatatactctataacaattattatagcacgctcacatcatgtttacttgctccaatgagatagttggagaagtcctcttttacgagtagaactgcgggcataccactccaaggctccaagctcacaccaatacacgtgcatacgtagtcatatgtgtccgttacttatagtccaaaattgtatgacatagaagatgtatagcatactcatcactttcttcgagttgatagtgcttgtcattttgaataaagacatggtcttgaccgctattttttattacaatatatgtaaaaatatcaataaatatatgattttattgaagtactttttaagtacaatctacatatatggtcaccatatttctaagaaatattttagatattatttatagtcgaattttttagagtttgataatagccttgtcaaaaataacaaatactatcaattcgtaggtagttttacacactacatttactgtatattttaacccttattaaaatcctagcgcacatatgagcgtaatatttatgtacaccaaaatttaaaatttcatgtgtaaagtcatacaccatgactctacaccgtatcatttttttgtccctgtaatatggtaatatattcttaaaactagtgtaagttagtgctaattagtgggacacaagacccaccagcactaatcctggtaggttattaagcgtacacatgtacatttagccatctggtcacatatatattagcttatcaatggatctctttctctccaaattcgacccaacctatttgcaattggcaggttgacagtaataaccttataccatatatcataaacattagttcgcattggaacggtgttttaataagttaacaattaaggtgaagagcgagaggtcgacgaaggtcagaagtagatattgtaatacgacggtgtagtatctatcttctaattatctccatctcaagatatgtggtaatttttaacaatgaatccagataactattatctccatatcctaaatatagtaacttttgattattaatctggactggacatataattatctagattcatagctaaaattacttatattttgggatggacggagtattaaatatgatactcttgtataatatctactacttcctttccaaaatataacttttaattatatatgaatgtggatgggtatttgttcatattatagctaagagctgttatgaatctggatgagtagtggttcagattcatagctaagcgtttctatattttaaaatggagataatattgttggtgacaatggtgtgcacatcaatttcaaaaatttatagatgaacttgtgttaacgaaatatcacatcatttcctctcgtgtatatataacttataatgttacaaattgaaaatataccgtcaagattgtatatgtttttcacatcccttaagcaacggtgttgtgacgtggagttgtgcgtgtacaactttactaatcagagattaaaattccctgagggcacacatattacatataccctgcactatacttcctttgtcccaaagaaaaataacttctgaaaatgaatcgattcatccttaaaagttgaattttttttaaggatagaggtgtaggattttagcaaggtccaatatataggttacggatttgtcattggtcgttgtattcttttatgtatgccagagaatgcattcgcggatatatgggttttatattgcacgtttagcaatgacataatcgggaaacatattgaatactccctccgtcccaaaacataagcatttctacaaatgaatctagataactccatgttcatattcgtgttgtttttttaattaatttagctcacaacatatgggcagatctgagctggaccagggagtcaggtcaggcgagaggcgaggccaccacacaaaactgtagcgagtgtggccacccatgcatgcaatgcagcctcatcgcttacgtcaccgccgtcctccccccccctacataaaccatcagcatcatcatcatcagccgcaagccactccacctcgagctctcgcaatgccggccatggaggaggaggcggtggccaacgaggcgcatcacttcctcgtcgtcacgtaccccgcccagggccacatcaacccggcgcgccacctcgcgcggcgcctcgcgcgcgccgcgccgggcgcccgcgtcaccatctccaccgccgtctccgcctgccgcaagatgttcggcgacgccgcggctgcgggcgccggcggggagctcgtcgacgaggggggtgtgcggtacgcgccgtactccgacggctacgacgacggcttcgacagggcggtgcacgacagcgccagctacatgacccaggtcagggtcgtcggcgcgcgcacgctcgccgccgtcatcgaggggttccgcgccgccgggaggcccgtcacccgcgtcgtctacacgctgctgctcacctgggtcgccgacgtcgcccgcgaccatggcgtccccgtcgcgctgtactggatccagccggccgccgtgctcgccgcctacttccactacttccgtggcacgggcggcgtcgacagggacatcgccgcggcggcggcggcgcgggaccggatggcgcccgtgcgcgtcccggggctcccgccgctccggctgcgcgacctcccgtcgttcctcgccatcgccgacgacgacgacccctacgccttcgtgctcgacgcgttccgcgacatcgtcgccgtgctcagccgcggcgacagacccaccgtgctcgccaacacgttcgacgccatggagcccgaggccgtggcgtcgctgcggcagcacggcgtcgacgtcgtccccgtcgggccggtgctctccttcctcgacgccgccaagagcggcggcggcggcggcgccatcaccaccaccaccagcaacgacctcttcaagcagaacgacacgggctacctcgagtggctcgacgcgcggccggccggctcggtggtgtacatctccttcgggagcctgtcgacgatgagccggcggcagatcgccgaggtgtcccgcggcatggcggcgagcggccggccgttcttgtgggtgctgaggaaggacaaccgcggcgaggctgacgacgtcgccatcgacggcggcgtggtggtggagtggtgcgaccaggtgagggtgctcgggcacccggcggtggggtgcttcgtgacgcactgcgggtggaactcgacgctggaggcggtggcgagcggcgtgccggcggtgtgcgtgccgcagtggacggaccagggcaccaacgcgtggctcgtcgccgagcggctcggcgccggcgtcagggccgccgtgagcgaggtcgacggcgtgctggaggccggcgagctgaggcggtgcatcgacgccgccacgtcggaggcggtgcgcgccagcgcggcggcgtggagagagaaggcgcgggcggcggtggccgacggcggctcgtcggagaagaacctgcaggcgtacgttgggaagattcgcgccaattagatgtgtcttattggattttgaattgggatgatgctccaattttatatgtaattagccgaatttcctatgtaattgtggaaatatatgctaatgcatatttgtatttcattttaatgtagagttgtgcggttgtgcctactagacacactctagtactccctccctccaaacaaaagtaatcttggtgaggatttcacatcatctagagcaagtctaggggcctgtttagttagttaaataaaaatttttgggtgtcgcatcagacgtccgaccaaatgttggaaggggtttttagacacaaatgaaaaaaaaactaatttcataacttgcctggaaaccgcgagacgaatcttttgagcctaattaatccatcattagcacatgtgggttactgtagcacttatgactaatcatgtcctaattaggctcaaaagattcgtctcgcgatttacatgcaaattgtgcaattagtttttctttttatctatatttaatgctccatatatgtatccaaagatttgatgtgatgtttttagaaaaaaaaaatttgagaactaaatagggcctagattcattgtcttatgtggtatcaaatcatcacctaggttgtttttttttaatggatggaatacatgtttatatataatcctatcagatcctaggttcttgtattttaagatggagggggtactagcttgttgtctcgtttgaatgaaccttagtttgataccgttttcgacacatatcaagtggttgaattggcctatcgctctaaataacacgtcacataatcaaatcaagtaatttgatcctactggatagagtcattacacggtactccaatcaaaccaacaagtgatatgtatgtatcaagatttaaactcctatcggcagcaaaatcatcaagcttagggaggagataattaaggaggacaagtcttgaaattaatcctgatgactgcgtttggttcacatccgtttcttagagacgcattcgagtaacatagcaagaggaaattgagaaaacatatgtaaaggcgccaactaaaatgggtctttgaggcgagatgatgttccaatttatataaactaaccgaatttcatatgtaactatgcaagtatttcgtttgaatgtagagttgtgcctactataaagcttagacgcactgtatatccttatactcaagtacatgcttataatggctagggatgtaattatcttcctttttctttttaaaaaaagtgtagctagttgtttcattggaatgaaccttaatttgtcgccattttcgacacttctcaagttgtttgaaagtcatcgagttggcactattcaccctggcctgccacacttaagtacatgtcacacaatcaaatcgagtaatttggcacttatgttggtggagttatcacacagtactccatacaatccaacaggtagcatgtctgtatcaaagttatgaacttcaattggcagcaaaatcatcgggtgtatagtatagccaattgctaactatagtataaatattgacacatcatctataatcaatttaatagtatacttgtaataggtagctataaatatattatgccatctctctttctacacaactagagtatgtgatgcagttggctataaatttatagcccgcgtgttcctctatttctctcctttctctcctccagctaagcacaaatccaatgtgataattattatatcatatttatatcatcttattgtactcactcaagatgagataaggacaaatccaatcctcgttactgtgtttggttcacatccttgtttagttggggaaaatttttaggtttgtttgtcacatcggatatacagatacacatttgaagtattaaacgtagtctaataacaaaacaaattatagatttcaccaggaaactgcgagatgaatttattaagcttaattaatccatcattagtaaatgtttacggtagcacgacattgttaaatcatggcgcaattaggcttaaaagatttgtctcgcaatttacacgcaatctgtgtaattggttttttttttgcctacatttactctatgcatgtgtccaaacattcgatgtgatagcgtgaaaatttttgttttgggaactaaacagagtaagagaaaacatacacagctacagtagaagagtatcttggaagaaaagttaccaattcagattggagggtagccaagccagtaggattgagggagtttagctgctttgaatacgccgacatagacaagaaccagaccagatgatgttggcatttgatgtatcaccattgtagttctctctttgtccaagaaaaataatttttcggccagaatgtagaggcgtgataagcaaccgagcaatggccaattccctggcaaaaatggcgtttggttgtctcatgtgactatgtgagcaaacaaaaattaggccgagtttagttccaaacttttttttaaaacttgcaactttaccatcacatcgaaactttctacacacacaaacttccaacttttccgtcacatcgttccaatttcaaccaaactttcaattttgtcgtgaacaaaacacaccctacctaggtgtggcagttttgctagcaataatacttggtcacttttgttttggaatgatattatcatatatctgcatgcaatttctactttgctgaccatatggcccatatctttgcctgacaccaaacagtggttttcctcagaaaccaaacagtgaccatattttggatgggtacaagcgagcatcaaaccaaataccaattttaccaaggctaatgcatgtgtggtgtgtatgtagtgtgcgtgccaacatctgcatcacactatttttacctgtagcacaatctctatgtacagttgaaacattaaaacaacacagctacacacacgactatgggtgacacattgggacccaattgtcaggctcattatgtaccacttttctctctctctctctctctctctcttttttttttttttgcagcagagaaactgtcaccatctttctcccaggaccagctctcaaacgtcacaacaatgagaagacatggatatatcatcgttatgcagaaaatgccgggctgcaccaacagctgcctatcattttggcccatttcccccaacaatacgttaacccagaggtctaaataagaggggggaaaaagaaaaggagaaatcaacatatgtacaaatgatgaagaaaaaagagagaaaaaaggggggcaagatgctatctactgacttggtcggatggagcagatgagctcctttctatcaacaaaaaagatgggtagtcttgcatcggctcaagccggaaaaagcgttgtcgtcagtcgtccctgaaatctctcctcccatcccgggaagagtccctgctggacgccttgatcgcgtcggccatcatgagagcaactgtggccttgtggagggcaaggtcagccttgtgcatcagcaggtgggccttctctctcttgagcttggccatggccaccgcatgctgcgctgcactggaggcatctcgctgcttgagctcctctatgtcgacgcgggggctctgggacgcacccgggagcaggtgctttgagctctgccattcgtggatgaccgcgttccagtgatcaggcgcgcctcgcttcactctctgatgacggaaggaaggtgatggctggtgatcctcagagaatgcaaagcttgcagtccttttgacactgttggttctcaaaaaccttggtgtagaacatctttccaaaccatcaaatgcgcgaggggattctgttttcacagagaacctgggagagtaccctgttggtgaatagatagaaccaccgtcataggattcacatgccctcccatcccccacatattcgctgtattttctccctgatatttgacagaaacctcgtatcagcaaaatataatgacaaaatatggcactggatcaatgattagaaaaaaaaaagttaagaaaacgaacctggtcggtaaaagccatcttgctctctcgaaaagcttcctgaggacataagttttttatgggaacgctgcttcggtcccttatacggtatttggggttggagtcctcgaggtctcaaacagaaggcgaacaaggcaggttttggaggcaacttaacttggtaaccatttgatgaaccctgtattctgagtgctgttgattcccattcctgtagctgctgctcgtggatcttccacatagcggactgaaaatggtacaaatacaaggttagaggtcgtaagtactgaacatttttggtgcactgccctttatccgtttagttgtattcaaacatagtaactgagaagcacaaaaccaatcatttccccagaagcatcagcagttcaacacaatccatgcatcctagggttcaagttaaaccatgactagacacttgctctacagtcactcttattagaaccatatcccaaaaagaaattgtatgtctagttccacagcacataagctacttgaaagttgaaatcccatgataatacactcactcatcttaatatgactgctcaatggcatccaatactcttggaaaagaaactaaaagtggaaaactacctccgctcaagtaaacgatgttttggtctaattaattggtggtcttaaagctgggaataaattatgttaagcacacacagtgctctgcctctcacatagcaaaaataaataagcatgaccataaaactacctaagcacaaaactaactgaaatttagtttaaagcttggacagatcatggagacaaagctgttcactaaacacaaaaatatagggtaataacttaaactagattgaaatctacccaatattttgaacaaaactagtagaaagctatcggcaacaaggcaaactcagaaatggcaatatattgttcacctgaaagtgtcgaatgagtggcattccctttttcttcctcttgtcctgccaataatcatgtatcactttaatggtgtccagtggtatgttatcactatctagttccttcatctgatcaatagtgagttcattgcagttgtggctataagcaagtttctcgaatttgtccatgatcctctcaaacaagtcatctgtcacagaggtgctgtccttgcctagtttcctccatcttgaaacccacacttcatcatcactgtccatgtcatatatcacacgagattcatcaagtgccatttcaacatctgttccaatatgaccaatataatcttgagagcgtacaaaggatacagcatcatgatcatcatgagcttcagcaaagcagacaccaggaattggaatattcttaacagatgcagctctaatgttatgactataacattcatcatgcatttgcttgaaaatcaaccactgacttctgtcaggaaattctaagcaccactctgtcccccctttccatatcattgcatgtgtatagcggtttgtcgccccaggctgcaaaacttgaagaactttgtgagcatacttagttccttctgcaagcttcacacaaatcctccgttcactctgcccatcagagtcaattgtgatctgagtatcgtactccctccatcctctatcaccaactgtaactaggacatttgcaacacaagccaatgactcaggactgctctgttcacttcttgaattatcaggaagtctctttgcactgctatgagactgtatcttgcggaaatgtcctttgtgttttgagccaggttcatcacttctaggagaaaccgagtacaaaacctgagtccttggcttcttagagccaccagcaaagcctgtcaccataatatcttcttgccataattttgaaccatcaccaaaagtgcgtgatagggatgtaaatcggttccgatggtagggagtcctgggggcagttggtgtaacacgaccaataggatactcattcagttcctggaccaagtcagatgtaggctgcatggccttttcttctttgttaagtagcttatcatctggtggatctgatatattatctccaggaatagatatagaagaacacctcttttgatacttctgaggagggcaaacagcagaaaggcttccatccataatttgatctggaaaactcctgcttgttatgttggcaccaccaatacctctgctattacaatccagacttacagtccttttagcagtattgagcttgctgctagcagaaccagaatgattgatgcaaccagcggtacccatatccaaggaaccagtattagatggactaacataaacagaacaaacttcagaagcagaagcagccagatgaaccagatcagatgtgtgctgtggcagagactgctgatcctcttctaaagtaatcggcatgaattccggaagacttttagaagtcaagttgctttcactgcgcaattttaagtggtgaaaaaacaacagtgaaggtgcagctgccacatccagatgattttgaacagatttacttcgctcatcaagacaaaaaatgatagggtcgacatttgaatattttgattctgtgaaaaacagagagtcctgagcatcgagtgatagaccctagttaacagaagagtaattatcagtaataagaagattttctataaacctgtatttcagcacaatatgttttgcaccagcgcattcaacatgtaaaatacataagaaagcagatatttaaagggaaaaggctaaataatggattgatcgagacggaagagatgaacaagaaaaacaacagttcagatagtctgtttatttcaaaagttcaaatttatgattcccaatgcagataaacataacagaaatcaagtgaggcatctgcagaaaattataactgcatataaagtttctgggaaaaaaaatgtgtgtccagaatatctcacaggagaaaccacagatcaagaaatggtatagatcaagagaagccttttcattataaaggatagctaacaaagagcactaaagtcatacaccagcagtccagcacatgaaatatctgacaacattcggcactaagtttactgtaggaagccacgtcccacgtgagacaaataaaagaagtattcagtcagatgtctgtattttaggatactgtttcaacagtactgatgcaacaaaaagtgcatcagaaggtttagtgttaaatgcatcagaaggtttactctcaagttattggttgacaattgacaaggtcgtataaatgaaccgagcacataaaaaactgcaagactagtaaggaatagtcgttttccaaaaattcaactaaaattagcatttacatatccttggatcaagagtaaagcaaacatataggttccagtagcactaccaagaaggaatcggttcattttgttgctagttagaaaacaaaagagcaaattcagtatggtggtttcatccaatttatctaaacacatgaccacattgagcctctcgtaatgcaaagaactattcagtaaaccagcctgagcgtccagtatagtgccaagcactgaatgaaatataattagccggtatatggtttactcacaatctggaggaaaagcattaacaataggaattttctcaacacaaaaaagaccctagagttctagctctatatggctcaatgataataaaaatgatttgatctgcataagtaaggtgggtctggtaccttagagaagtgttctgttgaagtacagactctttgatcagttccatttgtaagttgctttatgtcagcacatgcgcaattaactttagatagccccctttttatatggtgatgctgcagctgtccttgcaggtgcttccatttggggtactttacccccacgaagctgaacatcaaaaacacaacttggcttctaccgtgcaaaccagatatccgaactctgactgaggtgcatagcatttttgactcattgcgtgtactcgccttggaatacgaattgaaacatccaacaagtaaacagaataaggatacagctgatcttaaggaagtctcaagaagcaagtgtttcaatcctaaagtatcatcaacaagaagtatctccagatgtacggcaggccacaaggaaaccattgcaccacggtgaaggagaacaagagcattgagaagccagacatggcatgcttcagacatgatcttataaatagattttaatggctggctcagtactaatatgccatgtcttctcgaagtaacattttcagtaacagacccccagccagcaactgaagcaaacaacgcacctgtaacttttctgtatttaagatcagaatcttgttctgaagtgttgagaaatccattctttctcctgcaagatcgcttccttgagtaaacaaagcgaaacctgctatctttaagcgtagtcctgtcttcagggatctcctcacccgcatttgcaggtgaaccaccaggtctatcatcagagcacagcatagactgcttttgatcaaacataacaggagaaatatctgaatgagtgtgattctgcttattcgtattactggatgtagcagaccttgcatggtttgatctagacagcaatgagatgatggggcctgactcagaacttcctgtgctgtttctatcaatgtcttccctctcatccacttcatattttggtttgaatatcgaccttggattacgacgattagatttatgccgagcttcgctgggcaaaaggagaagcttaatcctctcattttgaagattgatccattcctcatctttatcgtcgtatctgacatgatgcaaccttgtcatgggatcatattcctttaccaggccaaagtaccagatctcatccagaggccaaaacacccggattctctcttttacaatgcaaaacggatccacatcatgagggctgacttcataaaaatgccgacgtgggcgacgcttcttggatgaagctttgccatcacgattccgtagcaacctagcaggacccgccatgcccttgtctttgttacatgaatccttgaaatgttctgaatgctggacaaagtatgcttttgatgatctattcagtgattttgcactcttcctcagtgagctagcacacatattatctgatagagaacagagcatcctagcagcattttcttccaaattaacattatcctcctcttgaacatgcacggagctttccttggtaggatggacatgttttgatggttcacctgaaagatttggctgcttttcgactgagacatcattttcagaacagaagtttgtactgttgtcctggtcacaagtgccattctcaactttcaagcaattgatagggtcattactaccaactctgttctccttaagagtctgtgatttcctccgcttcctcctctggacctgagtagctttcgtaatgccattggatcgcagaaccttgcgacctccggtaccactcttgatactaacattctgagccagcttccttaacctcaatacaccacgaggctgcctgatcactgcaacttcacctgaattaactgaatgctctaagtggccatccttatttcttggcaatgaacgtccgtgacggccattgaaactatcttcgctccatgtggaatcgcctgagctggttcctgccgcatctagcccattaagttccactctatcagaactcaagctagtacgcttcctcttactccctgcagatgaactgctcgaaggctcctccttcccacccccattctgtgaacttggtccttgccccgctccaaccgatgccctctcggacaaagtctcctctccatctaagccttgtactgattcagttgcatccgttgcactaggcctgtcactaccactggattccattcacaagcccagaaatcacaagggggccagactcccaaaattccaccttccatcatacgcgaagtcccacacacagatcttggtgcctcatcccgaccacataatccacagattagagcaaatgcagaatagaagcctaaacaaaccaaggaaaaacactacggtcgcatcaaaaacggaacatttcaaaacagtagagcaccaatctagatcggagaaataaaaaaagaacaaaaaaaatacggggggaaagaccacgcacctgagcaggagcgttgatccgaccaccgaatcgagcccagaaccaccgccggctgcagagaaaatccggatcacacaaaccacctcagacctccaatctctaacaactccacagatttcacacgaaaacacacagctttaggggaagataaaaaaaattaaaaacagctcacctcgattgtatcgtgcggcggatgcgacccacccgcggatcagcgccaaattgggcggcggaatcgatccggcgccgagggtagaaccgatctgcgtcaaaagccccttcccagggccgatctagcgggggtaatcaagcgcctcccctgccgccacgggaagctagggtttcctcttttcgttgtgtttttttcccctttctttttttttggggggcgttttgattttttctttttgcgaattgggggaaggggaggagtggtggggcacagctaagtggcggtggatggcggtgaaggggggtgcgggattgggggccgtacgatctggatcggacggccaggatgagcggtggctgcttccgaggtttgggcggggcttcgaggcacatcagtgagcgaagcaaaagcttattggctctctttttttttgttgaagatttggaaaagtgaaaaacaaaactgatgtgacttttcttttcttttcttttcttttttgcatttttgcttgttcttcctgctttgaggttggtaagaagcttccagtacgttgttgggctgcatttttttaggcttttagtggcaaaagcatactaagctaaaacaatgtggagttaactcctccaatttgttgaattggaggtcatatattatactctctctcactcttcagttataaatatttgatgttttggacaaagattttattaaagttttagaactttgacaatcggtagttcccagctgctagtttaaaaagaagaaagagtggtatgcgtatatttatcttgaatataattactataatatcataaatgtattctaatacaaaaccaatgatacaatttttaaattttttaaccgaatcttatcctaaatataaatatttatgaccaaagggaatagcaaaaatatcaacactatattacaaaagaatatgaggccatacatgttacatgaacaatggtgtggctgtatcactgtttcctaaagtttcaagaaaattatttttttaaatgaacatgtcctataaaaaaccataatcgggaatgcatacatctcacatataagtgcaatcaaagaaaaactgagcaaataaataacatgatcatatcaataaaacacagcgtattcatggagaaatatggaaggaaagagaagtgcatatcaaagaagagagacaaagaaggaaagttgcacctgtagatctggatgtatggagatcagtggagaagacaccatacaagcggagagggctcaatccatacccgagcgatgggatctcgggaaatggaaagaacctagattggttggagaagggatctcgatagccagtggacaagatctcaaccgaagagtgcctaggttggttggcaaacctccgcatcgtctactcttacctccacgatccggagagcaaagggagcgcaatgaaagagaaatctcagcaagaaaacacaaacctctgtaccgtctgtccttgaacctccgtgattcaagaagcaaggggagcgcatggaagcaaagaacgaactaggggatctacatgtgccaatggtgcttggtggcggcgctgtttaggagaaaaggggataaattgaggaggagaggaaagcgtctatcagaaaaaggcgaaccattcgggttccttatatttcctattttactataacaaattgggccttgtagcccaacctcttgggccttataacccaatctctctctctcgcacacatttagagagagaagaggagaggtgaggaagatgatcgaggaagtggttgacatgtgagtctcaccccttgacttagcaagccaatcatgatcggcctgccattccagcagaaatcactccctaaaccactgaaggagttgatttgcaccggttttcgaggatggagagatgttatacctagttttacaatgaggaggcgattcaatcagaagcaagagagtgaggcaaatacacttactcctttagtttgcaatcatgcataatgactcaggagtgagccgaacgcacccaaaatgctagaatctgatggcgtagttcagcccaatatctaggatacaaacgggatctaacatgaaacaaccaatttttggtacaacgattaaacatagcgatacttacatttatgggaaacagattagaagagaaatagtttgtgaaatgctgaaatatcaaaaaacagtcgcaccaagattatcataatttactacaataccaaatgaagccatgctatacctaccatttgagaatgctctcaccacacatccatcgactccacgagattggaaattttcatataatttatgcaggtagttctttacatcttacgttaactagctaaaggagctaaaatttgctacctatgtacaaacccagaaactttgtttccgagaaaaagaatgtagatacaacaaagagcaaaaacatcagcaagtctacatgtacaactgcctgcctatcaaaacttccattatctacaagaacaattgatcggtgtcggtgcgccacatctttgtacagaccagctgccattccacagctcctgctctgtgtagtgggcaaaaatgaatcaaccctgggatgttgcagagtactcgaagagaagtcgattggacggcgtagattggaagagaacacggagcctgctggttagctgatatatgagtgaccactgcattgccatttctgaatctttcatctgcctgacaacagaggcctgcagaacgatgtgagcgattcaggtcggatgatattcatacagaacattatgccagtaagcttaaaatgcttcggttttcaaaaatgtaaaaaggctaaatacctgaaggcgttttccaagttgcacttcgacctcagtagcaaaagatatattgtttgccagcgatttaagtgggtcaaccgttggatctacagatagtaaactcggaatctgcggtgcataaaccagtcgccaccgtgcttgaccaaattcacccttgccttcaatccttggcatcaaagtttcgagtgttgcagttgcgagtttcttgaacgcgagctgtccatcaccttccaatagtgactccgcaagctgtgactcaaaaacctttgcagcctagaaacagcaatgaacaaaagaatatcaaagagttaggcatgataggagaagcacacatattaaccaattgtctaatatctttatgtcagtcttggatagagtgctggcaatcaaccagtaaacggttcaccaggcagtcaccttattatacagtaataaaattctgaaaactagatgaaaataaaccaagaaactatcagacctaaagtaaagcttagctacaattcattgaagaaagtgccttacctcactaggtgaaagaacatcctggtccacagagcgtgtggaggttacaacaagattgtcttgccacatgcttgctcgactttggatcttaaattgccactcagatccaacaagaacaagatccagaataggatccaaaccaagatctggctcaaactttgctacattcaaatgatcatttttaagtcttacctgcataagaataaaaatataaaaccacagtaaccatgagaatgtatatttaatataaaatgacaaagaaggtatgccacaagggcttaagaattctcatgcttacctgagtagcaaccaaattgacctcaccattttcaaaagttaagacacccttaggtcttatgtacttcggatgaaccatgccattaagctcaaggtcgccactcacagcaaaattcaaaattaaaggataaacaatccttaattcaggtccaaatgtgagcttcagatcattgagtcgggcatcaatgtttggcttaaaacttccatgttcaggagtcctttcagtttctgattgttggcctaacacattaaattgaataatccagttgacttgttgagtaaatagacaaaataatagaaagagacaagtaaaggaaaaaaataaatgctgctttccaatattttgtgtaatagcaagagttaggaactaactgtgaaatgaaactactaataagctaagcaaaatgtattggtaaaagggacttgctaaaatactaatgaagatcgaaacaaatgactacttaccgtctggactagttgatagtgatcctagaaagtgggagacatctcgtgagactgttctttggtcaaaaccagcaggaacagagatggatttatttgaagacagcctggtggcaacagcaccattgcctttatcatgaggcaaatacgcttcaccatggcttagccgaatcattccagagacatctggccgcaatattgagcctgtaacctgcagctggctgtctacttggccactgcacaagttaagacgaaagcatattagacaataagaagttatataatacggggtcctacacattgcacagtcaaatttaatttatgacatgtcagatcagcaacatttctgctaaggaatatgacttttttttaatcaaaggaacaattttagaagacaatcaaccagatcacaccaacacccacaagccacaggttagcaaatctgcagcataagaactttcaacatataaaaggataaagtaatggtaatgacctcaaaatattttttgctcgtatgtccagaacttcgcatttcagttcaatcttgtcattggctgatggctcaatattgtggagaggtagagtccctttcattgacaatctccctttcctcccaactctgctttccatggaactgatacatagtctgttagatataacatgaacattgccagcgaaatttgtcagtggtgtccgaaggaaaggagaagccacggttgcacggtgaaatgaggcagacccatcaacaacagggtgatcaacagtgcctttaacctttcatccaaatgacaaacaaggggggaaaggtcatcttggagtgcacaggcataacaaaagaactagctatttaaactgaacttgatgcttaataattcagtttcatcttacattttcatcaatttgaattaatgctatgaaaaaaaggtgaaaatgagtaagcctatgttatttagtcatatatctccttaatggaattatggggattaaataggaatgggcacctggagaagaacttcagcatagccttgaagccagtttgagtaaggactcagtgcagttatcagtgtcatacccccatcctttatatctgcatttattctcacttcgcctggttctagcatattccagcttaaaccctttaggctttcagctaattgaaactcccaaccctcatcaggcttgtctctcatgattcttgtttcgctgatgtcatttgtcaagcctctgtctttcgcccaaacagggattcttattataccttgtttaccatctcccccttccaggtcttcctcaatggagttgctgtctacataagtaacaggaacactaccttgaatgttaacgtgcccactttgtatggtcggttcgaagtttgcatcaaaaacaaaacggcttgttggggttacagaagctaatacttcagctcttccgagatcaatgcctccaatggtgccatcaagaagtcttatttgaacatcacattcaggctttgctagagtacctctcaaatctccctccatatgtagaatgcctttgattggtgtcaaccattgcctcagaaaatgaatcgagtctgtggttgatgattctatagcctgaactaatgcgggtataagaccaactgggaaattaagcacagcaaagtgaagatttgttaatgggccaagaattgatccatcagcatgaagagtggcattatccttctgaataaataacttatcaagacgcaggccatcattattgctgaatgaaccagatgccagaacacgctgtgtcttgtaagtgccccactcccaatcttcaccattgaaatcaaaatcagcctgtagtacataagagtattacaatcaagttcaaatatatggggcatatatttggctcttgtataggaagattatcctgatgatagtttgattgtaatttcaagcttctgtagagttgttcttcaagagacataaaaaagaatgcaaaggaattggaaactaaccgctaactttaacactgcacaatgtcagggacaaagtgaataaagttgaacaatacaagcagggaggtccatatagctaaaagatacttgtatgctcaatccactgtgcaactgtttgcaaagtctaaagagaaagaccactgtaagggagttatcaatagttactgcctgaaatgcttaccatagtatcgccgttccctccaccactggcatcaagagaaccacgccaataacctctcagttcagctaagccaggaagagttatatcctcaattgtatcatcatccaaccaatcaggatacatttctaatgcctggtgcaagcaatgggataggtttaatacaaaagtagcaacctatggtaatggtaacaacagcaatgataaaggcaaccatataacattatatatgatgccaattctatgcatctgtttccattttcataagattgtttactttagtgtacctttagctggtcacgaagactttcagcattgaatccaacagaatgcaaagtttgcataaaaagttcctgaaaagaaaaggaggataaaaatggctctgtcatccaagtctccaacagaccacaaataaacagaatattttgtccctccaaagggaatggcatgcacctttgatctggaacgaatagctgggtctgtacttcgtgatagaagtcttgccaacggaagcatttcagctacttcagcaccaggtacttctaatctcatcctccacctgcccatcgaagacatcatgctaccaagatgccctcccatcgctttctctatgaaaccattactctgactttccatagggaatctatcacgtgttccaggaaaaacatactccccttgaagttcatacttgctattagcttgctctaggactgatttttccatagtaatctgggtgttgaaaagaaaatacaaaagaatagctcaagtgagcacaaaggtggtttatgtctgatgagtaaaagaagataagaatctcactcagaaatcagaatatataaataatgtcaggaaaaacaacatatggacatgcagacgcattgttattttctattttctactgggaaacacaaacgatggagatacatctgttttctcaaaaataaaggagaacaatggagatactagagaggataaatttgctctgtgccaccaaaattgccgccgaagtagcaaaataccatcacaaaggtaaataggaaaacgtcatagcaaagaacaaaaatggaaaacaaaccatcaccatcacctttttttgtccaaagtgttcaacatgaccattctaaccgtaacctttatttcccttgccttcattaatttttttgttagcatcaggtccacctgtcatttgccctatcctctcccctccctattctccagtccacacatgcacatagtgccacagactagccatggggtgaattagaaatctagaaattttctttctaatgaatgggcattaactgcacagaccaactggcatcttaacagtgacggtatttactggagttctttcttgcccattttgtgtttgccaaggtgttttaaagcccagcatcttcatcacagcacttcccaacaccagggcagtttggatggcacggagacggagcaaagttagtctgctagaagccataaataacttataaattgtgacagtgagtaccatacccttgcaactacactcttacggtatattctactaagtgccagacatggggcatgactgtaaagcaaacacgaaaagaatatatgaaaagaagaactcacaacatcaccactccatcgagcagctatatcaagtgattccccaagcatgccactaaattttgggcggataactgacagcaaaccatgacctcttcttttctggaaattaagctggagttctgcctgtaacaacaaaagacccatgtgtaactgttttacataagcatcacaactaactacaacttacaaatacatgggatatagtagaatcaacaaaacagagctagatacagatatgtaaaaaaagactgattcaaatgtgccaatgggctagctaagagaaatttaaaatcataataaaccctgttcttatatagcagtgttaccttctgaacaaacccacgtaatgaagcaaactccagctcatcaagtggcaaatttcgaacctttacaacaagaaaacaaggatagagaaaattagacattcatgccagcagagtacctccaagcaagatcacaatgctctagaaagatctgttggataacatgcaagcatgccagtagagtacctccaaactagtcaaattttcagggtgatagcagatattagatctcagctgccccttttggaggaatattgacaacagccttccgtcttgaatggcctcgtgtgtgccaaaaaataatggcacattcacttctatggaaaaattttcatcgggtctgcctgtagcatttaactgcttggacatggagtagaagacaaaatgaaaagagagcataaattggagcccacacaagtacactgaaatgcaactttaataataaatgcatatgtgctctcaattttgctataatctgttgagagtatgttctcattgaaatgaagtctgtgaagcagtataaactggaaacaaaagtgaatcaaattgataagaaaaatataccttttgtgcatgcatgatcctcaaaccttagttaaaaggcgaatggttgatatagattatgtaaaatttctattttttactattatattcattacttggttttgactttgttttgaggtaatggagaaatacctttagtgtttaaaaatgttaaatgtaggagatgttttaatttataaaatcctctatatagactgaggtctgcctgcagaaacaatcattgttgccagttgtgctaagtgcattgcaacaaagaaatttacaaacaaagggaacataatatggtaccaaatcactttaagtaaagaaatttaaatataaaagcgtgggaacaagaaaaagagcatgtaataacaaattaccattatagaatctggtgatatggaaagaaaaccagtagattgtggtgccagcataagttggttaagtttaattcctgacagagaaatctcgccaacaagccttgatacatcgttctcaagcttactttggtcaatggtaccttgtatagcaccatggttcttctcatcaactaactggctatatttcaccacttttccttgaaatttaaaccttccagatgctttcaaatgtagaggccgtggtgaatcaaaaggtatcgaagaagctatatgagcaaactcaaagcccctcatgcgtaaatccaaatccacaccctccacaatcagtggcataatttttttcctttgatacatctccttatgcagcaaataatcatcaatatatgatgtttgaatatgagtattcaaatcaaaagaaactgatgatgagttgaccataatatagtcatgtgcaataacaatattgccacgcgcatcagaaaaagaatcttctgcatttggtgcagcccatttgatatcaaatttcctgtcagatattatccacagttagatcaggagtaagaaaaagagtcagcccaataggatatttggactgcagatggcacatctaaggtactcacggcctaataagggaaccagaaagtctagtctctccattgagctctccaattttgagtggaatcaactggatgcctccaggaatgtagcgatgcaaaactttgtcaagtaaaatgctcccagacaaattaatatccatagcagaatcatcaccttccccctgcagagatctaaatatatattacacttgcataaggtggtaattaattaagtgcagtgctagtagtagatacttaagcagagactttcttgtaggcccaatttgtatgtatgcatattctttcaatggaatagaacttgcaggttgagaatgcaaattatctagtgggttggtactgaatgtatacaaaattacacatatgtacttgggtgcattattgcacttattaggaactttaatggcacagaagaataggagtagttggctatttgcaggaccctcaacccatttagcggtaaacattgctgtaagcccagagaaatgaacaatgcaatacctccactaggcttcagccatatttatggcataacagaacactgttaacaatgaaataatatggaagaaatgatttgcaatgtttaattcttatactaattttcattttgaaaggatactgatgtcattatatatccatctactctttacacatcacaacccaaaatcctccacttaactctctaaatagattgagaaatcaacaaacatgggctattcaaaacaaaatgaatacactatggcagaagtagaaagaagttagcgaatgcttaaatttaatacagatgtgaaagcattagtgaccaggggtgcaatcaataactacagtacctctgggcaaatccaaacattaccagctcctcgaatttctccaccatccaaaaggcatgctctaatgccatataaatcagcaacctgtagccagtgaaaatacaaaatagtaaagggaaaatcactgccaaacatccataaacttcatactggaaataatggtggctatatttgtactcacgcagttatcaaggttgaaagtgaaatttgctgaaacatgagtgaagggaatatgatcaaaagcggccactgcaccagactctttgttttgcatcacagcttcagaggctgccgatggaagcataccagatactgaaagagacttccttgagacaatcccacttccaacaaaaacaggagcatcaagaggcccttgacagttaaatacggcagtaacagcaccagccaactgaacgaattaagatattgtattaaaaccaaatcttaaaggatgaacattaagggtctgagccataacccataaaggtgttttggcaaacatttacaccatcattagaccattgtaaaatattaaaaattgagtttgacacacatagcctatccaaaagctatttgcacaattgcatgtactaacaaagaaggtaattttgagataaaccaccgcccattgccatgcaatgcagacaagagataatgggtatcaaatgatgcacctagataggttagccagttaactaggtgtttccataaagacactagccatataaaaacacttcctatacaagaagtcacaatttttcattgtactagatatatggactcaatgtagctgtaccaagttacaacttcagaacttcagatggaaaacacatttttctttatcactaaacagcatctcttcatcttttttatcagaatggattcgagtttatttctaatgaagtatagttaaatcatctgtgatgtgtccacatatagtccagcctttatgcaattatgtggaaacaaaccaactcaaaatgataaaggaatccagtatctccagaggagttcagcaactaaatatgagaggaacagtattttgtaccggaaacattaagggtcgcattttcattgttttcataagtgcattaacttcaactgatggaacctggaaagaagatcaaaattatcaagtttatcactgttatgtaaaggaatatttgaatgataaatcaaatatgcacttcgaaagtttaaagatacctggcacattagatgaaactctccatcctcaggatttagaccaaaatcaccagaagcttctaccggagcatcaccaaaccaaccacttgcattatgtagaaatactctttgaccacgaaaagatagagttgccactatatcctgaatgagttcaggctttagttaaaataataataatcatttcgaaagctaccacatgctaacacttcaaaaaagtaccatggatggcaacctagctataatccacagcaagatgttagtgtccaaaaaaaaaaatatatgatacttggaaacattaatggacaatccagttcttgggacataactgttccccacaccccattcttaagtctactgattccatagttattgtttccttgaaatgctaatgaccaattcatttctggcgtcactgcagatcggcagctctcaccctgatgacactaataaccaatatgcacatcatattccttatctccctctttaaacccattttggttgcgtgcaagaaatttatcacatccaacatcggtgaaagttaaggcactgtaaacctataattgcaatatgttgcttacaatcaagtatgcccaattgtttctcagatcttgaaattcaaattccaggttagcctttatgtatacaaatcaataagccctagatgctctggaaatgtaatcacattgcttacacaagtatcaatgtttattggaaatgtaaaaggcatcaatgacaaaaaaaaatatattggtggtcaagttacagcaaattaataagaaagcatcagaccatgctaatgtgtctcataacttgagggaaataaggaaaatatgattctctagaaatatatgcagagtacgagaaaacatattattgggttaagcacggacatactgaaaacgatgatggagcatctaaaatctgaaaagctaggcccttcacatcaagctggccatgaatgctcgggaaactatcacccttcgacatacagagatgcacctgaaggaataacaaggtgaaacgttgctgtaagaaattcatatgttcaaggctgagacaaaaaaaaaagggtttcctcgagacatggatgattttataaagtttgcaataaagccccggataagtccactaattaagtgaatatggaagtcacatctcaaaatttgtcttcagaaacatgcatgtgtgaccatacaaatagtgggaaaataacatgtaagagatcaagtttagaagatcacctcgccagtagctctccctttattccaaacaactggtatttcgaggatccgctcaaacagctgcacatgaaaactacctttgaacacaaagatcaagaataccaacatcctatatttgcatcaaagagaagtctagtaaaaaacacagtagcagaaaaatagatgcattaccggagcaaaagcattgactacattcaaattagcatgccatgtttgctcagctatatcaacaaaaacatcagtagaaagataaccccctccttgagaagtccggtcttgcctccactccatgcagttcccagtgacatgcacatgtacacgattataactgtttttgaacttgatgtgtccattagcatgtttcatttccctacagttggatggcaataagtctacggaagtagtggaatcatttaaatgttatagatggccaatactattaaattgtggcaactgtaagctgagaaaataagatcaaataacatgaatcagaaaccaattatgagaatattctatattttgtaacactgaagggtgattgctattcaatgcagtacattcataggctgctgtaaatggtcaaaagaaaataacatggtttttgtggctgatacaatggacatataaaagcatgagaaagaacagggatttcagtatttgtaatggaaatggagaattacaaggtcaaaccttggttcttggtcaccatatcctagaagcatcagattccctccattgaaatatacagaatccagggtgatgggaagagtttgttgaacagcaccaggatggatctggccaacaccttgtgaaagttcggcagaattgtctcctggaccaatagcaaacaatgacctcaacttctggatctgaacattcagagaagctgatggtgcattgaacccgacaggaaaccccttcaattggaagggccaaaatgatagccagttgtgagcatatgtgcatgaaccaaaagccccaaaatcgaattcttgccggtaatcatcttcggatatatttttacgtttcttcaaaacaggggcttcagatacttgctcattattttcccaagagtgtgaactaatctgactaggttgttgattatgagaacttccattcaagacatccgtattgccaatcagcattgtactagcgaaattgcttttctctggcggtaattcaccataatccatagatgttgtctcagagtattcagttggtccatcatttggactaccttcctcaccaccaccatttgtatgacctccatcagatgagctttcaccaggaccaggcaaagagtcatcaggattaccactacactcgttttgaaaatatgcaacagcagcatatgcgctacgcctaaggatcctttgctgagaagaattgtcagtgtccgatatcaacttgctatgagccttcctcctgtacctgcgcctgctagggtttggaatcatcctagaccagaagctgatccctggaatacgagctttcacgccgaacgatttctccaaatcggcatgtttcgagctggagtcaatgcccgcatcaatgtgatggtccttcctgtgcatttcatcaggacataggtgtgggctggatttcccagtatcaacaggtccatcgtcttccatcatctcatcgatcgaaggcgaaatcgattgggcactaggaacaatgtatcccatttcggcggcttcccttgcagccttatccctctcctcattccactgctcggcggccttctccctcgcgagccgcctcgttttggtgcggtaatcgatcccctcctcccccgaatgcctcttgggtgagccctcggatggcgcggggagccccagccatgagaaatccttcctctgggccacgagcgccgagggctcggacagcacggcgtcgacgacgaccctcccccgcctgaggctggcgaatggcctgaccctgatcttcatgacgggcacctcggcgcaggagaactcctccgcgtgcgggccgatggagcaggtgtggagggtgatcccgagcggggagacgctgcgcaccctgccgaggtggacctcccgctggaggaattcccccagggcggcgcacgcggcggggaggaggcgagactcgacgaaggagcgggcgcggagctgcgcgtaccaggagagcgcggcggcaacggagagcgccgccgcgaagacggagcagcgcacgaggaagagcccctcccgccatagcggcgcgagggaggcgacgagggcctggtacggcggcggcggctgctgctgctgccgccgcgtcgggagcagcggctggtgctgcgagtgcgggtggtgcggcgcggggcagtcgctggagtcggagaccttgaggcggagcagcggcggcgggtcgaagcgggcgcgcgcgacgaggggcctcgtccccggggaggtgtggatgcagcctccctggcggtggcggcggcggcgggacgggtggaggaggggaggcggcggggagaggaagggcgacgcccggaggcagtgggacattgcggccggcggcgagcggcggcggcggcggcggcggcggcgagcctaggtgaccatttgattttggcgttgcgtgcggcgaggggagagatgcttggcttggctttcgccggggggatcgttttgcgtattctcctcgaggtttttttctctttttcttctatctttgtctttactttgctttattttgtctctttgaggatggcttttcagtcttgatttttaagtggaaatctgaataaatgtttataagtacttgttgttgaattatgatattcatcttctgtacattttgatcacttcttttatgaatgttttatatacttatctaaagattatcaaagtacttcctccgtttcacaatgtatgtcattgtagcatttctcatattcatattgatgctaatgaatctagacatatagcattaatatgaatgtggaaaatgctagaatgatttacattgtgaaacggagagagtatgtaaaagtaaagtaaaagtctattgcattcatgctgcttgcacatacgacttcaccatcacatttgcttgcacctaggacttcttcaccatcacaacactgatgcttctcagttccaaaatattttttcaaacttccaacttttccatcacatcaaaactttcctacacacataaaccttcaacttttccatcatattgtttcaatttcaaccaaacttcacacttccaattttgacgtgaactaaacacagcctgtatgaacttgcaagaacatgcagctttgtccattgtggctagactgtttctatcacaaccagggcagcttccattcatcagaatagccaaacaaatcaccagacgccagccacaagaacgccagacactcagtaaaaaatgtccacaggttacattaacacactgagctagcaccacaagcagctagatgatcagctattctactccagaaacacgaacaccgccataaagaacactggagaaatttaaattcgacaccaacaagatccttgctacttctggctcacaacgccaattccagcaacatccccattaaacagcttctaaagtaaggaacaaaagatatgacaacgtaagaacaataactgtcgaccaatttcgacacagcaagccacagcacaaaagagaacgagagtacccaattagcccccactggccatgccgtccattaagttccaccgggtcaacaattcaaaacacaattacatgaccgttttgagaccagaaaggccttcaagaattcgaaatgaatctcagaaaggcgctcaaaggtcataaatacaactcaaaaaagtttattgtgagtccaaaaacgaacaaggggatttttcaaactcagaacatttttcaaaactttggcggccatttaccgcacaggttgctggttgtaatggttcttctctttcttcttggctgccgcgagcctagcgctccttgctgcagcctcagcagctgcaatttttgcagctgtgtctgactctttgcctgatttctttttcttcattgaagccatcttctttaagcgctccttcacatcaacagaggttgtgtcttcatcaggttctgcactggcagtctcctctgtcccatcagctggttcttgtgattctttagcctcctttgctttcttgtttttcttcttcttggaactcttgctctctgaaggtgctggtgcatctccatcaccagtttggtttgaacctttcttctcagctgcaagaaaacaaagcacatgaacaaataaattccataaagacaaccaaccatagagagacacatgctgaggaacacacaaaaaaccatcaagtacaatttcagcatcataaagaaagcaaactaaacaaacagggtatacagtagcacttaccattgttttcatcctgtgcagcattgcttgaaccaccagaaattcccaactcagccagaacagcatcaagttcggctagctccttctttttcaactcctttttggacagctgcctctccgtatctttaggcggtgcaacaggaactgcagctttcttaccagcaggttcagcagaggtatcatccacttcatgctcaggttcatccacagcaccatcatcaacctcatcatcgaggtcctcatcttcactctctacttcctgcagtgcatagaggcaaacacaaataagaattccaccaatcaagcataaagaggcaacagtgaaaatgcagcacccacagtttctgttgagctttatattgtattcaacatcagtcaattatttgttcacatgttttttttggcaccaattatgtgcccctaaaatctaatcataaagaattacatacttatgggaggaaaagaaatttaaaaacatactgttttttataattattcatgaaaaattatacatcgtattcttgttcgataggtaaccagtatattagcagccaaaatagtgtgttcttatttgctgtgtcaattcagtgatatagtgcaaaaagtaactccttgtcaatttatcagctcagcatatgctgtcagacaaacaaaatcacgtcgttggacaaaacaatccacagtataaataaaataaaatcacatcattgaaagaaacagtcctaataaatataaataagcatagcagacatgatatcatatcaagtaatcaataatgactccacctgtgatgttaggttattcatcaaatattgcactgtgtgacaaaaggaaattgttttgccaacggacaaaattaataacgtagtaacaaatacgatacaaacattccaatttaccagttcggtatctaaagcctgttttgaaaactaaccatgcagaaataaatacacctgagatattcccttgtctcctcttaccgtttcatacggatgcattcgtagtttgtaaaaactaataatgcatgcacaagtataactaacgcattctaacctcatgctacggtttcaatatacctacatataaatccaaattatcaccgagcatgtgtttcgcaattccaaaaactaatcttgcagacatcaccactaccattacagcctacataatatcctcctacctcaatccagcaattcctcgcgctacacgagtgcgaaatctattattccaactataatcaaaacgttgcgcagcagaacagcacatgtaatcaagcgaaacaaaaaaaaatccatgcacatcacagacaaataggcatggtacatggaggagagataaataaacctcctgaagggcggcgtggacggcatcgtcgtcgtcctcctcatcctcctccttggccccatcgtcgccatggccggtgccccagacggggcgagggggagcggtggtggcgaagtagtcgtcgtcgtcgtcgtcctcgacgtcggcccaggacttggtggtgaggggcgcgggcgcccagaagacctccttctgctgctgctgctgctgctgagacgacggctgcgccccctgctgctccctcttcctccccgacgacgacgacgagccgcccttggccttgtccccgcccttcttcttcttcttgagcgtctcgagcgcggcgaacacgttgccggtgctgagcttcacctcctccgccgcggcgcccctcctccctcctcccaccataatcaacccccctaaaaaacctcccgaatccgctcaccgccggggaaatctgaatctgggaaacacgcgggccccgcgcgacccccgcgggcacaggccgccgccgatctgcgggggagggtgcggagcggaggacgcggcgatcgggcggcggcggcggggaggaggaggaggaggttggggatgcggcgcgggctagggttttcgtggagaggagacgccgccgccgcgtgcttgcgttgcgtgtggtttgtttagtgagagagagaagaggaggagagggaggggagagctctcccgggttgggcgagttgggttatctgcacacacagaaaagaaaacctatccgcgtcaggtcagggcgcgaggtggagccgtgtgcggcgtactggtgtcacgcacgcgacggacgcgccacctcccggcgtgccgcgtcgcgcacccgcgcgtgcctgggctggggggcctcttgcgttgcgtggctaatctgttggctgttgctagctcagcctaacacgaaaaaaggctggtatattttatatgatggccaaacaccagttcctccgtcccaaaaatataaaagattttaaaagaatgtggtacattttagtactacaaatataaatgtgtacatacatatctaagggtcttttggacatgacacggtttataaatgtttcatcacactatggcagtgtttagcaaatgggtaatggaaataatttcccacccatctttaaatcctaaccattcattctccctctttcatttaatcctagccattcatttatttcccaatcccaatctcacctcccatttctcattatctaaacacaccctataaatatgtcgttaaattatgtttattatagtgataatatgaaggagaatagttctggtagcgagcaatatagaaagtagtatggggtagcttattttggatatgacaccattactgttacattacgctataaatatatcgttaaattatgcttatcttattatagagataataaggagaaagagaatagatatgctagcgagcaatatagaaagtagtacggggtagctcatcatgaagtatggtctataaattctggacttaactacccacaggtgccatatcatctccgaaagttccagttaatctggaattctggatactacaattccttgaacacgacaatataattgcttcaatatattgttgatgtaggagaggatatactcctgttaatctaaagaaacacgcaaataaaagccaagcaaaagaaagcacgcacaaatgaaattgctttaagccatactagtgaagttcagaaacagcgggtcgtctgctatggagcaataggctgtcacatgttcagatatcacaacaccatcaccacctgaccaccccctcctaggggttcacccgttggcagtgacagttttcttccacattgctaccaacgtgtgtcatcaaatggtacatcgaacaagtagtgaaaactttaacataccagttctggagcttctcccaatttacatgaccacaaaaggctagacggctgcttatcatcccgggtgaaaattgtgtacatgttgtagtttggtaaaaatcaaaagaatatactacgcatagcagacaaactatgcagaacattcatggtgacattgcaagtggaaatcatgcaacgaagaatataaagatcatgaggaaaaccatcagcacaaagaatatcttcatcatcagccaccggttcgatgaaatgctgttgagatacttcagtagctggccctgagctccctcaacattggctagtgtgtcatccatgttctcatcaattctgttacggattgtgcgaattttaaacacaacataatctcaggaaaatagaaaagctagtatgtgaggagataaacaatttgacatgaaacagctactccttcctcagccctatgcatgaatcctaaatgtagtgcactgagagaacaagacatcaacatggactagaaaaattctaagagtgaagaactggccaatggccataataattgataaatatatggaaacctattcttactctaaatcattgctgacatacaaaatctagttggaatttaggtcctcaaaggtttttcaactattctcaagttacgccattagtggaaattttgagaccaggagcaaaacagtctattcactgaatttcaggaaaatgttcatctctttatcgcacaatgggaatctccccacaatgagatcacagcatatcttgaagcttataacaattattcaaaataatgatatgaacttgaccataggcataagacagccaactcatgaattaaatggaacagacttttgtaaaagagtgttaacctgattgctagctctccctgctgagaaaccatagttgccagttgtgtaaaaatgttgcttagctcatggatggttgattcaacattttggagagcctccgctctactctgcatgtaactgtcctgctgtactaactgctgctgcatgaatggctgagaagatgatgatgatgctccatgatctccattagtcttcttcctggtgaacagaaccacaaaaaacatttaaaaaaaaaaactaaaaccacactaccaactgaactcggcaaagtatcattgagttgttcttagtggatagcattgagactgtacaatgagttgtttaaggaaaataactggagtaacaagcagtttattgcacatttgcatgcaagtgctaactgcagttactagcctagataggttaaccaaaatctagcaagcaagatggtaggctaggctagtgtgtttttctattggatatgagcacattccccaaaggaactttaacaattgcactttgcataaatatgagcaaattttatacctctgaaacaatggagtagtggcagaatcactggcccatggtgccgggggtacagaggattcaggaccatccctggtaacaaggggacgttgacgaacaaatggatttgatgcattgttcgcagctgatgatgagaacatttgccttctattctcatgaactttcaagttctgcgcattcaaaaataaacaaactaagtaatatatttttactgaagactatcaaaaggaaacaggaaggcatatatttacctctgtccgcatggtaagaacttccttaaattcttttgttgcgctcatcaggcgattttttagattgtccacaactgtagtggaatgatttgttgtatccttggaaaggttgccgctctcattttgtgaattgcagagaacctgtaggtctacaacggcagaattcaaagcagtgatatctttcttgataactgcagtcagctcttgtatctctaccgtagggtcatcaaaaacagatgtcctctttgccactgcaaacaatccaagtcatagattagcaaggtctacagtgtcaaaggaaagcctaaatattagcagagcattgaaataagtatttgtacgttcaagcgttgaggctgtgtccatcaaaggttatatccatctaattcttagtgaagtattgagacaataacactaggtcgttgttgaggctttatggtaatgaaaatatcacatacaacatcattaatacctatgtgcttaactaaatctcaaggagtcaaagatagaaccaatgaatcatagctgagaaaaaatctgcagatgatgatcaacacggtttaaggcaacatataatgtgccaaataaaaagggattacataacttggattctagaaacatattatttgcacaattaataaagtatgaagaagtcatgtgcatcaatgcttatttgccagctataaaacaccatgtgaggaaagtatgcacgaacaagatacatttaatttccaaatccatcaggagctagaacatctaaaagcaacagtcactatcgcaagagctccaaccaactattggccctcgcagcgcatctttgagcagatatgattagttcacgttgaataccattgtaccccccataacacatgcaaactaccgatgcatccagttcaaagagaagaaagaatgcccatattagcttcttgagaacatggtgatgaatcaatcagcagcctattagcaactgtttgatttagtaatcccccaaagtatgcaattcatgacatgatggaactcattgtttataccatgggaacacgattgcagaataccccatcctgactacccacaaaacaacgtgagcaaaatcacaatacccactaaccgcatgggttgagtgggcaccagaagatcaatcagcatggcagaggaagtatgtaatcaaaatatcacaaaataacaagcaagcacatttttagagtatctaactagtcctatggcaactacaagcacaaacagatagcaataatcggctgccacggtactagctaatcatccatacacggtggcaacttcctaggttacaattccatcgagataagatctacagcatgggcatctcgagatcccaacccaatagtatgccaggaaaccggcagctgaactaattggcaaggatgcaagcataagagagaccaacaggagggtagtgaagagccatacaatcgggccgccaacgctgctgtagcgcgccacgctctcgacggcggcatggaactcattggtgcgatcacggaatgacaccagaacgggactcatcaggttcatggtcatggcggacacaagggagctggatcagtatctgaatctaggcgccttggtgggcgtgatggggcagagagtggcggttggttcggtctctgtgggggaggagcaaagcggtggcggaggaggggatcgtgatttggtgggaaatgttaataaggaacaagaaaccagaataaaaccgggaattctctagttgggctccattgcagaacaccacatcgtgagttcctgactagacaggagacaacactagagaaagcaagataccccctaattgcatcggctgattgggcactggaagaacaatcaatcaccatagctgagagatgtaatcgaaatattgtagctagaaaaaaaaatctaacgagtcctactgttactgcaactctggaagcaagcatacatatatagttcagaaaaaaaaatctaactaatcatcggagaccgcacatacagtaataactaatcaatcatccatacatggcgacgacttcctcctaggctacgattccatcgaggacgagatctacagcgcgcggggttcgagatcccagcaacggagagagggcaggcggggcgaagaggagggaggcggcatacgtttggcgaggcgggcgagcttctgcgaggtctggtggatcccgagcccgatcttggaggcgcggcggttgaactccgagtgcgccgaggccgccccccgcgacacgtcgagcgggccgccaacgccgccgccgctgctgctgctgggcgccgccgccgcggaggaggaggcgtagcgcgcggcgctctcgacggcggcgcggaactcgttggtgcggtcgcggaacgacgccggcgccgggcgccccgggttcatggcggcggatctggatctggatctcggcgcggttgggtgggtggcgggtcgacgcggtcgcggtgggagggtgggaggcggaggaagaaggagggaggagaggggatggggatcgagctggaaattgggggagatcggcgagggaaaagaattggcgtaaaatggtgtttctctgcgagtttgatgaatttttttgggtgtcggttgccgggcttgtgtgacttcgtaacgaggtaatccttcttactccggactatacgatggaaaagaaagaagttgtatgtagtaggagtatattccaaaggatttaatgatctgtatatgtaccatttatttttgtaggaatgtaaatatgataaaattaaagaaagaatatatggaaaattttccgttggtatagattaaagtgtgcatgcgttgaaaaaacaggaacccggtcccctttgagttgtgctcaggggcatatccactctccgggtgcagcccctaatggctatgcttggggcacatcgacccctatggccccaaagtgacctactagacctatactttaaagtgtgccgccgcatgagtgatctacatcttcaaaattagccacatcatatggaagaagggttcatcctctcaaacttagaaattttcatcacccctcatagttgtgaccatcatcatcatcaccatccaccaatgatcccacgagtagggttttacacatccggtggggcttcgaaattgtctagaaaagcttgcctctctcattttcattcgcgcaaagcatcacctctgtggaattcaatttgttgttgacaacgatgtgttcattggtgtctttattagtctcaagatatatcggcataatctttttaatgtgctcatataaatagggtgtgtgtatggataatctaaaagtaaaacttcgatgataaaaaaaatgagcaaagtgaaatttaccaataaaaaacaattttcataacgttcccaattgaaaaaaaaaagtaggtggcacaataaaaatagaagtacgattattttcctgtgcttgtgtccactgggccgcaggtgacgcaatgactgatgatgttgtgggttgtggccttccaggcagaccaggccgacagcccatttgagatcaaaaaggacccaaaacagtacactgaacggaccaagatagaggataggaccaaaggggaggagaaaagagaagagagatgaagatagtatatgatgacttacatgtgggtctcgctttttttccttgactatgatgccatgtagacgttaagtgggataaataccctatcaatgcgacactcaggacgaaactgccgttcaaaccgttcgaggaggtaattggtttggtttttatagttgaaggagcctatatacccgattttacggttgagggatacgattcgacctatggcaatagttgagagacgcaaaacagacttattcttagagtccgatattgggtgacacagaattgcagcccatctaaattcagcacccaattcttttgcactgccatttgccaaagaaatatcattttactccctcaaactatttgattagatcatttaaccccattaaaatacgtttggctcattttactcctaaactattgaaaatgatttaccctacttcctaataactttgatttttaaccatttgatccttttgaaaaacttactccatagataaacccttaaaaacccttattataagaatgaactctttgcgcaacgcattcatcgttgccgtggtccactatgtcagcaccaatgacgttggcatcatccccctaccgcttggtggaagccaagttacttgtgtgaaggggaacagtgctaatgccagtggcgcggaggacctatttattaaaaaaataaaaaggacatatttataataaatatttttttacaaataggtcttgcctatttataataggtccatttatataataagttttttttatctatttgtagaatgagttttctaaaagaatcaaaatgtgaaaaattcaatcctaacaacatctctttttcctctctatgtaagctatattttaaactacaattttgtagagccgtagatgacaccatcatcaaacttcatcagtcgttttcttgaactttaaaatcatgatgtttgaatcaattcttaggtacttccaacctaggcaaacagtaacaaaaaaaactaaaaaaatgctgagacgttaagttatatacatgcatacatcatcatcctacaaaaatcattgcaaaacagggagtattataaaaggagtaaaggataaatacataaaccgttttagggtaacgaaaaatggtttagaggattaggtgcttcggtgaaataacttgactaaagcagaatataccttttttccaaacatttcatcatgcttataagtcaacttatgagaaaaaccaatatttttttcgtttggcttttttaagttataagttactcatacactgtcaaactaaagctagattggaataactttttttccttatgtgaagtggaagtataactccatcattaaatttaaggttttaaagccaccatcttataaaaacatataatccaaaacgttagcttaaaagcgtaaggctaaacaaaaggacctcaatgtcaaacactcaaatttaattactgtacatgctaaacgctgaaacttttgactgaacaacaccaaaattacgctgtacatttatacatgcattcacacaatcatttaagttcagtcttagacattgcaagcccctgtgttaggggcaatcttgtttagccttttatataaatagcggctgcttttcattgtgcacaacaagtagttagttgggttaggcagcaatccatccaaatataaacacaacaatatgtgcatgcatgcatgacatatataagtcattggtaggcaaaggcataaagtgatctcacgatcgtcaggagccatcagctacagtctctactaattgtggattcagagcaatgaacacatgcatgaatgaataacaataagcagcctcagtgccatgacaattttcacaggatatatgcatgcaccaatacgcatacactgaattatttgagcctgaatgattaatgttctctccactgcatgagacgaaatgtcaaacaatgtcctaactcctaagtttgtgctgactccattagcatctcctctttgcatatgcatccatgcatgtgttaaatggtaaagtgattagctagcttgagaatagctagtgggtgtgtggatgtaataaagtgaatggctaagattagctagctagctaattacctttttgcagtgggagattgatagatagatctttcttggcaactgctactacttatccgcaatatctgtattcacaatggtcgatagttcgactaaatcacatttctctcgaagttgcaggttttgcagtgttaattaacaacgaaaaagtattctgaaagtgcgaaatataatgaaggatcacgcagaccatttgtttaatcagctgaccagatagcaagcactaacacagctgcacgtactttatgatgaaaagaaaaggagaggtgacaattttatacacaaatatctgtaagcgtaagctaaacgtaatacacctaaacctggctgtatttaagaactacaaattgattgatgactagatatttagactatcatatttttgcaaaacacaatctatcaatgattagattgcggttcgtttcgttcgttcagatgcgccatcatttcagggagagaacaggtggatggctgcatatatatgcaactagctgcatttgccatcttactatctcaccaaccatttcctcaatgtgtctggctctcacgtgttaaatatgaacaaaaaattaaaatgattcgtatcttgacccttagcctgtaatagcagccgccagcgccactgatcattcggaggttgtttggtctaccaatacattattcagaacatgaagagattacacaccaacagtccaatttgctactccaataaaggagggagtatatcgcatagttcaattataaccagctaatcactaattaatcagtgcagactgtgtgcatgtttagttcaactcaaattattacttactgatgaaagatcaatctgtaacatgctgggtcatcaaatattcacaattgactatatatgcagccgacgacgacaatggtcatgagactactgaaaacatgcctgaatatgacaaaaaggagtgagagctcaaaatcttttgtcttctttggtttagttattttctggcccacacgttgtctgaattctttatccagctagcttcttcagagctgaccattattgcatcattggatgcttaaaaagaaattgaattgcatgcatgcatatatccgaaaacgtgtgagtttatctgttcatccaaccactttcagggaaaagctgcatacatgctccatgaaagacaaagcgaaaggtttcttgatccaaaaaagcttctgatatgatggcctccatctaccgaactttcctgttcaaacaatcccttttgcagtttcctttgctctttcccactgtttattcacatcaagatatctctctccctatgcactaatgcttaatttccatgctaatttatttgatgcgttataattgtggagtcagacatgcggcattaaaacattaaaatactgaaaactatgatcataattgataaattacgatcaaagttacacctacatgtcgataaattttgctgctacaaaatcagtccaccggctcaagctggctcggtttcaaaaaaattaaaaataagtcaaagtatatgtaggacatactcacagacctgaaagcatttattatgatcagtattagctattggaccagaggaattatatcagtaatttggtggagttggtggactttacgcgtgtggtatatataaatctcgttaagaagaataattaaagacatgtgaaattggtacaaataaagaatctggagtaattcaaatgttaaaaaaatatattctcgaagatacgcccaatccagacaggaggttaatcagaactaataataattaagctacgcaaatttaattccgctgtcggtcagtcaagctagatcaaagctgcgagcttactataagcatgcactgcagcatatctgcaccaaactagaccactgctattcctttttggttttaaatttgttgtaagccaagttgtctctctcgatcctgattaggagtaactaattcaccacctgctgctaattgacaagttgtctaatcagtcgatctgactgtttatcggtttagcactcgctaatcagtttgatttgatttgattttggatgacctggtccatggacctggtagctttcgtgctctcaatgtgaaggaacatgacgtacttcatcacctttggaacgcgtctctgttcgatctgagtctgaatcatgagcttatgcctgattgagaggtttcatcggattgaaaaagtgaaatatgatgatgaaataaatctatatttacccctgttttaccactgggcgatcagatttttttttttcacatatcaacggttgcaaacagagagtattttagagtacatttttgttgcagatttattagactgtgaaatgtgaaatcatttgtcatgctcactgatttaatttgaaatcgttgctccatttcacaaaaaaaggcctttatccagacaattatgagcataaaacaaacataaattcaactttatagtacaattgcttgtgataataattaatttgacctattaaaaaaaacactgctaatttggagatagagtccagagtctatggagcaggaaggaagggttcagacttgcttggaaagcacatcttcccctacctttgaccacgacgctggaactcacacgagcaggaaatctctgacaatggcaggtgggccccaccccgactccttcctacccacggccgactcccctcctcgtcaccacgttgtccatttgatccaccatttcccaaatccaaaacacctataaataccactcaccctccttgcactccaaacaagtcaaatcaaaccaaccatttcaaaccaaagcaaagcaacgagctagcaagggcaacaacaaccacccctctcctcgtcttcgtagttggttattcctctcagctacaccattttgttaacaatggcggccgccaagtccgtcgagcggctcgggcagcggcgggtggtgccggccgagccgacgccggccggtcccctccgtctgtcgtggctcgaccgctaccctacccagatggcgctgatcgagtcgctccacgtgttcaagccggctctcgatagggcgatcggcggcgatgacgtggcggttgggccggcccgcacgatcgagcgggccttggcgagggccttggtgcattactaccccctcgcgggccggctcgccttctccgactccggcgaggtgtgcgtggactgcggcgacgccggcgtgtggttcacggaggcggaggcgagctgcagcctcgaggacgtggactacctcgagtacccgatgatggtgcccaaggacgagctgctcccgccgacgccggcgggggaggaggagcgcgagctcgtgctgctcgtccaggtcaccgcgttcgcgtgcggcggcttcgtcgtcgggttccggttcagccacgcggtggcggacggccccggcgcagcgcagttcatggccgccgtcggcgagctcgcccgcggcgcgggcggcgtgtccgtcgatcccgtgtggggccgcgacgcgatcccggaccccgccgccgccgtcatcggcagcctccccgaccccgccggcgccaagcgcctcgagtacctcgccgtcgacatctccgccgactacatcaaccacttcaagaaccagtacaacgcggaggcgcacgccgccgccgcgggcgtcgccaggtgctcggcgttcgaggtgctgatcgccaaggcgtggcggagccggacgcgcgcggcggggttcgagcccgacaccaccgtcaacctctgcttcgccatgaacgcgcgccccctcctccacgcctccctcccgcgcggcggcgccgggttctacggcaactgctactacatcatgcgcgtctccgcccccgccgggaaggtggcgggctcgtcggtgacggaggtggtgaagatcatcaaggacgggaagcggcggatgccgtcggagttctcccggtgggccgccggcgacatggccggcggcgacccgtaccagatcacctccgactaccggacgctgctggtgtcggactggacccggctgggcttcgccgaggtggactacgggtggggcccaccggcccacgtcgtgccactgacgaacctggactacatcgccacgtgcatcctcgtcaggccctgggcccacaagcccggggcccggctcatcacccagtgcgtcacccccgaccgcgtcgccgccttccacgagggcctcctcgacctgaactgacgccgccggcggcgaacctggactcgccggaggccgggaggatgggtggattagcgtcgcgtgattaggtgggggtgattactactgatgattagatgggtggtcgttgtgtgattagtgggggttggtaactgaattggattggattagttattaatacggaagctcgtgggtggagcgtggtgtgggtgtgggtgatgtaagcctgaaaataagcagctcaactcctgaaaatcgggggtgtttttggttcatccattcaattgaatttgggttgcatttgataacaatcttcgaattgttgtgtttacgtttacggcgttgtctgaattgtgttcccttctgtccgaaagggacaaaagcggcagaaaattctcgtcagtcactccgttgtcacagggagattcagatctattaaagttggattgcatttcatctaaaagttggattttttgttgcatttggtaagaagtttcaaattctgaattgctccattctgtgcagcagtttgtttgtcagtcactttcagacagattcagtgtctcctggatcttcagacttcagttgcttggtatactgaaacatcagctactgcttcagatcagctggcatgcaaatgcatgcgtgtgttgaggaaaaaaacacgagcagcaagcatgttattggatcgtgattgcctcctgaatttgacctccaggtttagtgggcacggaatccaatctgactgaacccattttttcttcttctgatgaactgtcagtccagttccactggtctccctctttgatattgtttcccaagtgggcttaatatcaaacacttcatgaagagatattatgcacatatatttggtgtaaaattcttaagctgatgagcagcatcagcaggctggcacactgactcacattcctcagcagatgagtcctatacaaatgataaatctgtcagctaaactgttttcagaaactatattttgcatgctcttcagtcttcagggttgcagacttgaacacttcagctcgctggctgtattctttactacttgacaggtgctatgccatctaatttttttagataatagaagctctgttgaacgatcaattatatccaggtaatacaaccgtatcgagaacaggctgtttagaaactcatgtattgtcaagtgcactaaaatggtctgatcagttttgctccaaattccagaaaggaaccaaattttcttgggaacgcctagctgcctgcagagaccgaaacaaaactattggccatttaaaacaagaccgaattaacattcatgattagaaaagccagtttgaattcgattgatctactagcatagagtatagtactagctccactgattacaaaaagaactgatcatgatcaagcattaaaagatgttatctttcatgtgtttcccagcattaacggttctgcaggagcagcttctggagtatggatggctcatccttttgtcagatagtgtccggtctctgggttggttgatcctgcatttcttcaggatcagcagctgcctactgtactggtttagcatttgaccgccacaagaagcggatcaagattccaagaaccaacgtaaataaggaacacatggaacaaaacatcgccactgggatttgtttctttctgaccacatagaaaaacatcaagttgaagctagcagcagccctagttaattgattcatctatcggctgcagaaactaaataattcactttattctgatgccagataatgctagtctagtatagttagtcagttacactatctgaaaaatctgaagaagtgcttcactgcagttcattgcttaccttcgcggcagtcagcaatccttctgcatctgaaagttcagaggatactgcttctatcaaataatcaggtagcataaaatggatcgaacggcatatcttatttactaaagaaatgtctaattctcgaaaattatatggtcatggaggggagcctttctcatagatgatttggctagttctttcatccttttcgatatatggaaatctgcgttcttctgaacaaagtgaagtgcacatactgtattttgttttcgatgatagaactgaatatagcctcacatcgaagatgtatctggacaagaacacattacactgcacaacctgaaatactcctagtaaatatgagcacagaaaaaaaattatagagttgctttattactgaaagtaaacatatcaaaccagtagtcactactcactacatttgttagaggtcattggagaaatcaatgctatgccaaaattgtttccctgacatgtgcgattttgtgctggtcaatcccaccttctacgcacttgtctctcaacaggtcacatccagcaatgaacaacctttccagtgatcctggcaatcccaggtgtggtagggagtctatgctctcacacgatgataaatgcaggctcttcagggaggaaatctggtgcagcgttgcaggcaatgagcggagatatgagcattcactgaacacgagtgttttcaatgaagtcagtgtaccaaatgcttgctcctgctctggagttaggcatatggtttgctgatccgtgtcaatcatcaaatattgaagatacccaagtgtcctacaaattggcatggtaaggaatgataaatcatcaatatgcagtcttttcagtgaggcagtaattctgagatgtgatccctctgcctcttcgacgagatttttccatccctccatgaacttaggacttcttagcacagtcagttctgttagatggatgagagttttcatacatttcaatgtcgtgagctctaggcaatcttctataatcaggtaatccagtcttaccattgggttcagctcaagggaagtaacctgggggcagtcctttattgacaagcagtcaagaatgccaacatttgataaaatttcatgtagtacatcctcagatatcccagaaccgcatatcttgagttcactgatgttagacagtgaggatccagaatcatccatagtcgtcgatacctcagaaatatcatgctttccctggcctttcaatggtagtaccatgaaattatcacaacctggtatgctgaaactcttgaggctcctcaagttatgaaatggcagaaataattgtctttccagcaccaaatcagatatgccagaaattacaatctcttcatcattcaactccatgagagagattatccctgcatttttaaacttatccttgacaacgttgaagaatgtggaagtggaggcaattgatccaggctaggacagttttggatgtcnagcatttcaaggcaagggaaccatttgtagttgacttggtcagaccattgctcaacaggtagcatctgcaagctgggacagtccatgatggtcaatgtcagcaatttaggaaagaagcattctttctcaaccccacaccatgatcgccactctagcatgttctcaaaatgcaactcttctaaacaagggaaacccattaaagagccacttccatagagttcaggacctatgcttaggatggaacccataccagtgaaatgaagtctccttagataaggaagctgtccaagaggaggaagcatttcccatccggagcaatcatgtaggtagagggactccaagtatttggtatgtaaatccgtagctagccatgttggtgatgtagagcctctataatttattatcctgagatgtctgagatttggatggggttgaagaccctcaagaacacttatttctacgtcactgcttctacttttcaagttgctattccaaagtaaatttaactcaaccaggcggtatttttctcttactcctgaattacttgcttcttccttgtttcttacgttctcaagatccccaatggcaagagattgccccatctcccgtaactcttttagctgctcgatactaaacccatttccctttccaacattgaaacagtccaactcctgtaggctggtcagcttcccaatgtaagaaataccagcataaccagcaagcaacttgcttgaagcatcaactaatagatgtctaatgctaatgagattgttaacaccagttggcaatttaacaaggttcttgcaagatcttacatccagtacctgcaaatggcaaagcttgcgtactgattctggcaactcagcgatgtctgagaacctgagatccaagtacctcaaatgtatcaagtcaccaattgttaccggaagggcttcacagtttatatgatgtaagcatagcatgcggagattaatgattcttctgtagttaatagacatgttccaaaatccatcatcagatgcatcagacaatgaaattgttggagaatccataaaccatatggtccttagattattcaactccaggggacgaccaggtggtcttctctcaggtaaactttcattgctcagtgatccatactcgatcagcgagaacttatggcggaaaaatttagcatggtccggagaaaggaaatacaagtggcggaccacatctgggataccttcaggcaaattatcactggtagtgaagcactcatctttagataatgaacttgcaaggtcatgcaataagtcgtgcattctgtaaaggttgtcatttgatgaaacttggaagaatgaagcagatgccaattcgtataggtattcccgtgctgtatcctctagtgttttgtctctcctcatgcactgaataaaaccatgtgccatccaggaaaatattagctcctcttcacagaaagaatagtccttggggaatgctgagcagaatacaaagcaacgttggatgtttgcaggcaggtgttgatagctcaagagaaggactggcatgatatcttcaggtccttgtctcagctcccataagttgctgtctaatatactcatccagtgctctgtagtaagttgcttgtgcaacagctttccaatagtctttgcagccaaaggtataccattcagcttgcttgctattttcctgccaatcaaattcagattatcaaccatatttgcatccccaaatgcgttttgtttgaagaaagaccagaaaggactgtcttgtaaccctccaagaatgactgaaggaattgtgccaacagtattagctatattgtgatgccgagttgtgattatgattttgctccctggtgtcccagatgataagggggcacacaacagttcccagttactgcaggaccacacatcgtcaagaacaattaggaatttcctcttcttgagcttcttcaccagcatggtctgaatgttgtttaaactgagcgaactgataaactgattatgtccttcttcatctattgattgaagtatgtctatggttacctgtttgacatcaagaaatccagacacacatgcccatgcccttacctcaaaacaagtgatggtagctagatcattatacacatactgcacaagggttgtctttcccacaccaccaatgcctacaactgggagcaccaagaagctcttgtacctattttgaatatttgaaaactttgtttccaggagtatctttacaatggtgttcttctcctcatctctgccgtacacctctggttcagtcaagagtgagctggtttgtcttgagtttggaaactttggttgctgcatatcatcagctaccaacttcttgaactgagcaacacgctcaatatgggcggtagctctttgtagacgatcggaaatggatttcatcttgcaagagactgaatcccagtcacatgacacataatcaaaggttggtctggcttttttgaatggagggaaaagggaggaacctgaaattttagtaatgcatgttaaaaggtgatatatgattggaattgtatatgataaatgaaaaggtgataaaatcatgagctaccctaggtcatcctaagcttaaatggaaagaatgctgcaactaactgaataatcacaaaactgtgcaccttattagtcagcaaggaatgttaaaagttttctatcggtttagagtcgtcttctcatcagctgttagtcatcctaggctgcaaaatatttttgcagatgccaacttctccaaagaaaatgaaggacatatgaaatcagtattatgtgttgtttacttcacatatcgccttgctatagtcctttcaggcatgtttggcaagagtccatcctttcatttgtactgaacattttgtttcttattaaagaaaatgacatgcagtctgccttcatgttctcaaaagaaagaaaagttgtgaatagtatcacacacaagaatctagaatagccccaacatttattatgtctgttcttgcagtaatccagcacttgtcttgctcattgcctagtggcccataaagacctatataatccaaggtaagtacttgtaaataagtttcatctagtccaatccagtcaataaattgtatgatctcagtatttccactatatgctacaaaagttaccaaatgattgggctgtactgctgtatagttagagaattcctagtcttttttaagcatagtgatagttcctaagtttcaagaaacatatcgaaaatctcgaacatatttacaattcaacccaattgaatttcatccaaaaagttgaacatagatgcctgattctaaagaagttcaatttctttatctcacatctaagtttagtggagtcaaaagttctcggaagatgagtacctggctggtcaaaagtgttccgaagagctttaggaattgataatccaatgctagcagcaagcttgttttcgcttctgttgtccactatttccataaggcgaaagtagtctaactcatcaagcacatcctctgcatcataagctgaagacttcaaatcccaaactagttgccagatgccctcctccatcacaggactgcctttcagggtcataagtattgccttagccatatcaagctgacgacagaggttttgaaattcacctcctaagtttgcacgatctgcccactgctctaacttggagcttaggtacttgtcgaagattacttgcatgaatatcccaattgtgctcccaataatccctgaatccatggcaggctgaagcgaagagggctagaagatgattcctttatctgtatgtgttgtgtgctatggagatcgagtttacaagataatcattgcttgcaaccatgtcgagcaagaaaacaagtccactacccaagtcaacaaaacataaggtagtatcataaagagccaaatagtgataagacagctggctagttgggtggttggatctaacttgtaatagaaaactactgtgctgacatggacttatgctgagaccatgtagccaaacaggcttgtgcagtatgctggaatttaacaggtgcatgcatgacagtaaccatcaactaatagaaacttctgccgtattcaaacttttcaagttaaaaagatgtttttttccctttttttaataatgccatagtcaagctcgtcattttcatttgctcctcagtattaaacaaagtggacccccttatccccaatatggactgcctagtcgatccgtcgaagtaattcgaactcaagaacagaaaaaaaaaaggagagagaactgcaattcagaatatctcccttatagtgttttttttagggaatacgcagaagactacttgcacacctttgtattaagaagaaattgcaggatacaatggtcgaatttgtcgggatcgacttacccgaattgatttaactacgcgccacggctacagcgtgcaaatctcccctagtatgatacaagcatgacattatggtgctactaacagctactatcgtctcctctacactacgccaggcgtacgacacgcttcatgaatgaaactgaggtaataaatggtgaagaaaagccatgcgaaaactcatgagctcgaatgcgcttaaatctgattatctgaagatgacagaacgatatccgtacctcatcacgagtcgaatcctgcagaaactccgcctgaaaattagcctcgaaaggtctttgaggcagtagcgcatgtgaaccgccgccgcagatcgatctggaccagctgtcctgctccaagtgactacgaatcagggattccacaatggaaaatgcagccacgcgcgcggcgcggggagggagggaatacctcacctcggaggggaggtgccacggcggcttcgacggcgacccccccctcggcgtgctgctcctacgcggcggtggccggcgggaagaacctgggacctgggagcgtacctgtcggtagccggccgccgccgcgccgcacggcccacggggccgggggaaggcccattccggcgacgcggcgtcggccttccacgtgagggcccacctgacagtgcgagaggctttcttgtaggaatccgtatcagctgcagtcgctactgggactacaagctctgttaggtatcccattttcccgttttctgtgcgcatgattttttaactgttaaacgatacgtttttttacaaaaagtttttatacgaaagttgcttaaaaaaatcaaattaatattttttttaaaaaaagctaatacttaattaattacgtgctaatgtaccactgttttcgtgatcactgttccatatgggaacaagaatgtgcgaacacaggcactaccagtttgcatcaacggatgcagatggaacgtccagatcagcgaggcgtactgttcatcatactgtagcagaaacactgcagcacataatactgttggtatggtcactgtatcactagatctgagccgttgatcacagaaatggaaggctgaaattgcatgtagttcttaagttgcagtcatagctataactgcacctgatctgaatacttcttgtagcttgcagggtccacctgtcggggctagatctagaggaaggattgagcaccaaaatccaaacgaaatcctgtaaaaaaaaatccaaacgaaatggatttaagggtctcatatttttgcttatgcttatacttattagctaaaatttgatttaatcttaaatttggagctgatttttaggtcttctcatcgaattttattttccagcctttgtttttagatcgttaagaacacgtatataaaaattttattcataaattacttttcgtttacaaatataccgttttcgattattccgcgaataagcaaaatgatggttacgtaaggccccattcgaacaagggacaagctgccatatttttcatctaaaattctgtacaattgtttttacacacaaaaaatgtatatctttatagaaaaaattcaagaaatgtcattgacaaatacccaaatcatggaaatatcatcgataagtgcgagtttcataaaatgttatcgtacaagtgattttgtccaaaaatgatattatcgttaaggttccgtccaccccgctcagttaaggatactaacggaacgctaacaacgatgacacttttagggcaaagttgcttgtatgataacatttcatgaaacctgtacttattgatagcattttttggaatcagaagcttgtcaatgatatttcttggattttctcatatttatactgtaaatttcaaagttacattataattatattgtaccttttctaatacacaacaaaagatataaagagtaaagaacagatttatgaataggcacacatgtaagttccaaaccacaaaagcaaaggattatatccgtgtactcacaaattaagggctaaaaatttgactctaatctaacgaaaaatctgttgccacttaaataaaaaaaagaaaagattgccataattttgttgaagcaaataatttgcgaacaaattttgtaggattcaaactctattttttttcattttgtttctctgaaacaaatggttggggctttccaaatcctaaaaacatactaattaaatagggaaatctggatgaaagttaacaaaagctccaaacctcttgaaaaaaaaaacttttgagtttatttctctcatccaaatcctttgttttatggaatagtacattatgaggctgagcttgaatacatttcttccataacaattgcctctaagttgttactcccgccattttggagtaattgtcgctgttgactaaaattatctcactttaatcataaattacttttaaataagtatattatgataaataaaagttgcatggttatatttacgacactatatgcttcaacaatatataacatattttgaagcatttttttctgcacaagaatatgagcacatatatttttaattaacacccttaggaaaaacagatgaatagacaataagggaaatgagaaaaggagtctttgatagtatcgcagtaaacaaataaagcaaagaaaagttttaaagaggttagttgatctcttacttgttttactatgaaattaaactatagaaatgcaatcctttagaaaattttctatcctttccaactaactaaagagttccataggaaataatcttaggaagttgactcctccacaagatatatatatatatatatatatatatatatatatatatatatatatatatatatatattgagtgggacaatcctccatttcgaagggccaaaaatcagtaggaatttttttccctcgacacaacgcataactgaactgttcgtcagtaccccaccacaaaggtgaccctgcacgtaccattggctgggcatgcatcacaggctcacagcacactgaaataacaactcatgcgaacttgtccccatatatatactccttccgtactaaaatacaataaattttgggtggacatgatattttagtacgaatggagtttatggacgtcaacaataacagaaaaacaacatgaagaaaaaaaatgatagatcaattaattgaatggaatgcacacagacaattgcttgcagtgcatctgcaacgaaaaataaagaattcttcagaggagtaatatacatgcagtttcagttcatgtacacttgagcaactagttctgttcatagttgcatcagctaaccaattaagtaagcatacacactgatcgattctctttctgtatatatatactgcgcattcgcctcactgatctgtatatatatactgtctcgttgttcgatctgatgatggaaatgggcaaatggccaagaacagcagaattaagatcgagctttcttcagtcggagtcatggttgtgccaacagaggagcatggagacgcacctcccgaggatgtacagcctcgtcttgtgctccttcagcaccgcgttgcaccgcccggcgagccccactccggcgcagccgccgccgactaccttccctcgccgccgccgccgtggcgttggccccatcgccgacgaggaggacaggtggcggtacgccgagcagactgaagaggcggacgatgagagctccatggagaagagatgaaaacgaacgaagaatgtgtttggtgtgtgtgggggtttgcgaaacgatgaggtcgcgatccggtggtttaaataggcgaggtgatgtggcacaggtggaggtagcgagatgacgattctacccccctgggggtatgagacgacactgcgggctgtttagatccctcgtaaaatttttcaccccgtcacatcaaatgtttggatatatgcatgagtattaaatataaacgtaaaaaataaataattacacagattgtgtgtaaattgctagacgaatcttttaagcctaattgctttattatttgacaatgtagtgctacagtaaacatttgctaatgacggattaattaggcttaataaattcgtctcatagtttacaggcggagtttataatttgttttgttattagtctacgtttaatacttcaaatgtgagtccgtacatccgatgtgacacgctagaactttacacctatagatctaaacaccactgagaagatgtgatagtagcaaaggggtaggatggtaaaaatggagtggggaataagagaccggtcgtcgccgtcgccgtcgacggcgtcgagacagatcggtcaaaggcatgcatatgatatatacatgcaccgtcgtcgtcaggcgagcggcggtgcaagcaacgcatgcacgcgcgtacgtacgacgtccggtccccatcccgcgcgcccgccaccggcgtggcgatcgagctagctggcgatcgatcgcggcggggcggcgggcggcggcccacacgggtcggggacgggagagaaggggggggaagcaagctaagcgtgcgtcgtcgtcttcctcgtcaccggcgacacaccacgttgccgcgccccagctagctagatggccccgcgcgccttatcgcctcactgtgcacgcgcgcgcgcgcccactgccacactacatactcgtacacgctataccgctagcggtaggctagcgtatagcttactccctccgtccaataaaaaatcaacctaggatcggatgtaacacatcctaagggtatgtttgaaggagcttctagcaactacagcttctcctagaatttccagttgccagaagctcccctaaacagtctagcttcttacctagattatgagaatctgtagttgtagaatctgtagttgccagaagcccagcttctccaaattctcatcagctagcttctcagcagctgcttagaattttaaactccccaaacaggccctaatactacgaatctagacgtccagattcgtagtactagaatgtgtcgtatacggtactaggttcgttttttatgggacggaaggagtatgtaggtaggctgtagctgctggctgcctgctttcgcgttgttcgtccaagacgtttatttttttactgtactttcagttttttttttcttcttcgaatctgcgaacctttatatgatagattttttttaacctttctagggatatagttttaattctccccaagttgaatccgcgctaaaatacgtaaaatattccttctccagctttgaagaccggcaatgattaatttaatcggttagaattaacgattcgggggttaattaaggtcagggtgagagaaaggaaagagctaagtttattgggtttagagggatagttgtggaagatggtgagcaggaaagggcgaggcgaagcctcgtggtcagttgagggcggatccaaaaaagaaaaaacattatagggtgactcatctccctcttcctcccctctccactttggtctccctcttttccccttctctctccttttataaatggtgatccaacgggatagaaacttgagtatcccaacacccacgttagatccgtcgctgtttagttactagcggtgaaccagggttgaaatggggagtggggtcccgaccagtttggaggtagggatggtggtgcccatgagccatgaggccgattgagggatggtaagctggggcatgaagaagcttagcaacggtaatgcgggcttgagtgaagcgagcaacggagaggaaaggagaagggaagggctagttaaaacgtagttgcacgaattatcaaagcgatattactgctctttttttaatagatgacgctgttgactttttgtcacacgtttgactattaattttattcaaaaaatttacataattataatttattttgttgtgaattattttatcatttaaaatactttaagcatgatttatatcttatatatttgcataaattttttaaacaagacgactaaacgagtgatcaaacatatgtttaaaggtcaataatgtcatctattaaagaacaaatggagtatttagaattcacatgatttatttctcttttacttcctccgtttcacaatgtattaatgtcaatatgaatatgaaaaatgctagaatgacttacgttgcgaaacggagggagtatttcccaagatctctgaatcgatttcgaacacgcaatgcatgagctgtgatcattctcctcctgatggaacatctgtcgtcgtgtgctcactgctgcgcacgcacgtacgcaatgccctgcccacacgtacgtacgtacgtctgccagccagatatactacgcatgagtgcatgaccagcttttgcatttcgcacgagagatttggacgtatcgctgctgcctggtggtggccggtttggaccggcggcagtgagaggcgaggcccagtagcacgttgcattgggcccatcacgcactcatgtgcacagagacagtgtcacactcacacacacatgcctctcttccatctttgaccagattcagactacaccctctttgtcacctacctaacctcggctcactgctcaatgaccaagcgggagattaggctctctctgctctatcctattttcttagccaagtgcagttgcgtttaagtagcacgccccccccccctttctactctaccttgactattgaattgaattcaaactttaattgccctgcttcattcttgccatattgagattctatggaagaaatgaaacgttacccgcctacttatacttcataagtgccaccaatctcgttcaggcactaaactagtttcggggaggatggatggttgtcccttcttctcaatagctgcggcacaacctgggtgtggagacagtttgcatgggttcgtgcacagatttacgttcaataatccctggggctttcacttcgacacgtcttcgttcgtgatcgcttagagccccttttccatcaataggtactcccaaggcgtcgaccacacggcctaacatggcctttcccgcaggaacatccacaatagatccagtgcgcttgacaagatctccttctttaatagcggtatcactaccaaagacaacaatacctacattctcattctcaagattcaaggctattcctttcacaccgctggcaaattccaccatgggtctattctgagaagcagctggttggtagcctgtttttgagaatctaggaagggttgggtttctagtttctaacttctaatttattttctggattatacaactacaacttatcagaatctgaatctaaaactggagaagctcccccaaacaggccgcccatgcatgtaagctgatgtaacgaaaatgtatatcatctcttgctattctcatttggttattcttctttagttccatctgaaggaaaacaataggaaaaagacagtacatcttcattcattcagacatacgacaacatgatatgtgttccatcccatttgattctacattgttatatttttgaacaaatggaatatttttttctttttctcggtgattgaaatttggctcgaaatttctgaaatttaggaaatcccgggggacacagaacgatttcgtatggaaatttcttttttttttaaaaaatattcaatctaaatttgttcaaatttaataaaaatcccattcgaaattcctgagatgcccccgggcataaatacgcaaaacgaaattgcaaatgtatgcacccatagttgccagttggcatagaacccggatgttttcatcggggatatatatgatacagctactctcttcagtcttcaggtttttgtcatctgatctctctgcaccaagatgtgtactacacttcttgctgatcttagatttgccttagaagatcaacaagaaggtgagagggacatgatggagtggttgccaatcgtcattagctgtactaccactgcctgcctgccctgcaaagtctctctccatcagagcaaacaagagaggaccaataattggagatctctctctctggaggatgaacagacaaacaaccatgcattaatccatagttgctttaataattcagtcaatgaataaagttttctcccagctaccccagatacaagttgttggatctgcatgcaagcatgctactaaaaacataaacgtgggagtttactcttctgttcttccattctcatccaatgattatgtgggctcaaatgattatgtcatggtaatatcatctataagtgttgcattacagtagaataaactcaactgctaatctgtacttgctcaagcacttgatgagtgctgggagatctctgcctactaactgaatttacaaaatgcaggcaaaattgatctgatatacaatggagatggttgttttctatacaagggagcagatacaaaggggaggggattttttcctaaacaaggagataattacattgaacctccccggttgaaggttaacctcaacaacctaatatgctcaactcaggtgatcatcatgataactattccaacaccatctataatctgttacagccttacaggcaacttcagttcagaacaaactgcaggcagcaactcatagccatagcctcagcctcataggagtttctgggttaacaccagagagcagtgtaggcaaatgctctattcaagtctgtctgaaaaaaaaagggacttgagaagttgcatgccaatttgtagattgtcaagaatgtgttccatccccatgctcatgggaaagggcatgagagcagctactgttgtgactcgacgtcgttcctgactctgctgttgttgctgtcatggctgctcctggagctcgagtccggagcattcgtcgagccgcctaagtcagccttgcaaagagggcacagtgcgtttatcttgagccatttatcgacgcattccaagtggaaaacatgattgcagggaagctcccgtagatcttcgttgtttgagaactttgacaagcagatgcagcatacctgcagagcccagagatccataggtgtcaattgcatatgtggaaacatgctacagacgtgtaaacatgagcatagtatatcccaggtttggtaaagtgtaaacaggaatgcaggaggacactcacagcgtcttctgcagaaatagttcgctctttgtctgttccagctgccaatactccaccattatcttctcccgcttctccatcttgaaactttttcgattggaacttgtatgccaccaaggcatcgattgcttctgcagtagcgcctctgttaaaatccaaatcctcgtggatgcccatcatggagataatgcagggtaggcagcagcatatcattgtacataggatgaaaggcagggcatagccgatgaagccgaatgcaaggaatactatgcacagcctgaaaaatgatcactaacaaatgagtaaacatctaagttgagaagcaaggaacacattgtctatggctgcttagcatcacagacctgtacaagttaggagcgtcatggagagaagtacggcccccgaatatccacacattcccaacaacaaaccacacagcaaagaaacaatccagagccaatttgaagcacgcaaccaatgcgtagaccctataaagcacagaaggcattgttacctcataaatgaatccaaatgttagttagaagaaagaactcagatggtttcatatgatgttgaatcttctagtatccagataagtgacctaaagtgttagaaatactgaaagcccaactgttttcaatggctaccaggtagacagcaggtgcaaagacatcatagtaaaataaattgctaaagatcatatgaaatttgataacaaaaaacagatcttctcaaatataggcggttgctctgccatagcatatcggtggttgatggttccacttaaacaaacttatgagcctgagagtgagaggtagtgcagtcaaatatactaaagataaattcccaagaaagataatgctaccttggacttgcaatccttgctactccaccattattaccactgtccacaacttctgatccatgagcagacgaaactactacataagaattaggctcatatacgtccctttcagatgaaacctgatttgttgattcttgctctgtgttctgccgattgcggtggagaaatcgccaataaaggtgaggaagagtagcaacacaacctatcgtataaccaataagccactgagccaaaggagcatgaggatgctcgttccttgatactgacaggacagtaatagctgctataatctggcttaaacttacaataagctcaattgagatccagaagccagaattcaaaggatttggttgacggtgtccttgatctcttcttgcaaaagaagcgtttcgggagatagatgcaggagttgcactagcagaactttctgggacatgaggaacatcatttagaggccctctagtttggtgcaactcatccaagttattatgattatcctgatgagatgttgatgggaaagttgcatcatttctcagtatgtcgatcgtgtgatcacgatgactggcatttccagagtcccccatcagtaatggatgactatctgcctgaccttcgcactgtggcccaacaggacggacagcaataaactagaagtttactccacacattagtttcaggacattcctagatatgtagatgttttcaattgaagttgcctttttcacacccttgcttttagtgtaccttaaggaaaggaaagtaaacaaggtgtcaattaactgcctgcctaaacaaagaaagcatgtgtgcaaggtaagacatcatatattgttggacaggattagactagaagggaagatcatagccagaatttaaaaaatactccctcttaattcttatttactacttgttatgtagggcattgaaatagtatgacatgtttgatcattgccttctctaataatatatctataataattatataactaaatgaaattattttcatgataaatctaacaatgtcatttttacatataaaatattaatgttttcttaatatattagtgatttaaaagatttcgagatttgattgcatgtattctaaaatgattatagcctttcccttaggttagaccaatcatctattctcggtttgcattttacattacaagttacttatattacagaatcaattatttcatcaacatactcctgcaatcttagaacttgactgcagatcaatctttcaggagtaattcaacaagtccattaaaacaattccagtggtaaggactcgattgcccccgattagaaagcaacctagttaaaattggattagtagaccaatgcaaatgcaacacaatagcagccatccattatttgcaactcaagaaccttacggtgatgtcagctaatacacaaatgaagcactcagcatggagaaggaatgaacaccatacctcaatgcctcagcagcaaaggtccctctaatcaccaaatctcagcaattcatcaattctcctatttcacctgaacaaacaagaaaacaatgtggacagacagcattggggagagaaagaaaatcaaacagaaccccatcccacaagcatttctatgatcctatcccattggccaagaacccaaatcagcaagaacataggtttcaaaaaaaaaaaaatcagcaagaacatggcagcagctcgtggggatcgaacagttcaaccaagaacgcaagcgaaatcggtggattcggtagcctacgctccactgaattggaactcaccgaagcaagcaatcaaccaatcaatcaatcaatccccaatccaacggagcgagaggaatccggagaaaaatcaaccataccaggtggagatcgcagcttcgattcgaggtagctctcttccccaatttctctattcctttttctccttttatttttcttacgctttcttctccccaatttatctcgcgcatttgggggctctttacttaagtaggaatccccccaggtcagcggtagaggatgaacaggtcgtcgtgaggtcagcgagggaaatttcaacgacacgtggagctcatcccggccgtttgatcagcccgggcgacgagatcggacggtcggggacgggctaagttttctcagcgcacgcgtgcagaattagaaggtttctttttagaattttttttttgttacaggcattttgattttcatcaaaagcgtgtgggattaggttgttgcaatagaggttaaaattacaaaaggtaatatttgcttggctaatgttaggtgaagctttttggctcgtggggaaaacacattttcctcgttttgttatgagacaaataaatacgtgctggtaaaaaagaattg

SEQ ID NO: 42282 - DNA, 7975 bp, Oryza sativa
atctcccaccaatagccaaaattttcccctgccatcatcctagttttttctcatttttttagtgggactccagtacacattgtgaattctcttcttatcaattgggattcccaaatatttcatgggaaaagcacccctttacaagttaaaatatgacagtatatctcttctttttcttgggcccctcctaaacaaaacacctcaattttattgaaatttaccttcaaacatgacatttgttcaaagagacacaagatatacttcaagttttttttgcatactccaggttatcctccagcataaagatagtgtcatcagcatactgcaaaatcactatctcatcctctgtatattccagccctagccctttaaccatcccctgttccactgctctattcattaaaagaggtagagcatcagctgtaatatcaaaaagtagtggagacaaagagtctcctttctcaaacctttataggtttggaaaaaaatcccatatctcatcatttaccttaactgccactttaccctcttcaacacatctcatgatccaatcacaccaaacactagggaagccttttgcttccagcatctaacatagaaatggccattttattttatcataggccttcccgaagtccaccttaaacagaactcctgattgttttttcatatgaacactatttaaaacttcatgcattatcacgactccctccatgatgtttctttctttaagaaaagcagtttgtgctttctcaattaagtcagctatgacataggttagcctcttcatcagggttcttgttatgattttgaaactaacattaaggagacatattggcctaaacttctgaatttatgctgcatttttgcatttaggaattaaggatataaccccatattttagtcttttgatatccaaaatcccctgatgaaaatcatcaaccataacttttagatcattttttatcaccttgcaaaagtgtttattaaaatcagcaggaaaaccatcaggcccaggtgccttgttacttccatttcaaacacaaccttcttcacctcttatagagtaaagggtttcaacaattccttcttttgatcttcagacaattgtcccatctcaaaattttgtaatcttatattagatctttcaggtggcccaaacagatctttataaaaatctgttataaaactcaacatctgctcttgcccatcaatcaacacattctcctgttgcaaagaaaaaaaatcatatcttacctccttctcccattagccttggcatgatagtacttagtgctattatcaccctctaacacatctctctcctttcacctttgtaaccattttagcctctcctcctcatagtaaaccttagttgatcctccaatctccctctctcttctctgctcctcacacatacaccatgattctcacaccatttgttaactttctaactcgctcactaatttctctttttctctcttataatttccttcctaattcatatttgaacccttaagagctttccttcaatctctaagttttctttgccattttttctatatttgagatatcctctttattattcccctaggcttttctcaccacatcatctacatcttctctcaacatccaactattttcaaacttaaaaattgattttttttaataactgatatgtatccaacagaataggagcatgatcagaataaatcctcttcagactttctactattataatggatacttcccctcccagcttttagagagtcacctgattattacaccatgtgaacttcctaccacacatactcaactcccacaaattactttgattaataattgcattaaacagaaaattgtatttattataacatcacttcttatttttatcactttcttttttaattatgttaaagtcaccacaatagcattggatgagactattctgacaaaccaaatttctgctataaactcctctaatgttccaaaaagacatttaattttcttttcttatatttattttacttccataccctttattcacttttggggttaacttaattttaaggggctccttttaatttttttttcattacccaaatctctaggtctaaatttgactttataggatcttagataaattaaaattagaattctccttatcagagctgttaacactaattaacccattatcatctacctcatgtggagcatcctccactttattttccacttccttattaacaaattaatcctagccactttaagatccctaaacaaattagcaagaaggaattggagatacttttgtttatgaaagcattcctgatatcggctgttgactagaacctgcaactgtgagagaaataagatacaatttaatcacaaattcagttacaaaaatagtgcgatttttgaaataacacgaaaatacaattacactcacaagtgtctacgaaaatacaattacactcaccagtgtctcgtaacagcacaagatacaatttaatcacaaatgcagttacagaaatagtgcgattttcgaaataacacaaaaatacaattacactcacaagtgtctacaaaaatataattacactcaccagtgtctcgtaatacaaaaatataattacactcaccagtgtctcgtaacagcataagatacaatttaatcacaaattcaattacaaaaatagtgtgattgttaaaataacacgaaaatacaattacacttacctgtgtctcgtaacaacatatcactaacagggcaaggacgtcggctgggacaacagcgagagcaagggtgaattgggagacgcttccagcagcaactgaaggaagacatgtagagtgtataatatgctgaactgttgtcgcttaggcataatctgtggaagacatctgtgacaccctgcgtagacagggtgatagatgcttttgcccttcctatcgtgcttttgttcatcccggcttccaagtcacggtacactactcaaatcaaatctgcaaccgagccttgcgggccctaaatcacaaatggaaagggtcagtttgtgtgcaatggcgtataaatattacatttacatgtagttttctttttgaggaagaagctccattttttcaggaagaagctctatcttgttatttggcggcttgcaatataagctctcgcagcatgcgggtcagcatgggagtagtggttgtatgaattctagtacactcatttctgagatggtttgccatgtacttaatagaagagcattaaaagaaactgcagaccagacaccaaaagcctactctcgacttcgcttcactataaatatgaattgtgaagggccagagaagcttcccttggattagtgttcttcggcaaccgtcatatctattatgcatgaagaacaatcacaaatgactatacataacataacaaacaaggagattattaggggagagctacaaatcggatgtccgatgatgtaaaaaaatcggacggtcaaatgtttcagttgactattggtgcaacattaagttatacatggtgaaacaaaaaaatcagtctctgaaacatatagaaattttgtgaaacacaatgagaatacatggtgaaacatattgctatcacgtatgaaacaataagtttttattgtttgaaacatatgtttttctttcatcagaatataatcatgtgatatcttgttgtaaacatttaattataacgaattcaacagtgtgatcgaatcgttcatcggataaatagtttagaagaaaaatatttttaagatcactaatatatgcaagcatccatggtgtgggagggagccaatagaatggaatggcaggagagagaaggggcaaaagcgtctcataattttttggtcattagtgaaacattgagttatacatggtcaaacacaaattcaattattgaaacatttaaacttttttatgaaacataatgaaaacacatgttgaaacatattgctaacacgtctgaaacattaaatttaacggattgaaacatatgttttctttcatcagaatataatgatgtgatatgttattgtaaagatttaattataacaaatataatggtgtgttcatatcatagattagataagtagttcagaagaaaaaatattttgaaaatcattaaagcatgtatggatgtgtggagtggacagggagatagtagtttgcttgtccgatttttctcgttacgtcagacgtatgatgctaagcattttccagaaaaaaaaacatgtatcctatcttcctatatatataaagttgtatctaatcatttaaaactttgattttattaaaaataacaaatctcatggcaatgtgtgtggtgccaactagtaattaggctgggttcgttccgtggggttgggatctaatcctcaagcacacaaaacggagcaacacattagcacatgattaataaagtattagctattttttaaatatgatttttaatgcaactttcgtatagaaattttttgtaaaaaatacatcgtttattagtttgaaaatcatgcgcacggaaaagaaggaggtgagttgggaaggctaggaaacgaaattgatttcctttagaatacagggaagtaggtaaatgctgatgagaacattaggactcctcataacaagttcatctagtaacttgctgaaaacaattaaatgaatgttaaaaaaaacgatgagtttttttgacaattttattacaaagatagcacagcagcagtcatatgtcacggttaagaagcctcttaaaatcagcacattcaatatttatcaactcttgatttgaataggtggattcaatactcttcagggaagctatatggttataaaacatagcactcactttctctagccgatcattcaaaataagatgacaacactttacttttcggcagtgcaagagcaaaagaggatgttttatgcatcacctcctgccactgtgttgccaaggaaccctgccaatcgtagttaatgatgtattcatggatccacatcatcaattgtaaaccccatagaaaaataatttcagatatataggttagattatatatactagtagaattgtcccaaattttgaactcttatatcgggcattctgcattcccaatttccctagactctacccagtatttcgcatttctaatttccctagactctttacagtgccatccgcctacgcgtcacagtccccgaagatgacggatataagtatactattatgcttaatatttataagaaaatgaaatttttatgtgactttcaccaagcaatttggggtataggatactgttcctaacatgtaaggttatatggcatatttgatcctagctgtgtagggtgacatgaaagattaactatttctggcaaataattataaatgcattatgattagttataaatgaatcatgtaatatttatctcatagtgattgttattcatcaaaatatgggcctagacaaccgccgtcaccaccactagatgtagaaactgatgatgtatctgttatcgttggtgaaaacaagagttacgaaagtgacaacaattagtgtgtgatgtaagtctgtattttcctaaatgactatttctataatgtatataaagttgtgttttaattcattttctagaacaaaggtactcatattaataaatagatacaaatattaatatttttatttttattgttatttacttcctccgttctatattaaaacattttagttttgtcgtaagttagatttatttaacgtcgaatgagtttagagaaagatggattgatatttgcaatgacgaataaatgtatatattatatatacttattactaattttaagttatataacataacataaggtatatgcatttgtacatagtaaaagacacaattgacttgaatagtatttataatgcactatgatcattagattcataacaaatgttacttttaaatttatccatataagttatatatatatatatatatatatatatatatatatatatatgtttattggtattatctaatattatctatatatattattaattgagagaattctagattatgttttaaaaaaatgtctctcaaattatagcaactagttaaataacttggatgcatcaaaatctctctcaaattctaaaatttgactgacgaggcatcgaaaacaaatctttgttctcaaccttaaagtttactaccttcgtcccacaaagaatgcaatcataacatttgagataataattttgttagatggatagagtggatccaattaacctaaagaagtattttcaacaccctggtataggtatatgcatgttttatacattgttaaataaaatatgaaaaattacatgttgtatacattgttaaataaaatatgaaaaatttggctagatatattatgataataatacattaccatacaagcaggcaactacaattgacaattgaagaaaattaaaataataaattttgtctgcacttatttttgtttcttaaagaacaaatcacttaatcatacatgttgatatatgcacttgagcacttctaacatcacaatcaatctaatcttttttttctatttggatgacatacaaataacggagattgcacctgtagacagtaatatgtccctgttagtgatcccgatgatggccgtggagcagggtggaatggattctaatcccgggtttggagtttggactataattactccctccgttttttaagagatgacgccgttgactttttctcacatgtttgaccattcgtcttattgaaaaaatttatgtaattataatttattttgttatgagttgttttatcactcatagttctttaagtgtgatttatatcttatacatttgcataaaatttttgaataagacgaatggacaaacatgtgagaaaaagtcaacggcgtcatctgttaaaagcgggggtagtatcagactaggaaattgcgggaacaaattaactgcgtatgaaatattggaaatttgatcacaccgtaccatactggagtaccacgttgccattgatcaccgtactaccagatgtacattattaggaataacgagcagctaattacacaagacgccgccccgccggcgagcactaggagctaggatgagccggcgcagtcggcgccggcgaaggtgaccgtgccggcgtcgaggtcgtagccgacgtggatgttctgctgcgcgaggttcccgaggatggacaccggctgctgctccgtcgtcgccacgattgccaggcacagcgtcccctcctgcaccgccacgaacgcgttctccggcttcagcgccaccgccgcgccgccgccgaactccagcgtcaagtccgggatgctctcgccggcctccacctcccgcccggcaacgttgtagcacagctgcagcagcccgtccggcgactgcaccggcggcagcgtgatccggcgggagagctcgtcgacgatcggccccagcagcgacgggtcgaggaacgtcagcgtcgtgccggagtccacgatgatgcgggagctcgccgccgacgccaccgtcttgttcccgaccttgacggagtcgaggaccacggtgtagtacgtgtccacgtcgccggcgacgagcggcgtgctcgccgcgccgggctcggtgacgtcggcgagggcgccgaagttgagcgccgacgaggcgttgacggagtgcgggacgaggcagtaggagaatctccgcccgagcgacgtcgcgccgccgagctgcgtcacgagggagaccgcgccgccgccgaggccgaccagaccgtcggccgggaacgagccggccgtcgcggtggagcagccgaacttgacgccgccgacgcgcacctggcgggggctctccccgagccgccgtcgtcgaaggtgaaggtttcggtggagaggacgccggtggtgttcgacccgtcgccgtaggcgtag

SEQ ID NO: 42283 - DNA, 10361 bp, Oryza sativa
ttgaccgtcatgaggtactcgaacgaccgggacacgaccttcgacacgacgtcgtccgccgcgccgccgccggaggcggaggaggaggcggagcccgcgatcgcggcggcgcgcgccacggaccgccgcgccgccgcgagcgcgcggccgtgggcggtgaacgccgggtcatggaacggcgacctgggtgagtcacggtggatgaactccacgctgaatccgccgccgctcgccgcgcactcgcacagcctcccgccggcgacgaggaggacgacgccgaggagcacgagcacggaggaaggcgccatggccgccatcgtcgaacaccttcacacagaaactcactctctactcctcacgctgctaatggcgtattcatagggagattactcgtaacgtaaatggtaaatcacgagtgattaaggggggtgattaatgggatgatgagtatgaactggcataattacatactactaatcacctgtgcatgcatggaaacatgcaaaatgacgatacagatagctttggcagtggagattttgattggaaggagagatacgttttttaaatttttgcgcgttaaactgatcctttggttgagctaatttatatactacctattttggatttaagcattaaagaattcttttttgagtgtggatgatttcaatgtgtgtgtgtaaattcggtgattaattaatatccagcaatttttcctgtatagtcaattaatcatagcctattcggtttgatcaattgtgtctatccttccattatttgtttcccttagtgttcattacaggttgttttctcttgttctttttcttcttctctcttttttttttgaaatttcagtagaatttgcataatataagaggatttgattcctatcggcgacgggtcgaggatgtgagtaaagtcctttcaggatttcagcctggcccatttctaaacagcacaaaggctgcagatcttgcgtaccattcgcctaagtccagtttagtcccgaaaagcccagttcagtgggccggaggcccgtagataggatcatgagaggagtttctttttctttttttttctgagaatataagaggagtaaattcatgttgggcctagaatagcataatgaccaattgatggacctctacctgtcatttcatcacaactatgatttttcttttttcagaaacaggaaaaaagctgaacagtaaggaagtttcgtattttccctacagaaatactaatttgacatcattttgtctttttagtagtacgcaattttttaacatatatcccttccgtcttagaaaaaaaagatcaatcctagttatgaacctgtacatacgtatccaggttcatagctagaattgggttttttatgggacagagtagtagttagtaggaataaatttcaatttttttgattcaaatttccacacatggtgttatctgggcagtatcttggatggttctgcaggaggtgagacaacattgcacagtgtcaaacaagcttagacgtcttctattattatgtaatatttttgtaagatatggttagtatgaataatagtcaaatttgtttcatacaaattctcacatgatgttatttgcgcaatttcttggatggttccatgcagcagcatggcacacaggcgcagtgtcaatagacaagattagacaactagtgagatttcagaggcaacaccaattgaacaaccctatttgtaaccatacaacctctctaattaatagtctaattagtcagtggtgttacttgcaaatgatgcaaagtggcatctgatgcccctcacttggcagacaaagtgtaggttgactgaccaaacaaagccctgaattacctcgtcttcacagacaagtcattaccaaagagaaaaggtccatcttttcacaggaattcagaaaagaaggaagtaccagtactatatatcactgcactaagcaaaaacaatttgactattagcaaaaagcatccacagcttgaagaaagcaagtactagtagtagcaagaagattctaattgacctactgtttgtgcaaatggcctacttaatggttcaattaagtaggcacaactaggtactcctaggtgagtatgctgtttgtgacaaaatgaataaatagagagatgtgacaaaatgagtagagatgattcttttcagatagtagtgtcatttgtttagcacaaactcatgtttgtacaaatgatgggactactaaattccatgaccaaagtgatgagtaagggtcctatactaatgtaattccttgtcttgaataactgtattaacagtattcttctccttctgaatactgaacctgaacatgcaacatgcagagcagagacatggaagattcaggatcaaactggatactgcagatcgggggcagtacacgcttttaaagtagtaggaaatctggaaccacgaggatttgattctgagtagaatatgatcagtactatacttagcaactgaatttggattaggttaatcgttcatgtgtgattaactaaaggggagagggattttgtcaagtcagaagggcgtgcaacctgtttgatactgtgatccctgaagatctctggtgttggtctggtcgagcagagcattttggatacgcaagtgcagtgcaggtcgtcgatcggtcgctggccgccctctctgaatgatcctgtcgagagatcccaaacaggacaagaccagaccatcaattcacaaaagaacgaagttttgcagaatattattccgtccgttttcaaataaccgataattttaactttgctatctaaactttaaccactagctattattggatggttagactaaggccgagtttagttccaaactattttttcaaacttccaactttccatcacatcaaaacttctacacacacaaacttttaattttttcgtcacatcattctaatttcaactaaatttccaattttagtgtgaactaaacacaccatggaagcgaacaatgtaaaatttttgggaaaaaaaagacgagccattgaagcatgaaagtaaatagtgtcagctgctggttattttaaaaagcagggagtagctttgaagagcaaacgaattttacacaaaagttcagatttttttaaagagaaatttgtgttgttttttggggtgaaaagcgaggaaagtcaagagaggggacaagcaaccgacaggggggcacaatcacatgtccccgctttatgctactcgtacctcattggctgttcactgatgctgcctccgtgcccacccaaccatttcactttcacccctctcaaatccaatcccaattcgattccaattcaattcaattctggaggctatttactcgtaaccgtgtgactcactccatctaccacagagtgtctttagttcacgtcaaaaatagaagtttggttgaaattggaacgatgtgacgtaaaagttggaagtttacgtgtgtaggaaagttctaatgtgatataaaagttgaaagtttgaagaaaaatttggaaactaaactaggccacagtctactacgatgctactggaagacaacttgtttatttgatgagtaaatttaataaaaaaccatgttttgagacactcataatggagaatccaaaacttttttatagtttatttcataaaatcttagattttagggtgaaatattttacgaaaactcatggtacatgcttatgacatccatttaactaatatatacatatataattgtgagaaaattgtatgagatattttctaagttatgtagtagtagatgaaagttccttttttttaaaaaaaatgtatttttaaaatcatgaagcaaataattcgtggtaaaaaataggacaaagtacgaaaagaacatggccatcttgagttttcttctttgacttctctatttcttacattctaaaattccaatttagagtgacaacttaagacatacaaatactgaagttgtctactgtacgtgtgagttcttacgtcaactacagtaaatacatacaacatgtacagtacccattatatgtttattattttaaaaatgaaaactaacatttttttatgtttaataaactcatatcgttgtcttgatttttcttctctctatcttgctgtgcacgagtgcctgttttattattattaactgacgaacggattctttctcatccaccgtacgaaaaaggaaaaactacgggaaaggcaccgtggccgtcggatcgggatcgtgcggcgatgagggtggcgtagcgtggagccggtcgctgcagggcgcccaaccgacagcccgggcccactgccgggagcgacccgcgcgaaatgctcggccactatttccttgtttattccgttttgggaaaacacacaacactaaattaatttcccccctttttgcacttaactcctacctttcctatcttttcatctctaactgcatttttccactaacttcagtttatttgatttttatgaaagtttggtgatttgaaaaccatcttttatgcactggttagattacttgttgtaaactatttgtaaaaattattttctgaaatatttttatttttataattaaatacatattcctaaaaaataacgtaatgattaataatctacgtctctctattccgtattttatattataactcgcattgatttttttattagttaaatttctttagatttaattaagtatataaaaaaaagtttgcaacagttagcaacaccaacaataccaaattagttccagtaaatttaacattgaacgtattttaataacatcttttttttgttttaacaatattactagcattgattttttttattagttaaatttctttagatttaatcaagtatgtaaaaaagtttgcaacagttggcaacaccagcaatacaaaattagttgcactaaatttaacattgaacgtattttaataatatgtttgttttgtgttaacaatattactatatttttctacaatctcgatcaaactgtttttttatataaaaatgattaggaaaataccaaaacaaccaatcaaacggggaaagtaaaatgtaatttgacatgaggtcaggtgctaatgtgtaaaatggcagtcccgggtcactgaccgttttgaccaccggtgacctcccagctataaccaacccaacctcttcccttctcccattttgctttgctttctttgctttcctctcctctctcgccgcccacctcgccgtcgccgccgccgcgagggccaacgccggcgaagtccgcgagccgaagcatcacacagctgcgccagcgatgtcggtggagacggagcggagctccacggagtcgtccgccgcgtcggggctcgacttcgaggacaccgccctcaccctccgcctcccgggctccctcgccgccgccgccgcacctgaccccgaccgcaagcgctcctccccctcctcctccgacgccgccgacgccgcagacaactcctcccccctcgccgccgccgccgatgctccccctgctcccaagtatatacaatacactgcctcttctcttgtgttcttgcgcgcgagaggtttgattgggtggtgtttggattgattggtgaggttgtggtttgtcagggcgagggtggtggggtggccgccggtgaggtcgttcaggaagaacgcgctggcggccaagttcgtgaaggtggccgtggacggcgcgccgtacctgcgcaaggtggacctcgaggcctactccggctacgaccagctcctccgcgcgctccaggacaagttcttctcccacttcaccatccgtaagctcttcttcttcatcatctctcgatccatctgattctgttggttgttcgagcaattgacgggaggaaagttgcagggaagttcgccgacgacgagaggaagctggtggacgcggtgaacgggacggagtacgtgccgacgtacgaggacaaggacggcgactggatgctcgtcggcgacgtcccctggaagtgagcctcttctttgatttcttgccaaccttttccttttccccttgattcattcatcacttggttgtgaaattcgtgttccagtgccagatcttagtatgattcttgatggttttccatagtggataatttgttggtctggttcttggaccgaccaggttagaatgtcttggctctgattcgttcgagaaattcagagtacttcatttgttgatttggagctatacataactgtagaggctttggtactattgctaaaagtggtattttgtgctgatagagatctgaaatgaatttggtatatagatgcatgatgctttacgttttgggtaggaagcagatatggtttgctttgcttgtggttttagtctaaaaatgggtgctttttatatgttgtgtggtctcatggatatgctcttagttgttgacataatccaatgcaagttcatgaatgcatttcaaagatttggagttgcttatgtggctctggtctgtgttgatctgaagaaaggggggttagttagggatctgaacaaataatgcattactaacaacaaatcataccctgattccatagatagtgaaaccccttccctttcagtcttgaggttaggttacattggaaatgcagattggattctactagtggccaataataggaagttctgtttggttcttgttgcactacgtcttgcgttactgttgcttccttagcagattaagcaactttgatgtatcacttccaaataaataaattgatgtgcaatctctctcctcctcagagcaactagcctatgaggcctctgtacaataaaaagaagaaccccactttgttaggatagactactttggataagcttgcctttctagttttgttctccactacctggaacacactgttcattgacctatgggctgtgctatgaggcgtcgatccttcttgatccttctagctaaatttcgtttgattaatttttgagattgtttttgtcctacttattatgtttctttatcttactttttggtgaactgcaacagttctcatgaaacagtaaatggcacaaatgctctctttttatcttcagcagtttctgaccttaatggttgtgcaggatgtttgtggaaacttgccagcgccttcgtctcatgaaaagctcagaggctgtcaacttaggtacatgtttgcttagttgttttaaattcacctgcctacgcaagagctgtttttactctcttttgtacctgcgtcctcagccgtcttgttctaatcggtttgttctctcccttgcagcaccaagagccgctcaatgaggcattcccggtgcccatgaccgtgtggttggattgaaagaaagtggaagctttgccccgccgatgttcgcccacgtgtgatatgaacatgtacagttgtctcctactacttttggttccttgatgatgctgagttgagaaaaaggttgtagtttcgttactcgtctgtagtctctccatatatagataatgaagcactgaagcttgaaatatacacctacagtttgtctctttatgaataagaccatatacgcaaaaaaaccgatgttctttgctgcggctcgcgtgtcgtcaggctatatgcagttttttgtcgcaccataggcgatggacatctctggccttatactttcgtaaaaatcttatcatgttaagcgatggtcttgctttggagttcatagttctgtgctctatgatgtgcaatcagcttggtgttcatctatatataatcttttgctgctgtattctggttattgtactaagttgtaactgacgaaatgatctcttggatgttagtgtcttcgctgattgatatgagctcgtatctattgctgctgcattctggtttctgtaacgaacaaaatagtttgttggtgaggctgaaaaacgttattggaatgttcagtgttttactctgaatcatatgtgaacatatcagatgtgttagtctgaaaaaagagcaataattgttcagttgaaaaaggatgatggattcatggatgagcttaccctaccccgggccatgttcttccatggacgctttggacagaaaagaagaacagataagatcagatcatcgaacgacaggtcaccgtcgtcgttaaggacggcggcgaggtcgctgtcaaaactcgcctgctttttccacaagatgggccatggcgtgacctcaccggccggagatggtcgccggcggcggcgacggatcgacgactacggttgctcaattttctttgctattttttgtgcatgggtgagaagaaaacgacctctctgatccatgtcggcctatactgcggcggcaaccgtcgtttcttcatttgttttctgcttcgagaaagcgatgctacatggacttgtggtggtataaaattagaaattataaatctgatcttaattatttaagttgttgcgagagggcatatatacacctgcatagcacttcaagatttcgagtttaaatcttatatcttgatggatatggagaatttcaaattgagttatttgagagagtaagttaccactttaaatggctgtatatattcaattcgatgtagaggataggtaaaaaataccattgtttataaaaaataaaaaagttatgagttgttaactgcaggctccgttatttggaacttggtcctgaacattagtctctttgataaacatagtatttgacgtttaggataaaattcggacacttttacaatccaaccatcattaattccttatattttagttttttaaaaaatattatgcggagaactgttttgaaaagcactctcgtaatgtcataaacttattaatattcgtacaatccttttagtataaaattgattgttagaaatcttaaagtttgactaaatattactctaaacatcaaatttttatgactaatgctgaatcttttttattgcgtgatactcaatggtttaaaagttctgtatcttttcaccttggggcgaagaaaagtttggaggacttcatgcttactcaagctacagtttattagaggagatgattagggatttggaatgtccatggtcaaacatacccatcatttgattagagagaaaacaatgaacgaattgaccacaatttctcatcaagtggatatttcatatttgcgcggaggaaaaaacatgatctaactattttacgtggagcaccatctatgataggttaattgtttctctatctggattctatggcaacgctacataccctctgtttccctccacaaataatgtccttcaaatttaccatcagaatctactgctctctctgtttaaaaaagaaaccaatttagatgggatgtgattctacccaaaactttttatccagattcgttattttatgtagagtcatactccttccagcctaaaaaaaaactaatctagttgggggatgtgatccttaataggagaatgaatcttgactatcttaggttgagtttttttttgaaacggaggaagtacacatctatgggtgtgtttagttcacgccaaaattgaaagtttgattgaaattgaaacgatgtgacggaaaagttgaaagtttatgtgtgtaggaaagttgatgttataaaaaagttagaagtttgaagaaaaagtttggaactaaacacggcctatattattttttctaataccgagggattacaatgcagcaacgaatttaaaaacacgaattaaactacacgaaacggaaatgacacgacatttctcgaccgttacacccgatttcccaattatcccctcccaaaacggaagcaataaaaaaaaagaaagagagagaaaaaaaagccgtaacatccaacggctacgattccccggtccccatgatcggacggccgagatgatccggcgcgcaacgcgcatgcgcgttgccagtgaccaccaccccccgtcctctccaaaacgccaaaaatttttcccccactgctccccactgctttcccctcctcctccccgcgagatcccatccatggtggccgcctcccgcccccggatctggccctgacgaggccgccattgccggatatttttggccctcctgccatttcctgaggtgtcctgtcgtttcccctttttcttttttcttttttggcccatttcttgtgaggtgctttctttgggttgggttcttgatccgtcgcatttcgcgcctggcactcggcgatccgttcttgcgatcccccgcacgttgcaagcgcggatttgttgtttttattattatttttttttgttgtgatttgcggcgtcgtgttcttggtgctggctggcaatggtggtttgatttggggggggggggggggggtg

SEQ ID NO: 42284 - DNA, 8118 bp, Oryza sativa
ccgagcgcctcgccgccgccgccgccgccgccggccgccgcgggcgccgaggggaggtccagggaggaggcattcgtccagaacgtgaacatctgctgcgcggtgttcgacttctccgaccgcgggaaggacaccaccgagaaggagcggaagcggcaggtgctcatgtcgctcgtcgactgcgtcggcgccgccgaggagcccctcacggaggcgatgatcgcggcgagcgtgcgcatgttcgccgccaacctcttccgggtgttcccgcccaaggcgaggtcgggcgccgcggcgtcggagacggaggaggacgagccgttcttcgacccctcgtggtaccacctccaagtcgtgtatgaattgctcctccggttcgtgacgtcgccgatggtggacgcgaaggcggcccggaagtatgtcgacagctcgttcatctcgcggctgctggatctcttcgattccgatgaccccagagagagggacagcttgaagacagtgttgcataggatatacggcaagttcatggggaatcggccgttcattcgtaaggccgtcagcaatatcttctataggttcgtgttcgagacggatcatcacaacgggatagcggagctgttggaggtgtttggcagtgtgataagcgggtttgcgaagccattgaaggaagagcacaagttgttcctatggaaagcgttgatcccgcttcacaagccaaagacggtgggtgtgtatcttccgcagctgacgtactgcatcacacagttcatcgagaaggaaaccaagcttgcagggactgtaatcagaggcctgctgaagtactggccagttacaaacagtcagaaggagatgatgttcttgggggagttggaggaggtgctcgagttgaccgacatggctgagtttcagaaatgcatggtaccgctgttccgcaggattgcaagttgcctgaatagctctcactttcaagtaagttcctttccaaattcagaactttaatttgaattaggtatcgattaatgtttgttcatgaattgtttctcttctgtgtatcacgctctgcatttatgtttgcaactatcctgtcctaaacatctgaattgcttcatgaagtagttgcaaagctgtttatcagtggaatctaattcttattttaatccgagaatcgctttgggatctctttcctttttctctgtgctttttctagtatattagtgttacctacacggtccccttcacctttttatgacagtcattattgagaagatatctcagcagtaggtaaactttctctgtgttggctaaagtgagaccatacacacttcttgttcactcaagcacaattggtggcctctaacacttccctttggtaggcttcagaccattgttaattaagtatacaactggagctgaaagtagtttaaattatatagttctgctgtgcatcttggctcatgaaccatgacaagaatcaattaggttaggtacaattctaattcccattgtcattccatttgatttatggaacaactaatgacagtcactctccccattatggaccctaattttctattatctactgatattctatttttctggcatatgctgttagagctgataaaacctttcatcggtaagttaaacgtttttacttcttgaataagagagggcccttaggagttaggactgaaacatgaccagagctgtgatagcactgcagtctgcggtcttcatcttttaattcttgaccatgttaaaatttctcttcccgaaaaagaagttgcccaggaaactaaagatctgattttaattatgggcaggttgctgagagagccttattcttgtggaacaacgagcacttgttcgatatgatctcccaaaatcgtcaggtgatcctaccgatcatatatccagctctggagaggaacacccgttggcactggaatcagtcggtcctcaatgttaccctgaatgtcaagaaaatgttcttggacatggacgagagattgctcctggcctgccagaacaacttccaagcggaagaagagaagcgagccgcgaccgaggagcggcgaaggctgatgtgggagcagctggagcggaatgccgctgcggcatgccatccacatccagtgatcaccactactgactcaagctttccttcacccccttcatcaactcctctggtagctcccactgtgacatgacatgtggatcaaatatactccatttccacttatttgttagctagctagatgatgatgaagttgcttgcttctcctgggactatacagaaggcattttgttaccttcgtaaggcccccccatgtcaaagtctgtaattaatagttgatggtttgaggacaaaatgacacttgattttttcttctttttttgtggtgtattctcgagtaatgggcattgctttctaggcaaaatctttgattggttcatcctgagtgagtgatctgtcaaagtgtggacaacaatgatttttgtgtgagagaaatgacaagtttgcagccgttctttgtggctaagaacttctgtctatttttaacaggcacatttttagctacagtgtaataatatcagatgcacttgtatagaaacaaaaagggcttcgggaacagcttaaacaaattgatttgttatttctgttcaatggactatatctggatggattctatggagaagaaaacaagagtagctgagatttcagaagaaataaaaaacatctctttcaacatttgttgtaggttatctgcctggtcttttcaagtacttttctttgctaaaccacatgagaagcatctcttcaaaaagaggactaactgaaacattgacaaaacaagatttgttgctcaaatcaaacctaaaacaaataatagaagaaaatgatggcaaggacaagtatactccctgacgtcaaactaacacatacataatcttctggaaattatctaggcccatctctgatgcgcctacacttgaacttttttaagattggaaatggtttataatcctacacttgaatgctgtacattagcagcctaacggattgatacatctggttacaaatgtgcactacatattgtgttattcaaagcacggattcagtcgtcctgtctccttgagtatggataccacgctgctggaattcaagtaagaattccttgacaagtgtgtaccagacgctgttaaataaatatttagcacccacaattatgcttaggtggataaactgctcgaatctcgattacctgcctagtggccgcaattattggcccttaattgtgaggttaatccgtggccattttgacagcttgagtttcacaaaaaaatagcactaccggttttaattgttaacttaagaaataatatttgatcattcgtctatataagtactatttattttagtgttactttttctattatcaaatgcactttaagcataacttatattttacattttatgctaaatttttaaacaaaatgaattgtcaaacgtcattatctaaaaatcaatatcgtcatatatttaaagacataataagagtatagtttttaaaaggatttgaagaaattccagcgttccaaacagagattcatcagtggagttatctaccagtgttcatgtctactagggaaggtcgcagtttgacgtgtttccaagtgatatgttttcagttcagacctgagctgagtttccttataaaaggaagcctcaagctgggcatcatgtgacccatgctctgttagtgccttctgtctatctatcccccttgctggtttcttcctcctcttctgcgtcgtcgacttcgtctccggcggccgcggcacgggcggcgatgtacaaccctccggcggcgcaggagatgtcctactccgaccatgtcaagaagcgccatgaggacaaaggctgcctctatgcatggtgatcctcttcttctgtcatgctcttctaatctttcagagaagctgttgatgctattttatgttgcttattaatttggatgtcatctaaactaggttatattctctagattaggatgtgatctaaggtatttttcaaagtagaaattaggacatgtttgttcatcttggatgcactgttcaacatttctcaaatcatcagatagttcatctagtttcttcagacaagctgatttctgcatcatgtgagcattgaacacactcctaaagtcctactagattcagagatggatgagctgaagtagttagtggtcattttcatgtccaagaaaaccaaagatcatgtgagattttgccctgatcaagagggcttcttcaccatttgacaccttttttcctctgtttacctgtgatctctttccctttttgttgcagcctgttcaccctctgctgctgcttctgctgctacgagacctgcgagtgctgcctcgaatgcctctgctgctgctgatctccttatctcatttcagcagtcaaaataatgatgatgatatatcatatatagtcaggaataaaagatataatatgccgtttgaaatgcaggaatttatttttccgatttcaaaccatagtttgttgttgtatgtgtactggtgacaatatcatggtagatgaaactttctgaaaatttggtaggtatcagcaagatttgatctttttagttgtgctcccatctataaaatgaataaatatatttaagctgcctgccgagataaaattattaatcagaccgtaacaagcatccaactaatataacaatgggataacgtatattgtacaaatgggatgttcatgacaaagcgcacacatttctgatacaaagaaagatttctctattcaatgcgacatctgtattaagatcactagagctgaatctatccatacaaaaattggattctgtgtgaaaaattgctaaaacaacagttgcaactattgttaggaatgcccagaaagaagcaactgtcataagattttctgtctgaatttcatcagttgtattgtatgagaacctgtgatgtgttgctactgcctctaccactactctacacaactaagacctcagaagatgtatacgcacgccaatgcagtgatcagagtagtcaagaacacagaaactacattgacaccattgttgtccagtatattccgtcctgaaatcctggtgaccgtcggaccgtctactccaaccacctgcataaacaaaattcagaagcaataaaaagaaaaaatcaacttctgattcaaaggcaactagggtatatagacatctaataacatcaattgcagaaagcaccatacctttttacgaagactacagtacccactgtactggagtgttgcgcccagcaacgaatcgatcagacttccacataggccagctgctgtagctaagggtataaccagcagctgcctccagaatacatcagaagaacactgagtggttaagaatcctagtagcacaaatgtaagcccaatcgagaatccagcagccgctgctgcgagaagtccatcaatggttaccccgccattggtacccttccgtactctctggtgaagttccatgtcaaaagcaacagtgattatatgtactgatatttctctaattggtaaaagaggaaaatgcaatgtttaccttgaatgttgtgataattcgtggttccgctttgctgagaatgccgagctcagaagaccatgtatcaccattgcagcaagcataatgtccaataacaccaccaatgagggcagttacaagactagattctctcgtatccaagcacctatcgctccctcctgtgacaagtgctatcaaaactaccaagacacttgcaatgccactgtttgacaaaacttgcttcctgccaataagagtggtgtgcacctgcattagaaagattcagaagggtactttctgaaactgaaaggcatcttattcatctcaataacggtgacaacagtccttaaactttggatcccttttaaataggtgattctttttcctttgaaaaatgcctcttggataaatttgggagaaaatacaacaagacaaacttcatgaaaaatgggattgcgttccgagttgaatcttgaaaggaagtaggcatacctcaagttaataaggacaatttgaacagtttaaacagtttcaaatgttgtcaaactacatacttcatcatcaaatcgagctcatttttatttttcacaatttaaactataccgagccagcgaacatggtagctgtacacactacagaaacatcacatgaatcacttaaatctaactcaacgaaccccaactttttatcatatagcagcactatgaggccctcaattcccttgttgcacaaataaatcgcatatatgttctaccagatagctattttgcctttctagagatttaccacattcccctactctactacaatcagaaccaaaatctgaagcttccactctgaatgtaaacctgccaattataccaaaagccacagcgcaatctcaaacatgtccgaggcctctctgatctctacgatattaatttcagatttcacatcattctctatttttcttggtcaccatcggaacaagaaaagaagaagaagaagaagaacagagaccatcttcttactcaccagttgcgctgccctccttccttgaagtcgggatcaagcgcgcgcttcctcttctcgccgaccctcgtcatccgcgacgccgtgaagaagaacaccagcagcatccccgcgaacctacgatgatgattcgtctcaaaaaaatcacatcagaaacaggatttttttatcaataatattttttttaaaaaaaagagaaattagccgccctttcacctgtacccagcgacggtgtgggccaccatggccggaacgccgacgaacaccgcggtggagtcgacggacttgcgccgcaccgcgcgcgccgcgatggcgccgcccgccgccaccgccaccgccgcccggatccaaactcctccgcctcctccgccgccgtgatccattgccggcgacctccacctcaccaaaccggatcgcgcacagcagcgaagaacaccaaaaaggaatcgatcaaaccactcgcgaacggaacggatatggatctcctcctctcctcctccaactccaagccagtgcagccgacacacgctactactactactgacgcccgcaaaagatacgaagcctttttccgcctcgaggcgaaggcgcgtgctccggtgtagaaattggcggccgaccagatgcttcgggaggatcgccggcgagccggcggcggtgggctcgccggaatcgcgcaggtgaaggtgaagcggaggtaggagagaagaaataagcgtgagatctgacgaaagcttgatgcttttctctcacgcgagtcgcgagagacttgtatttgtaagcgtgttgcatcgaatcgatgggcctgatcctacccgttcatctcctgaggacgcatcacagccgtacaaacatttttcgtgcacccatccaacggtccaggtcggggcagaatcccaatcctgatggtaagatagtcttgtaattcttttttttttgagaggtgatagtcttgtaattctagattatattctgcttaaaaaaacactaataatgttcagaatttcaaaaaaaaaaataaagaagaaataaggttgcgttgggcaaatcccaatcctgatagtaagatagtctggtaattctaaatcatattcttattaaaaaaacactaataatgttctgaatttcaaaaaaggaaaaatgtaaggttgtgtttggcagggctctagatctcatatttatggtacatttgaagtttgtatattaaattatattgttttaaaattttaaatttcatctaaaataggaacaaaatgatttatccaaatgttatcaacgagatcacaggtctagatctataaatttgtggagttaggaataccaagctcaaaaaaaaaaaaagaatccatagctatgtcaaaaaagggcctaatcatatgctgattccatgcatctgtgaacaaaaaactaaaaatctatccaggatagtgtacagtacatgttgtttctgaattgagacttagcttttagctaagcatcatctggagggaaccagagga

SEQ ID NO: 42285 - DNA, 11612 bp, Oryza sativa
  unsure (1)..(11612): unsure at all n locations
ggccccttcctctcccccgtcctcgccctcgaaaatctcttctcccgcctcccgtttcttcaggaccgctgaagctgaacatgctcatccgcaaacgatctgcgtctgaactctctggcactccctgcaaaatagcacaatgccatgggaatcaacattcttggaatggcggtaatggaagttttgaaacacaaaggggttctgatcagggaagttgaaccgacataggagtcttcaagatctagttgctcctggagctgccttgccagctcctcgtctcggctggtatcgtcgatgtagctttgtgctgtggacttcaaaccagcggattttcgcttctcccattcatcgagggtaaatactggagtatcttcttgcctgcctttacccttgaatctatggccccgaccatatctgtcttcgggcgcagcctgggtcattttctgcagaagcttctgtgcagtggcttggttttgaacaggaatagcttcactgactgcaacgccaaagcaaaaggtttgtaaccaactgccaccaatatactatatatataaatattttgaatggaagccaaccctcttttggtctgccatctgaaatagattgtttgggttcaactgcagactctttgttctcatcacttgaactctcattgactggtttgccactggaactaactgacacattctgacgaccgacttccggtttcctagccttattatctgctatgacataagaaaggagtccaagtggaccacaagtcacggaaacaagcaatatgaactccatatatacacaaaaaaaggaagtaatttgtatgtcaaaaacacattcacttgctaatccaaatatattgtcagcataataaccagatgcagatcaggttttccaactaaagtcatgcaaaagtgcagttcagctccatgtttttcagaataaagagtattttttatccaaataatgttatttgtttaattttgcaggacttgacaataatctccagtcagattccaacacagggaaaatcttactagtgagtaacacaactgataatcacccatattgcacccaaaaggaacaccctcgtttagaggaaatagttctgaacatcttaattcatgcatatagatttcaccaggagaatcgaattcaaacccttggtacctttatatatataacaactgccacgcataaatgccaactttacagtggacataactaagggtaaggggtgtgtgtgtgtgtgtgtgtgtgtgagagagagagagagagagagagagagaggacagaacaattaccagaataggtttgagaacgggatgtcctactaggacgtgcttcaacatctaacttctcaaatggtggaggtccaactccatcatcattttgagacaacctcaaggatgaacgagataaccctgagaatttctggttcatctgccactcttcatacaatgattggacaactccccccatgatacttatattcttcgcacttaagcacaatatgccattatgtattggaatcttgttctcaagacaaatctacatgagtcgtaaagaaggagaaaatacatgacgatgtaaaacagtcagtaaatagcaaaagcatttaggtctgaatcacggatttcaatattgtttatttgacaaggtatatattgtgtaaataatcactaagaaaatattctactgttctgtatcaaaactatgctgcagtttgctcataagcaatgattaaggatgaaactcaatagactgtaggacagagacagacagacaaacagtgggaattaggaatgctatctcccaaccccatcctgatgatgcaatataaatacaccatctctacaggtagctcttacacaaacctcatgcagcatttactaaggaggatttcagattcaatgttatcaaggagcattcttgcattttgttttccaaacattattcatgtgggatgtgtggaatagaaacacaccattgatcaatgagctatctgagcatctctccttctatttatctagttccggtgacatgggaactcaatactgaactagttaggagcctaagatgaaattcagacaaagatgaaactatgtgcagagactctgactatgtcctctaacctaaaataaagcagaatgacaaatatcagtgcacatctagaacctagatcaagaacatggtggactaaccttagtacctggagcaatatcttcaatgataaacgggattgggaaaaactctatcgctactgcttcagaaattccatcagtcagaacaaagcgcagaaggcggtgttgctgtgggttcttaaaggacgcatcaatgatgcttctatatatatctcttactgatactacctgcaaacaagtttgcattaagcagggatcaaacagtaaaaaaaaaaatccaaaacacaaggacaacagttcagctccacaaacactagatgtaggttcaatcatgatcaggaaagacaagcccatgtttcaccattgagatagacaactagacatcattgttccacagaggacgttcagatagccaccctggaacagccaagaacatctttttcatctgctcggatacaaaacccgacccatccacaaactgagaatgatacaacgcaagccccagccacatgattgaaacgatcttaagtaaggccattccctagcatccagacacaaattctcaaccttatgtccagccaagaacaccatcgtttcacaaaggcctgacacatatccatacaagaacagccaagaacatcttttcgtcagtctactcggctacaaactctggccgcttccacaatctggatacaatccccagccacagaatcaatagcagactaagaactgttcctaaatgaggcatttctttcccttattttttttaccaggaataaaattaattagaattactgagctaatatcgaaacaaaagaggggtgtcatcggaacctgtaggacgatggggccatggaggtaggaaagccgcctccccgtggcggcggcggcggcgcggtcagggagcgacttgccgccgaagagcctcaggtccacgtcgacgagctcggtctccacggcctccggcgacggcgagggggaggcgtggagtagctcctggatgatctcgttgctggggtcacggaagcaccacccgcgggcggagagggattgaaggagcctctcctgatgaggggaggccgacgaccccggcgtttccgccgccgccgccatcgcagtcggggggcgaagtgttctccggcgaggtctgggagagtgctagggtaggagacgtgaaggcgggttttgtggtatacgccatagcagttggaaagcggacatttgtggtgcttactgcttagggctttgttgtttagactaattataagtcagcttaagaaccgaaaagtctaaatctaaacaaaatattttttctggttgaatctattaatttttgataatttcagtagtgtcgtatgaatgtttggtttgatgtcaaatttcaccaacactaataccaaattgtcttgaaatcaaattagccccaaagctcaagtggatcatcaaacctggagtatcgttcagtgtcaacgtttggcagattcaaagaaaaaaaaagaaacggcatatttgtaaataaaatataatttgtgaataaaacttttatatatgtgttcttaactattaaaaacaaatgctagaaaatcttataaattcaaattttagtttataaacataaactctaaaattaaagttataaatttaaattttagtccataagcatagcgaaatgatgaatgtgaactcggaaggctgaacacagggacatgcagccgcgggcaacaagccaacaagtgctcctgcagcagggtgtgaaaaaccgccggtaaccgcgcggttaccgcggttaccgcccgtaccgcgggggtacggttacccgtaccgcgcggtacggtttaataaaattcatccaaattcaaaaatttaaaaaaaaaagaaaaaaatcaaaaaaaatagtgaaggtagtgcttgatttatagtgttttatggtgaagaaatttctcaaaaaagagtaatatttattcaaatttgagagcaaaacggagaataaatttgaaaattggaaaaagaaaaaaaaatgggccggcccgttactgtgcaacccattacacatcgcgcggtaaccgcgccaaaccgcgtggttaccgcgtcaaaccgtgcggtaaccgcgccaaaccgcgcagtttgcccgaatttttgaattcaaatttcgatttgtaaatttgtcgcggttttgcgcggttaccgcggttaccgccggtaaccgccgtaccgccgggtggcggtaaccgggcccccggcggtttttgaaaccctgtcctgcagtcctgctcatctgccttcactcctcctcatcgtctttttttttttttttaactccttatcgtcgtagagccctagattcgcacgaggctgaggtcccgcagcgcgagcgatccaaagatatccgaggtgacgccgtgtcatccctagttagccgagccaatttttgtttatagctgtggattacaaaatcctcttctcatctgaaacgttctcatctactatactatcttcaggttcaggttcggcctcgcttttgagcagaaagcccaaaaggtttcagcttgggaagagcaaaatgcggtgagaccagaataatagatggactgtttctactcactccgtttttctcaatgtaaattattctagcatttttaatatttatattgatgttatgaatgtggaaaatattagaataacttacaatatgaaatgaagggagtagtaaacttcatttacaaatcccattttaagacgaaatatttattttatttattttttgacaacgaatttaattcggtcaccacgaataccgcatcaatattgtgctctctgtcagatcatcagacgcaatattgtgctctctgtcctggaatctctcggccatcagttattcagttggcaggttggcagtaattttgacgaaattcgttgaagaatgatagcggtggggttaaaaacgaaatcttttcgtcctctcaccataataaagtttctctttttatttgttggtcaagccctttttgatctttttttttctgtctcatgcttatcctccaacttcgcggcgcaccctccgcaaacgtaagccaaaaagatcaggaaaagagacagaaaaatcggaataaaagagtgatagatagatagatagatactccgtagatactagatcagcagcgatttttttttcagtttttgttttttcatttcttcctctgtcttgtttagatgttggggttggtgagcccttggggggaatcagttggtgactgactcgagaagttcagaggttgttgtctccgaattctttaaccccaacctctcctcttctcttctcttctctcctcttcttccttatactgcttcttgggctcgccgctgcgctgttctttggtcttcttggatctctgaccctaacatcgtatccaacttctccagttcttgttcttggaggggtgaggaagaggaggaggaggaggtgagatgggtagcttcgggaggctggcgaggagggccgtggagacggaagcgccggtcatggtcaaggtgatggagaagaagctccctgcctcgtcgaaatcgcatctttcccttctgatttctttggtcttgattgatgagttctatctctcttgtgccttgtgctcttttttcagatgcaggaattgcttcgagggaacaaggatgtgatgtcgcttgcgcaggtatcggatcgcaatttctttcggttatctgtccaatgattgtgtgtgtgtgtgtgtgttttcatgagagtaccaatgagtttgtgttgttgttggtacttggtcacaggcattttgatgtttgcatttgattgggaagagtgttcgaaatggattagtgaaatgatcatttgtattgttcctttactgtttgggtcaattgtctcagtaaactgttcacgttgtaaggtgaatcaggagagtttagtacatctgataacatattgtgctttgtataacacaactatttatcaagcatggaatttggaaactaaaatggttgtattcctgcttagttcctgaaaatggcgtttaactgcttatgctagccaaataagatatccaaatatatatattagtggcagtggtgtgtgtgctggcctcctattactgccaacagaacatgtgatatttactggaaattatttgctttcttttaaactaatgtaaatcttggatgcagggagttgtttattggcagcctcctgaggcagctatgaataagattaaagaaattgtatgggaaccatcaatcagtaaatatggctctgatgatggtcttcctgaactccgagaagcacttctcgagaaggtaatttttcaattgggatttgttagataatggtttccatggcccatgttatcaagccttcccagttatcacaaagcaattaccatgtgagacaaatgcacttggttgcctactgctaagcctttatcatgtgagacaaaggaacctgtgtgcctactactaagcctttgtcatgtgagaaattgattctggaattttttttacctcgatactgagagagtgagagtaaggccattcccaacccaaaacattagacatagtttccataaactccacatcatcaagaaataagtactagacactactcttccaatgcaaacactactatttcatacttaaatttaatgctacttatctcacataatgtcttggatgttgtgtagaaaccatgtctcatgcaagacatagtttcctcctctttcctcatttattcacttgccacatcagttttcatcctatgtgacagcttatttaatgctatggacactatcctagtcattgggttgggaatagcctaatatcaggaatcacatgctatccttacaaaattttatcaacgagaaagtttcagaaagtatctctcagcttctgtgggggcttgggggggagggaagctaagggcccctttgaatcgtaggattgagaaaacatagtaatagaaaaaacgtaggattttgataggaatgtaagtgtaaaatagaggattacaaaacgcaggaaaaacacaggaatgaccgtttgattgaaccgcaggaaaaacgcaggatttggatgagagagatagactcaaagaaaagttactaagaggttgaagctcttgcttaatttcctccaaaatttctataggattgttcattccataggaattttaaaggattggataggattcaatcctttgattcaaaggacttcataggaaattttcctataggattgaaatcctccaaaattcctatgtttttcctccaaatcaaaggggccctaagctctgttgagagctataatagttcaatgctaccatgtaacagtgcagtagcacagttctgagacattgcccttggtactaccgatgccccctcatgtagagatgggtgttatattcactgatttctcttactgcgataatattttattgaaaaactaataatatgaatggtaattattataaacatgttcgttgccttccctctattttcttcctgaaatttttagcatacattttgcagctgcgcagagagaataagctaaccaagtcgtcaattatggttacctctggtgcaaatcaggtaatgcacatgctttccagtttccacctgatttattacagctttgtcatcttattccggttttcctctgtgtattttgccttgtttagctagactataggatgccaatttgtttttcttcttcagttctatgagatgctttcttacttttctgtatgactgcttcacctaaaccttgtttaccaactaggttagccaaataaaagtcaaataaagtgatgtcttctatcaaattttggcaggcctttgtaaatgtggtcctcaccctttgtgatgctggggatgcagttgtcatgtttgcaccatattacttcaattcctacatgtcattccagatgacaggagttactgacatattagttggtgcaagcaatcctgagactcttcatcctgatgtcggtaagatagttcttccctttttctttttgttggagaaattggttagatgtctattatcaacagtcaattataaactagttgccactttttttccgcttctgagatcttccactttgtaagttgataagttctatcacttgatacattttctctcagttcaattgagagctatatggtttttgatcattcgatttggttcacttaaggactgtaaaagaatagttcattctggtagtacaatttatatttgtttaataaaatgcagattggttggagaaggttctgcaagaaaacaaccctatccctaaacttgttagtgttgtaaatcctggaaacccctctggagctttcattccgaagccgatgctcgaagtaacctgtctctctcattcacagttcacgcacacttgcattcgaggtgactttaattatttcttaatattgcaccattgttccagagaatttcagaactgtgcagaaatgctggtgcatggcttgtagttgacaatacctatgagtaagttagtactcaattactgattattgctcaactgcaacgtcattttggtgcttcttttctttctgttgttgataaagctcctcagtcccttcagaaattgatattacttaaagcaattgtaaagacgaggcactacgaaagaatgaactacacatggacatgatcaccttaagtagtagtttaaaaggacagttcaccataagcagttgagcaactgtgcttgacttcttgaagttgagtcctggatgacgccctctctgatagattaaataaataggacttcaagaatgtggtatctctttcaaaaagtatctgcaaaccacccgccagtaagggtttgtcaaatgtagttatcttcacatgctcagcttattcaagtagggaaaatcttccatttcttctcaacactagaattggacacatggaacaactcgttttcttttgaaggtcccatttcagttcctcaatttcagtgatgcccaaaataaaccctccagtcacttacaggcagagtggaagactcactgacaagagcctaaattgaatcacggattagactcttccctcaagaaaagtcttactttcagcagcctagcatccgctgtgcggcattgggaagaatatatctgttgttagttctgatcaaatcagaaatatttgatctcttgctaatctacccttgctctatatttcagatcatgtttaccttttcttgtctggctctgtagttgagtaatggaaattgatattagtttttgccatttccttaccctgatgttgatgttaaaaggatgctatgggtccttttcgaatataagcttgatggacttcccaatgttaatacaccaccgaatttgacatgtgtaaatcttgtatatgataaaagtataatttggaaactttcaattatcatcacattgatttttagataatctgtattcaaaatgtttgcacgaatactgaaattcaagaaaacattttctcggaagaattcttttccataaaaggtgactgaccttttactttctgtaaaataattctacatatggggctattttggattctgtataactttgatgttgaacttgcttgcaaaattggtgggtggtctccaggtactttatgtatgatggaatggagcactattgcttagagggtaatcacattgtcaacctcttctcattctcgaaggcttacggaatgatgggctggcgtgtaggatacgtaagtttgcctctctctctctctctctctctctctctctctctctttctttcatcctctgcttaggcttgaaaatgctgatgtaagagtcaatattgagttctttcagtttcatgaatttcccgcatccacttgaatcttttaccagggcattcccttaaattatcaccatagcaatgcagtataagtaacttagtggctgcacaatctgtgttgatcagtgagtcttacaagaactgatgagctgactgctgcagattgcccacccaaacgaagctgacggtcttcatgcacagctgctcaaagtgcaagataacatacctatctgtgcttccatcatcgggcagcgcctggcgctctacgcattagaggctggtccagaatggatcagagaaagggtgagagatctagtgaaaaaccgtgaattgctcatggaagcgatgtctccgcttggcaaggactctgtcaagggtggtgagggtgccatttacctctgggcaaaactacccgagaaatgctcagatgattttgaagttgtcagatggcttgcaaacaagcatggtgtggctgtgatccccgggagcgccagtggaggtcccggatatatccgggtttctttcggagggttgaaagaatcggatacaaggcttgctgctgagaggttaaggcgcggcttgcaagaacttgtgactgagggaatggtacagtgacagcccaatggatgcaagaaatacatgacatacaaatcacaaaagtgaaaattttcagttacataataattctgggattagttcaagagaagaaaagagccaaaatttcaagattacaacatggttgttagaaaatgctgaagcttttatttcagagaacttttgtcacattggatttcctagtggaaatttgatttggtgggttgagtagagggaaaaaaaaagactcatccaccctgtggaataccattgtcattaaaggggtattcatgtttagtacttactgttgcttgataacctctttccctacaatcaggacagcagctgtacacaagtaagatataataagatataatagcaacaataagtgttcatgatgtgcttttatttcagcttttttatttatttcttcggttcggatcacttctcgaagctcaaaaactgaaaaaaatatgtttcttgaacttgttagcacttcaatttctgaagaaatgtgctcgtgcagaatcagacattgcattttttttatataatggtttatattaaaccggcatttacatccaaagtgaatgtatagccaaaatcagacattgcatacaaccatgattttagttcttcaagcactatcacctccagttcctgtaaaactccaattgctgccaaaccagtgattgtaaatttagagttgttttcgtggattattgatttgattataggaataaattaaatattttaagaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 42286 - DNA, 25188 bp, Oryza sativa
  unsure (1)..(25188): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacctgctaaaaggaacatgtctacaaagattgaactaactgatggatggtatgtggttgctttctctgtattgcacgagttgaagctgaaagatgttagaaccttttccttttcgcaggtattctctagatgcgtcattagatctggcacttttggagcaactagagaaaagaaaactttttataggacagaagcttcgggtactgtgctatttcaactagtcatgagacatgactataatttactcatagcacctaatatgtatttcatcttggcagatatggggagcttcactatgtgggtgggctgggcctgtgtcatttcatgaggtttgactaatcttctaagtcttttaacctcattagctgtgaacattgactaccattgaaccatataatcaattttttgttgatctcactttacaggcatcgggtaccgtcaaattaatgatccacataaatggcacctatcgtgcaagatgggatgagactttggggttatgtatgtaatttgagcacaaaactggacacttctgttctattatttttatacagctgggttgtcttttataacctattgtgcgcatctcaggcaagcatgctggagtcccactggcattcaagtgcataaaagcttcaggtggcagagttcctaggacactggttggagttacaaggatttatcctgttatgtacagggagaggtgtactactggacataaatccattactaaactctctctcagttgcacacactgaattgtttgtttcaggttttctgacggtcgttttgtggtgaggtctgaaaggatggaaagaaaagcactacagctgtatcaccagaggtatttatttctcctattggagtaaacttaacacaattaagtgcaatggatgcttatcacacctccaatagaagacaagcaatcatgcatggatacatccagtttcttgaagcatacttcctgtttgccttttttttttctgtccaaaactttctcaatatgttttggggttcatcatcagtctagttcactgaaatgtgatgtgacacttttgactttatttgctcaaatttttgaaactttgtcaatagctctcaaaatatttagtttgaaaatatgtcatatgggtagattttttaatttataagtacttttacaatattataatagaaaaaaacagtggtcaaaattgcacatcaaagaccgaataaagttaatagcgtcatatatttaaatgtggacgtagtaatattcatgagtagcacaaactgtgtatttgcaccaatacttccctttttatgccattataaattataattataataataataattaccttatgcagagtgtctaagattgcagaagacattcagtcagaacatggagaacactgcgacaacactgatgataacgatgaaggggcaaaaatatgcaaaatgctagagagggcagctgagcctgaaattcttatgtccagcatgagttcagagcagctgctgtctttctcatattatcaagaaaagcaaaaggtctggacgcataactatagcatctcatctgtctgctaatattttatgttttttaaactacaccattatgttgcagattgtcaggcaaaatgaagtagctaagaaggttgaaaatgctcttaaagttgctgggcttagttcaagagatgttacaccatttttgaaagtgagggtgacgggccttatcagcaaacactccgccacaaaatctggctgcagggaagggttaataacaatttggaaccctaccgagaagcaagtacggtacaataattctacagcatataagtgtcagaaatcatctttattctttcttatgaacagaaaaaaagaacaaaagatttggtgttatgtcatcaagaaaacaagccagtgattgtcatatatttttgtgtgtagcgttacctgctatatgtctttaggacaacaagatgcacatgcctattttctttgcaatattcccatagttatgtgctaatgagcaaatatacctaaaacaattttcatttctgtattgccactggcagaaatccgacctggtggagggacaaatttattctgtcacaggactgttggcttcaagctactttacagaagtatcctacttgagtggtagaggatcatctacagcatggacgcctttagcaaccgcacagactacaaattttgagtaagagacctcattggacatgatggttgcactgcatttagaaaacttaaccatgtccctttttcatgatgcagaccatttttcacccctcgtaaagcagttgaattgtcacattttggtgaagtgccacttacaaggtcagccctgtctcaagctgacttgctgaatctcctgttgtattatgaaccttttataatgagccgttcctttttgtttcagcgaatttgacattgcaggtgttattttgtatgttgggaatgtttatttattgaacaaccagaataggcagtggctctttttgacagatggatctaaatttatctctggagaaaagtatgaagagcaagatgactgtcttctggcagttagcttttcttccaaaaccactggcgaggattctgcattcttcaattatgccctttctggacatatagtatgtgatcttccattgcactgactatatctcaagttgactaatctttgaagtccgaaattcatgagtcccatatgaaatgcgagtagttatgaattaaacagtgcctcgtgtaattttctgtgtagacgagctatatcccagtttcttttctgcaggcccttcacataattcttcagatttacccctttgtagtgcaagtgcaattttaactcactgttacgtttgtttctcaggttggttttagtaatctggtcaagcgagataaagaccagatgaggcacgtgtgggtagctgaggcgacagagagctccacctatagtctctcccacgagatacctaaaaaatcacatctcaaagaggctgccacttctgctgaaaaatgggcttcaaattctcatcctgtaagtttcttcacaccacagagatcctgttctgataagatggacagtcttattgtcactttctgttgatctcttgcagatgattcagcatctgaaggaaagagttctgcaaatagttggtgacagtggtggctgaagtactctgaatggtgctgctcgtagaacagtgtaaggaatctctcggagttctatcaagcacaactatattattttttcggacatgtttttctttgtcgttccagtgcttcacttgagataacgttgattggaagtagtttgtttcaggactcgaccagaatgaagcctatggcagtggatgctcgttgtcgactagacaactgacagtcttgataaatgctgcatggcatacgaatgatggatggatacgacggtatgaaactcactttgtcatatggttttctagtcataactaaatatcttgattttttattgtaaataactgggctataactataagcctacaatcatctttcttaaacaaaacttggactgtaataaatagcatgtgtgttcattagggcgaggcacgttaagaaacacgggtacacttcatgatgaattagcttcacaaccatcttattgaacattatctgcatatttaacatgtaacatcagaagattatgtataatgaaacatgttgcgcactgcataataccactactccctccgtcccaaatgatagggcgtccctttttaagaaaaaacatattcggtagcttttgaccaataatcatactaactatatctatactatgtattatgcatgttatatcactagatttatattttgaagtacatttatgtgatgctaatttcatatttgttgggattatagaatgaaataaaataatgatcaaagtatgttattgaagaccgtgtaaaaaaatataggccatatagtttgggacagagggagtatattgtactttctatgctcaaattcgtgaattgctgactgctccttacatttcaggttataagatgttttgactttggttaaagtcaactgtttcaagtttgactaagtttataagtttatagacaaatgtagtataatagctataatactaaattaatttcatcaaatcaataattgaatatattttcataataaatttgtcttgtgtttaaaatattactactttttttacaaacttaatcaaattttaagcagtttgattttgactaaagtcaaaatgttttataacctgaaatagaggaagcataatagtcacctgtgccagtgtttaccagtagatagcatagaccataggtggcaattcgcacgctgcatcatatgtttattaataaagcaatgcatggtttatgtgattttgtgcgagcaggacgtgattggcacgtggagggacagatcagcggatttggacacgagatatcctgctggcgaggaaatggttagactcccaccacgacatcatcctgctggcgtttgagcgtcccaagtttcaacatggagcgtcatgctgccctcccaatcccattgaacacgcacatctgctcgtcgttcgctatgagcctatgaattatagattacgagcatctggtgtctgctgcctatcctgacttgtaattatccggtgtataaagttgtgtatggaggcttagtttgatcattttgatatttctacagccattttacatgcgtttagggaaaaaaaatagtaatacgtgctatagctaagttattgatactcaattctcaaattggagaacagccctgacgcaattatatggttgtatttctcactccaatatccaattggggaaaatgtctgttgtttaaatttctatgatattttagacttcccagatatgtttaatgtgcaattggagtatattacagcttttttagcctactgtctgcaactcttccatcctcatttggccagtggcatgggccaaatctctcggtcattacccagtaatggcctgaattcacggcccgtttcaagctgttatatatggaccttaacgttaggccattgccctaactttcagcccacatattttgacgggccgcactgtctaaccaaacaatcgtgtacgcgaagatgaagggaacatgagaccagtcaggataaatgccgttttaaaactgcaaaactggaactacaaaaaatgttaaagaatagtaatatcattagaacacgaccatgatacgagcaaaacagttgaatggttttacaagagatcagtggtaactggagcatatatcatcatatgcagtttggagctaaatgtatggcctcaggataatcaaggctgaggaaggcagcaacagaactttttcttatgctcttttcgggccgggccgggtgttcatcttccagcagcaatttgtattagcgaacgaaatgcgcgtcgggagctttgtgctggaatatttatgacgaaatccttttctcatcattatacctgcagaatacaaagaacaagatcaataatggcttgtatcggaactaggttgccgacttctagtcattgtaataatattggctacactaatggtttagtattgattatctgtttgcttcattgtacttgggaaactatacgtgaaattacatgaacgtacagaaaaggtgaattgaacaaaacaaaatgaagatggcaatatttataactgaaagaaagaactcaaattttttttcttgtttgtttaccacgtaacaggtggacatccgtgacttcataagctacataaaatttgcacttcaattcctgaatgcttagatcaactgcaatttcaaattatagaaatatatattctttcctctaaacatgatatgcacttcatgaaacgtaatttcggcatgactgatatggaactaaaggcatacgacggtagttattgtgaaaagcaactggtgtgtactcaacttcaaaagtaatcaatgcaatgtactagcaatcggcatgaatgaatgatagatgaaagatgtaaatcttaccctgaacatatcaccaaaaagtccttccaaagcgctctggctccgtattccataaaattttgcggctatttcatctaataactgaaacccaaccataatatcacgtgagctctgtttcagcttgtttttcatatatgatagaaagcattaactaccttcttcaagttactctgctagttaatgtaatggaagttctatccacatattactctgctagtagagttaaatattaagcacattataagtgcagatggtcctttatcaacactgtttacatttccctatggacagcacatgataacaaggttgttggtggattaaattgtagagtttcctacatgatctaatataactcttgtgaacacattgttttatgacaactatgcagggaacatgaaaaatataatttttcccagttcttgttaagttaatctttgaaagaataagatgttttggtgcatgttttacagctgtttagcaagctaacactatatttgatgaaatagctacctcctcaaatacagggtcgtgatctgtacttgtcttgtacttctgccgcagtgtcctgaaaagagggtaagcatctctttcgagcctgtaaacatagcatgcagtcagtaatataaccacgaccagaggaaacaatgagaaaaaaaaacttgttgcttgtataaaataacgtctgggcttggtatacacgtacaagtaacaaaatgcaaaactatctcatcaattattcgaaagatgcatggaaacttggataattgaaactgtaggatcagtttgtttacagtgaacagaaagctacctaggcaacctagatcaacatattgcgcagtgatacacaacaagcacacaatagatcctagatttacagtgttaaaattatcacatcatcaatacagtcaaatataatcattatcctgcatagcatgcaatctaacagcaaagcatcaaccaaatctaacagtttgaactttaaccatcagtgagaacttaaacatggctaagttatataaggttatcagaatttttcaataaccatcaaagaaatatttaatatttttatatgcattcatgatctgtactgaaaacaaatcctacataaactatgaacatatctcaaaggtggaaaatagtctaatacccaggtaatgtacctaggccatgaaagattttcccataactggtggttctttcaaaaaaaaaagaattgttcctgcgatcagtattttttagtagaaacatgtaaggatgaaactactctgcaggtgtcctctaagttatcatggcaaattgcagcatgaatgcacacaaatacatgagaacattgcagaacaaaaatgtggaaaagaaacataaaaataatgcaaactgaaagacaggaaagacttacgtcggtaagagatacttgatgaactgaattaaatctgttttggggatttccaagtcagcagattttagttgatccttcagctcgtccatgagcaaatttgcatccctaagattcccttgtgatagataccttaaataaaaatgcagtatatcagaaaaacaagcatctgagcacgtctttttccccaaaaatttcttatttattcatcctataacgaaacactttcttaactttgatttttctgaagttagctttgatttttctggtccccagtgcaagaattttgacacttccttttaacatactatagtactataaacataataaaataatatattatgtaactatttccgaagttcgatcaaattctaatattttaccttggatggagcactttatagtgtgctcctgtatgtgcttaagtatccaaaggagatttgtatataacttagcaggatattgtattgatgcatattgaggaaatatatcctaatgcatgatttgctagcacattcctaaatatgtatattgtttactcattgtaaacagaacatgaaatagagaactccctatgaaattcggtttctgcattgcaagatgcaaacatcttccatggcttttagaaattttgccagtgtcaaaacaatgcactctttgaaaggaaaaaaaaaagaaagaaattatatcttacattaggacaccacgtgctattgcagtatcatcttcaccagggtagcactgtgcagtaagaaaaatattaataaaaatatttttttgattgagaaaaaacatctatgaatactgctttacacgaagattatgttggtcttgaaataatccaacccaaaaatggatatagataactgattgaacaatcacttgctggcaccgtgtttctattttcggagaaggatgacctccaactcaaataaaaactataagcaagagacccgttgtaaaatgaaaattgttgtaaagaatgtgaacctactgatcatattcagataagacattttaatcattgctcagagaacagaagaatgtaacagttcaatagaatttggcattagacaatcatcagctgcaagtctattatcaattattttctaaaaaccattacctttcccataaagttcgccagcatagaggcaaactttttaggatcatttcccctcacaaaatgacttgacactttagtcatgtcctgcatccaacggcagtcaacacgaaccttagcaaaccacaaaggcattaaagagtaacagttgaaaagacataaaatttcagctctaaaacaaacacaatatattcatgtcagaaaaatagttctataatttataaacagtaccgtttctggagattcagaatatatgtattccgccaacataacatgcagctcaggagatccacttcttgatgccccaacctcagcagaccaccttaataaaggattgatatgctattagtggcatataaatatagcaggcagaaaattgagaagagtcaactagatgaccacattgtccattaacagagttaaacataaagattcaaagatcccatggaaatgattcttatatgttgcacaccttgagttcatcttaaaatcacaaattcgtgaccatctcctttttcatttttttctgagagcattattgtaataaacaaacttacacaatcaacatctggatttttatatgcaagtgagcaacgagaacagatcatttgtttttaccatcatgataagctcaattgtctgttctacttttgtcagtaatgaactactggtcaagcactacagttaacaagtcctggtcatagtatagatgctattcaacagtttgatgtatttgccttaagatccacttaaacaaactgccatgtttagatgaagatgtttgatgcttgcatgaaggatatttagtttttctactcaatttacttggattaatgaaaattagtacaaccttacctgatagcagctctcaggaatgatgaacaactctcagaacgcacttttgctgcagaaatagcttcggataatttctgcccgtcgtcatcataatcatctccaaggaagtgtggaacagatatcctggggaaggcgtcgtacatctttctgatacgatctaaggtttacatatagtttcaatcacaaaatgtgatactaacaaatcaaactagaaacatgttctcattcataataaagtaagtatcttattcaattcaattaaaatctaagggaaaagtgatcttctgaaggtaaacaaacaaagagaagacaaagtaaagctagagccacaattaggactagtaaacactgcttccactaacattttaaacaactttgattctacaaaactttacaagtgatggacattaggagtatgctacaaataaaatattgtaaatatgttccaaaaatgaaatctagatgtgtatttacttacaggataaatatgcaatttattagcatgttaatgatataaagaaatagtagcttttcactatgagagaagactgaccaaaggtttcttcattataaggaagcgctgccttgacaagggtgtccacaaacattatagcaagttcaccaccacaagttacctgaaatcaggaatttttaaccaataaggcaaaaatgtgaaggtttaaaatgatataaaacaccaatctaggataacacatgtatgtaactacagcatagcacccaataaaaacatcccataataagatgtgaatcactaccaccacatcgacaatacacacattaaaaaaacaacttcaaatgaacacgtcaaggtccattggctggttgcaacaaatcgttacgaagggagcaatgagcttttggttggctctctcttctcttttcttttgggaggggtgttactttgccatcaaatgtagcgaatattttttttttacttagatctatgaaatttagctttgatagaacctgcccatgcttcagttgaactaaagctcctgactgaaggatgtccaaggcttccaaatacttctgagcagcaatatacctgcaagatatgagacacaattaatcaaaattgtattcctgaattggcactttttgtctacaatatctttcagacaaagctcatgcccctttcctttattaagaaatcaataaatctagtcaaagaaaatagccattttgtgcatgaataacatttttcattgtgatcatatgaaacatacttgtaggatccagtaatactgcttctatgcaaatgtaaacattctggtcattgttttactttgaatttgtttaatgtcctaacaatcctgacattaactatttttaagatgctgcattagccaaataactatgataatagacggaagattgtataacaaagattctaaattcaatcaactcatattatttagcagatccaatttaagttataaaaagtgaatggttgatttctatcatatgctaagcagttctgaaatagacaaccataagcaagatggtcaaatgcaagttaaaggggaatcaatcattgtggcttcagttaaattattcacagagtaccttgcaccggttgacttgtacatttgttgggcttcataataatttccttcagccaccatattctcaagcttttcgattgtctgaaaacaaacacctcacggttacaaacatcaatccaaagggaaatatactcaatgttgtcaaagatgggtatgaggaaccatgctgggactgggaacacttcaaagaggatccaaaccaggtatacccacagctaggccttgttcggttacgtctggattcaatccgggcnnnaccngacaaggccctagtgattatgcgcacaaccaggtggtgcggactgcggagagtaaatcattgatgcctttttttatcatcatcaaaccacaataagtaatcttaatttttcttagaaatattacgattgatttttccagctagtagttccacacaataaaatggcgagattcgcaattggacatgattcggtactagaaccctagtttcctcaaattcgccacgaagagtcgggtaatcgaccccctcgcccctctacgccccaaggtcgaaaaacaccgagatcaaactagcgcatcgcgcacgcaacagcgaatcccgcgcacctcgcgcaaatgttacactcgcaatacccaaggcacggggagaggagggatccctcacctgctggggaggaggcaggtcgcggcgcgacctcatgctcatcgacgacctcatgctcagggaccgcgacatggctcccccggcgatctcagcacggcggcggagtaccgtagcgggcgcgggcgccggcgcggcggtggtcggaatcgcggcggcgaattcgcgagctccggcgatgagatgggcggcttcgcctcctcgtgatttggggcgcgggtgggtggctgggtgcgcgtcgatcgtgctcgcgcgaatcttaaagcagttcccccgtttctgacccggattcttactcgaacccccttggaaatccacttattctgcgattagtccttatgtagtaaactttttcactttggtccttacgagaatagataatacgtaaggggtgtatttgaaaaagtgccgtgctagtgacgtgtcttgcctgcctccaccactagcgagcgagcgagcgattcacggtggccgcgggcgacggaggcgaggcgaggaggagatagagcagcagcaagccagccatggcggcctcctccactgctacccgcctctcgccgcctcgcctccacgcacccactaccccttctccccatctcccgcttcgccgctcgcgcttctcccctcttcgcgccgccaagtatgcctccctgcttacacctgttcgatcctcttatctttgcccttacgataagtttcagtccacgaaatgttcggttttatcgaattctcgggttcctaagacatgcgtttgattatcagtagtacttgggtcaaggtgcaaatcttaagttgtaatggagcaatgttctcactgatagtttattttttcaccgggccggcaaaagaaccggccaagttttgtattaagaaggagagagagttttacaacaagaacaccctaagccaggaatggcttaggctacagaaaatcgtctcagcgatttagactacaaacaaacacagctgctaatatatatttcagtctcactgataatttcagtctttagttatttctagtgtgcttcatctgtcagtgtttggtaatgtgagcctgtaattgtaggttggaagctgtgttaactattggaactcatctaataccacacccaagaaaggttagtcattttttagataaacatattaatatattactcttctggtagtgtttttttccccttcatactcaattatacaacagaagcaaccattgtttgatatttgaatgttcttcaaattctgaaggctgagactggcggagaagatgctttctttgtgaacggcgatgatggtggagtgtttgccgtcgcagatggagtttcagggtacaccatcttcgctgcaatgaattgttttgtacttttgtccctgaaaagaactgcttcaataaattgtagattgtgcttttgtttccttccttttaattttgggttgatttcagcacttctcaaaaaaatacatggtgttttcagcaattcgcattaacacaaggtttttatcctgctagtcattctcttgtctactgacagatgggcagaaaaggatgtcaatccggctctgttttctcgagagctcatggcacacacttctacttttctcaaggatgaggaggtatttcttaattgacatcagtactgatataaagtcacgtacactatacgtcaatttgcatatcaaataggagtttctatccatcacaggtcaatcatgatcctcagcttcttctaatgaaggctcatgctgcaacaacttctgttggatctgcaactgtgtaagcatatatctacattgttatgttagtacaactttacaggtcaaaacctaatgacttctttggaacgctaacagaatcattgcaatgcttgagaagacagggattctaaaaattgcaagtgtgggagattgtggtttgaaagtaattagaaaaggttagcatgaacaaatttatagatttcttaaagtttattagcatacttatctgttctcttcttcctaggccaagtaatgttctctacatgtcctcaagaacattactttgactgcccataccagttaagctctgaagcaattggtcaaacgtatctggatgcactggtatgtgccttattgtaggtcagaataatagagctgtgtgtgtgacgattgttttattagcatactcagttctaggtggttgcccatatgttacaacgagtccaagacatgcacattaattatttcttaatttgaaaactctatatgatctcaagtcatgcagatattttgcatgtgtggacaaatcaaaattatggggaagatcttacaagggacacgcatgcatgcgcaaatctatccataaaagataccactaatgcagtggaaacataataccaagtgcttcactacagtaatcaagatagtcgtacaagatttaagcattatttgtagaaccttctgattttgatccagttgtctaccaggtttgcacagtaaatcttatggagggtgatatgattgtcagtggctcagatggattttttgacaatatattcgatcaagagatcgtttctgtcatttccgagtctccaggggtagatgaagctggtaagtggtaaatatctcagttttgaattgggggccaccaaacacatgttccagtcctcccaaattccaatccttctgaaagtttgatgttttttccacagcaaaagcactagcagagcttgcaaggaagcattcagtggatgtcacctttgattcaccctactcaatggaggctcggagtcgggtgcgaaacatatacccctcaacaatcttttctgttcagattgttacagccaaaaagggatgacagaaatttcttcattctgatcacttgaatgcagggttttgatgtcccctcgtggaaaaagttcattggagggaaactaataggtacgcatgaactcatacacatactatcatgctctactctatgcagaacgcaaagtaatctcatgatgcctaaatttcatctatgcaggtggtaagatggatgacattacggttattgttgcacaggtgaaggcagtgatgatcccagatgatgaggtgaacctacaaaatcttccaatcttgatatgcagataaggcagtttcaccttgggattcttactgttgagtgaaatttacagggtgttgatgaagaaaagggtcaaggggatgagcaaggcagtgctgttgccgttgcatcctctgaacagaaggaagactcaattaccacataaacagtaaaatcaatgataccgcaatcacaatgtaactactgattcttcaaagcgacgttcttcgtgcgccgccattttctattttatgtcttcctccttatcttttctctaaggatgtacatttgtaagtttctactggagggaatacaactcaatcaaaatactcatgtacagccgaattccctgcagaattgagtcgctacgaatacacctctctttcatttattgctgaaaattgtgactttccttttatacaagtcacccatttacatatgcattctatctctttttttccctcctttgtcttttattttttgagaaattgtctgtattattgttgagaatggcagtcgggcacgacgggcacgagtagtgactacccatacccatgcccacgaggtaatttatgctcgcgggcatacccgttactacatgatgagcaaggaacactactcatgcccgttacccgcgggtgctatgtgcccgcgggtatgcccgtttacccgtcacaaactcacagttcaacatttcaaccacaaatctccacaagcagagagacattatcgcaatttaaagaaagggtacagttgtatcaagttcaacaatacaagcattacaagttcatcaatactagatggtggcatttatactaatttgaccgagggaccacatatcagttggtttttgcgggtaaatgggcgaagcgggccagtgcccgtatgcccattgggtataggttttgacccaataaaaaacccactggtactaaatggagaacaaacccaactttattagggtttttacccacgggtaaacgggcaaacggtttaaattgccatccctacttgagagaacttgtgcagagtagaagtgaattggatggaatcggtaaaaaaaaaattaattgaacaggctgttgggcagtggccttcgggagaagaccagggtttcatttaccgccggggccgcggttaccgcgccccggcggtaagcacggttaccgcacggtaaccgcggtaaccgtgacaaaccgcgacaaaccgtacaaaatttatcaaaaattcaaattattttttaaatttatttgaatttgacgcggttaccgcggtttaccccttaccgtacccccgcggtaagcgcgataaccgcggtaaccgcgcggtttaccgcggtaaatgcaaccctggagaagactacgcggcccaccatcacggcccaatcgatgaaccccccggaatccctaaaccaacagcaagaggaagtctctcctgctcaagcggcgcgacgcgagtagcagacgcggcggcgcgacgccatgtcgtcttcctcctcctcgttggcggcggcggcggcgcggaagcgcgcgctgacggagcagaggttctcggagctgtcgcccgcgctgtccccggaggtggtgaaggccctgaagggcggcgggttccggcggtgcacgccggtgcaggcggcggccatcccgctgctgctttcgcacaaggacgtggccgtcgacgccgccaccggctccggcaagacgctcgccttcgtcgtccccgtcgtcgagatcctccgccgccgcccctcgcctcccaagccccacgaggtctgctcagtgctcacggctccaccccatcctctcttgttctgttcatgcgttgcttgcaaagttgctggattgcattgcatctcttgttcacttctgatcagaaaaatgtatggaattttgcaaggttcttggaatcatcatctccccgacgagagagctgtcttcgcagatatacaatgtggctcagcccttcttcgcgacgctgaagggcgtctcatccatgctactggttggtgggttcgacatcaaggcggagctaaagaaactggaagaagagggtgcaaacatactggtcggcaccccggggaagctgttcgacgtaatggagcgcttagacactctgaactacaagaatcttgaggtggttttggaagcaattgaaaattcatgtgttgttcttttgtgcttgaaatgcaaatctgacataaattgttgttgtgtatgtgttttcgaagcagattttgatcctggatgaagctgataggctgttggatttaggattccagaagcagattacgtcgattatttcgaagttgccaaagctgaggagaacagggcttttttcggcaactcagacggaggctgttaaggagctggcgaaagcagggttgaggaatcctgtgagggttgaagttaagacagaggtgaagcccacaggtaaagatggtgctcaacaagagcttggtccatccaaaacaccgttgggtcttcgattggaggtatggtgaggaacttttgtacaagcatttggatagttattcgtggctgccaatgattacatgggctggttgtaacatatacttattttgttttactagtgactatgcctgttgattgccttatgtacttgtcaatttaatgtaaaccacaaaatttctttgttctttgcagtatatgatatgtgaagcatcaaataagtcatcgcaacttgttgatttccttgtgcagaacaatggaaagaaaataatggtgtaagtagacagcgaactaaaatttgttttcacacacttaccttaagtgcctagttgtgtagcattgtgttagcttgtgggctttctgatcttacttgaatgcaggtacttcgcaacatgtgcttgtgtagattactgggctattgttctcccgctgttggactcacttaaaggttctccaataattccttatcatgggaagatgaagcaggttacagagctaatacatgcatgatttgttgtacatggcgcttccaaaagctttccttcatactgattgctaccgcgctattttcctggtatgtagggccctcgtgagaaagctttggcatcattttcagctctctcaagtggtattctagtttgcactgatgttgcagcaaggggtcttgacataccacatgttgatctgattgtgcaggtaatgctttgaacataactccctaaattgtttccttgtgcttgtcattagttgatataaaacatttgtttcttccccagtatgatccacctcaagatcccaatgtgttcatacatagagctggccgtactgcacgttatgatcaagaaggagatgctattgtattcctcttaccgaaggtacttgctctgctttgacattatctaagtggaagtcagtagttgaatttcaaagacatatttggctatgcataccatgcacatgcagtagtgatttgatacaatggattgccttgttagtaaaatgcttagcgctataattgttctgtaggaagatacttatgttgagttcttgaagaggacaggtgtacccctcactgaaagggagtgttccacaaatgctgtagatattgtaccacaggtgagtttcttattgttatagatcatcttagcgttgtatgcctgtgaaggcatcctgaatccagaatgattttttttcttgagagaaaaatttagtgtttaaaataaccgattacccacctgtttgtcacagatcagaagtgttgcattggaagaccgaaatgtcatggagaaagggcttacagcttttgtttcgtttgttcgggcatacaaggagcaccactgttcttacattttcagttggaaagaccttgaaattggaaggttgggtatggagtacggcttactccaaattccatctatgccagaagttaagcaccattctctttcattggaagggtttactcctgttaaagatgtcgatgttacaaaaatcaagtacaagtaagcctgcaaacctaacatttcactctgttgccaattgtactattgcatcaacgcactactaatttgacaaatttatattggtatattttatattaaaaggaaagcccatattcaaaacgtagatgacacaaaccataatcttgttgtgtaagacccttgtagggctaaagagctatgtctaaactaatcgaacaattattcagcaatttttcacttgagagctatccgtattttttgcttcaaatgcaactatgagaaagggatcaacactccatcatggttaactgcagggataaagctcgagaaaaacaacggcagaagacattgaaaaggaaagcagaagaactagctctaaggccagagatagagaagaggaggaaagccccggagaagcctgaaaagccaaagcggaagaagacaggtaaacagcgtcaagcagtccaaaccaaggaggacatggatgagctcgcgaatgagtaccggctcctgaagaagctgaagcggggggtgatcgacgaggacgagtacgagaagctcaccggattcggggaatctgacgatgacgattcctcggatggcggcgattctgacctggacgagagaaaggagaggggcaacaaggtgctcaagaaaatcaagcagaaagggaaggcaaaagggtctaggagatttgaagggaggagcaaacagaagactaggagaagatgaaaagtatatcttgttcttagcaattttgcttttttttttctttaaccagtgtaggttgcaagttttgccctggctattgtatgttcgattttgtgatttgtgacaaggacggtgaatgagcatgagcatcattcatagaagatagtgccatctctatttttcgtcagttaaagccagctgaatcactgtaacaatgccctagttcaccttttaaccaagaatgctggtagtatagagctacctctagggtctagctaaatgcgactacacaacctacggtttatgttctactacgtggcaaagatgccggacatcgtttgaactttgaagtaatacatcgtttatctaaacgttgcacaattcacttataacacgttcgctcgtttccgctcagcacaccccgcaagtagtgaagcaacaccgatcatttttttatccttaatgcgaagccacaggtacgtttctcagtgcattattacaatcccaaatgaagtgaaaaatttaagtattcagcaaatgtcatacaaccaaactattgcaagatacatacggcacgtaaatgtcaaacaaaaacgacgtgaacggcttggagcttcgcccatctgcaagtccagggctccagatcaagcctcctaaaacagatccaaataccaaacccatatggaacagcgaggagaaacttcagaaagaaatgaaagagtcggaaaaagcaatcaacggaaagaagcctgacgtctatcttccgcaactgtgatagaaaccatacaaagaaaccagatgaactggaggtatccaccgcaactgtgacaaaccatacaaagaaaccagatgaactggaggtatccagccaacaggtcaatttgccaatcagcacaaggaactggatccggagggcagatacaaggatggcttcgaggtttcacaatacgctgcagtgatagaagagcaggcagcatcgatgtgcagcagacggtgttggctgcacacattgtacagcagcaagcctgcaagcgtaacctcaacagtaggaaacctcatacaagagtgctactactaatgctaaggggggtgattttaggagtctcccacaagattttttctactatgttagaatatttttccttttggaaattgtagtttctaagcatgctacatttgagtcacaaaccacatgaataagccaacaaatgcgcagatgttttcgtctggaaatagtatctaaatagtaacatatccatgctttatttgacgcaaaccacatgaataagtcaatgaatgtgtaccagaaaaggtggttcatatacatctaatatccacagagatatccgtaattaatggattctagatctagtaaacctatcgaagaacaaaaatgccctacctgtttctcctcgccaaaatccaagctagtgatccaccggctgagttaccatgtggaatgtaagcgttatagcaaaatttgcaatcgcagaaataaaaaggtaagcaatcacgggatagcaaagcattgcagaatcataacagatcggcactcacctgaaataacatctcaaaactaccagcatttggagcttatccatctgcctctatggaaaaattcacataacatggatcaatcactttttggatgagacaaacaaacatccgaccaacattggagtatgacaatggaatataattccgagaaaagcaggcaacctaccttacgctcttgttttgagtacaagtccgatgaacaggaatagaaatggtttctcacagatgacaatcttagtaactatattagttgctttcagtatggccttgaacgcgaaccaccaccttgatgcctgttaggcccatggcctcctccatctctgaagttatccctgcgacctccaccatagccaccacgtccacctctgcatgccatgtaatgcagttgattatacatatacaactcgacatgagtaataacttaagttatatatgagctaaaagtggtgtggacagatattaaatacctaaaaggcacaactgataaaaattaaacaaaaatcattcagttgccatatattacttgttttacaccatgatgtatatgcccaagcacatacataaaataacaagtagtgttcacaaatattgtgttaaatcgaggtatgctaaagatttcaaccaacacattgtcccttacacagtcatacactacacattgacttaagacaagtggttaggacccaccttgtcaagtgagaataaatagatatttacaattatccagtttctaaaataataccaaacaacttcgaatcgtggcatgttagtgacattcttttctagctaggctaaaaattacacaaagaggttcagtgaacaatgtttaagatcttaacccggaagtagtacaagtgtacattgactgatacatacttggcattctactgctcccacattcaacttatttctacaccatgaatgtgttattataagccctttgtgacagaatgcatatgcaaattaagaacacataattgaagtatcaggtaaaactaccttacacgctatacaaaaaaatatgataagaaaagtccccagattatgttccaccagaatccaatcaatgtaattgtggcttacatcacatttctagcttaagtgcttggttttacacagtttttgtagttgaagaaaaaaaagctacaccaaaataacataaacagatggtacgtgtcatatactcctaatatcacagtttcttaagggggcaacctacgagcactttgaagaatagattcaaacatctaggctatcaaattgcaactaaaaggggcatgctttgcccataatagaagctgtcttgcttggacataggcacacagcattccacaatctgcatttagcatctacagaactgaaaagtacttacccatgaccatatgcaggagctctaggagctgatttctcagccatcgcaacactaattttatagcctctcatttcataatctggaatatcaatagaaaacatgcattaaaaattgcagaacactgtatttatacacacataatataatctcgatgctgaacttactgttatagaatccaccagctgaatgagcagcagaaggatcttcataggcaaggcaggcatctcctttattctttccagagtcatcagtatagatctttatgttccagggccactggtctttgtagccacgtttctgcttgatccttccaaccttaagaaaaaagcagttgcaaaaactcaaaacacagccatgaaacacaagcagttaccacccccaaaactaaagaaattaatttcttgcaataaatttagctaggaacactaagtaatctgtaaaaccaactttactttattatcaaagattttacattaacatcatggggtgatatgccacgaattatttggcataaaataccaatatgggagtaaagcaaaattactacaaaatcattgaatggcttggttataactaaaattacagtactactacttctacaaaaaaaaagagcatcattactgcaagatgattatgttacatcaaaacaaatatccaaatttaattatgcacattgaaacacaagggtgtacttctccactagcaaggaaaaaaacaatatgtaataagctcgctctaactgcgctgtatacaacagatggagcagattttgtgcaaaactatgacttgcaatgtgctagcagtagtgaaagcaaaaggggaaaaaaatgttaacaagcccaactacagattataaacatcatctgaatactgatttgtaaatttacttaaattccaacaagtaatatcagtaacactggaaaaagatattatggcgaaacacataaaatgaaaaacatgaggttagaaaaaagacataaaatgcacaaaatatttcagtgagcgaatcgtgaaatgcacagttcataaacactaaatatgtgggagctcaagaggaggtcaaagtatacctggccgattcctccaaatagttcttgcagttcctcaacagtcacatcaggaggtaagttggagatgtaaattcttgcattatcacaagtctcatcacagtttgcatcacactgcttaacctttgcagctggctctggagcagcactgccagtgtatccgccgccaccgccgccgccaccaccaccaccaccaccaccatgatagggtggaggtgcaccagggcctccacccccaggcataggccgaccaccatacccaccatcatatgaaggaggtaggctaccttggccacctggagcaccaccgctatatggcgggttcggaggtggtgcaccataacttggtggatatgaacctggaccaccaccatagctactaggaggtggcactgcagaatctgaattgtatgcattattgcctccataggagcttggaggtgctgcatagtcaccaccaggcccaccataggaaggaggaccttgaggaggaacttgtccatagctaccagcgtcataaccactttcgtctcccctttggttgttcccttggtctcttcccccataaccacccctgccaccacggtggtcatcaaatccacgatcatcgccaccacctctattgtaacctcctcctcttcctccccctccagtgccaccaccacggccaccagagttgtaatctcctccacctctgttgtagccaccgccacctccagaactaaaatcgccaccaccacgattgtagcctccaccccctccaccagatttattataccctccacctccacctccacctccacctccagcaggagaaggtgctccacacttgttgcattcagtcctccttgcaaagttcacattgccacaactggaacaagaatgataaacaaatatattaggaatattggaagagaaccaatgaaattgcaaccgaatattctgcaaaatataaccaactcagcaagacaactaatgccatattgaaagaaacatattcataaaagaaagtatttactgtattttgtagtgcttatttactgtattttgtaatgcttccaataacaccatgaactcatttcaaaaacatatatgaaatttcttctctgccactctgctataccaaggaaaatagaacataggggaggggaagaaatcatgggagacaagtataacataatatttatgtatctagaggttcaacataaatttagcacttgtgacctaagattatagggagctctcatagagaatgaattatgcagttaactatttgttggcagttctgatgctcacaatactacgatgaaacaaaaatttagtaggacacttcacacatgccccatgcaaaatcctaaaccaaattatcaaataacccaataatttataatttaacaacctaaaaaccctagatttcatggccaagtagcataatttacaagacaatcgggacaaccacgatttcatcagtcacagtcgaatcaaacgagacaacgtcaaatgagtaaacgaaacaaacctcgggtctgggcaaacccagtcaccgtcacgtcctccacccctcccgccgccacctcggccaccgccacccccaccaccacctctgccgccgccgccaccgccgccatatcctcctcctccaccgccacc

SEQ ID NO: 42287 - DNA, 27316 bp, Oryza sativa
  unsure (1)..(27316): unsure at all n locations
ccaccaccatatccacctcccacaccaccaccaccatatcctccccctcctcctccgccacctcccctcccacggccgcctccgccgccacctacaaaaaaaaccacaagccagtcaggagcagatccagaagcaagcacgcacacaacccgcaggatcccgacgcgacctcggccgccgtagccgccgcggtagtcgtcggatccgtacgaccccgacatggtcacgcgcctagggtttgggagcgttccggaagggcaagtgcgaacagagtattccgaatttctgatacgtgtgtggattagggcagaagtaagcagtcgaaagagatggatttgggccggaattaaacgggagtcgaattctctcgctgcgtgtgggcctggattgctggggtgtacatgtaatgggctgtatattggggatcactcaaggcccattgggaattttctttggtgggtgtttggcccagcccattaataatattcactagccttttgtggacaaatgaaagtgtcaaaatttattactacctccatcccaaattagatatcgttttgactttttgcttgcaatattcgaccattcgtcttatttaaaaaataatgcaaacctaaaaaggataagtcatacttaaggtattttgataataaaacaagtcacaaacaaaataaataataataacataatcttttaaataagacgaatggtcaaacattacaaataaaaaactcaaaacgacgaatattctagaatggaggtagtatatttttgagcggagggaatagttaagagtactgatgttaaacctgtgtcttatatatctgtttgttattgttttttcctagttagagcagggctaaccttaccatcaggggttgagttaccgcacccaatcgtaagcacggtaatcacacggtaaaccatgaaaaactagacgatgctattagaagttcatattattatgtaaatttatttgaatttgacgggataagttactattagtgtatccaaaggtaagtccggttaccgcggaaaccgcacaataacaagcgatattgtcgatttatgacctgtttggaatgtgaagtgagaattgtcttctactcttccataaatcaaatctttaggacagcacatataagtgatatacaaaaatgattaggctcttcagacatgtaaacttaatcggataatttctccctcaagatgaaaaacaagaactagagcacatattgctcttgatgggatggagatgctacgttttgtgaatttttgggtaagctcgattagtcagacttcctttccatccagtaactttcgccttaaactctcctactcctatgtagaaacaatcagaaaattctcttactccagtgctctctgtttatctttcagtcggtttcagacaaaacatggacgcacatcatgctcctacatgaactgcacattttacagataaaataagatgtcagttcgttttcagattataaaacaagttgtcgctctgccggcaaaattgattattttgcgcggcattgcgttggggaacatctctctgcctacacggagaaccagatattgcagttgaagtcttgaggacacacgcgggcagcacgttctctgacaaatctgcatatcatccttctgaacattcgttatctatgtcagactgaccaatcgccaaacagattacaagcatgcgatttcttctcttaaaaatgcccatggtgaccaatcattacatattgtctttcttttcatttcgacaggtcaatcattgtacgtataatattgtcacaattttacaataatgtataataaaacgtaatcttaatcaaaaccaagacattttccaggacaaacatggccaccacttcgggcttcggccatctacatgtccgcacgtttgatccatggcagtatataaaaccccaagcctctctccatctcgacacagccaaaaaaaagcttcacacaaaccatctcagtcgagcttacaccaagctccgcatcaatggctgccttcctccacctcgccatcctcgtctccctcctggccgccggcgccaccgccaacaacggctacaccacaccatcgccaccgccaccaccgcagcacacgccgccgccatcgccaccgccaccggcgccagcggcgcaccaaagcagcgacaaggtgctagtgagggtggaggggaaggtgtactgccagagctgcgagcaccgcaactcgtggagcctcgacggcgcgaggccgctgcgcggggcggaggtgtcggtcacctgccgcgacgccaagaaccgggcggcgtggtggaggctggccgtcgccgacgagagcggctacttcctcgcggagttcggcgtcaccagggcgtccgacttcctcggcgccgacccgcggggggcgtgctacgcgcggctgctgtcgtcgccggaccgcaagtgcgacggcctcaccaacatcaacgccggcatggtgggcgcgccgctccgcgacgagggcaagcggtggccggggcagggctacgacaacgtcgtctacgccgccggcccgctcgccttccggccggcgaactgcccgcccaagcactactagatgcgcccgccgcggccgcccccatgcgtgtggcgcgcgcgcactctcgtgcttttgaattgggagaggtcgtcgttgggtgtgcgaaatttaatttggacggagaatatatcctggtttattttgtgattctgttctaattgaattggtggtgttattatgtgattcttttgtaagttgatattgttgtggttctaccagttttacggcaaattaatcaaacttgatgtcatttttgttgggaaaaaaagataaccccgcgagtatataattttcggctccatcgtttcgcttataagcgaaaggtcatatttacaacaaaaaagaatatgaataaaatttttacatatgtgttcttagcgatctaaaagcaaaggctggaaaataaacttcgacgaaaaaaaatatcctaaaatcaattataaatttaaggtttaaaatttaaaatttgactgataagtataagcataagcgaaaaaatgatgccgataatttgcttcagatatcaggctaatgggccttgtggataatgctgcggggcactaggtcgtgattttgacggcccacacgagctgagtaactctctacgtgaagtgaaattttatgatccatgaaaaagtacctcaagtacctaaataaaaatatattttggtacctcaagagtcaagatacatggagataccaagcttaatttacacaagaaaaactcccaataatttcttaaggatggtaaaccgtaaacccttatgtgaattagtgagatcagtggtaggatagagcggcctctaacaaggagctagtcctagctagctgctggctaggggcgtgtggtactgtgcacataaattatagtcaccggctcaacgcaccggtatggcgacacaccacacaaacattacacaagttaacaacgaagatgaacagttaacaacgaagatgaacatggtcagatagatattagaattgagacggtgagcatagtcatgaaaatgacacgacaatggatgcctaatgcctagagttagctagggataaaaatgactgaaaacgatcatttattcagaaatgatttatggtctgttgcaaatttttattttaccaatttaactatttaggaaatgatttatatatggccaatcggatatgataaaaaatagaaccacttatagaaaacaatacttagttggtcgggaatttccatatcattttcatccctttttgaaatacttgatttatttgatgggttgatggtggaatagtggctaatgtgttagatccacgactaggagggaggtctgggggtgaggggtggagtgtaccatagcggagctggttgacccatcttatctaatgggtgtccgcccctaagattagagtgattttaactgtaaaaacttgctaccgtacatcgggttccccacattggttaccggatgtaggggtggccattatgtaaaaacaaacaattcgatctcaaccttcgatctttagagaaattttgggaccgacatgtatataaaaatagtcgatactgatttagtttcggtcataccaaaacaataaacaatctcaaaatttttaaaaaaaacataggagagaccgctccaccaaattctcaatctctagtggaggagacgcggaggtgccaccgcagagaagcaggatggcacagcgcagtaggacaacgcgaggaatgggatcgatgccgccgatgcaagtgtgacggactaacgggtgatgagagaggtggtgggggtactggggaagggagtgggatttgctcttgttgggttggcaggttgttgttggtcatttttgaaattgcagataaccgcgcctactgacagagttaaattttggttcgtcagatacagaaatgttttttttttcggccagtattggttactactccagtagtttggttcggtctctcggtttcagtctatttcggtctgtctggagaacctgaaactgcagtccagttaacgacagatacgggcagcacgttctaacaaatctgaatatcttgatactgaacattctttatggtctacagactcttgactaatcaccaagcagatcatgaacatgcgatttcttatcttaaaactgcatatcacagatgaatcgatcattacatatattgtcagaatcgaataacacataataaaatgtgatcttactccaaaatcaatcaagacagttaatttccatctacatgtccgcacgtttggtccatgcattgcaagtatataagccacacacctctctacgtttcgacacagccaaagttttagaaaagaacatctcggtcaagcacagcaagcaagctcccagcaatggctaccttccttcctattgcgatcctcgtgtccctcctggcagttggcgccaccgccaacaatggctacaccacaccaacaccgtcgccgccgccgccgcagcagtacaccccgccggcccacagtgacaagttgctggtgagggtggagggcatggtgtactgccagagctgcgcgtaccggaacacgcatagcctcgacggcgcggtgccgctgcccaaggcggaggtgtccattacctgccacgacaccaagaatcgcgtcatggagtgcaagcgggccatcgccgatgagagcggctacttcctgacggagctcggcgtgaccaaagtctctgacttctttatgggtgatccacgcaaggcatgccacgtgcgacttcaggcgtcgccggacttcaagtgcaacaaccccacaaacatcaactcctccgatattgagggcgcgccgctccgtgacgaggacaagcgatggactgatcagggctacgataacgttgtttacgccgccggccctctcgccttccggccggcaatctgccctctcaagcactaaaactaggtaccccacacaagtgcggtgtctatatttgtgacgtttacacgcacgcttttcataaatttgggaggcgtggaattcaatttggatgttggatatgcattttatttgtttctatcttaaatactgttgctcttgtgtgatatttgttgtaaatctattatgattttattaatttactatacacatcaaacttgatgtgattttccatcaagaaaacgctttttaaggagagtctcctaccgtgtatatatttatgtaataaataatttattgagttatgtatgtacaatgaaaattacaaattttttagccactgtgaaataagtagatcatcaaagttttcttaatctacatgcatccgaaaagtggccatttggccaacaccgaacaatgtggcctcggtccgaaaagaatcaacaatttttgagatgcaaaagaatcacaatatagtcatcaacaatttcatacaaaataatatcatagtaatcacaaagaaatcaactttctatcaccgatgtccgcatgttactatcctctaccctttacctatgcccgtgccctcctctgtcaggactaccgccgctagatctccacttgagaaggtatcgccgcggagaagcagggtggcacgacacggagtggtagcacaaaagggtggtgggatacgtgacgggatagcatggggaatggcatggtgacacggcaggacgatgcgttgtgttgttctcaatgccgtgatgctagtgtggcggtttccaactagcgtggggtgggaaagattagttagggaaatggaaaagagagaaaagtgagtagggcttgcttttgttgatttggtggactgctgttgggtttagggaaatgtaatagagagaaaagtgagtacgtagggcttgtttttgttagtttggttttctgttcttgggttttttttctggaattttggtttttaagttatttcagtttattgagcctacttaccgaattaatcgattaaatttggctagacagattcaagtgacctttttttttttgtttgtgtcttgcttagttcggttcgatttcggtctatttgtaccactaccacccaaaccgaacgtcgatagggacggtgcatggtaaaatggagagtggtagaagaggttggcggtgggagtggcttgtgttcttacttctagctacccggatccgttgtgcagggaggtcggggttgtattggcttaggcctccttgccagcagatctggcaacctcaccgtgacaaactggcaatggcgatagcgccatgaatcatgcagtgttagctcttgatcgatccgccgcatgtaaaaaaacatagttgctttgcgtccagtaatttggctttacatctcttgtttgtataaacaatcaggaaactgcactccgttttctttcaggtagtttcagaccaaaagaaaaggaacagcatggtacgacaatactgcatgaactgtatattttacacagaagatgagatgcttgttccttttcagagtactattcagagtactaacggaaataatgtagcgctatcggcaaaaatcatttgtctctctggagaacctggtattgcagtggagttgaggacacacacgggcagcacgttctctgacaaatctgcatatcttcatataccgaacgttctttatcgtctacagactgatcttaactaatcaccaagcagatcatgaacatgtgttttcttctcttaaaactgccttgcagatcaatcattacatgttatcttcttttttttctcctccaggccaatcattatattttgtcagaattaaatagcccacacaataaaacgcaatcttaataaaaaatcaagacagttagtgatttccatctacatgtctgcatgtttaattagtccatggcagtatataaaccccacgcttctctccattttctcacaccaaaacttcaggtaatcgagcaccaagctagctccaagcaatggctgccttccagcttcctctcgcgatcctcgtgtccctcctggccgtcggcgccactgccaacaacggctacacaacaccatcaccgccgccgccgcagcagcagtacaccccgccgccgccggcccacagtgacaagttgctggtgagggtggagggcatggtgtactgccagagctgcgcgtaccggaacacgcatagcctcaacggcgcgatgccgctgcccaaggcggaggtgtccgttacctgccacgacgtcaagaatcatgtcatggagtgcaagcgggccatcgccgacgagagcggctacttccagacggagctcggcgtgaccaaagtctctgacttcttcatgggcgatccgagcaaggcatgccacgtgcgacttcaggcgtcgccggagttcaagtgcaacaaccccacaaacatcaattactccagcatcgagggcgcgtcgctccgtgatgagggcaaacggtggactggcgagggctacgataacgtcatgtatgccgctggcccgctcgccttccggccagcgatctgccctcccaagcattaagaggcgccccgtgcatgtgcctacgtctgtggcgtttacacgtgcgcttttcgttaatatgggaggcactgaattctcaatttggattgtggataatgtttcttttgtgtttctgttttaattattgttgctcttgtgtgatatttgtggtaaatttgttctgattttattagtttgctgcaaaataaacttggtgtgattttcgatctagaaaacttttttaaggagagtctcctacattgtatgtgtttatataataaataatttactgagttacacaagtacaatgaaaatcacatactttctagccattgtcaaatgagtagatcaagaaaaccacatcaaagtttccttggtctacatgcattcaaaaagtggccaacaccgagcaatgcggcctccgtatctgtcatgactgaagataatcaacaaattttgagaagcaaaagaataacaatagtcatcaataatttcaaaccaaaaaatcgcagtactgtaaaacaaaaaaaacatttgcttttcgccggcgtccgcatgtttctctccttcacctttttcctacacctgcgctttcctctatcacgattattgccgctagatctccatatcatgagtgccgctagatctccacttgaggaggcatcgttgcggagaagcagggcggcacgacacaacgtagcagtacagaagagtggtaggatgcgcgacaggatagcgtggggagcggcacggtgatgcggtaggatgatgcgttgtggtgttgtcgatgccgagggtggtgggggtgggaaagggtagttacggaacaaagaaaaaagtggatagggttttgcttttgttggtttgatcggcttatgttgtgctttttcttaaatttttgtttttagggtatttcggtttaccgagcctacttatcgaattgatcaattaaatttggctagtcagatctaatgaccataatttttttcattattgttttggttagtttggttcgattctggtctattttgcccactcctaacttaacgttgataggagtagtgcatggcgagacgaagagtgatagaaaaaggtggcggcgggagtggcttgtgtccttaagctacccggttccgtgttgtgcggggaggtcgaggttgtcagatccggtggcccgggcctcctcgcgaacagatgttgcagccttaccatgacaaaacttcgcacgattgatctgccgcatgtaaaaaaaaacagacttgctctgcgtacaatcaatcagaaaactgcaccccgttttctttcagttagtttcagacccaaaggaaatagatactacatgaaccgtatattttacacagaagatgatatgctgttccttaattttcagagtactaacggaaataatgtagctctatatcgccaaaaatcatttgcctgtgccgagaacctgtggtatttcagtgcagatgggaacacacacgggcagcacgttctctgacaaatctgcatatcttcacaccgaacattctttatcgtctacagactgatcttaactaatcacagcagatcatgaacacgcgatctcttctcttagaagtgccttgcaaatcaatcatgacatgttatcttcacaaaaataaaatgcaatcttaatccaaaatcaagacagttagtgatttcctacatgtctgcacgtttaattagtccatggcagtatataaaccccatgcttctctccattttctcacaccaaaacttcaggttaagataaaccatcttaagttgagcaccaagctagctccgactccgagcaatggttgccttccttcctctcgcgatcctcgtgtccctcctggccgccggcgccactgccaacaacggctacaccacaccatcgccgccgccgccgccggcccacagtgacaagttgctggtgagggtggagggcatggtgtactgccagagctgcgcgtaccggaacacgcatagcctcaatggcgcgatgccgctgcccaaggcggaggtgtccgttacctgccacgacaccaagaatcgtgtcatggagtgcaagcgggccatcgccgatgagagcggctacttccagacagagctcggcgtgaccaaagtctctgacttcttcatgggtgatccgagcaaggcgtgccacgtacgacttcaggcgtcgccggatttcaagtgcaacaaccccacaaacatcaactactctgacatcaagggtgcgccactccgtgacgagggtaagcgatggactggtcagggctacgataacgttgtttatgccgccggtcctctcgccttccggccggcgatatgccctcccaagcactaaaactaggcaccccatgtaaatgtggtgtctatatttgcgacgtttacatgcgcgtgcttttcataaatttgggatgtgtggaattcaatttggatggtggatatgtatttcttttgtgtttctatcttaattattggtgctcttgtgtgacatttgttgtaaatctattatgattttattaatttgctataaatcaaacttgatgtgatttttgatcaagaaaactttgatatctctgtagagaagggatctctggaccaccgaccattcacacactcaccctctaccgctccattgtagcaccattgtcatacttgcaaaacacatcaaagcaggtgtaggtctgctattgtaaaaacccgcgctccaaaaccgtgcagtccaatccatccaacaggcatgcccacttacacaaatcacctcacttgcactttcctccttattaggccaagatgtcgtagctatttttcaggaggcccaaacctgggtaaatctctacgtgaataagtgagattagagtgatcacatttggataaccctgctgccgaacaccaacttccctaatatattggctaccttacgcgggggtggcagtaaggtcggtctcgatttccggtcttttaagaaattttggtcatctatgtaaaatcaagaagttgatttatattttgtgatgaaaatattggtggtttgctaatattcctacaatctaaaaatgaaaaccaacatgcaatcgaaaaatggccaacgctaagcaatgcggccttggtctctatcatgactgaaagtaatcaatatttttagatatacaaaagagtcacaaaaatcacgaaatatttcagacaagaagatcacaataatcaaagaaatcagaaaaaaatatcatctacctatcgccggcgtccgcgtgtttctctcctctgccttttgcccgcggccatgcccttctctattaagactgctgccgctagaccttcatcttgcgggtgccactagatctccactgagggggtgccgctatggagaagaaggcggcacaatatggagcacggaagcagtagccgattcacctatcgggcagatcgggcggctgctcgggcttcacgccatgtaagggttgactccaatcgatgtattaccatgcaagttagttgcgggcgcatggcaacaaatgtgtgcggttgtgtcctactgcatgaaggcaccagcctgaatgcagatcctctacagtactgctgattcagtagcagtggctgatttatgggtacagacctgttaacgaccacgctcatacacccgaaggcgagttttggacctgcactgaagttaagcagatctcccaggcctcgtgttttctgtcaacaggacccacacatcaatgtttgctaatgcatgcaatctcggaaatgctaatgggcgggtgatcgctcccccgcccgcccagcgatcacccgcccgccccctccctatactactagatacactcctccctcctcccctactacagtacaccacacaaattttttttaaaaaacaaaaagttagaaaaatttatgtatagaaatactatatatataaaaaatttaaatttaaattcaaatttgaatcgggtatgtaaactttttgacttataaactttgggtctataaattttaggtgtataaactttagatgtatagaaatactatatatagaaaaaatttgaattcaaattcaaatttgaatcagatataattcaaattcaaatttgaatcgggtatgtaaacttttgacttataaactttgggtttataaactttggttctataaactttaggtgtataaactttagatgcatagaaatactatatatagaaaatatttgaattcaaattcaaatttgaatcggatataattcaaattcaaatatgaaacaagtaaatttgaatcagatataattcaaatataaatttgaaacatgtatctaaactttagatgtgtaaacttgaggtgtataaactttaggtctataaactaactttaggtgtataaactttagatgtatagaaatactatatataaaaaatatttgaattcaaattcaaatttgaatcggatatataaacttttgacttataaactttgggtctctaaactttagatgtgtaaactttaggtgtataaatttactaaaataagaaagtaatacggtgccaaaaaggaaaccaggtggagggagggagaggggaggggggtannnnatntgatcgctacccccattggcgggcgatcaatcgcccattagggctgcccatgcaatttccactgagcaacttgaaacctgaaccaatgccaggctaatcaccttgctaattgtgtatgcttaaatacttaatcatgttgatattgctgactatcaactcatgtatactacaccatagtccaggaaagacataacaagggaccaattatattttattaagagaaaatcttccacatttatataagtgttagatcgcaattttataacaaaattactctgatttaaatctctactattataaaaattaaagatgtttctgccaaaattttagtatgtcatccgtgttggagttggtttactaatatttctctttatcgcaaatctatctgtacatctaataaaaaaaataagcaagcatcccgtgtatttgattttgtacgtcgtccgtataagtccgatccgttgccacgtgcctccagccaccgccgccgcgctgcccaggccgaaccctaacgccgccgccacatcgatctataccttcctgtgcgttttcttctctaattaattgcaaaaatcgattctctactcgtccctcatcctttccccataatttcccctttcaattcggatttaattaactagatttaatatttgtttaacggttgtgaatgatggtctgccagtgatcttcccccaactgtttttatcccgagtttcgtggattcgttccgattttggaaaaaactaaaagaagagatcaagtggataaaaaatccttaatcaattttgggagatcgagaaagattcagtttgatttgatggggaacttgttttctggaatttaaaaggaggtaggaggcaacgccttttcaattataatgtatagcgatactaatgtttcaatttattccttggctcttaatagccgttgtatcactgaaaaacgcctttacccgttgcaacgcacaggtattttttctaatctaagaacaatttgagcgaaatatgtagtggttttagttaggctttgtccatcacctaaattttctaaagggaaaagtccgaattacacccctaagtatgaattaccccctcagactcgaaaaccatacatgtttcaccctcaattattaatatcagacgaattaccactaactcgaaccggagtggttttggtcctacatggcagtccagtcagcaattcttcttttttaaatggatgggccccacctgtcagtctcatcctctgtatttctttcccctcacctctctatctccctctttccccaatcctctctcttgtccctcccctcacctccgtctctctcagctggcggatggggagccaagcacggtagcggcgggcgggggtggggacagaggcaaaagtggggcacgacgcgagcgtgagcaacactagccatgcgacggtgtgaaacacatatatgcgaggcacatccccgtccaccttgccttcctctccctctcccgatgcctgcaacgcacgatccttcgtcgttgtcttctgcttctgattaatggaggagtgaagtggtttttgtaacaagtgatgttgggtgctgtggagagagagagggcaggggagggagagagatgacatgtgggtccaaggattttttttctatttttttactgactggattgtcacgttgatgcacatgtacaattttaggtcaaaaccgctccaaaatagtgctcagggtgatctttgtctgttattaatagtcaagggtgaatgatgtctgattttcgggtccagaggataattcgtactcactcaatagttcaggggggtaatttggacttttccctttctaaaattcctagctcggccatggacgaaagaatggtggtacagcgcagcgggactacgtggggaacgacacaacgaagtggcaagacgatgtaggtgttgttgatgccgtcgatgtggtatcgtgacgagtgatgattgggatgttggggcggagaagggtagttagggaatagagagaaaagtgagtatggtttgtttttttcttgatggttgttattgggctgtttttggaattttggttaactgagcctacttaccgaatcgatagactaaatttagttagtcagattcagtgatcatatcttttttatttctatcttggttagttcgattttgcccacccttaaccaaacatcgatagggcggtgtagagtgagacgtattaggaaacgataggcaaacaaacgataaagaacaatagatcaatcacagaagacacgagattttaacgtggaaaacccttccaaagtaggagagaaaaaaccacggacgctagccagcaaaatatcttcactatatctggggagaggttacaacgccgcacggcggcttacatgaggtatatatatggtggaaccctaaaatggatgacgatccgtttcgcgggggctccgcccccgcacctccaggcgtccccaggtgcacggcccaatgggtcagcttcagtctccgccacgctccggcccaagcctcccgacgatgggcctccgcgaaacaactcaacaagacgaagatgatcaaagaggacggtagcaggagtggcttgtatcttcacctccagctactcggatctgttgcgcgcagaggccgaggtcactagatccggtggccttgggctccttgctagtagatgcatcagcctcacggtgacaagggtgatagcgccgtgcatcatgtggtgttggctagatcgatccgctgcatgtaaaaagcagacttgctttggatccagtaatttggctgtaaagctcttgtttctacaaacagtgagaaaaatgcacctgttttctttctgtcagtttcagacccaaagaaaaaagacgccatggtacttgaatactacatgaaacatactatataaatgagtctaactgcaagttagaactacataaacacaaatcttgacgcaaaatcaaatcttgacgcaaaatcttatggacaaagtataaaaagatagaagcccaaaaatctatcgcaagtaaaatagcaaacctgtctttatggagaataatgtagctactaaataatctccatatatatcatctgcttgtgtagacaacctggtattgcagtgccgttaaggacagacacgggcagcacgttctgacaaatctcaatatatatcttcatcctgaatattttcggtagtctacaaattcttaactaatcaccaagcagatcatgagcatgtgatttcttctcttaaaagtgccttacagatcaatcgttacagatcatttatttcgccaggctaatcattatatatattgtcaaaatcgactaacaataaataaagtttgatctgttaatccaaaatcagcacaattaatttccatctacatgtccgcacatttagtccatggtatgcagtatataacccacatgcctctctacgtttcggcacagccaaagcttcaaaacagaatatctcagtcgaccacggagcacagcaagctagctcagaggctcagagcaatggctgccttccatcctctcgcgatcatcgtgttcgtgtccctcctggccgccggtgcaaccgcaaactatggctacaccacaccatcgccatcgccgcccccgccgccgccacagcagcagtacaccccgccggcccacagcgacaagctgctggtaagggtggagggtatggtgtactgccagagctgcgcgcaaaggaacacacacagcctcgaaggcgcgaagccgctgcctaaggcggaggtgtccgtcatctgccatgacgccaagaatcgtgtcatggtgaggtgccgtcgggccgtcaccgatgataacggctacttccgcgcggagctcgatgagaccaaagtctccgacttctacatgggcgatccgcgcaaggcgtgctatgtgcggcttcgggcctcgccggacttcgaatgcaacaaccccacaaacatcaactactctagcattgagggtgcgccgctccatgacgagggcaagcggtgggctgaccatgactactataacgtcatgtacgccaccggcccactcgctttccggccggcgatctgccctcctaagggctaggctccctatgaatgtgcctgcatttgcgacacttacagtttcatcaatttggaaggcatggagttctaattggacggtggatacgtggttcttttgtgtttctattttttaattgttgttgcccttgtgtgcttgtgttgtaatttttttatgattttattagtttgctgcaaatcaaacttgatgtaattttcgattaagaaaacttgttgtggttttcagtcaaccatttgtaccctcttttccaaaaaaaatacaaggtatgcataaatattaattcaaccctggtaatatctcacgaccaataaatctaatataaattaaattttatttgataaaattaataccgttgaactgagatttgaatgtaattttctataattagtctttgttgttacaaacatcgaaatatataggacaaattaaaaatcacttactatttggaaaaccgtgctaaatttaactatactgtaagtttagaattttgagtacgtacataatttgcttagtcagataccagaggttacgtattttcgaaaattgaagaatgagtcggacccttgttgggccagatgtctgaggcccatacaaaatctgtaattttgatgtggaaaaagtactgcgaagatccctcatcttatcaccgaattagaaaatcatccctcgatcgaaaaccagagacaggccatgtttagttccacagccaaaacttttttaaagtatacggacacatatatttgaagtattaaacgtagactaataacaaaacaaattacagattccgcctgtaagctacgaaacgaatttattaaatctaattaatccgtcattatcaaatgtttattgtagcaccatattatcaaatcatggcgtaattaggctcaaaagattcgtctcacaatttacatggaaactgtacaattggtattttttttatccatgtgtccaaatatttgatgtgacggaatatttggaagtttgaagggaactaagcacagccacaatgcatcttccaacattcaaaacaagtgcaaacaaaattcctcagcttcccaattttagctgacatagcgtttatatggctcctttctacaaagaatgagaaaaatacatccattttctttcgttcagtttcaggcccaaagaaaaaagacgtcatggtactttaatactacatgaaacgtattaaataaatgagtgtaattgcaagttagaattacataaacacgaatcttaatgcaaaatcctataaacaaaatataaaaaaagaagccccaaaacctgtcacaagtaaaatagcaaaacctatctgtatggagaataatatagctaccaacataaataatcactacttaaaaataattttcctggacgaccacatcaatagattgcaggtggaccaagtatctgtgtctgtaaaaatcgactcacatttttacagacgatcctgttaagcagccgcaaaaaaaaataaggttatttttctagatggacatcttaagaggccaaacgggaaaaatatattttcgcagacggccatcttaaacgtccgcccagtagtttaaattatctcctcttttccctcatagcacttctattttttttcaagccatcctcatcttctcttctctctctcacctcctcttctccacatactactctctcactctctcaaactcccgtacacaaaaatagctattttcgtagacattttagtacgtgtgggttgtcctaccgtacgcgaaaatttctcttgagccatgagaaaaatcacttttgtcctagtggtagccctattggcaaaaaatcatctgcccaacatggtattgcagtgtcgttagggacagacacgagcagcacgttctgacaaatctgcatatatatcttcatcctgaatattctttatagaattatagtctacaaattcaaaactaatcaccaagcagatcatgagcatgtcatttcttctcttaaaagtgccttacagatcaatcgttacatgttatcatttctttcgccgggcaaatcatcatatattgtcagaatcgaataacaaaaaataaactgtgatcttaatccaaaatcaagtttaatttccatctacatgtccgcacatttagtctatggcatgcagtatataacccacacgcttctctacgtttcgacacagccaaagcttcaaaacaaaacatctcatcagtcgagtacggagctgtgctcagagcaatggctgacttccttcctctcgcgatcctgttcgcgtccctcatggccgccggcgccacagcaaactatggctacaccacaccatcaccatcgccgccaccacctccgccacagcagtacaccccgccggcccacagcgacaagctgctggtgaaggtggagggtatggtgtactgccagagctgcgcgcaaaggaacacacacagcctcgaaggcgcgaagccgctgcctaaggcggaagtgtctatcatctgccacgacgccaagaatcgtgccatggtgaggtgtcgtcaggccgtctccaacgataacggctacttccttgcggagctcgatgagaccaaagtcaccgacttctacatgggcgatccacgcaaggcgtgctatgtgcggcttcgggcgtcgccggacatcgaatgcaataaccccacaaacatcaactactctagcatcgagggtgcgccgctccgtgacgagggcaagcggtgggccgaccatggctactataacattatgtacgccaccggcccgctcgctttccggccggcgatctgccctcctaagcactaggctccctatgaatgtgcctacatttatgacacttgcacttgcacacttgcgtgtttcatcaatttgggagaaactagtttgatggtggatacgtggttcttttgtgtttctgttttaattgctgttgctcttgtgtgattgtgttgtaatttttttatgattttattagttttctgcaactcaaacttgatgtaatttttgattaagaaaacttgatgtgattttcagttaatcatttgtaccctcttcgaaaaaaatacaaggtgtgcatacattttgattcaaccctagtaataactcacgaaccataaatctaatataaattaaattttacgtgataaaaataataccgttgaactgagatttggatgtaatttttttataattatggcttttgtggtacaagcatcgtaatatataggacaaagtaaaaagcactaaatattttggaaaaccaattttaactataccttaaattttgaattttgagtacttacgtaatttgcttagtcagatacccttagcgaatgagtcgtaatttgaattttgagtacgtacgtaatttcgaaaattggcgaaagagtcggacccttgttgggccagatgtctgaggcccatacaaaatctgtaatttcgatgtggaaaaagtacagtggaggtccctcatcttatcaccgaattacaaaatcgtcccacgcatcctccaactttcaaaacaagtgcaaacgaagtttctcggtggtgttgtttccaattttagctgacatagcgcctatgcaactcctttctacaaacaatgagaaaaatacactcgttttctttctgttagttccaggccctaagaaaaaagacgtcatggtactttaaaactacatgaaacgtactgcataaataagtgtaattgcaagttagaactacgtaaacacgaatcttgatgcaaaatcatatgaacaacatatcgaaaaatagcaaaacctatatgtatggagaataatgtagctactgacataaataatcactataaaaataatttttctggatgagcacctcaatatattgcagacggacaataagtatccatgtctacgaaaatcgacttacattttcgcagacgaccctattaagcaggtgcacaggaaaatatattttcgcaggcagccatcttaaatgttcgcccagaagtttgagttacctcctcttttccctcctagcacttcaatttttttttcatgtcatccttatcatctctctctcacctcctctcctccatatactactctctcactttctctcaaactcccagacaaaaaaatagctattttcgtagatcttttagtgcgagcgggctgtccaaccgtacgcgaaaatctcttttggcccatgtgcaaaaatctctttcttagtagtggtagccctataggcaaaaaaatcatctgctcaacatggtattgcagtgccgttagggacatacacgggcagcacgttctgacaaatctgcatatatatatatatatatagatatatatagatatatatatcttcatcctgaatattctttatagtctacaaattcttaattaatcaccaagcagatcatgagcatgtgatttcttctcttaaaagtgccttacagatcaatcgttacatgttatcatttcttccgccgggctaatcattatattatatattgtcagaatcgaataacaaaaataaactgtgatcttaatccaaaatcaagcttaatttaacatgtccgcacgtttagtccatgccatgcagtatataacccacacgcctctctacgtttggacatgaattaaatttaaaaatatattgttcctcattttttttaaagaatagttgagatgcaaacttttttacagaaatataccgtcgatctcgcgtaatcgttacgcgaaaatgacacggacgtaatatcacggacggtatcgcgcgatgaaagcgcgagagcgcacagtctcgcgcaacaactgcgcgagaccgcacggtctcgtggaaccaaagggtctcgctgattgaaatagcgataccgcactgacatgcctgttgattaattatcctgattagcaattaattaatcactaatcaggataattaattactaattattattagttaatagttaattaggtaattaaccattgacggccgggactgccatgccggtgttgctgcttgaacaagcgataccgagcggactcgctctttgcttccgcgagaccgcgcggtctcgcgccactgccgcgtgataccgcacggtctcgcgctttcgtcacgcgataccgctggtgacgtcatgtccacgtcattttcgtaaaacgattgcgcgagattgatggtatatttgtaaaaaaaaaaatttatcccgaatattcctgaaaaaaattggataaacagtatattttaaaatttaattcgtttggacacagcaaaagcttcaaaacagaacatctcagtcgagtacggagcacagcaagctagctcagagcaatggctgccttccatcctctcgcgatcctcgtgttcgtgtccctcctggccgccggcgccaccgcaaactatggttacaccacaccatcgccatcgccgcccccgctgccgccacaggtataccccgccggcccacagcgacaagctgctggtgagggtggagagtatggtgtactactagagctgcgtgcaaaggaacacacagcttcgaaggcgcgaagccgctgcctaaggcggaggtgtccgtcatctgccacgatgccaagaatcgcgtcatggtgaggtgccgtcggacagtcaccgacgaaaacggctacttccgcgcggagctcgatgagaccaaagtctccgacttctacatgggcgatccacgcaaggcgtgctatgtgcggcttcggacctcactggacttcgaatgcaataaccccacaaacatcaacaactctagcatccagggagcaccgctacgtgacgagggcaagcggtgggccgaccatgactactataacgtcatgtacgctgccggcctgctcgctttccggccggcaatctgccctcctaagcactaggcaccctataaaaatgcctgcatttgtaacacttacacttgcacagttgcgcatttcatcaattcaggaggcatggaattataattggacggtggatacgtggttcttttgtgtttctgttttaattgctgttgctcttgtgtgattgtgttgtaaattttttatgtttttattagcttgctgcaaatcaaatttgatataattttcgattaagaaaacttgttgtggttttcagtcaatcatttgtaccctctttccaaaaaaaaacaaggtgtgcatacatattaattcaaccctagtaatatctgatgaaccataaatctaatataaattaaattttattagaaaagatgcccgtgcgttgcaacggccaacgggtaaactaaaattatagcaaatataaaaatattagatgattagggtttagtttttcgtgatatgagcccataaaaaaaatatgttgcttacaaataaaaaggttctaaaaaaagaaaaaaaggccccattggaccctatcggcctgctattgcgcgtccggcccataaagagcgtgtggcccaacagtgctatggcccgagatggaggccggcccgacacaggatcgatctaagccactcattttgatggacggctcggatcgattctaaatccatcaaaaccgttggtgcctaaaaccctaaccctaatcacactttcctctcccaccccccaccacgagctcctcctccccctcccatccactctcacgactggcggcaccgctcgtcctccgttgccccctctccgctgctccccctcccccaccgtcgttgcatgccccctctctccttggtccgagctcagcgggggcgctggatctggtgcccccagtcctctgctcgccacggagatcccctctgccggtggctcattctcatacctccacgttgagctcagcgacatcgcggtgttcctcgccgccgggaacataccgttggaggccgtcgtcagggtggtgcgcgcaatggcatggctgctgctcgcggcgtacctgcagttcacgcttgggtggcgccgtgaggagtggttccctgtgccgctgcggctctggtggtcacgccgccgcttgtgggtcgtatgcttcgccggagaagagagaagagagaaagtagggagagagatgaagagaggtaaggaagaaagaggagaggaggaggaggaagaggaagaggggcaattcggtcacgatgtttaacaaagtaggccccttctaggctcgtcagcacaaaaatactaatttaatggatgtggtgtttggtggcaaataactacatttacatagtgtcttctctcaaaagttactttgcgcggtgtcctacagctaaaaccataaagtcgcaatgtcctgtagcaaaatttgcctatattttacatagtccctccatcccataaaaaaccaacttagtattagatatgacatatcctagtatgtactacgaatctggacatgcatatatccacattcattgtctataatatgtcacgtcccgttctagatgggacggtgggagtaggaaatgacatgccatactccttttcagagtactgacataaatactgtagctctatcggcaaaaatcatctgcctgggtggagaacctggtatttcagtgccgttaagggctgcacgttccgacaaatctgcatatcttcctcctgaatattctttatcgcctacgaatttttaactaatcacctggcagatcatgagcatacgatttcttctattcaaagtgccttacagatcaatgattacatgttagcatttctacgcgggctaatcattatatatttcttagaatcgataacaaaaaaaaataaaatgtgatcttcatccaaaatcaagacagttaatttccatctacatgtacccacgtttagtccatggcatacagtatataatccacacgcatctctacgtttggacacagccaaagctacaaaacagaacatctcagtcgagtacggaacacagcaagctagctcacagcaatggctgccttccatcctctcgcggttatcgtgtttgtgtccctcctggccgccggcgccaccgcaaactatggctacaccacaccatcaccaccgccgccgcagcagtacaccccgccggcccacagcaaaaagctgctggtgaaggtggagggtatggtgtactgccagagctgcgctcaaagaaacacacacagcctcgaaggcgcgaagccactgcctaaggcggatgtgtctgtcatctgccacgacgccaagaatcgtgtcatggtgaggtgtcatcgggcagtcgccaacgataacggctactttctcgcggagctcgatgagaccaaagtctccgacttctacatgggcgatccgcgcaaggcgtgctatgtgcggcttcgggcctcgcaggacttcgaatgtaacaaccccacaaacatcaactactctagcattgagggtgcgccgctccgtgacgagggcaagcggtgggccgaccatgactactataacgtcatgtacgccaccggcccgctcgctttccggccggcgatctgcccgcctaagcactaggcttcctatgaagcttcatcaatttgggaggcatggagttctaattggacggtggatacatggttcttctgtgtttctattttttaattgctgttgcccttgtgtgattgtgttgtaattttttttatgattatattagtttgctgcaaatcaaagttgatgtaattttcgattaagaaaacttgttgtggttttcagtcaaccatttgtaccctctttccaaaaaaatacaaggtatgcataaatattaattcaaccctggtatatctcacgaccaataaatctaatataaattaaattttatttgataaaaataataccgttgaactgagatttgaatgtaattttctataattaggctttgttgttacaagcatcgtaatatataggacaaattaaaaatcacttgctatttggaaaaccttgctaaatttaactataccttaaattttaattttgagtacgtacgtaatttgcttagtccgataccagaggttacgtattttcgaaaattgaagaatgagtcggacccttgttgggccagatgtctgaggcccatagaaaatttgtaattttgatgtggaaaaagtacagcggagatccctcattttatcaccgaattagaaaatcatccctcgataaaaaaccagagacaggccaacttccaactttcaactaaacacatccacaatgcatcttccaactttcaaaataagtgcaaacaaagttcctcggtggtattgttcccaattttagccgacatagcgcctatatggctcctttctgcaaacaatgagaaaaatatacccgttttcttttcgtcagtttcaggcccaaagaaaaaatacgtcgtggtactttaatactacatgaaacgtactaaataaatgagtgtaattggaagttagaattacataaacacgaatcttgatgcaaaatcctataaacaaaatataaaaaaacagaagcccaaaaatctgtcacgagtaaaatagcaaaacctatctgtatggagagtaatgtagctaccaacataaataatcactacttaaaaatgattttcatggatgaccacctgaatagatagcaggtggactaagtatccgtgtttgcaaaaatcgactcatatctttatagatgattctattaagcagccgcacgaaaaaataaggttatttttatagatggacatcttaagaggccgcacaggaaaaatatattttcacagacggccatcttaaaggtccgtccagtagtaaaaatatattttcgcagacgatcatcttaaaggtccgtccagtagtttaagttatctcctcttttccctcctagcatttcaattttttttcaagccatcctcaccttctctcctctctctcacctcttcttctccacatactgccactactacataataggtttttacatacggccagcaattattttcacatgcggctaggccattagggaaatcatctgcccaacaagatattgaagcgccgttagggacagacacgagcagcacgttctgacaaatctgcatatatatcttcatcctgaatattctttatagaattatagtctacaaattcttaactaatcaccaagcagatcatgagcatgtgatttcttctcttaaaagtgccttacagatcaatcgttacatgttatcatttctttcgctgggctaatcatcatacattgtcagaatcgaataacaagaaataaaatgtgatcttaatccaaaatcaagcttaatttccatttacatgtctgcacgttagtccatggcatgcactatataacccacacgcctctctatggagaataatgtagctactgacataaataatcactataaaaatgattttcatggatgagcacctcaatatattgcagacggaccataagtatccgtgtctgtgaaaattgacttgtattttcgcagacgaccctattaatctgctgcacaggaaaataagattatttttctatacgaatttcttaaggggctgcacgggaaaatatattttcgcagacggccatattaaaggcccgcccagaagtttgagttacctcatctttctctcttagcacttaattttttttttcaag

SEQ ID NO: 42288 - DNA, 16287 bp, Oryza sativa
ttagcgcgagcaggctgccctaccatattgcagtgccgttagggacatatacgggcagcacgttctgacaaatctgcatatatatcttcatcctgaatattctttatagtctacaaattcttaactaatcaccaagcagatcatgagtatgtgatttcttctcttaaaagtgccttacagatcaatcgttacatgttatcatttctttcgccgggctaatcattatatattgtcagaatcgaataacaaaaaataaactgtgatcttaatcaaaatcaagcttaatttccatctacatgtccgcatgtttagtccatggcatgcagtatataacccacacgtctctacgtttcgacacagccaaagcttcaaaacaaaacatctcatcagtcgagcacagcgagctagctcagagcaatggctgccttccatcctctcgcgatcctcatgttcgtgtccctcctggccgccggcgccactgcaaactatggctacaccacaccatcaccatcaccgccaccgccgccgcagcagcagtaaaccccgccggcccacagcgacaagctgctggtgaaggtggagggtatggtgtactgccagagctgcgcgcaaaggaacacacagcctcgaaggcgtgaagccgctgcctaaggcggaagtgtccgtcatttgccacgacgccaacaatcgcgtcatggtgaggtgccgtcgggccgtcgccaacgataatggctacttcctcgtggagctcgatgagaccaaagtctccgacttctacatgggcgatccgcgcaaggcgtgctatgtgcggcttcggttgttgccggacttcgaatgcaataaccccacaaacatcaactactctagcattgagggtgcgccgctccgtgacggtgcgccgctccgtgacgagggcaagcggtgggccgaccatggctactataacttcatgtacgccaccggcccgcttgctttgcggccagcgatctgccctcctaagcactaggctcactatgaatgtgtctgcatttatgacacttacacttgcacacttgcgcgtttcatcaatttaggaggcatggagttctaattggacggtggatacgtgattcttttgtgttatgttttaattgttgttgctcttgtgtgattgtgttgtaattttttatgattttattagtttgctgcaaatcaaacttgatgtaattttttattaagaaaacttgatgtgattttcagttaatcatttgtaccctctttcgaaaaaatacaaggtgtgcatacatattaattcaaccctagtaataactcacgaaccataaatctaatataaattaaattttatgtgataaaaataatactgttgaactgatatttgaatgtaattttctataattatggctttgttgttacaagcatcgtaatatataggacaaattaaaatcactaaatattttggaaaaccatgctaaatttaactataccttaaattttgaattttgagtacgtaggtaatttgcttagttagattatctcgcctcacagcgtttcctcgtctccttctcgcttccttgtctcctcgccttgccgccgcccgagcaggccgccggcgtgccgagcggcagtgaggaaggcgacagcggggcctttcggcggagaccacgacgcggctgagggctgtaccgagtctggggttccggcccccaaaatctggtggcgtggaaggtgacggggccgtgggcggcggtggccggccgggccgagcgcggctgcggaggtggtccggaggtacggaggcgcgcgagttggcgagcggcgttggccgaaccgcaccttgcgcgcagcagtggaggggtcgggaggcagtgcggcggcgggtcggcaagacgtcggcgacacgattctttgggcgacggtggatgctgtggagaacggcgacgtaagcgttgatgtccggtcctcggcaaggagaaggcggttccggcgaaggtggtttcgtagctagcgggcgaccctaggggcagcggcggtgtgcgagtccaagcaatgacctcctcggttgcggcagctgcagccctagaggcagtggcggcgtaatcaccgatgcagatggttcaggtgaaggtggatccaatcggcgatggcagcccttggggcggcggaggccttggagtccgggcggaagatgatgtcctctctgaccacggcaaaggacgttggcagaggtggtagtgggctgggaatcggagaggcggagaaggattccgacgttggcagcggccctatgggcggcagaggcttaggaatccggtgaagcagatcctttcagcccgtgtctagttggctagttctgactagacgacgatggatgaaggtggactactcggtggtgcgtggcatcggttcacttgaagcagatgaagaaggcaccagtggagattcgcagcgacaacgtactaggggcggttgtgactaaacgacttccactcatcgattttgactatttcaggagagaatgtcgggatgcagggatgtgtcgaggttgtaggttttttgttttttggttgtgtgttctcctctttattgagatttgagtttaagtgctcttatatcattttagctgtctatatccatcgtggatatagaggccggattaatgaaaatccattatctaaaaaatagataccagaggttacgtatttcaaaaattggcgaatgagtcggacccttgttgggccaaaagtttgaggcccatacaaaatctgtaatttcaatgtggaaaaagtacagtggagatccctcgtcttatcaccgaattacaaaatcgtcccttgaccgaaaaccagatagaacacatcctccaacttccaaaacaagtgcaaacgaaatttcttggtggtattgtttccaattttagctggcatagcgcctatgtaactcctttctacaaaacaatgagaaaaatacactcgttttctttccgttagtttcaggcgctaagaaaaaagacgtcatggtactttaatactacatgaaacgtactacataaataagtgtaattgcaagttataactacataaacacgaatcttgatgcaaaatcctatgaacaacatatcgaaaaatagaagcccaaaaatctatcacatgtaaaatagcaaaacctatctgtatggagaataatgtagctactgatataaataatcaccataaaaaatgatttttctggatgagctcctcaatatattgcagacggaccataagtatccgtgtctacaaaaatcgactaacattttcgcagacgaccctattaagtagctgcacaggaaaataagattatttttccatatggacctcttaaggggctgcacgggaaaatatattttcgcagacggccatcttaaaggtccgcccggaagttcgagttaccttctcttttccctcctagcacttaattttttttctaagtcatccttatcatctctcctctctctcacctcctcttctccacatactactctctcactttctctcaaactcctgcacgcaaaaatagctattttcgtagatcttttagtgcgagcgggctaccctactgcacacgaaaatctcttttgggccgtgtgcaaaaatcactttcgtagtaggggtagccctatcggcaaaaaaatcatctgcccaacatggtattgcagtgccgttaggtacagacacgggcagcacgttctggcaaatctgcatatatatcttcatcctgaatatactttatagtctacaaattcttaactaatcaccaagcggatcatgagcatgtgatttcttctcttaaaagtgccatgcagatcaatcgttacatgctatcatttctttcgccgggctaatcattatatattgtcagaatcgaataacaaaaaataaaatgtgatcttaatccaaaatcaagtttaatttccatctacatgtcctcacatttagtccatggcatgcagtatataacccacacgcctctctacgtttcgacacagccaaagcttcaaaacaaaacatctcatcagtcgagtacggagcacagcaagctagctcagagcaatggctgacttccttcctctcgcgatcctcgtgttcgtgtccctcatggccaccggcgccacggcaaactatggctacaccacaccatcaccatcgccgccaccaccgccgcggcagcagtacaccccgccggcccacagcgacaagctgctggtgaaggtggagggtatggtgtactgccagagctgcgcgcaaaggaacacacacagcctcgaaggcgcgaaatcgctgcctaaggcggaggtgtccgtcatctgccacgacgccaagaatcgcgccatcgtgaggtgtcgtcgggccgtcgccgacgataacggctacttccgtgcggagctcgatgaaaccaatgtctccgacttctacatgggtgatccacgcaaggcgtgctatgtgcggcttcgggcctcaccagactccgaatgcaacaaccccacaaacatcaactactctagcatcgagggagcaccgctacgtgacgagggcaagcagtgggccgaccatgactactataatattataatattatgtacgctgccggcccgctcgcttttcggccggcaatctgccctcctaagcactaggcaccctataaatgtgtctgcatttgtgacacttacacttgcacgcttgcgcgtttcatcaattcgggaggcaaggaattataattggacggtggatacgtggttcttttgtgtttctgttttaattgttgttgctggtgtgataattttttaaattttttatgattttattagtttgctgcaaatcaaatttgatgtaattttcgattaaataaacttgttgtggttttcaatcaatcatttgtaccctctttccaaaaaaaaaatacaaggtgtgcatacatattaattcaatcctagtaatatctgacgaaccataaatctaatataaattaaattttgttagaaaagatgccagtgcgttgctacgagtaaactaaaattatagcaaatataaaatattagatgattaattaggttttagtttttcatattacgagcccataaaaaatatattgcttacaaataaaaaggttctaaaaaaggaaaaaaaaaacccattggaccctatcggcctgctattgcgcgtccggcccatgaagagcgcgtggcccaacagtgttgtggcccgagatggaggccggcccgacacaggatcgatctaagccactcgttttgatggatgactcggatcgattctaaatccatcaaaaccgttgctgcctataaccctaaccctaatcacactttcccctcccaccccccaccacgagctccacctccccctccctcccggcggcgcctctccccctcccctccactctcatgactggcgatgccgctcctcctctgttgccttctctccgctgctccccctcccccaccatcgtcgcatgcccctctctccatggtctgagctcaacgggggcgttggatctggtgccctcggtcctccgctcaccacggagatcccatccgccggtggctcattctcgtacctccatgttgagctcagcgacatcgcggtgttcctcgccaccgggaacataccactagaggccgttgtcggggcggtgcgcgctgtggcatggctgctgctcgcggcgtacctgcagttcacgtttgggtggcgccgtgaggagtggttccccgcgccgctgcagctctggtggtcgcgccgccgcttgcgggttgaatgcctcgccggagaagagagaagagagaaaggagggagagagaggggaagagaggagaggaagaggaagatgaagaggggcaattcggtcatgatgtttaacaaagtgggccccttctagcctcgtcagcacaaaaatactaatttaatggatacggtgtctcgtggtaaataaccatatttacatagtgtcttctcccaaaagtcactttacgtggtgtcctatagctaaaaccacaaagtcgcaatgtcctgtagcaaaatttgcatatattttacatactccctccatcccataaaaaaccaatctagtaccggatatgacactttctagtactatgaatcttatatatatatatatatatatatatatatatatatatatatatatatatatatgtccagattcatcataatagaatatgtaacatcccgtcctaaattcgttttttatgggacggtaggagtaggaaatgacatgccctactccttttcagagtactgacataaatattgtagctctatcggcaaaaatcatctgccagggtggagaacctggtatttcagtgccgttaagggctgcacgttccgacaaacctgcgtatcttcctcctgaatactacgaactcttaactaatcaccaggcagatcatgagcatgcgatttcttctattcaaattgccttacagatcaatgattacatgctagcatttctttcgcgggctaatcattatatattgtcagaatcgaataacaaaaaataaaatgtgatcttcatccaaaatcaagacagttaatttccatctacatgtccgcacgttagtacatggcatgcagtatataacccacacgcctcttcgtttcgacatagccaaagcttcaaaacaaaacatctcatcagtcgagcacggagcacagcaagctagctcagagcaatggctgccctgcatcctctcgcgatcctcgtgttcgtgtccctcctggccgccggcgccaccgcaaattatggttacaccacaccatcaccatcgccgccaccgccgccgcagcagtacacccctccggcccacagcgacaagctgttggtgaggttggagggtatggtgtactgccagagctgcgtgcaaagaaacacacagcctcgaagacgcgaagccgctgtctaaggcggaggtgtctgtcatatgccacgacgccaagaatcgcgcaatggtgaggtgccatcaggccgtcgccgacgataatggctacttccgcgcggagctcgatgagactaaagtctccgacttctacatgggtgatccgcgtaaggcgtgctatgtgcgtcttcatgcctcgccggatttcgaatgcaacaaccccacaaacatcaactactctagcattgagggtgcgccactccgtgacgagggcaagcggtggtccgaccatgactactataatgtcatgtatgccactggcccgctcgctttccggccggtgatgtgccctcctaagcactaggcacccgataaatgtgcgtgcatttgtgacacttacacttgcgagcttgcgcgtttcatcaattcgggaggcatggaattctacttggacagtgtatacgtggttcttttgtgtttctgttttaattgctgttgctcgtgtgatagtttttcatatttcttatgattttattagtttgccgcaaatgaaacttgatgtaattttcgattaagaaaacttgttgtggtttctcagtcaatcatttgtaccatctttcccaaaaaaaaaatacaatgtgtgcacacatattaattcaaccctagtaatatctgacaaaccataaatctaatataatttaaattttgtttgataaaagtaataccgttgaactgatcatttgaatgtaattttctataattatggatttgttgttacaagcatcgtaatatatacgagaaattaaaaaccactaactagtttagaacaccatgataaatttaaccatgcattaaattttaaattttgaatacgtacgtaacaatttgcttgttcagataatagaggttactccctacgattgataatacttgtcgttttgaataaggacacggtataaaaaaacaactttgatcattattttctattataatatgtaaaaaggtgttaacaaatatatgatcttattaaaatactttttaagacgaatctataatgtagtcatcatatttaagagacaaatattttaaaaatgatacataattaaagattctaaagtttaaccttaccattgcccaaacgacaggtattattggtccgacggagtacgtatttcagaaattagcgaatgagtcggacccttgttgggccagatgtctgaggcccatacaaaatctgtaatttcgatgtacaccatatgtccatatgcggcgcaggcgcccgcacgccgtcgtggaggggttgcgccgccgccgccgccacttgcgagcccctcctcacgtcgtcctctcctccgcgtgcatcccactcggaggactcggcgaactcccaatcccatccccaccgcaggctgtacaccggaatccccaaccaccgccaccggaatgggggcacgggcaccgggttgaggcgttgagcacaaggtggccgtcatgggatttgggagcccaagtggggtgggtgaccagctgacaaccaatgcggtcacaatggggatgtccatgtcccactcccaggaggtttgcatcggcgggctcttgtcgtccgccaggtgtttgatggaatggtccttccgtgttcatcggctgaattgcacaggtttgtgtgtgaaatccagtatttctcgaatattatgaaccgattttggaattactacgattctacggaattacgtatgcagcttattgctgctgctgctgctgctgctgtggtattagcctattaggaatctagcagttcaatgtgcgacctgatatatgacaccgttttaattttaggtatagatgtagaggtgatacttaataaacagtcgggtaaatttaacattgctttcttgtttccatttattttaagccttgcttgtgcattgttcttggatgacctcatttagttagttcatatatatatttcttactacctaatttggtgcatatacaagattcaggttagtattagtgtgactactactagtaacattatcagtataacgctgattacaattgtattgcaagtgatcttttcacagaaagttttattccaacacataattaagtgatcttcagttcttcacacagaaattttgtgttccagtatggttgtttggtacttaagtaagttctgtgtaagtatacatttcaaacacaaaatcacggcatatagctcactgatctatgctacaagttaaactgaccctaataatgccacatttgtggtcatgcatttctattcctttcttggttcagacataacaattttctgttggcttgtataaaattttcaatactaatcttataggatgcatgatgatggaaaaaaatgttgtacgtgcacatagtactataaatcatacaggctaactataatgacagctaaatttacaaggggaagcagactggcaaactcctgaacatataaatataaaaatgggtggatttgatgaagattatttgccaatgcaaggtttcctcactacaattgcaatagcaaacccaacaccaaaacccaatccaacaaagagaaatagtataatgtctgcagatttctcttcggaaaggtgtggcatcacatttgatgttgatttgttgctgcattctttcgacaatggaggcccacacaaaccagcatttcgtataaatgaactattggggagtgtcaagaaatgaggtgactccggtattcttccctccagcatattatcggataggttcaatgttgataggaagtccaaggatgctaatttttgagggatctccccagaaagcttatttgatgagaggtccaaagactcaagttgatgcagactagcaagctggttgggaattggtcctgtaagagcattatgtgacatgttgagaccattgagcatgcttagtgtggcaatagtttcaggaatgctgccatggaatctattatttgagacatcaattagtacaaaggtctttaagatcttaggaaacatcatgtccagtcctttatatgtaaatctagcagtaaaaagatatgttatatggttaaatgtgctgtacatatctccatctttcatgaccaatgtttcgttaatggagactgacatcatggattttagtttcctaaaccattcataaggcaatactcccgagaagttgtttgaagctagatcaagaattcggagatactgtagttcacattcatcatctttagcaagagtaggccccaacggcccgtagaacttattggacttcaggacaaggacttggagtttaggaagaagatgcatccaacatggaaaagagcctccaatttgattgttcgcaacattaagtaccaccaagtttttgcaagttactaatgatttaggtagtgtcccttcaatccaattatagctgacatccaatgcctcaaatgcacagtcttccttcatattatgtggcaactctccgcgaagttcatttcccctcaaatttaatatttttagtgttgatgaattctccatcagacaggaaggaattgagccatttaagatattgtaggaaaggtcaaggatttggagactcttaacagtacaaaatgttgatgggacttctccagagacattgttcatagagacctttagagatagtgtaccagcaagatatggaattagatcaaacggcatagaagaaaaccgattattcgagtaatccaactgagagtctgtactctctttaggtataggtatgggtccttcaaacatattataactgagattgatatatcttgtgtacagggggagcaacgtgtcatgtccaagactggtaaatttgttatttgataggtccaagaagaacgattctttccaagtttcccatgcccatggaggtattgccccattcatttggttatttgaaaggtcaaggaagattatcttatcttgatgtcttaatgcattgggaaactttgatatgttgcaggaagctaggctcaagaattttactttgggagaggacactgctgaatcattgactaacccgtccaccacagataatttattatttgaaagatcaaggtgtgataagtatggtagtctccagaatgaggtaagttccactgtccccacgaagttgtttagtggaagatgcaagctatgcagttgtgtcaagttaaagatttgcaatggtatgtttccagtgaagttgctcttgaataaagacattcttctgagattcttgagattgcctatggaagatggtaaagatccagacaaaccacaatgagaaatttggagatctgtcaaagatgttagatttgttatccaagctggcattgatcctactaggccgagccccgaaacctcaaataagttcaaggatttaagcattcctagagaagacggcagttctgtagggaaattatttgcactcagactcagctccttcagatccgtgagattagaaatagagcttggtatgtaacctgagaacttggtgccactgacatgcaatttgatcaaactgctattaggtggaaaattgggcaaatcaccataaacttcatagttgtagctaatatcaatagctgtcagttttctgttctggaagatcctttgtggaaacaaaccctcaaacttatttcttgaaagctgaagaacactaagggatgacaaatcagcgaagaattcaggtatggcaccagacaggtcatttccttgcaagtcaacaacagaaagggatcgcaaactaaacagagattggcaaatgggaccagagatctggcataatggtaggctcagaacctgaatcttaggagtggaattagccagagcattgcaccacccttcgcctccgttggacatgtacaccaatccaagatagagctccctcagattaccaagatttgcaatcaacttctcgaagtttaccctcgagaagccccaggggggtaacaaatttgacatgatactgacatcgtcatctccttgattgacgatgtagatgctagatgacagatcaagagaaaccaagttggtgaggcttccaatacctgctggtatctggcctgcgaagctgggtggggagatgttgagatgggtgagctcagtgagcctctcgaatccggtggccgggagctgtgacgcgttgaagtcgttgccgccgaggttgagatacctcagcgacgtgaggctgaagacggcggcgtcaaggccgccgctctgcaggcgtcggccgcctagatcgaggaaagtgacgcggccgccgtcgcagcggacgcccgcccagcggcagcagtcggtgccggcgcgccatgaccggaacgcggtggcggacgcggtggtcgccgagaacgatcgcttcagctggagcagcgccgccgcctggtccggcaagcatggaagcgagctcgcgatcaaggtttgtagtaggaggaggagtacaagtaacaacggctcgtactctcgttgggctacccgaggtgacatcttggcgggtggcagctgaatgaatgactatattgtatgatgcttgaaactgatttttttttatacatgtagagctagagagagcctgttcagtactccaagcctgacttgtatgactgaattgtgatagtgtgatggtgacatactatatcaagtcaatgcaaatgcaaataatcaaagatgccgttggcatcgtagtcgtatcgtacgtgggacgtacttaacagattttgatcgtgtcattatgtgaacaggtgtacatgcgtgtagacctttgtcatgatcagacaaatcacaaactgtagcacttatggacgaaaacagattaatccgagagcatatccgctccttgcagatggctgtagtgccgcacacgtgacacgtcgcgtatccgtagattcgtcaattcacctcggacactaatcgtgctacgtttggaaatactgttatttgagaaggaatagtctacttttatctcccttaatcgcaaaatggatgtgccctcacaatcttttaaaagaactttttttagaaataatacaaatttaatgaaaattgtaagtggttgtctgaaatcacaaatttagcaccttatagaacaccaggttgttcgaccaagcttaaaaaattgggaatttgggatgtgtgtgcatacatgtgagtgggttgtgagattgttaacgaccaaatttgataatatcagcatcggaaagggagattagatcgaagcggaatctaagatgaggattgtcgcgggaacagagcaagaattggctggagtccggatcggctacgattggatcggctaagttcgagtcagacttggttaggtaatgcagccgatttcgataatacgacttggtgtacaacatcaggttgggttgatatgcttcaagatgattgccacgcatggatagagtcctgagaaggcaattgtatctattaattaggatattttatgtaatttccttagagatatatttgggcaaaagtctgccgcaaagacttatgatatcttagagtttgttagagataagagtcgtgtccggtatggacatattttgtaattctcgggtataaatagacccgaaccccatgtaatcaaacaacatacgttcaatacaatctcggcacatcgccactctttttgctttcgttttatttcgacgagttcttgctttcgggttgagctgtatcggtttcgatcttcacaagaggtaaaacttgttatgacggcttgcgttctcgggattagtgcttccatctttatgacactctaatcttgtttatgtaatttatcgagttatcatatatcttacataatcttcggtaatatcgtcatctaacctacaatcggctaacatctgttaatagaaggcggccgattaggttaaatagcgacgttagcttggattatataagatatccaccactctatgaaacatccaacgacttgattgtctagatattgttctttttttcatacttaatgttgcaacagttgagtttgatctattaaatcgtgcttagaatttcaatctctagcctgtcttccggttgccgattaggatagcatcggggtttcagccgatcttacctgatttaactatagttattctatatgcttgatcgacatgttaaatctgccctttatgttaagatcttgttgcttttaagtatattaggcttctgcttggtatgttctacttgctttaatatcttaatattgagcggtattggagtattagccgatgcatgctagatctatctgatcggctatgctatgaacatatataattttgttgttaatatatatttcgatttaagtgatttatactgtatcggcatggcgaccgatctatcccaatcacttgatttaagtatatatcgacataaggattatatattgttaatatctacagccgatcgggtagatttagttcttttttacttatcaatgactgccgatcaatgcttatatgacatcggctcaaagataaatgatatgtcatcggcacttagccgatcggctatcatttatgggtttaaccacggcttctttgtttctatttcttgttgattgcaggatcaaatcaactggcacgctagcatacccgaaggcgagttttagacctgcactggagttaagcagatctcctaggcctcgtgttttccatcaatatagacctgcagcatagtacttgcttgctctctttttttataatcaagccacctaacctgtcgaatggctgttgttcgtcaggtataaatttatgtctgtcaaacaatggttgtttgatataatgctaaatttgtgatttttatcaaccaatatctgtatagctgagatctatataaataaactttacatatagcaatcctcataatgtataaatacaagatatcattaagagaagagagagaagtcgagatagataatattatttattccatatgggtagtccatatgcatacaagtatcttttgttattttttttatatggaccagttgcacaatggttgtaggtggctaaatgtaatgttttattgcttataaactacttttgcactgcattgtaaatgctccttggttctttgcttaaagacgacggttgctgatgttctggatgactggatccttttggttttaggcttttgttgcaagttagggggtgtttagattaagaggtgtaaagttttggcatgtcacatcaggtgttatatagggtgtcgcatggggtattcgggcaataaaaaaaaactaattacaaaatccgttagtaaaccgcgagacgaatttattaagcctaattaatccgttattagcaaatgtttactgtagcactatattgtcaaatcacagagcaattaggcttaaaagattcatcttgcaaattagtcataatctgtgcaattagttattttttagcctatatttaatacttcatgcaggtgtttaaacgttcgatgtgacagggtgaaaaattttagggtgggatgtagaggctgcgttcggtgggacatgttcccaacttctcctcctcgttttccgcgtgcacgtttttcaaactactaaatggtgtgttttttgcaaaaagtttccatacgaaagttgcttaaaaatcatattaattcagttttgaaaaaaaattagctaaaacttaattaatcatgctaaatgctgcttcgttttgcatgacggggaatgagggttcccgaacacagccttagttccgatggcaacatagttttgtcgaaagtctgcagattttttgtgttgccttaggccatcaccaatgcggtgcttcagcccgtgcccctagcgacggacatcccctttttcatcggtgtcgtcccctgcgatggaacgcgtccctctgctgggggatgcggctctctctgtgcctcactagcttttcgtgggaagacgcagccaggcgccgcgttgtgcgcgtgtggagctcgtgggcacggcgtcgtccccccaaatttccccttacacccttgtctctctcgctctccccttggtctcgtcgcgccgcgcccgacaccgctggcgccgcgcctaccaccgccgggaccgccaccgtcggccttagagagagagagaagagagaggcgacggtgatgacgatggatcggcgacgaccggatccggccaccgcgcgccgcggtagccatcgaccaccagctagcgacggcggagatggcttgaggcgcctgtgctcgccgcctcgcgcgccttgcccggcctcctccgccggtgccttgcccgccaccgccggcgccacggggggcctagatccacccactacggcgccggatctggcgctcccgactgaccacgacgcg

SEQ ID NO: 42289 - DNA, 5514 bp, Oryza sativa
ggggtttcccagagagtactctcagttagtgagggtagtcttagagtgttctgattgtagatgcccttagaccgagttctcctttattcttgaggttgcccttagaccgagttccccttttttcttgaggttgctgcgttgaaattctggatcttttgttttctttagagcctgtttagattgtagccaaagtaaaccttaccaaaggcaagatggtaatattgccaaaattttgacatgatttcttatgtatttaccaaatatggtaacaattaaacgtagatatttttttgacaacttaattaaaaaaaattagtatggttgaaaatggtgaacaggcgcttagtccttttgtttcctttaagaatcttgtactccctccgtcttaaaaaaagacaaatcttagatttttgtgtccaacgtttgactgtccgtctcatatgaattttttttataactagtattttcattattgttagatgataaaacatgattaatactttatgcttgacttatctttttaatttttttcataattttttaaaatgaaacggacggtcaaacgttgcacacagaaacccaggatttttctttttttttttttttttacgaagggagtactagctttactatgatactatctcatctctgtcaatggaaattggggcctcaaaagcccttgaaaaaaaaaactacttcgacggggaggcgtagggcaggatgttgcccggcgacgacgaggatggccggcgccgccgtttacaacaccagatgaccagacgcgaggcggccatgtacgcctccggttgctttgcctctctgcgacgcctccgaattgagagaaagtgaagatgtgcagcggcggttggaggcggtattggctgcaggcgggcggggtctctcccggccatcctcgtggcgagctcggggcgatctccctctcctgtacgccgtggctgaagcgcatgccgcgccctggagtacttccactcctcgtcatccttctactccacctcatcccactcgaagtactcggcggaatgggggcgtgtggtggtagaggggtgagattgaggaggcgacgagggagagagatggtatccaaggttccagatcgtcgcagtcggcaattaacggggtctccatggccatggacatgtccaaggaaatgcgcgcagttcatcctattgccatcggtctcgtcgtcctctcctaccaccacgtgttcgaggaaatgcgcctctcagcggctgcaatgtacaggtgagagcacctgaagcgtttcattttccaaatttggtgtatgcggtgcagtatttgggtttaggattcctagaatactcttccattgttgattgtgcttagcatctatcgaaaacgagctcttactggatgtttgatgccgtggtattaggaatggcagtttacttgcatatgtgattgttcagcacctacaatgacgaactcttgggtcactttctgttggtatcatcgcctacatgctaacacgcacatgtctatttcaattctcactgcatttggcctataagaaaatagtttatctctaatactgaaaatgttgtcttctattaggtcattgtcaatctttctgagaaatcataaggaacttcacggacaaatatgacatatagctcttttattgatcatacaataaaatcaatatttttagagttataccattcctccaaaatatcaggcatactttccaatgaccatgcacaaagatataggatgtatttcatattccaattattcccctagtaaccatccagctttaccttttccattcatgaatgcaatagatatagtcactagagataataattgtagctattctagtcattttcaatgtctcaattgtcatgtacaaggcaagatacaccttttctttggacaaagggagtacttggtgcttggtagatccttttgtttttcagcctattttcggccttgattttgcattgttcttagacgagcccagcttggacttttggcttctgtttttattaaatggaattcataacactggatcatatttagaatgcctgttaatttcttctatgaagccataaaaagggaaaataagaaactggaaactaatagcttctgtggatgtgagataaaactataaaagtttagctgactagtttgctctgtagaaaaacagtatgcaaggtgtatgagagctcacttggagattgtgctatttcttaaaaaaattgttgtagtttggacattacaaaatttaactggctgctctgattggtacccagtaacagtttactgttttcataagttctaattctttgttggactcatttaccaattaagaaaaccataacattcttttaataagtaacatctacaagaaacccagaccttaatttcaacaagcattttatatagcactcataagtgatacctgggaaataaggtcatttctaagttcacgctattattttaggtaaggacacacagtgacggggcaaactgcttttaagtaataactacactattttccaaagccaaagcaaagtagattcagtgatatttctaacaaatacagtaggttccccctttgacctggcaaaccagttgaaatatgattgtcagcataaagccaaccacaaaccccaagccagcaaagacaaacattaggatgacccctactttatcttgccacaaactgctgtcttctgaagaagcttctgtatttggagttattgaaccagaactatcacaatctttggatagtggccttccacagaggccaaattaccttcaaatgaactgttggaaaacgacaagaactggttgctctgtggtattcttccagtcaagttgttattcgaaagattcagccaagaaagagaagttagaaatgttaactcatgtggtattacccctgagagctggttccaagagagatccaaggactctagctgagccaagttaccaagctgttgcgggattgctccagtgaaattattatgtgacatgttaagtccatgaagtgaaacaagactccctatcgttccaggaataactccaacaaatgagttatttgagaaatcaattgctttaaaggtagttagcattctattgaatgtcatatcaaaccctttgtatgtgatagtgatgatgtctcgatagataaatccttgtgaaaagtttgtttggtgctccaaaacttgtccatcatcgacatttgccatcattgatttcagtttctcaaaccattttgggggcaactgaccagatagagtgttattggctaaatcaagtatttgcaagcttgagaagtgatcccttgttagatcactattatggagacccttaattgtgccatataattggtttgatctcagtacaagaactcgaagcttgggaagattccccagccacaaagggaacagatcgaggatgtgattgttactaacatcgaggagttccagacttttgcagtttgatagtgttctgggcagcctcccttcaatttggttgctgttcaaatctatagtctcaagcttacatccttctttaatgcccttaggcaacatcccgttgaatttattccccctcaaattcagtacccttaagcttctgccttctaccagacaagatggaacgaaaccactaaagttgttatcagataagtacaggaattggagtttcttcatactacaaatggaaatgggtacatagccttttagtttgtttttggacaagttaatataggctactttgttaagatacctaccaaatgtacgtagtatggaagagaacccattgtttgagtaatccaatacaactacaccataaggcaatgatatggctggtatgggtatttctccttgaagtctattgaaactgagatttagatggcttagatgtgtaaatgtaacaagagagggagagttctccaggctagtaaatgcattgttcgagaggtccaatgatccaagggtgtccttccaaatctcccatatccatcctggtataactccaccaatcttattacttgaaaggtctagctcaagaatgtcatatagatgtctcagaattcttggaagttttgtgaggttgcaacatgctagtcctaggtgctgaatcttagggagatattgagatggagaatcttctccatcaatcaccgacagcttattgttagagaaacccagaaaataaaggcttcttagtctccagaaaggcctaagttccactatgccggtcaagtgatttgactcaagattgagatactcaagatttggaagacagaaaaatgatttgggaatggggccatgaagccaattgttgcttaaatcaatgtcatacacagatgaagataatggaacagggatgtcttctaaatgaccagaaagttgattagaatctagatatagtgattgcaacgcaggaagtgcgaagatggactttggaattgttcctgcatacacatctagttatagtcaacaagctataatttgtaggctctcttataaatataaataaaagtagcagtgcaaatggactggactcactggagtagaagctaatttttaagttacttgtgatctagggcatttcctagtcaatgcggcaaaatactaaaacatcaataaccttttaaagtaaggagtaggttctattcagtattaccacctgtactgtactactgtaccattagaaactgttgagctatgattgagatttcaaattcttgtagggatctcaccattgaggttgttgtttctgaagttcaaattattgagttggatcaagttcccaatccaagaaggtatgggcccagacatgctgcaattgtagagcgttaaacttgtcagatttgtaagattgataatcgaagagggcatcaatccagagaagttgtaattgccaagctccaggtatgtcaaatgtttaaggctgcctatccaagagaacgacaccagcttcccttgtcctgatcctccatagagccggagaacttccagccagtggagttctctgatcaaaaggatatcagaattcattgaagcctctactgttgtaaggcccaaatgctttagatacttgagattgaccactgatgctggtatggcgttagaacggttggtcaatatgagatccaacacttccagacgactaccaggtaggaattctggcaactgcacacaaagcttattgttccagtataaatcaataaactgcagcctttttagttggaagatctttgtggggaactgaccctcaaaagcattgccagatagctccagaattgttaagaaagagaagttggcaaagaactcaggaaccatgccactgatgacattgagtctgacgttgatcattgtcagtgaacggagtcgtgagaaggagggatcaatgaaaccagacaagccacatgacatgaagctaagtatctgaatctgtggagcagaagctgctacatcgcttgaccaagttgccccgctgctagagaggtccatctca

SEQ ID NO: 42290 - DNA, 16047 bp, Oryza sativa
  unsure (1)..(16047): unsure at all n locations
accatcactgaggtccagcacaacgacatgcccagaagccatgcggcaggtgacgccctcccatcggcagcagtcggtgtccggttgccaggacgagaggcggctcgcgtcgtggaaggagctcttcagctggaggagggcggatgactgagatgtcaggcatctgatggtggtgttgctgctgttggcagcagcatggatggagtatggctgtatgagtatgacgacgatggcaatgaggaggatgagaagagggagtttgtggctgtggaggcatctatgcgtgtagttcatcttgcgagttcacttggtgcttgcttactgaatcatgtgaaaacttgacatcctggctcctgaccatgcatatatatcgcgaatttcattcctctccgtgtgaaaacttgacatcccgtgtcatccaggcctgtttctgtacaatctatggcctatggcctgatttagttcccaattttttcttcaaacttttaacttttctatcatattaaaactttcctacacatacaaacttttaactttttcgtcacatcatttcaattttaatcaaacttctaattttaacgtgaactaaacgcaccctatgttggctagtgagattacataacatcttgcttcctacgatctggtaaagcaacccatcaatggacgtggagttcactccgtctccgtgggaatggcgggcgaagtcaaggtaagctcattcatttaaagtcaagaagaaaaaccaatgacactgttcatgcagtgttggaaccccttcatttttctccaataaaagttagatgaagattaagatttttatggcacgttttttaaactactaaacggtgtgttttgtgcgaaaactttcagtatgaaagttgatcttttaagtttataataattaaaacttaaattaattatacgttaatatcatcttattttacataaaaaaacttaatttttatcatattcttttcttctgaagatggtgttgaaccgttgatccttacatgtgaatttttctgttgtgaaatgacgcctctgttttagtcctgtcgttgtcgatgactgcatggctagtctttagaaaatgaaatatgagcccgtgtcgcggtgtggtagcgtaagcttaacgttcaacccatgtactgtcgcggccgttgaatggctttttgcgtacagactgtttgaatatctggaacgaaacggacctactacctccatcgtaaaataagtatagccatgagttatcttcatcgtaaaataagtgtagccatgagttttctatacttagattatttagacttgagatgtactccctctgccctaaaataacttaacttagatgagatatgattcatcctatatcaacgaatctggatatgtctctgttgaaattcattggtcgatcattttagggcagagagagtgcaatggcatagaaagtttaaaccgcattatcaatttatccgagcaggtacaattgcaggatcaaagttagctttaaacatattttaagaagataaataagaagagagaagagtagcacgctacagatttatagccagctgtagcacggacttcaaaacgcggtgtttgcataacaggtgggaccaattattaatagtgtaatatataaatattgtataaataagctattagattgactataggtgaattggagctagtagttagctatactattaaacttgctctccgggtcaaggaaaaaggagcatcttctctgtggctcttgtttgttggcctgacgaagatgcagaaaagattcgaggacgtgtcctgccatgtacgctaagctttagggtgtatttagctcacgctaaaattagaagtttgattaaaattgaaacgatatgacagaaaagttgaaagtttatgtgtgtatgaaagttttgatatgatgaaaaagttgaaagtttgaagaaaaagttaggaagtagaccagatctaaaatgagatgaagacggtgcaagatggtcaggtaggcctggtccggcaagcatggaagcgagctcgcgatcaaggtttgtatgaggaggacgagtacaagtaacaatggctcgttctctcgttgggctacccgaggggacatcttggcgggtggcggctgagtgagaatgagtgaatgactattgtatacatgtagagctagagagagcctgttcaatactccaagcctgacttgtgtgactgtgaattgtgatagtgtgatggtgatatatactaatatcaaatcaatcaaagatgccgttggcatcgtagtcgtatcgtacatgggacgtacttaacatgttttgatcgtgtcattatgtgaacaggtgtacatgcgtgtagacctttgtcatgatcagacaaatcacaaactgtagcacttacggacgaaaacagattaatccgagagcatatccgctccttgcagatggctgtagtgccgcacacgtgacacgtcgcgtagccgtagatccgccaattcacctcggacactaatcgtgctacgtttggaaatagtacacaactacactgagaccgagagtgctagctggatagtactaaacagagacacccttcttttcaaaaaaagctactaatacactcaatatctatatattttttcttcttaaagaagtttctcttaaattactcaaacgatttataatccgattacatcgttgtgttcgtaacaattaaatctttacaacaagatctcacatgattatattttgatgaaaaatcataaattacttttatgatatgtctaaattacttttagatttcactaagttacttcttagacatataaaagtaaatttagtaaagcttaaaagtaatttacatatattatagaagtaatttataacaaaaaagaaagtaactttaatttagaactatgtctagattcattaacatctatatgaatatgggcaatgctaaaatgacttacattatgaaacggaggaagtaactctctatagtagaaataattatattgtgagtgaactgaaataagaaactatgtagagtaaattcacgagtaaagtagagaagatttataaagtccacaaaatatagaattaactaaaaacaataataaaaataatcaacttagagtattatgaatgtatagaagtaatttagtcaaatataaaagtaacttatatatatatgataaaagtaacttacgtatataataaaagtaatttataaatataaatatttttcatcgtaatataatcatgtaagatcttgttgtaaatatttaattgcaacgaaagtaatggtgtaatcagattgtagattggataattagtttaagagaaaattctataagaagaaaacaagatatgcactattggatatactaatagcaaccaaaactcctaaagtactagcacgtgggtgtctctggttaagactaattggagaggcctctccaattagatttaccgttggaaatactgttatttgagaaggaataagtctgttttatctcccttaatcgcaaaattggatgtgccctcacaatcttttaaaagaacttttttagaaataatacaaatttaacgaaaattgtaaaattagatattggttgtctaaaattacaaatttagcacactgtcgaagaacagattgttcgattgggcttaaaatattgggaatttgggatgtgtatgcatgcacatgcatcgagtgggttgtggagttcggtaggctgcacatgcacatgtactattttcttttttaaaaagtaaaaagtacgaattacctccctgaactatcgcggttgtatgatttacccccctaaactcgaaaaccagacattgctcaccctgaactttcaataccggacaaattacccccttcgaccgaatctagagcggttttgtcctacgtggcgtacacgtggcaatccagtcagcattttattttttaaaaaatagtgggacccgcctatcataccttatcttcccctcttcctcatccttttcccctctctcgggctcagagcgtgcagcacggtgagtggaggcgcgtggaggcggacgggtagtcggtgcgcgggggccggtgatgagcggcgggcggcggcgtgctggggcggacgggtggtcggcgcgcgcgggctggcggcagaacgcagggaggacgtggcaggcaacgggcgatgccgaggaggccaggagggtgttggaggcggcggagagaggtgcggagcctcttctcggttccgacggggagtcagcgggatgcacggcctccctccctccctcccactctctctctctctctctctctctctgctcaggcaggcggccggcgatgaatcatcctcggggtggcgcggcgagtggcgcgcgtagcgtggagggcatggtgggaggcgccgaggagggcatcggaggcggtgcgctacggcgacgagttcgccgtccatccatgtcatccccatcaaccgtcgtcgccgtcaaccggagccacacagccgcgccaacgatttcctctccccggccgtcgcgcccgccgctgctgtaggatcgagatgtcgactagaggggggggtgaataggcgatttaaaaacctaaatgacacttaatcaaaactaacctaagtttctaggctcggtgagggttaagtctaactaagcaactaggttatgttttgcaaacctatggtgatagtggctcaattaattctctaggaaagtaaattacactcctatgtcaatgttttgcaatcctagggtgatatgatctcaagtatgtctctaggaatgtaattgcacaaatgtaaatacgacaatcaaatgacacaaggagacaagagatttttcaccgaggttcggaaactcgccagtttcctactccccgttgaggcgagcccaactccaccgctcaaccacaaagccaccgcacgcccccttcgtcaaggggtgggtaaggcgggagccggcccacggagaggactacccaagcctcgatcactcggggtagttcttccttcactccgaaggtggtgaactccaaaccactcacaaaccggcgccgggcctcctccacaatcttctcggagaggtcaccgggcaactccttcacaagccgtctaggaggcggcaacctccaagagtaacaagcaatgacgcggctcggagatgatcaagtgccacactagctctacaatggaagcaaatgcacttgactcttggctagaacaaccctcaaacacttagatggaagaacacaaagctcaagtgggtgtatgagagatgcaaggggtgtatgcaattgaattgggtgccaagaaagcccccttgatgctggagggggagtatttatactcccaccaaccaaaactaaccgttgggggcgaaatcccccaactctgtgtgccgccggtctgaccggaggtatgtggccggtcagaccgtgctactctgcaacggctagaaaactagctgttgtagccctatcagagggccccatcggcctggccggttagaccgacgttgagtggccggtcagaccggcctcggctcggtcagaccgccgttagctcggtctgaccgaataccactccgtcggctttgtatcggccaccccgagcaacaccatcccggcctccagggggccggtctgaccgcacaagtgcctccggtcagactggccttatgcaccggtcagaccgcgcacttggggccggtcagaccggccagggcactctggtcagaccgccactatgtggccggtctgaccgcccctggtcaggccgagacacagtgaatacatatgtgtgtgtgtgtgtgataaaatgtgagcacaagtctacatgcaaatgacctaatgtggcaattaaaatcatctctttgctaggtcattacccctcttaatagtacggcgaagctaaagataaactagcaaatttgatcgccttacacctcgatcaatttaaaactaaagcactagttttaccgtcttcttttccttcgctttgcgccgtcaattttaatccttcggtgatcatccatgcgtacataataagtgaacctaactcacaatgaatatctcaaagataacggttagtccacaattagcgcttgtcattaattaccaaaattcacaacgggggcctagatgcttcagctgctcgccgccggccggagcgacctagccatgcgcaccgccactcgcctcccagctccgccctccgcctccgcgttcggcggaggagcgggaggctagcggtggagatggcgaggcggccggagagcgtggggttattgacgagcacgaggtcctggactgaagcgtgggagggagctgccacttgagcggcgggagcggtcgcgtgttatcgtcgccaacgaagcagtcgtagacgaagaggctgcataggcgcgggaaggaggcggcgaggaggccggacgtgaggagtgtggcggtgacggaggcggagggcgcccgcgcagctcgggttggcagagaagtcagagacgtagccgagcgagatgctgacaacatgggacgcgttgccatcatcgtcgtcgtcgtcacaaaacacgccatgcgggccggcgaggcagaggtcgtcggggaagccggcaatttttccccttcccttctctgcttctcttgttcacgaggtggaggcggcgaacggtccgtcgtcctggtcgttggcatcgtggccgtccaaccacatccgccggcgaacacagagcaagctcgggcaaccggcgatggaggcggcgagttcgggcggtcggtggtggaggcggaggcagagcgcgtcacgttcgccgtagccgtgtgctctcttctctgcgaatcgagagagagaggcagagaagggaagggaaaaaaacgctgacaagtgggtcccacttgttttttatttatctttgctgactgtatcgccacgtgtgtgccacgtaggctgaaaaccgcttcgaaccatgttagggtggtaatttgtccggtcttaagagtttagggtgtcaaatgtccgattttcgagtttaggggggtaaatcaagctaactaacctgtcgaacggcccaagctgttgtttgacaggtatgcttattgaacaatgcttgtttgacaagatgctaaatttgtaattttatcaaccagcatttacttttataattttccgagataatttcactttgggccatattttattgccaaagtttcactttgtaccaccctttatctaatcttttcactttggactagtgcacaatggaccaccccaaaacacattttcatttcttcgataacttcgagcaaattgttaacggcatgccagcaaactttcatacctatatgcatgacatacttttgtctaaagagacgctagacatcacaagcgaaaagagttagggtagttcactgtgcaacaaaggcaaagttacctagtccaaagcgaaaagattacgtacagggtggtccaaagtgaaactttggtaataaaacatggcccaaagtgcaattcactctaattttccattaaagttgtactatttctaaaaaaaactccttttaaaactagtggaaaccgactccttccataatttaagtttattttatctcacttaattgcaaaatcagatataccctcacaatcttttagattattctactttagttaattataacggaattgctaaccttctgtcgacaaaaaatatatccccaaatcttacagattttggaccatcggatgagctgcgcgattcgtgctccaggccttctcctctgactctggtgacctcctcctcttctccagcgctggcgacaccctagactccagcaaaggaccctacgggttagggtcctaggacgtggtggaggtgggaggggtgggagggggagggagaagagggggagctcactggctttagagggagggccgtgggaggcggcagcctggcggtgggtggcggatcgggcgggcggcgaggcgccggcggcagtgccagagccgcggggatggaggatgacggtgggctggcattggtggcaggggaaaagcaagcgtgcggttaggaggcggtggacgatggttgcggatctagtggcggggagccaccagatacggggaagacagcgaggcgggggcacctcacatcctcgccgtcgcggtgttgagaagaaagagaggggagaagggggagaggggagaggggagaggggaaggggagagggctcaccaggggtcctcgccggcgccgttgactctttccggccagtcggcgaggcgggcaaaggtgcggtggggtggtggcggggaatcgcgcgagggacgggatgaggagtggtggcggcgcgatctgaacgggggaggaggagaggagttatggttaagggttctgcacgaatctgaaagcatatccaatggtccaaaattcgaaagatagaagatgggattttctgtcaacagatatatgatagtcccttattataatccagcttattatctgacttaataatctagattataataattttaacccgaaacaaaaaggactgaaaatcgactccttccattatttcgggagcagtttcgttctacatgacacttcatagtacccacatatgcacaggatgtagccggtcgccgtgtacggctgtacgcctacgatgtactccctccttctaaaagccaaagtcctatttcattatttggtttttccaaaagtctaagtcctatttgtagtcactgtgctatattaaatttttgatcgaaacccaagaagtcattttatttgtagtcactatgtgctatattaattttttttatcggaacccaagaaatcattttagtacttattggttgcatgttcattggttttgtcatatgatgaactagttggcaccccacgtcttgccgcgggatttgctagttttatcgtcaaataaaatcaatattttaaatgattagatgtaactctgtatatatacaaaataaatgataatgtggcttaatatatagcctatgctattacaataccattcatcttttatttttttaaacgttattgtgatttcttatgatgcacgaaagttattttcatgcacaatctggatgtcgtctattagagtatcctgcacctctttgctttatatcaagcttgtttcaaaaataggtttatgttaatgatgtctaattaccttatgttatccaattgtttataacaaaacaaaaatcgcatcttatacaataatttaagttatattagaaaaagataagtttgcattatctcggatgacttgggagaagaaaacatagtattatgcgcaaaatggataacaatgtcacgcgtgattatgagttaaatggaggtgactggatgagtaatcaatgattaaattaaatggatgagtagcttctttatccaacggctgataactatgtactaatacaactcgatggcttagaattattgatgatgtggtttcttatatgctttgctttatacaagtaaatgctccttagtgggtacaactatataggaagatatgatgagttaactacccgagagagagagagagagaggagcggccaccacttgcgagcccttcccctcgtcgtcccctcctccgcttcatcccactttggagttggagtactcggcgaactcccctatcccattcccaccaccgcagcccgtacaccgaaatcccaaccaattggaccaaccaatgtggtcaccatatggcgatgtcctcaggagctctgcacgccaggtgtttgatggaatggtcctgccatcagctgcattgcacaggttagtgtgtgaaatctaggatttctcgaatattatgaacccattttggaattactacgattctagtaccaaattacgaatgcagcttagtgttccggtgttgattttcctgctctgctgtggtattggcctattaggagactagcagttcaatgtgcgacctgatatatgacgccgttttagttttagatatagatgtagagctgatacttaataaagaatcgtgtagttttagtttttattaatgaatttcgttttcttatttcagtttattttaagctttgcttgtgcattgttctcggatgacatcatttagttttagttcctatatgtttacctaatttggtccacatacaagattcgggctagtattacacaactagtaagaataacagcatataactctgattacaattgtattgcaagtgatcttttcacagaaagtttcattccaacgcgtaattatgtgatcttcagacttcagttcttcacacagaaaattttgttctagtatggttgtttggtactcaaagtaagttctgcgtaagtatgtacttcaaacacaagatcatgatatatagctcactgatctatgctacaagttaaactgaccctaataatgccacatacaggtcatgcatttcaattcctttcttgtttcagacataacaattgtttgttggcttgtataaaattttcaaggtaataaacaactaatcttataggatgcatgcatgatggaaaagtgttgtccatgcacatagtattatatacatgctagctacaattacagctaaaattacaaggggaagcagactggcagactcctgaacagataaatataaaaaaagggtggattccttcaaagattatttgccaatgcaaggtttccatgaaactacaactgcaatagcgaacccaacaccaaaacccaatccaacgaagagaaatagcataacgtctacagatttctcttcagaagatgttgatttgttgctgcattcgtttgacagtggaggcccacacaaaccagcatttcttataaatgaactattgtggagtgtcaagaaatgaggtgactctggtattcttccctccagcatattatttgataggttcaatgttgataggaagtccaaggatgctaatttttgagggatctccccagaaagcttatttgaagagaggtccaaagactcaagttgatgcagactagcaagctggttgggaattggtcctgtaagagcattatgtgacatgttgagaccactgagcacgcttagtgtggcaatagtttcaggaatgctgccatggaacctattgtttgagacatcaattagtacaaaggtctttaagatcttagtaaatgtcaagtcaagtcctttatatgtaaccgtagtagtaaaaagatatgttatatggttatatgtgccatacatatctccatctttcatgaccaatatttcgttactggagactgacatcatagcttttaatttcctaaaccattcatcaggcaatatgcccgagaaattgtttgaagctagatcaagaattcggagatgctgtaattcacagtcatcatctttggtaagagtaggccccaactgtccgtagaacttattggacttcaggacaaggacttgaagtttaggaagaagatgcatccaacatgggaaagagcctccaatttgattgttcccaacatcaagtaccaccaagtttttgcaagcaactaatgatgtgggcagttgcccttcaaatcgattgtagctgaaatccaatgcctcaaatgcacaatcttccttgatattgtgcggcaactctccgttaagttggttcgccttcaagtttagtacttttattgttgaagaattctccattaagcaagaaggaattgaaccatttaagatattgtaggagaggtcaaggatttgaagactcttaacagtgcagaatgttgatgggatttctccagagatattgttcctagaggcctttagagatagtataccggcaagataaggaattaaatcaaatggcatatacgaaaaccgattatttgagtaatctaactccaagtctgaattctctttaggtataggtatgggcccttcaaacatgttataactgagattgatgtatcttgtgtacaagcaggggagcaaagagtcgtgtcctatactggtaaacttattatttgacaggtccaagaagaacaattccttccaagtttcccatgcccatcgaggtattggcccatgcatttggttatttgaaaggtcaattacgtgtagctcatcttgatgctttactgcattgggaaactttgatatgttgcaggatgctaggctcaattctgctactttgggagaacgcactactgagtcattgactaaaccgtccaccacagataatttattatttgaagagcaaggtctgataaatatggtagtctccagaatgaggtaagttccactgtccccacaaagttgttgattggaagttccaagctccgcagttgtgtcaagttaaatatttgcaatggtatgtttccagaaaaactgcacttgaataaagatagtctcctgagatttctgagattgcctatggaagatggtaatgatccagacaagccacaattagaaaactgaagctctgtcagagatgttagatttgttatccaagctggcattgatcctactaggccttgcccagaaacctctaataagttcaaggatttaagcattcctagagaagatggtagctctgtagggaaatcattggcactaagacccagctctttcagacctgtgagattagaaatggaggttggtatctgaccagagaacttggtaccactgagatgcaaattgatcaaactactattgggtgaaaaattgggaaaactgccatagatttcgtagttgtagctaatatctacggttgttaattttctgttctggaagatccttgctggaaataaaccctccaacttgtttcttgagagttgaagaacaccaagggaggacaaatcggcgaagaactcaggtcatacaagtcattttcttgcaagtcaacaacagagatatggcaagctgaagagagactgacagatgggacctgagatcttgcaaaatggtaggctcagaacctgatcttttggagtggaattaaccagagcgttgcaccatccttcccctccattggacatatacacaaagccaagatagagctccctcagattgtcaagatttgcaaccaacctcagaaaatctaccttccagaagccccagttgggaaacgaaggtgccatgatatcggcacgatcgtcttcttgattgatcacatagaaaagagttgataaatcgagagaaaccaagttggtgaggcgtcctatacctgccggtatctggcctgtgaagctgggtggggagatgttgagatgggtcagctcggtgagccgctcgaacccgacggccgggagccgtgacgcgttgaagtcgttgccgccgaggttgagataccccagcgacgtgaggctgaagacggcagcgtcaaggccgccgctctgcaggccgcggccgccgagatcgagggaagtggcgcggcggccggtgctcccgctcgcggcggcgtcgttgtcgtcgtcgtcgcagcggacgcccgcccagtggcagcagtcggtgccagcgcgccatgaccggaaggcggtggccgacgcggtgttcacggtgaacgaccgcttcagctggagcagcgccgtggcctggtccggcgagcatggaggaagcgattgcgcgagcctagcttgtaggaggaggaggagcatcagtacgagtaacgatgtctcgtagtaccgtcgtcgagcttgcctggtacacattttggcgcctttgattgttgtatgcttgaaacaactaattttatgactgtctgactcagacagagatcctttgtttgagcacaagaagatttacaatcttcgattggactttatgcttagggaaaatgcccttttgtaagctcgatttttaaaaacttcctacatatctggctatctgcctatggccagaaaggtagattattcaagtcaaggcaaatgtttttttgttgaaacgaagccattgacaacttggcatcgtaatcgtgcgagacgtcaatcgcacttagagattgaactggctgtgaacaagtgtacatgcgtcgttgtcgcggccgtgccctggtcagacgatgaacacagaagtaccacgaaacatacaaatccgatagcaccagctggccagctagctgccgtgcatactttgccagcgtcacgtcaccaacatgtagtttagtcgcaaaaccatttttcatttttaaaaaacacagcacaaacacaagcgctcacaacgcgcacatactcatcctatccctataaacacctccggaagactggatcggtatatcttaagattaataaaattattacatgcgccttgccgtcaacgtgtacatctaccattaaaagaaatacaattagcagtgtgaaatctaggatttaacacttcgatcacttctacgcctccgtgagaccgtgactgggcgggtgagcgcgatagaccgatggtgcggtctctgaacaggccgtgatgttgtcggcccatccatgtgtccatgtgctgtctaggcagtgggccgtttactaggtcaactacttcgacatgtacgggccgagatgtttggaggcccacggaaagcctgttatgttgcggcgaacaccagacggggccgcggccatgtcccgcctccggctgctttcccggcgacccggccggcgattgaagatgtgcagcggcgggtcagaggcggcagcgtctgcacaagggcggggatctctcccggccatcctcctggcgagctcggaacgatctccctctcctgcatggtgcacgccctgcctgaaggctgaagcgcatgccgccctggagggcctgcggcggcgccgccaccagctgcggcgagacttccacccctcgctgtccttctcccccacctcaggcggtcccgcacatcccaatccgtgataaccgccaccacttggacctcgccggaatggggcatgaggttgtaagggggtgaggatgaggggggcggagaggaaggtgagatggtatccaaggttccagatgttgcacttttcaagcagatattgcagtcggcaatcaatggatcgctactgggatgtcccgtcctgtccgtctgcttcgtcatcgccctcttcttccaccaccacaccacgagggccaccaggtgttcaagagaatgcgccaccggcccaccgcacaggttagcgcaaagagcacattgcttatagatggcgccactagacctgataatcacatatacaaaactatgcaaagcagaaggctgcattcttatcaacagaaaatgaatttaaattctcactaattacgagtacacacatacacatatatcatgtccgtaggtggataaacaccatacatatagtgtatactaacaatcatcgttttttgcgattccatcgttctatgtggcacaatgattcgaaccagactgccaatatgaagcccactgtgaaccccaggccagaaaagatgaacaaaaggatcacgccaagtctgtcctgccagaaactgttggtacctgaaggagctgatgcacttggagatgttgagcctggagtatcacattgtttagagagtggctttccacagaggttgacattaccttcaaaggagctgttgctaaatgacccgaactggttaccctgcggtattcttctggtcaagttgttgtacgaaagattcaaccaagcaagagaagttagagaagctaactcaggagggatttcccctgagagtttgttccaagagagatccaatgactccagctgagtcagagaattaagctgcgatggaatgtgtcctgtgaaggcattgtgtgacaggttaagtccacgtagtgaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 42291 - DNA, 6369 bp, Oryza sativa
  unsure (1)..(6369): unsure at all n locations
nnnnnnnnnnnnnnnnnnnnnnnnnnnnnnnnnnnnnnnnnnnnnnnnnnnnnnnnnnnnnnnnnnnnnnnncaaaaaaaatatgtggcacatcattgatttctcctcttctttataagtggcaactagagaattaatcctagtaacccagttttggccatgcatatattccctcttaaaaatgatatcatgattaatatagaaagagattcgagccaaaattaaagacaaggttgcttgacctcgagatgctcatgttccagaaagaagagctctgctgaagctccatcagagagagattcagagatgtttcgcctcgataggcttcagcttcaagcctgcatgcatgttcggatgttctgttctgttcgtcgcctgaagacgacgttagatatcaaggagcattttactaggttggatccgatcattgactgcacaaaatgcgatgtaaacgttgtactaactatgaaggaatcaagatggcaagagaaaagagtggacatgcatgtttccctgcaaaaagaaaggtaaggttcgtcagatacgctgatcgagttgtgcatgcaatgcaggctttgctttgctttggtgctgcatcgacatgacattttctgccccaaatggtccccaagtcaccaactaagattgttcctcttgtgattgatcagcatctagtcatggatcgatcgagctcccaaccaaaaggagagaggtttccttcattccccatcctagtgtgagtactaggaccattggaccaatccttcatgaagaaagatgctcaaatctgagctcctttttcatgttgcgaccaactcagcagcataaagaatccattcgagtttgagatgcttgcactgttgcacaggatgggagaagagagctactccatccgtttctaaacgtacttatcagccttgactcagttctatttcaaccattgaccatcaataaagaaatatagtttagtttctaaattgttaggttgtgataatgtgatggagaaaaatatatatggttaattatacctcaattccataaggtaaggtgttttagtttcatccaatttatttaacttcgacagagtttacggaaaaatacaccatcatctacagcatcaaaattagttccactataaaatatgacaatgtattaattggtagtaaaaatgtttatttttctaaatatttgatttagggtcaaactaaaacaccttataatttaaaacgaagagagtatttagctacaatatgataatatggtatgtttttaatatttgtaaaattattgctgaaaaataagggtctgttcactttgatgccaaaaaaaaccttaccaagttttggcattaccaaaattttggtatagttgccaaaatttttgcatgatttcttatatagttactaaaatttggcagcaaactaaatgtagccacttttttggtaactttatcaaaatttggtaaggttgaaaatggcatcaaagtgaacaggccatagccagaataagtagtgtgaaacagaagtagatgagaggatgaaaaaaataaagccagaataagtagtgtgaaacagaagtagatgagaggatgaaaaaaaaagtgcattgaaagaagttagttctttgacatattgacgcactttaaagatctgagatctatcactgcctctcttttgctccccttgaaaagaggagagcagggcggtccctgacaatcataagctgattcaaccttcacaataataaaaccagtaacttagtagtttgcacttgactattgtaccatgtaatgttaatgaatgcaaaagcaattggttctcacagactaggacttgatcgcattcaaaaaatacaaagttgcagagatacaacaaggctgaagatcctcgttatgctgtgagaattacatgataaggaacagtaaactgacaaaaatgtttagtgactggaagaaccatgaatatggtagcgtatactatatgatgattgccatgagaaaaccgatcctgctatgaggatgccagtttcctgagaaattcaggcactacctgaccacagcttgtaagaacctcagacaagggttttgcaagcagagcatcagcgctagaaaagatgcaatgcacctcccccacaagcacatgacagcttgcaccagcgaggatttcaatgtattcgtcaactgaaggaggcaagtctgcaaccaacacagtgtcgaagtcctcaaaatttgccgttgttatgttctcccagtctttcacaaggacattaatcagcccaacactgaagaaaatccagagaaatgtaagttgtcaaagtaaaagaaaagcagccaatctcaaatcaaaagataatggtgtgactacaattccctttcaagtaaacccccagtcttagtgaccagttttcagcttggaagagtttagggaatgttaggtgcattgcacagctcttggtttgtccccatagataggatgttcggcaataaactacatactgtaaatattttccatacctgctgcatatggtaaaagagttgccatgcgagtcattggtcacggtacaattttgcaatttcaaggatgatgacagatgctgtgcttcatgatcacttgcggttaccagtaggacctttgcagtctttctagcatgatcatttagaatttgttcaagaatttccttcacctgcatgttggaaaagcccataagcttaccatggcaggcaaaaaggcatattttaatcgcacaagagatttgtaactgtttctgttccaaaatcacaaccgtgaaaacagtacatgaggttaaaaggcttaacaacacagagaacaaggctacaagagtaagataggcagatcaaggcttagcaaggtgatctaacagactaatcttcagtaacaggaagcagattcctttaagtgatattatgaagccaggatgactgtaaaggaaaactatttttcaaaggcaagtacatggagcaaataagtaatgaactagcaatacatcagtggttattggttatgataattaccttcggtgccttttggtcctttgatgggcatatgtgtatcttttgtgttatgaatgcacctctagaagtaactgaatcattcgtacaaagccttgtgatcttttttccaccgactagttttgttgccagtgcagctacccttcggtcagacgggtcactgaatatagttatttgagggttgctcaatatggcatccctaatagaacaaagcttgtcgctgacattaaggtccgtgaaacacttcagaccatcaatcacctgtcaaatggagtttccatatttaaattaaacttgactgtaggatgagtaggcttgttgggaataggcttctaggttgtataattgctaagagtatccaaaacttggagatacaaatataatttgatatgacaacagcattcgttttgcaaactgaaattacataatcactaagatggtgaatggaagtgttacagatgatctgtcttagtacaaagaagttcaacaaccaaattaactcaccagcatcgatacgcctgatatgtcaatcgcctttaaagctattagttcaagcagcctctctggcgtggatataaggaactccggttcgcaactctttaatctgaattgagtgtgcatgaaattaacatcccctaccctaacacgcttatacgcttacagataacaatgacactgataataggattagactgataattaatttggccaaaacatacccagaaatctggtgttcaatggaagcgccgggatgcagactgacggaatggataccaagtgatttcagaggcttgcaaatcgaacgcacctgcacaaaacaccatcaaatgaatcactgattcatcatttaggaatcaatcttaagtgaattaaccaaacgagcaaaaatggcggcactaacttgcacggccttttcctgggaggggacgaggtagagtaggaaggggcaagagacgaccacagcgagcttctccttcctggcgacgatgtcgcaggctgtggagacgagccaagccgtcttctcccgggtggcgcactcgccgctggtgtcgagcacgtgcgtaggcggcgcagccgagcagcaattccagagctccacgccccacgacccggtgtcgtggatgccgccgccgccgccgtnctcggacaccgccgcgtctcggatggcgttgaggcagaccaccaggaacttggacggccggtcgtactccgccccgtccttctccctagacttggcgttcgcggcggcggcggcggcggcctccctcgccggctgcttcttggcgctcgaatccttcttcttcttcttcttcttcttcttcttggattcgtccctgcctgcggcggcggcggcgggggcgtctccggtcggctcgtcgtcgcccttccgcttcttgccgtggcggtcgttgaaggggtcctccggggtggggagggagaagcacatgccctcgcaggcccgccgcttgccggacttgcggcggcgcttggaggcgatgatgccggcgacgcgggccgacacggcgttctcgctgctgcgcatccgcttccgccgcaccttgttgcgcttccgcgccagcgcgtcgtcgcccttcgccatggcccccctccccttctcctccgctccgacactcgcggcggcggcggcgacgcgaggtgcgagacggcggcgagagagacggttagccgccgcgaccccgagcacgcagagggaaaaaacctagcgaagccactaaaaaggccgggccggtggtagtgggccacattttctagatgggcccacttaagttgcatcagttgctcggtgaggcccattactcagtgagacctatattggcccaactggagagtcaagctttagcatgcgttggcccatgagaggattggcccaccagtcagtgacagacaagggggcctttctttcgtatgggccgcataaattacgcagtggaatgattatgcgttcggccttgttggcaccaaattttagcatttctcatttttttattcgcagcagaccatacataaccatcacaatcttatgataattaaacttctggtcactcacttggtaattttagaaacatcaactcacacaaaactatactgataattctagaaactcctcaaaagaccatattaaaacttgccaccacatcttatcttgtcaaatttaccaaattattttagcttcatcgtgtagttttagttttagagtcccactccggtgctttatactcggagtagaaagtaatctgagccattgatcatatttaattgaaggcttaagatctagttctactcccaccagaattagtgggagtagaaatgtgaaggggtgttttcatccaggaaaaataattcgcgtagggtattatcgtatattatcagtctcttactcaccctatccctatcctatggattcgtatcgcatcgtcgccatttcactccatcccgacgccattcccctccatccccgcctccgtcgccgtccatctccctcgccatctatgtcgcccgtcctcgcgtctcctccccctccagcgccgttgccttctccgctccctccgtcgaagcccgtctccccgccatcgccaccttctcccccgcccgcatctccacgccgccttgtgagccccctcggtagccatcctcctcccccgctcccttctccagcgagtcgcctcacgtcgtcgcgcctccacccgtcactgccgccacgttctcctcgccaccagccctctccgccgcgtcacctccacccgccaccgccgccacgtcctcctccccatcaacccctgcccccttctccactcctctcggcgatcccgcatctccgtctgggatctccagagctccgccctatcccgccgctacccgcgtcggcacaccttctggcgagttccaccttagaccccagcaccgcgccactcgctgccgccgagccttcgtcctcctcgctatccccttactcgctgtcggcctcctcccccacgctcggctccagccccgtccatctccgcccgccatcgctcctgcagccgcgtgggagagcccccaatccatcgcccacaagcggaggacgcagcctctggatccaatggcaacgcacgcctggttccccttcgtccccatgccacctcaagcacctccttcggagcatgaggaagacttgccattggacaatagcggaaggtaatgcccggaaatttgcagtaagatgcactcccctaatgccgcccctcaactttcaatctcaagttgtttgtttttcttaaattttgatttgatttccgaggctacctgtttcctattaatctgtagcatgaaggatgagatga

SEQ ID NO: 42292 - DNA, 2914 bp, Oryza sativa
aaagttgtcatctttctgaatgaaactaatgttcacctgttgtgggggctttggaatgggtggctgttactagtggctatatttgcattggcattgttatgccaccatcaattaatacgagtagatgatgcgtggtgtctctttcctttgaactttggtgtccttttcaccaattatattgctcgttttggttcagtaaatacattgtttatttcataacagaacggttaatgttaacagcatttttacttacttactctgaaccacatgccggcgaaggggttctcggtgttcaggtgcgacattgaagcagatgcacgttggtgacgtcgactgcttactgccctgagtcaccccgaagcgtaaggtttcatataccgctccttctcaaatggatacaaatatgaactatgagtacgcggactggatggtaggcccatcatagcaaacaaaaagtttgattatgacagaaggacatttgtagaaaataagaaagataacatatagttgttgtgatctatgcaggaaggcatcgatgaatacataagaaagctagcagcgattctttacaactctccatccaacaaattttgaatcatgcacaggccatctccgaagaaatctaagatgttcagctttgtattgggaggatattctttcattaaattctgagatgttcatttatcattgagatgttttattttggagattcttagtttgtcttgtcggatgttcatttcgaataagctaggtgttaattttttaatattaaactctatctgttatttattaaatgatactcaatctcgttattcaacgatgtcagatgcggggacttattctttcttttgtaaaaaaaataatgttctgctataatatatgcgcgcggtcgattgaaaaaccatgattttttatgataagtactttctgcgagtttaaagaaacatctcgtaccacgacgaagcacctttgtgcttctgcactgcaaatcttacgtaaagaagctgctcaatgcaacatcttacatcctgtcaaactgtcaaatgtgtaagctaatgttgtatcaaaatcggatgctacggagaacaaaatgatgtgtcagtatcattttttcttggggacgacatgttccccctggaactgttcctatggtttgcttcgctcctgaatcagcatcttctggaggcctgatggctgaggatgccaaatctcccaccaccaatcctttttggtggcttcgagactccgaatagagctatcgcaattcgaagttggaactagaaaaatatggacagaatgagtcctccagcagcatgtgcattcttattgatctggtaggctctgcatgaaaaaacaaccagtttcagcagcagcagcagcagcattacagtttcagcagcaccagcagcaccagcagttcagtttcattccagcaacaacagtgcagttctagcagcagcacaatttcgaatagtagcagtatcattccagcatcaacaatagcatcattccagcaaacagcaccattaaagcatcacacaagcatcacaaaatgaagtcaccattccagttgcagatcatttaatcctaatatttaaaaaggcaactaaatttatttgttcattacactcctttaaaaataaataagcagccttgcaacgcaaacaacagaactgtgcttgcgccggaatcatctcagggtaaccaggtgcgccacagttatgctgcccagggacgtcgccccaacgctgaactgcaggaggggctactgacctcctgacagggtaaaccacagctccatgatcgtcatccaggacctattttcagaaaccaagcagcaacaagtcaagttaggacacaggaggcagctcaattctgtaattttctgaaaatggattaaatcaagctcaattccgtatttatgtaatgtttctgacaaagaattcttttatagttctaaagcattttagcttatttgcctctgtacacatctaaaataaattaagtgcctcagtttcagagtataatgcaaatgcagagatggccaaattatgccctgaattctttattctttcagtttcagagtgtaatgcagatgcagagatggccaaattcaggaagacaggtttgatttgctataaaagagtatccatctcacagatccatcaactgcataaattcattgccactctaaactattgaacaattactacagttcccccataatggctgcaaattttgtatgtatgataaaagaactaaggcatgcactaataaattaattcaatgtactactagtactactgatgaactagcaggaaatgttggatgctttaaccagttgacaaggcaatcatttggtagaaaagatcaaagatcaattgcacaagatatgatttaacttgccacctttgctgaggtttaatgttggacttatattagtaacacatcaatttcagcaaactgttttgagtggaatttcaagtgacaggtgtatttcatttgcagcttaagaccaaaattattgttcagttttatcgttcatgcttacaacttaacatacaaaatcgatttaataaatctcctattcaatttaacatccgcaaatgtagattctctagtatagttacaagctagtatacacagccatttacaagcaagtatatgcatttgtagaggaaaaattcagacaagtttaacactgaggagaggaaggggaacagaaagtcaggtggggggggaggagtggacacctgaggatttcaccgcgccaccgcttttgccggtgcttgtgtcggacagatgcgacgcgccgtgccaccggccgcgacgccgcctgccgggaggactagctgccggccgcgccgccgcctgccggtgcctgcctctgacctgatgccacgcgtggtaagaa

SEQ ID NO: 42293 - DNA, 6380 bp, Oryza sativa
tacggatggtgacggagggggtggacaaggcggcgacgccgggggaggaatagcgacgagactgcgtgcaacggagtcggacctaatgcgatgcgataaggagtccgacctgatgtgatcgaaccaaagaaaacaatccatattaaaattacccctaaacgatattaggagattacttaattgccctttatatattagaagattacttacctgccctttatttaaacaatccatatcaaaattacccctaaacgatattaggagattacttacctgtcctttatatattagaagattacttacctgccctttaaaataaataaagggtccctattaggatttatacccatcaggtttgctttatggtttaaaacatgagaccagcatcctaaaaaataaaaaggggatgctcgagtaagatgatagagcttcagaatgctattgagttacaccgacatttgctacagagcaacattctattattacaatctacagtctattattacaatctagcactctataaaatctatcactctataaaataagtgtatttaaaaataattgaatgaaatcagcacacaaaaataaatttaaccaaatacaagatcgggagaacacattatttcggcaatgagttgaacaatccctaaatccagataccacagttcatccaagttcagtttgatgctcgattattattcatacagaggcataaataacacgcatacaaaaccgtaaataaacactcaaacaaagtaacaaacacacttcgaaaacaccactcaaatggcggctgggcgcccctactgcggctgcagctgcagtttctcgtgcagctgcggcggcgcgacgacgtcgaccctggcgacaccatccctggcgtcgccggcgaccttggcgacctccacctcgccgacgacgtcggcctcgcgctcgtggtcgccttcctcctcctcgtagttggggtcgttgcggtcgatggcggccgggaggggatcgagctggctgtcgacgatgctgtcggggccctcccaggtgaacttgccgccgcggccggacttgggcggcggcgcgccgatgccgcgggagccgttcgccgggtggcgctccatgcggtggagcccctgctggtccagcttccgctcgaagtgcctggccgtgtccgggtgccgcgtctccggcaccgccaccttctccgtcaccttcttcccctcctcgtcccggtgcgtcgcgcgcatgtacatcatcgatcttcgccgccggtaggtcggtattcacaactttctccggcgaattggttgcggtggttggattgcgatctgggtgatgaatcgatgagcgcagagacgcgggtatataagcggcgcgcggcgaggcgagcggcggaggagtggagaagaagagtgtgtggagagggggaggaggtggcggaggcggaaggcgacgcgtggagaggaaggcggtaagggatggatggatagggggccacgtcatgtgcaggtgtgtgtccaggtgcaacgaacgccgaaaggatttgttccaggtgttgcacgcagcacgcctggttggttgcatgaattgcatcgatagcgtcacgggaaatttaaagcccgtattattttctatcaagaaacacagtataaacacttagtgaaactataaacgtgcaccctacttataggctgagtttttttttccttcacttttccgacctatttctttcttttctatgcgcatgctttcgaactactctctccatttcacaatgtaagtcattatagcattttctatattcatattgattatctatctagattcatctatctatgaagagttttactcccgtccggcagtctgtaccagccagtactggtactaggaggtaccagattaaatctggccgtccaacttgaaaggatacgattggaaaacaacaaatagaagcggaacaattccggagtcacacgccgccgctttcctccctcgctgcgctctttctttcctccctccccgcatcggttctttctcatctattcctccatctgagcgcagaaacggagcagttgcgccgcatccacgccccgccgaacggttttttcccatccatctgccgtccgtggtcgcggtactggagaaacggcgcgctcgccccgcatccatgcctctgccggtgccgattttttcccatccatctgctgtccgcgacagtgtcaccaacaacgccgccgcattcacgagcgaagatgtcatggtattctgtgtcccctatccccctccctcgacagctcaagcaagtacctaacctcccccgctgccatggcgcagcctaggcccccattacggctcaaacactactccactatatggtctagttattttgtaattaacaattcaatctgccatgtttcttgtaatgaatttgtgagaaaagcacaagcttttgctggagactttaatctttgaatggaaaattttaagctcatctgtcgtccgttttttggtatgctgtttacagggcatgatctatcgttgaatggagcttttgacttaatttttgtctgctgtgaacagagcatgatatatatgtcgtattgagagccattaatattttgtctgatgtttttgctcgatctcctgtaaaatatatatcattctgtggagtgatcagcagcacaacaatggttacaagcaagtgttttcaatgaacagcaatccagctatagatgtaaaagttgaggaatcactggagtagagtgctagacacatgggcaataattactgaaaaaaagtataatttacatgattctgaaagactgaaacaaacatactcgtactagtgtgttgtaattcagagtttcagacagtgggagatagataaacagaattctgcaaattttcagccaaacagaacgaactagaacttagcaagaatctaaaattgaaggataagttagacaacccatctgaagaagctgtaatttagagtttcaaatagtgggagatagataaacagaattcacatggataggttgctgagacatcaacatgctgagtgatccccatccattaattctggtaattgacatgtacaaaatcaacaatggcaagcatagtacatattatcaaatagcttcatgagaaggaacacagctacaactactgttcctatgaaccaatttctaatgtcatcagtctcttttttctgcttagacaacttcttgaatgaattttctatgtctgaaagccggtcatggtcaaccatttccagctctagcttcattttatctcttctgccttcgttttctcaacataacagttgagtgcttgagctgtgggcaatgctacagaataaccagaggttgaagaaggatgcccaccacgaaccacccgctgccgacgccattgccgccgccacctcactgacacgggcccaagcaccacacaccgccgccaacaccacctcaccaccgcagcccacggaccagccaccaccttctcgtcgcctcccatggaccacctactcgtcgcctcccacgaatcagctgtcgctgctgccgcctccgagcgttgctcccgtcgagcaccaccgccacctctcacggatcagagctgaatcgagatggatccctacgcgaaaagacaacattacccttccacccctctaactattccagtaccacctcatgggcaaatatgtacctggaggtaccgtataatttccaccggccgatcgagctaaatgaatggctgagatttggtaccgggctggttacctgctggatgggagcaatcctctttgataaaacttctataattccaaccatttaataatttttcagatgctttctttgttttaagaaaatgatatacgtacctaccatagtatcaaaaacttattagtagattttacgaacttattttattgtaagattgatggctcaaattttaaaagtttaattaaatctttttttcgtggggagtttaattaaatcttgtaatcataatgtagtaaaatgtttataaccgtacggatattagattttgagactatgagattcatactggacacaaaccgagcaacaatgcggaggaggaacacaatgaagcaggagtacaagagaaggtcacagcgagaatgaatcacatccaaatgtcccagcaaaatgacacatccccaactctaactgagagcatataaactatcacattctgtcagattctggctaaactgttcttatgttggcctgtttcatcccccaaccaaactgcaaactactcaagacacgtgattagatagaattgaacccaaacacatgtcacgtgacagccatgccacaacaacgcatgtcaggcacgagggcaacaaaaaaataggacaaattgatcctactcttgaggagtcaagcagacattgatgtcaggtgaaggcctgtgcaccatggactgcgagcttgcagctgcaggccacccaaccatggcgaaaccagtactggagctcgatgaattcaggttcatggcgcctctactctgctccacaccggcatgtgcttgtggaggcatggatgagatcgaaacctgcggcgaacggcagccattgttgccaggagctgcctgagaaatgggcatcgcagctgtgagcacaggaggaggatgaagaggagccatcggtgctggaaatgccggagcagcagatggttgtggatgtaggcccattcttctctgatgctgcttcaggttgttgggcaagaagctccccacaatcacctgtccatggagatattgtgtttagagcttcagagaaaaaaaatggctacagagtctaccatgcatgagtgacagagttaacaacgaagttctctatcttcagttgtaaaagcatggtacttggttcgactgaattacgttatcgaaaaatcgattaattttgtccaggttcttcagttgttgttgttgtttctttacctgaatagggctggcggctcgcagcatcccagctactacaccgccgacaacacggccatcagggccggcaagcgagacactgagcccgccggttctcctccgaacgccttcctccgcaattgtaaaggagccagtcagttgaagaatctcaaagcagccctggcaaccacatatccataaatgctgccatcttagagttcagtgaggataactgtaaacacaaatgtgtatgcacgtacgataagtaacaacttcgcttcaattgttatcctacactgatataggcatacagccgctctgtctcttaggcagggccctgtttggcacagctctagctcccaactccaacttacctggagccggggctgtgccaaacggtccagatcctccattttttggagtggagctagcagatctactcctagaaaatgaactatgggggtggagctgggtttttctgctccacagctccactccatcctaaaatacctactaccctttaattttttagtctatttataaaaaatgccattcaactacccttcactcctctcatcccgttctctctcctccccccatcttcctcacgatgccaaccgagctgcgggagcgggagcgggggagggggcgataggccggcgcggagaccacgggcgggtggcgcgcctggggacaacgtgtggccggcggcgcgcggcacgcctggcgacaacaccggccggcggacgaagcgcctgggaacggcgagcggctggtaggctggtggtacgcggccagcgattttttcaattttttttctttttttttcatatctagagctgaaacgtagccaaacacttttcaacgagtcttcaactctaataggagctagctctcacttgagttagagtttggagccctaccaaacggggatgggagtgggagacattagcacaaatcacatgctaatctagtaatataccactgttttttttggccgggcatcactgactgttttctggacaacgttattgagactcgcgtacaatttgcagacttgagcgtatactccctccgtcctataaaacccaccataataccagatgtgacacattaatatgttacatacagttctagattttttttgagtaaagtccatcatcgatccctaaacttgtaccgctgtgtcatcccggtccctaaactcacaaatcaaccgttcaggtcctcaaacttgttcgactgtgtcatcccggtccctaaacttgcagatcactcgtttaggtcctccaacttgttcagttgtgtcaccccggtccctaaacaggacggtctaaaaactttatatcaaaaaataatttataactttttcatgtgaactctaatgaagacaaactttatatcaaaattgtatccctcgacgtgacctacaactttgt

SEQ ID NO: 42294 - DNA, 19589 bp, Oryza sativa
tgatataaagtttgtcttcattagagttcacatgaaaagttatgaattatttttaaatataaagtctttagaccgtcctatttgacccaaatgatattcaaatccaagttttgggaccgggttgacacaactgaacaagttggaggacctaaacaagtgatatgcaagtttagggaccgggatgacacagtcgaacaagtttgaggacttgaacagtcaatttgcgagtttagagaccgggatgacacagcagtacaagtttagggaccggtggtggactttactcttttttttttatgggacagagggagtatgttactacagactgccggaattgtatatgtgctatcatgaacatagaaaaattgggaagaagacttcacccttgatctgtcttcaaaagtggctcgcataaggtggttaagacttaagacaccattacagaaaaaatactttctcaacttaggcaagaagaccatttattgtatctagtactataaaggtggtgatactgaaactaagagattaggtagagacaggccaaaaaaactgaatagaccgacttgagacatacccataactccatcagaagttcaggcagccgtcaaattagctcacaacatttccaagtatcatactatcacacgatgcaaggagtgaactccatttcatacctcgtaggagaaggtgctaccagacgagccaggctggttcaatacaacatttgagatggtgccattggcagcgagaatgcaaaccgagcgaggacccttctgcgagaaggacattatgcgagccgccacatcctaccaacgaattgcaccaaagaaacagtcagtgttcatcctttcataatcaaatcacaatgccaagctaactgttaaaaaaaaaacttcagttatggcttacctcccctgtggcgacaatgatgacatgaggcgtgaagctccctccagctgataacgcataccattcccctttacaagcattgagaataccaatcagacaaagcgatgtgcactttgttgtctactaccagactactccttaactgaagtttatcctcatgaaaaccaacgaaatcgcccaaaggattgggtcgattagttaaaccacctaggaaaatcaccaaataattcatacatatccaaaggtttggactgagatgaatccggacaaacacaagagcatgaacagcagaaatgtgcttattcctaacggttattgactggtaagcagtagagccctcttcagctcaaaaggcaacattacacatcatcctctccactggaccccatgcaagcaatgaaacagaaattcacccccaaaaaaaatgaagaagagacaccaataacaagaacataaacatgaaaaaaaatggaaactgggtattttccaaatccaaagaaaatcatgtaatgaactctgcatttctgaagaagcaatatatactgacctagattggcaaggatctggcgccgcccggaccctttcggccggccacgacgccgtctggagctcaacccagcatgctcgccatggccactcacctgcatgctgccgctgtcccctgcacccaaactccgcgcggctggcgttgcaatggcggcggcggcggcatcctccgctcctcctcctccatggacagctgccgccggtggaggtgacggagtgggggacatcgacgacggcgaggagggagaagaccggtaccctttcgctgctgctgcggcttcttgttgtgcagctgcttcagccatggaacaatctgctgttctgatgaacaggccgtagcctgctggcgctgctgctgcttcatggccacttgccacagcaatgcactcccttgatcttgatccctccatgtacaagcatgagagagagagagagagagagagagagagagagacaaggttttcttgcttgtttttcttggttttcttgcttggacacaaccaaaccaaggaggaagacaaacaacagtgagacagtgagacacctcactctagttttgctttgtgtctggttatcaccaggcagcacagcaagtatagtagtagctgggaaaaagaatttgaagatggggagatgacatgaataaaaatgagattttggaggtggagactgcacaaaaatggcggggttaatgtgactgtctctatctctctctcctttgaccaaccagctggattagttggacacttggactgcaaaagtgtactggagtactacagcatagggtacgcccatcttaatgaacagtacgatgagaactcatacacacagtatcttcagtcaagaaattgatagataaacgaaataatatgtgaaataaactacacaaatacatttaaagctctatttgaaaaattagattttttttctcaaattagattgtcttatatgaaaatcatgcaaaatcgcatgtagtttacaatcttgttttggagctaaagttcgagtaccaacaaggcagcaagataaatgaatcttgcaatatcttaaaaaaattaagttttcaaccgatcttgatcaaagttcgacacataagagcaagtttaatagtatagcctaccactggctccaattcagctatagtcaatttaatagctaattcatacaatagttaccaataaaatatactatacaattactatctagtcccacctatcatacacacatgcatcttgaagtccgtgttgcagctggctacaaatatgcaaccagctgctcttctctctcctctcttatctcctcaaaatgtgtttatagatggtttatagtatgctattatacttgctcgttaactctaacgagtaggttgtgagagcttagaaattcgtcgaatatatttcaaattttgaatgaaaatgtggacgtactctctccctcaatccagtttttttaatcattgttcatatttccagagtaaagagaaaatcaagcacgttggagaatgtgcctgaagttcattactttgagcaatatttattgcactgcaattaactactctatccgttacaaagccagtgtagtaattggtgatgttaattttactgttttgatcaatgtttcttagcagtacaaacacatcccgtattgtattatctattctaaaacttttattaataaataaatacctgaaagtacaaaactaagcatcttgcatgataaagctataaaaattaatcaatcttgactggacaatttcattttattagtggtcagactttagtagtgaagcagagagagtattcccgaacaatatggtctccaaaacatatttcctccttcttatacaaagcttttggatatatttttaatacgtctgtatgtattgtttagtgtgttcaaactaaataatttaaaaaaaattaatagtcaaagttaagaaattacagtaccagagagactactattaattactttcttcgttcatttgtggttcatcccatttatctcgaaataaatatatatttttaagtaatcattgtattagaatttataaaagtagaaaatgatttcattgagagttaataaagtatgagtattctaatttttcttattttgtattggtatatgtggggtttacagacattgacgtgtgaagaaataaaatggtgggaccatatataaatgaaattgaagtaaaggatccacacatttttcttacctcaaggagagcagctttccctatgctccttcctctttaaaattcccaggcttgcataaaaaggcatcaaaagcagattcttgtttactccgggggtgtttagatggggctaaaactttttagtccgtgtcacatcgaatgtttgacgctaatttagagtattaaatatagactaataaaaaaactaatttcataaatgaaagctaatctgtgagatgaatttttaagcctaattaatccataattatgaaaagtttactatagcatcacattgtcaaatcgtggtgtaattagactcaaaagattcgtctcgcgaattagtccaaggttatagaataggttttataattagtgtatgtttaatactttaaattagtgtataaacatccgatgtgacagggactttaagtccctgtttcccaaataggccctcattcattttccagcggttacagtaaaccttcagggcagtctccaaatgagactctcgtacagtacgagaactgttaaaagtgtagtactttatgagaacatcaattgacaaagcgaaacaattctgtttttgtttaaactctgcctgtacagctgtccattaggcttctgacggggtaagaccgaaagttcatttggttgatcagtaaaactggagttaattcaaagtgaacaataaagaatcccagtcaaatccatgatgtgctgcaactgtaaaagcacgaaatcctcgttgctgtaaaacgaatgaaatgatctgagtaaacaaggccatgatgccatcctagcccttattatacctgctagtatcatccatagaaagaaaatgctaaaggaatcaaaagaccagactacaactctaagagctaagagcatgtacaatagtagactatatattagccagctataaacatattttaatgagataaaagataagagagaaaagtagcgggctacagatctgtagccaactgcagcatgaactccaagacacaatgtgtgtatgataggtgggaccatatactaatagtatagtagtaagcaattattatatgaattagctattagattggctatagatgaattggagctagtagtgagctatactattaaacttgcagtatagcccgctgctagctctaattcatctatagctaatctaatagccaattcatacaatagttgcttactatattatgaatacctggtcccacctgccatacacacattacgtcttggagtccgtattgcagctggctataaatctatagcccgctgctcttctctctcttcctttatctctttaaaatatgtttacagctggcttatagcttgctattgtacctgctctaataagcaaaaggaagaaccactaagagtatgtacaatagcatgctataagctagctataaccacgtatcgagaagaaaagagaagaaagcgggctacaaatttgtagttagctgcaacatggactccaagacattatgtgtgtatgacaagtgggattgggtattaatgatgtagtatatttttatagttaattattatatgaatggtctattagattagctatagatgatttggagccaatagttggctatactattaaacttgctctaaagtaaggattctctgagtcgcttccatccacctcgctcccgtcccaggggcgacatggacggcgaaaaactctcccccgccaccccttcccacctcccccccttcgactcgccgccgcccgagcggctcgccagcaaagtcaaacggttgcaaggacggcggctgcggggcgctctccccacgaggatacccagccggcgaggacatcggggttgcttagcggcagcgagaagcgggaggcgacggtcgggcgttggcgcgatggatctggcagccggcgcggtggatccaccccccggcagcggatctggtgtccacgatggtgggggcggcgacagcggtcagaggctcgggcggcgcgacgaacctttgtggatagcggcggcgacggcgcatccaagtgagggcagccgcggatccggcccccacgcggcgggatccggcctccctgggccgaatctagccgggaagctgcagggccggcggccgcggctgcacgacaacggtggtggtggtgcgacagctaggcaactgaggctggacggcgtcggtgtcgacggcgctggatgcggcgtagtgtccgggcggctagatggcagcggtggcgccggtgacggatgtcgacggcccacatcggcggcctagggccgccgcgatgtggcttggaggctcgaccgacgacgttgagtggcccgagtggccgttggtgggcggcaaggtggcggcggagtggtggcatcgacaaggccggcggtgggtttggcggcgaggtcgtcttccttgtggttggccaggttaccactatatttaaggagctcttccccttctttatagggagcttttaggcacgggtagaggcgatggccggcctacagggaagactcaggttgccaaggcgaggttgttcccggtcagatcccataggccggattcgacgtggaggccgacaggcggcgtggcagaggtggcctgggtcagcgtgctagggagtagcggcgtggtaaagggcgctggcggcagggtcgtcttccttgcggtcgggcaggctaaccctgtttggggagctcctccccttctctgtggggagcttcttggcaggatgaaggtggtggtcggtctacaaggaaaactctggttgctgaggcaatgttgttccttgtccaggcacccttgggccggattcgactgggaggccggcgagcggcgtggcggaggcagcctgggtcagcgcgctggcggaggtgaccggtgctatggcagtcttgtcattggcaggactggaagtcggccggtggaggggcgtaggtcaggtgtggcggaagccatgtgccgccggtgttagatggtggattcggattgagcgacggaccacggcagtaggggatttcgagcgaaagcttagcccaatttctttgggccaacagtgaccacgctttcgggcgtggtaagcctcctgagggcattgttgaggtaccccctccttccttggaaaggagctctgggtgaaaaccttatccagttctttggatggatgacgacggcgtctttcggcgtcacgaccctcgtgagggtgtcgttgtagagtcttcgcgccgtggtggtttgttgtcccggtggtgatcggtctcgcatagcgacggccggttccgtgcttggcttcctctctgtagcgtgtttggacggttggcacatggttcgaagcgtgtgctctggtgcacatcctttctcgacagccagctgttgatgtaaaacttttcttgtaacatttctttctatcttaattatattgaatgacctccttcgataattccggcaaagaagcaaaaggaaatactggagtatcaaaacatatgctctacactagaaattgcagggaagtttgtatataagagagcatgggagagggagtttcagtttcctttaattttacttggaaacaatgatgtcaacagctgtaactctggagctgtacagcagctggagcaaattttctgcagcatctactgcggcatgccggcatctactgcgaaagatggaaatgtgtgaagtgcagatcaaaaggatggatacgcaatgcactagtaataactgttgcatttattgcatttcagatactggaacatgcacaaacaattcagaatgaatactacagtttttccatgtacaacatttcagatacttgagcatggccgtgtttagttgttttggtaaaaaaaatttacgtatacggacacatatttaaagtattaaatatagactaataataaaacaaattacagattccacgtgtaaactgcgagatgaatctattaagcctaattaattcatcattaggaaatgtttactgtagaccacattgtcaaatcatagcgtaattaggttcaaaagattcgtctcgcaattcacatacaaactgtgcaattggtttttttcgttcacatttaatgcttcatgcatgtgtccaaacatttgatgtgacggaaaagttggaagtttgaagggaactaaacacagcccatgtaaacaacattattcaggccacattaccaaatattcatttgcctattgttttcagctttttcatatcaagcggttagtgtctattccaaatctttttggaataggtaccttgcaaagaagcaagatctcctataactgtcacaaacattttccccttcaaaattgaaataattttctaaatataataatcctgttataacataccccctccgtttcacaatgtaagactttctagcattgctcacatacatatagatgttaatgaatctaaacacatgcatatgtctagattcattaacatttaaatgaatatggacaatgctagaaagttttacattgtgaaacggaggaagtatttgctaaacaaaataaacatgtataaaatatttaattagaaatcaatatgcccatttcaaaaatttgatcagagatctgcccaaaaatggcatgtttgtggagaaatggaaacctttatgaggaaaagggtaaaaagatagatcatactctgataattgaaacaaaatacaatgcaaaagagctgtatttcattactgcacttactttattagttgttagtaggaattattcgtctgaaaccaggaattgtaaaacacagttgccatccatatggacatcaccattcatgaaggacattacaactcatgcaaacatgggccatgcacataacaggataaatgtgctactataaattttactttcagcgtgataatgttgccagttgttagtttgttacgcagaaaataattttgaccttctttaagttttttttccctcaatcatttctattcagataaatgtttggaacagcattttctttctattacttgatctcaacaactgagcaatcataattttgttcagccaaacccacataagcaggatcactaatgacacaggtgtaatcgacatgaaaaccaatgcaaaatattgtgatagtatcgtacattactagtgattttgtgtgtagatacttgatgtgaatccccaagtcttaatataaagatgcgcaatacttgtatgtattctcgaaaagaaatttgtgtcttaatactaaaacagaccaattagaaacctgacaagtttatgaaaaacccatttttggtagacaaaaactagaaataaaaaagacagaaaaagactatccttgaagtttttggagatatttgacttggcagatgtggagtatggatcaattgatagccctctttgcttgatataagtactcacaaggagccaaaactcgccgcccaaagtttaatagtagtaatactaatagggtgattaccgataaggctttcatgattaaattaggcatgatggtggtattttatcctaacacaaggaaggggggaattctgatctcaaacttttttgcaagcctattgtagatataaaagaaaacaggacgagaggaagcagctagcacacctctgttgtttacaacttttaatatgctaaagaagtgaaaacaatacgggaaccaaaattataaagctgccagataataattaaagtgaaaacaaacagagaattcagacctagagtaccatcatatgatgctttttctaacctttcacatgaccttcaagcacccttcccagccaacaagctcccccacttggctgaggtctggggacaatacaaaaattactgaatgagttaacagatcgatgttaactcaagaaaagagaaatccttcatgacttcagatcagaaaatgcataccttctttatgataatgatatatatgtgaaaaaaaaatgtctatcacgctagctattatagatttcctcaaaatgttattagtattgttttgagattcacgctaaggtcgagtatacaatatattcaatgaaatgtggagcacatacctgtgggtttgcatctatgttcacagtaaaagcaaaaggttgtttacctcctaccttgccgatgtatatagtacatgtggcgatcgcgctcacccaattactaaatatttcagtgacttcaatgtaatatacagtagtttgtactttccaactgaggccctgtttagattctaactttttcttcaaactttcaactttttcgtcacatcgaactttcatacatatacaaacttttaacttttccgtcgcatcgttccaatttctttaaacttctaattttggcgtggatctaaacacaccctgacttgaagctgaaaaaatattggtctataaataacataatgaggatgaggactctatgatacggctttcactgacacaaaacaatgaaactaatgttattttatatctgaaacaaaataaataaactgatctatgtatagtgcagatctgggaatgacgcaaaacttcagaaatcactccgctgaacaaaacggaggtaataccgcaatacacaatgcaagcaacatgtgtggtaaaatataaacaaacataactactgaactagagtggtccaagatcaacaacttcaattaagcatctagtgagaaccgagatttcatatgcaaatacaaaatatatccttccattattcattctataatccttagtgttttcacaggtgctatcatcagtaaaattcatgcttctaacaagtcacaaaaggtgttcatcttagctctagaggttagtggtagaaaggggaaacaaatgtagtcatcatgatgaattcagggtggcaaacacattgctgcatttccagatcaacctgtgatttccgaaccattatgctaagtacacaaacacaatatggcaacaaaatgatcggcagaacaccgaattttaaattcggcgcgagagaatttcataacgaattctgggaactgcattgctgccaccccaaagaaaaatccagaccagcatacgtaccggcaacacctagcttgatttccccagacatcggagaacaagattacgcagaagatcgtgccggatcagcatcatcaacctcgctacaatgttgagtgactgtgttagtatcaagcatgaagatgagaggagcggaggagtttgtgggaagtgattgccggagagggtcaccgtctcaccgatttagccgaggagtttgagagtcgacgccgcgtccgtccacgacttggggaggagacggagacagtccgccgcagatgagggtaacggaaccgggcgattgacgaggccggcgaatcaatggtgggtttctgccgttccggcggtggcggcccgcctcgatcgccggcggccgcggctccgttcaccgtggggtgggggtggggcggcgccggcgtgatcgcgtcgtgggattggaccgattctccggcccagtgggccggatgggcccaggaggccgcatggctcgctcgttcatttcgaattggtgcgtgaaattttccgggaggaaagatgctatgttaaaatttgcatggtctgttcatgaagaatgaagatatcgatgatatcccagcatggtattttgagccaagagtgtgtttttttctgtgaaatatgtgtacaatgtctcctatgaaaacgagagagatgggaggagggtagacagggaattaattgttgcgttattcgatggaaaatcaagatttaggggatgttaggcacaactcaaatatttcttagagctgagtattcctagttctacaaattcatagatctggatcattgataatatctatataaatcattttatttttattttatataaaatataaagttttaaatcactataatttaatatacaaactctaaatccaacatggatataagatctggagctattctaagggtttgtttggtagagcgctctagctccaactaacatttctagctctatctaaaatggaattggaactggttaaagtgctatcataaaataaactagagatgtgaagctgtggtttaggttactttagacctaatctttaacttaaatttagagttagagccttgctaaataggcctaaatagaaccttagaaagttgttgaggtttaatataacaaacaagacgaagaagagttttagtttatggcttgtttggatcactaacgatttaaatcccgcaaaaaaaaaagaagtttctggttgagcaggggagccggtgagacggtgcaccgctactgaatggttccaaagaggatgatacatcaaggacaatggtgatgttaggttttggatctgttaggaagcgtaggtagcaacatataaaaaagtatattttttattgaaggtgatccaaaactgacatgaattcatacatcactatattagtttaagctgtagcgagttacatacttgatttcgaatgagctagttctgtactctacgctcttctcaccttataatggaatgataaaatgctcacgctttttaaaattctaaatggtgtattttttaataactttatatatatgactctctgagatataatttatttttaactctataatacttaattattcatttccgctctcgaataactatcataatcattcggccattcaacattcactctggaagggttagtgatttaccatatatactttgaacttaattttagctcgctgatgtttgaggcttaaaactttaacccttctcttaacaggtagtcaaatgttctagtattgcacacattttcagaccaacatacctatagttatatataccctactggtatatagtagaaagcttgccgttgcctaagtcctaactgttctttctttcgtcaagctggaccagtctggtactataccccaacctacttgggccggtagaaatgatcttatatttggccgctttacatgatgccattagccatagacaccggcaaattgccaaatcctcttacatcaaaactagttttgaaaaattgattgcaatcatctctgcagccagtcaaataggtcaacaacacgcacaggcatccaccgagtgaaatggttccgaaggatgatgcgttatcatttatcagggccaatagtgacgttatgttttggatcagttcggatttaggaggctccgtttcaaagttataagatgtcttgacttttatcaaagttaaattgctttaaatttaactaagtttgtagaaaagaaaataatattttcaactcgatacaaatttattatgaaaatatattcaattattaatttaatgaaactattttggtattataaatattactatatttgtgcataaacttactcaaatttaaagtagtttgattttgatcaaagtcaaaacgtcttataacctcaaactaacctcaaacggatggagtattatgttgtaggcttgtagcacctaacaacgagtttaatagtagagctaactattagctataaggttgaaactaatgttgaaactgatatgtataatagatgatatataatgttgtctttaattttcttctcttctctctttacctgtttaatccatttactttgaaatatgtgaaaagctaagtcttgcatgagagttaacatattttttatttgttttttatatagcatcatgtcaaacttgttattgtaattggtcgaaagggtcatgatacttcatactacaaacgtatacgacttattgttatcgaaggtgatccaaaactgacataaataattcagagtacatcattgggttagttgatatcgaatgagccaaagtatatagcaaaaaaataaataaaatgaagaaagaatgagccaaaatacttgagtgagaaggatttattagtatactttggacttaataattacctagatcactgatatttgacactaacgtgttagtatcgcacacactgtactagtatgatggaccaataatcgaacccacttcggccggtatctcacacaaacacacaagaaatgaaaccgaactttaaatttggacgcatcacatcataccgcatgacacagacacggggaaatcgccaaatccaccagcatcaaaacctgtaaattgtactggcggtactctcccgtctccactactgataaactcgtaattatccgtgcagtaatataagccagtcaaagaggcgatcaaagtggcaggcctgccaccgagacgaacaaattaaccggctgtccgcttccaccctctccatcattggaatccccgcgccgcggcgaacatcccaaccctccctcccgcaccacaacacagccatgcaacagagcatcgcctccgtctgggtagtggatcctgaattccagaggtgcatgttatcaaataattatgaaataataaaattattttattaatacccctttcgtattttagtgcatgatgccgttgactttttctttttaccaaccattcattttatgcaaattttttttgcaaatatgaacatattatgtcatacttaaaaaaacatttgatcataatccagtcacaataaaataaattataattatataatatttttttaataaaacgaatggtcaaatgtaagtcaaaaagtcattgacgttatagaataacatatggaggaagtatatgatagatcactccacaaatatgcaaattaaaacaaattaaactacgatcagttaacgtattctcatagttaaatttgttttcgttgtaacttgcacaagttaaattttatactgcatatttgtggagtaatttatcacataatatatattattaatttttttatattttttgtaactatttgaaagagcatctatgcccctagtgggttttggtttattgatgacaaacgattaagggactaatgcacttattgagtgtataagcaagtgattagtcctatgaagaagctaggaaatagacttatcgatggatgagaattaaagagaagatattgaagatgcgggtatgaagtgactacctatggcaagacggtgaagcacaagcgacgctcagttgcgatggaccatgcggtggtgaagggcaagcaaggggcttggcgccgacgaaccgaaaccggtggtgaagggcgagtgaatactgtgtcgtgatgaaccgtgcgaggccatttgaagccatggattatccacattaatcatttgagaaatggaagatgaaatgtcaaagatcaagaagatgagatcttcccgatgatcaaatgactttgacgttggtaaccctccaagtgaagaatcaatatggtgtgaaggtactcctattggtataactttgctttttaaatttgagtttaggatgctgtactattaagagggataccacatgcatataattggttaaatactagtgctcaaaatgcttcatgtttgtgtgagttgaaaaacctaagccaaaatttttaatcccgagttgtttcacttgtcacaacacttacaccgggtttctttgcaagtttttcaatatctcttgaaggttttggaccatgttttatgttgggtttgatagcccacgaaactagctttccatagagtccaagatcttcgaaatcggagttcagagtaaaaagttattgcatttttgcttgagcaacattagactatccgatttgaaatcagactatccgatgtatcggactatctgatttttcacagaacttcactctctgtctttgtttgaaaaatcctttcgagtgagtttttctaagtgtcggagtatccgatgttggatcagatagtccaatgatacagagactccgaaatttcatggaacttgagtctctgtttgaagatgaagtttttgcttctaaaatatcagatactccgatttaatatcagatagtctgatgtctcggaaaatccgaaatttcatgaaacttcgttctctgtttctccttgccttggaggtttaaaatatcggactatccgacgtggactgaaagattccccttcaacggtcacattttgggggatctataaaaaccccccactaaccccttttctagggttgcccaaactcattttattcaaatcttgttttgggttgagctttgtgctaagtgctttggatctttgagctatctccctctctatctcaaatcccccttgttctttgtgacttggatctttgtgtgtgaatttggagtttgggagtctagtgtatatttcttttgatcttgagcactaggatttgtccaagagttgtgtggtgtttattactcttggaggttgaggactcctagacggctaggtgtcgttcttgggccaccgatctacgtgtggttgttcaagagaagtttgtgaaggccggatctcgcctccgcaaggaaagagatacccttagtgaaaggaggagtccatttgtgcaacctcacgaggatagggttgaaaaagacccggctctttgcgagcccctcaacggagactagaatcccctcaaggattagaactccgggaaatacatcggcgcataaacctcggtgatatcctcactctctttaccttcttgttgcattgctttgtggcatgctaatattgttgttggttgagctcacctctttgcttgtggattgaatctagatatcttaggttgttctcttgtttgtattgttgttgtgcaggtcagatagtctgatctcagttcagactatccgatcacatagaactatccgacctgatatcagacaatccgaccctgttttgttttagcttccgtatttatttaaaaatcgcctattcacccctttagacgatatcaagatcctttcactatttaattacatgtaaatattgaaaagataatgacatgcaaataacgaaaacgatattcgagaggttagaatagttcccctccgtctgctgcgcagcgctgggcgacgggacgcacgccgaatccacccaaatcaccccaacttctcgatccaccgaataatctcccccccccccccccccacctcactcggtttcaactcccaccgcgcaaacgcaacccgtgacaccacctatgctttcgcttcgcctcgtcgcctcgcctaaaacccactcgcgccgcgcgctgcccgcacgcacccacccacgtcgcgtcacgacatgcggaagctgagcggaggcggcggggagaggagggtggtgggggcggtggcgttcgaggtggcggcactcatgtccgcgcggcggggctgtggcgcgcgctcggggacgccgaggtgggccggctccgcggggaccgcgtccgcctcgagggcgtgcgcctgctcgtggccgacgacgacgcggcgctcctgtccctcgcgctcgccgagatggcggccgcctgcgccgacctctcgcgcgccgtcgcgcggctgtccgcgaggtgcgccgacccgctgctccgcaggttggacgccctcttcgccgccctcgtccgtggcggccgtctcgccgacccgcaccggctgcggtactccgcggcgaggaagatggaccggaaggcgcggaagatgcagcggctcgtggcgtccacggcgctcctgtcccaggagctcgacgtgctcgccgagctcgagcaggcggccgcggggggcctgcgccgatcaggcacccgacggaagggcgcggcgagcggcggcggcggagaaggagaggccgcccgccgcgtggcgcagcagaggcaggaggtcgaccgcctccgcgcggcctcgctgtggaaccggagcttcgactacgccgtccgcctcctcgccaggtcgctcttcaccatcgtcgcgaggatcgcccaagtgttcggcctggagcccaagaacgtcgccaccatggacgacgacgccatgatctcgctcgccaccacccgcctctcatggactaattccttcgtcggcagcgtgcattccttggtctatccttcagatttcgccgcagatacacatactccccggagatcattgctcgatgcaaaatccggcaaggtctccaatggcggcgaacatgttcgtcggtttcttgtctccaggagccagagcttgagacaactcaaatggccaatggccgggaagcacctcatcggctgcatggtcagtgggagcaggtctccggacagcgagaggtggaagatccatggagatggtgatcttccactcagcttcagctactacgtgtcagccagcaacgacgattattccagcatcaattccccgttccaaggcgaccacacaaattcgaatctctcaatagtgttcgagtcgtcatcgcacaactgggtgatgaacgcgcccgcggtgacgacactcggcgccgcggcgctggccctgcattacgcgaatctcatcatcttcatcgagaagctcgccgtcgcgcctcgccatatctgcccagacgagagagatgccctgtacaacatgctcaccgatcggattcgggcatctctcagagctcgcctcaggccgatcgccaagaacatggcagcctcttcatcatcttcttcttcagcttgtgatcctgccatggctgcagagtggtctggcacggtgcagcgcatcctcggatggttagctccgctggctcacaacatgctgcgatggcaatcggagaggaatttcgagcagagaaatgttgcgtcgagcggtacaggtgtgctgctcctgcagacgctgcattttgctgaccagaagaagagcgaggctgccatagttgagctgcttgttgggttgaactacctgtggaaagctggaagagagcttgatgcaaaagctaaaaaattggtgtcaggtggtggaaaacgcgatgaattcacagattattatagtagtaataggatggaatgtcgataagatgcaactgaattggatgagcctgggatatgtaagcagaggtagcatcagattccctttgctgatttgctccttcaatccctacaattggcattatgacacgcatctattctgtaattgatgctcctgcattttagtgtataagtgtagggcagctgatcattttaatgtaaatttaccatgtaattcattagtgaagacgtatcaggtttaataaggtcaccggaacagaactgaaacagtgaaaatagacttgcactagttagtatgtttgtacatgatgcattctgaatcctgaaaagaaagaagggtatcttggatgggcatgcgtcttgtgcagcatctgcagttccagaatatgttgagaccaatttcagttagaacttatattttcaggttgttaggaagcgataggcaaataaacgataaataacaagagatcaatcacagaagacacgagatttaacgtggaaaacccttccaaaacaggagagaaaaaccacgggcgccagccagcaaaatatcttcattatatcggggtgaggttaacaacaccgaacaacggcttataacaggtatatatgaaggtgaaaccctaaaaggataacgattcgtaacaagcctctggcgacggacctccgcttcactccggtagaaactggcctttattatgtgcaaatgaatttggatcacaacttaatataggttgcactaaaattgctacacttaaacagtatcgtaatattggtctcagattaagcccatcaaggaaaaaattgttgggctttacatgggccgagctggccatcagaacatgatcaaacggcccacaggaagggcttcctgctccaactcgccgtcgccggccaccgccgcggcgatctctcccctgtcccctcgtcggcgatggcgctctcgtcctcccggccgcgccacctcctccgccctctcctccggggcctccacgccaccgcgcaggcccctgggaggccggagccgcacgagttctccaaccccagcgagcacctcggcagctggggggagcccgctggggatccccgcgaggcgtgggcgc

SEQ ID NO: 42295 - DNA, 8761 bp, Oryza sativa
attacttccttcaagccctcgtaaacatccctcctagtcccgcttcatcccccttcttttgcgttgatcacccgttgcacatgagttgcttgttgaattgccggagtgggagtcttacgattaccgtgcgggtttttttagaggatcaagtgaattacgttacttgtttgtagaaatgaatctactaatttaatttttttttctggtacgatatgttaaaaatatcagcgaaatgactttataactgagatgagatgatgtacagatgaaagtaagaggtgagaagctggagaactggagggagaaggagaagctcaaagcagataagagggcggaggacagggagctcttgggcaggaagagctctgtgtggattgctgataatgaactggaaaatagaattctcaaggctatcaaatttaccacgcctctctaaggacaacttttgctgctaaggtaacttgaattcgttaaaatttgtcaatcattccatattgcaacacgaagaacgctacctatgttttatctctttttgaaagaagaccgatgctttatggtgttatcaatcagtggcggagctggagcacaattgaggggggtgcaccactttgccatatgtatggtggcataacactctagataatggtatttaaatattcctagacaacttttaactacaacatcagtgagcagcgaggaaaagtgcttaccgaaataaaagatgaaaggaagccatggagggaaacataaaaaaatataaaaaaaacaatcgatctatgaaaaatgtatcctgaattgttcaaaccctaatatgaaaaaaaaagaattataaacagtcacatagttcaaacaacgctatttaactttgagatttgcttggaacaaattaatcaaactaactagatcagaaataagaggagaaaaatcgatacctttaatttttgtggcatatttagatgagcaaatcttagcaagtggattgaactgcttcttgccatgctgatcgatcggttcctccagctacacgtaagagaagatgtcgacggtgatgggatgacggcggatctgttgcctgagggcattaacacgagtcagcgagtggtcctgatggcgattagagaaaaggaaaagaagagaaagagagatgggtctctgcgaacgaagtgatcgaggcgtcggtcctggcatcgaggacgagtgctggcgatctcagcgagcagcctattctcagccttctcctctgcgtatgggccaacggggggtacactgagttgggccaaggggggtgcccctatggtgaaacttaacggtaagcagtaaatttagaaattgggccaggtgcctgggaaccccccctggtccattgtgctccgcccctgttatcaatagaaaatgctgcagattttagagcggtagccctatgtaatattgccatcagttccattgattctgtctagatacagcgtaacttgaaattatgtgtattctgaactggataacttccttcagaagatcggggcttcaaagacagtatcttctgatacactattcatgcagtaccagtgtaccatctgtgcagtaaaaatcagaattttatttgaacttgctaaattgtaattgtggccaacagaaaaaatgcatgctttgtagtctgatgttttttttttgaaaaccatgctttgtagtctgatgtactaaaataggaagtctcaagagtatagcggatgttaactttaaagcaatcttcattacacttgaatcattttaactcttaaagtcactgggtccctgtgcttaggtagccactgactttggtgggtattacataattatacactcttgatcttccatgtgtattttttgtttatgcctattgggaatgctccttgcagtcttgtggttaagttactgatcattggcatacttctaccatcaaattctccaatacagcttggacagcagagggcataatgctatgattaacttttcatctttccaatttatccgtgcacttgagttagatgaatgtccaaaatgcaattgtatattttctgcagtcagtagttacatggtttagtacgtctgctcatgacaatttcttcttttgtatctttaagatacttttcctaccttttcgttagactaactatgactatgttctttcagataccgagaagcatcgttgttttccttgcacaagatactagataatgtcttctgagaagcaggatgtgggatgaactgaatgagttcctggaactaatcacagctgtctaagcaataacgatcaattttgaaaattccgctgcagcattgtatgttatgttggtggtggatgaaagtctaggtgaagttgtgttcaagcattccttcgcctgagagagacagctttcctcatgttcatgttaaaaaaaattctttcgcaattgaaattactttagcactagctggataaactgatttgtgaagttcaatttcgttgtggacaaactactgccccgattttcccataagatctcctataattgcatagtgcgtaatattttgaattttgcttttttttttgtatgtgtgtgcaggagatgttattgtgtgtgagtatatcaattcatgtaccactgtgccagtgcagctaattgctagtattatgtgttcatgattatgggcaaacataccatgtgttcaaggatatactccctccttccctaaatgtttaacgccgttgacttttttaaacatgtttgaccgttcgtcttattcaaaaacttttgtgaaatgtgtaaaactatatgtatacataaaagtatatttaacaataaatcaaatgatataggaaaataattaataattacttaatttttttaataagacgaacggtcaaacatttttaaaaaagtcaacggtgtcaaacaatttgggagtatatggatggtctcatcaatttttgcagcacagctacttcatgatggagtgactctgaactttatagtgtatttctttctcattacaccaggagcctatcatggtctgtactctgtaccttccacaaatggctgcaataccagatcaaattcaagatactacccctctcctctttatatataagcggtgttggtgaagcgagaagagataccccaacatttcatagaaaccagatgatcgagtagagtacagagagacaagagattcatgttagcacaatctaaacctcatgacaaacataacatgtccatgcaaatcaaatggaagtagtactacgaatgggatggattaggagacacaactacagtgaaagtgacggctttgggtatagctcgtagtcccaaatctctccgcgttccaatcactgcagtatggacaagctacataggcctagtggtgtgccagatgtaagagcgagtataataagatgatgtaaatgggctatatatattcacatatatttgtgcttatgtggagcagaaaggagaggagagagaggaaaagcggcctatagattttatagctcgtagtcccaaatctctctgcgttccaatcactgtagtatggacaagctacataagcctagtggtgtgccagatgtaagagcgagtataataagatgatgtaaatgggctatatatatattcacatgtatttgtgcttatgtggagcagaaaggagaggagagagaggaaaagcagactatagatttatagccagctgcagcacgagctccaataaaccatgtgagagaaatgcggggaatgcactaatgatgtaatatatatctatagttgactattgtattagtaggctattgagttagctatagatgatatgttaatttttgaaactagttggctatattattaaactgattatacagttcttaggagctattgcgttaattaaaaaaaacttaccgttgatttggtgtatcgtattatcgcaatcacacatcgtgttgagagtccctataaataaccataaaaatatatctgttgatttagtggatcgtgttatcatgatcgtagatcatgtacaaatcccatacatatcgtaatacacacacacacactatgtttcacaaataatcctatatactatatactatgtttatagctattggctttaacaaggtgaagtgccaaaaagctattggcttcctttgttcctttactctgctcaggaatacggcaggattacattagctcggtaggcagtagtgagcagggtttacgattccgacaggcccttctgtttcaggtactggcggaatacggaatttcgcaaaatccggtgaaaaaccagtaaattctgaacaaatttcataaaccaaaatttgaatacaaattccctaagtttgccgacaagttctcgaaaaccggtcggttttggcgaaattctgatcgaaatcatcgaaatcagtaaatgttttcctttttttatttccggtcggtttttgcccatgtaagtgttttccttttcttgattatttattcttttctttcctgatgtaagtttcagtaaatacatacaatacatcatttttttcgaaaatttatatcccaataggttctatgaatatcatagtatttataagattttatttgatttttcttttttatcaattcaaattttaatttggatgaaacttctcgaaatctcagacgatttctactttcgagcctcgtcgaaacgtcgaaatttcacgaaatccggtcggttttcgtcggaaccctggtagtgagtacatgcccaaccaaatgctactattgcagcccctttgtagtgagtgcagtttaaactacgtcaagtgaaaaatactacactctccttaactatgagaggaccatagagatattcttcattaatggaaggtagcaaaataagagaggaaataaatacttatcagtagtttttcacagcttcctggaaagttactcgggaggtgatcgatgatttatagagttttttgctctttgttttccatgacaaaaatcaaaacttcacaactgtcatgtatagcagtgatgattaggtcagccatgagcatttgcaaggctagctaggaactggaggcgtttggaaatgctgcaaggcctcaacacactctcacatagaacaaagctcctaacactgttgcagatctttggacaattgacaagtgctgggatgcccaaaagctcaattcaatctttgagcagcaagcggttaatatgatattgcaggtaccaatcatccaagacaactctgaagataaacttcgatggaaattcactcccaatggagagtgcaattccaaaagtgcatacaaggagatctggaaaagagaagcctcacatggatctcaagtaagtgaacatgccagaacaatcttgaaacaggtttggaaagacaagtgtatgcctccaaagattaaaacctttgcttggagattgctgatgggagctcttcctactgcttccaggcttaatttcagaatcagtgaaatttctccaaattgcattagatgtggcatgattgaaaatgatttccatcttttcttggactgcccttttagcaaaatcacctggataatctcagatatcaatctgaacactgacattttttctgataatgtctcaatggctcacattattgcttgcattgtaaataattgctctaacaaagcctcccttaatagaatcttctcaatcatgtggcaaatctggaaagcaagaaatgatcttaaatttcaggggaaggtgctcgagccaacacaagtctgttttgcagcagaagctatgatcaacacttactcttgcttgattgagcaacctcatttgcaggataacatcgaccagagcccttcggagagaagaatggaacagctgcctgaaggtaacagatgctatgttgatgcctcctgggaacataataaagcatgcattgggatcttttttcatcttcctgctactcacaatgctcttttcattaaagctttttgtcacttgactgaatcccctttacaagctgaactgcttgctttgcaattagctatggagattgctttggttttgaatttcacagacacaatcttcctcatggattgctcaacggtggtggacacagcgaagaaaggaaacttccatgaagatccaagccattggagtcttttacctatttggagtcaaatcttaaccttcttaccaggacatttgctcaaggtccactggattccaagacatctcaacaagttggcagataagctagccaaggatgctagagggaacccttcatcccctccaatctttagttgccaaaacattgctcatattgcttacccatccaatcaatgttttgcttctaccctaagatctagcctgagggctcgaaattgtactgtcaaccatgtactttgtttctgagcttaataaaacgcatggttttcaaaaaaaaaaagaacacatagaacaaagctggagatggcttcctcctctgccgagtgagacacgttgttcccctcaagactatcgctccaatttccttttctctggtctgaaagtggttgaaaattacaaatccatgggaccaattgatgtgttactagttttgcattacatgtacatcataacatactattcatttggctacataacttggcacacggaagaaattaattaaagacaacttcaattccggcagcatagtgagttagtgactggacagagtaaacgtttgaacatacatcgattccagttttggctatatggagtagattactagattaattacttatatcttttacagtgatcagttcttgtatttctgtgagcactgaccattccacaaagctgacgaattcaccattgttgtcacgatgatccataaagagatcgagccatatatatatatttttgagagaacagtcaaggagttcttacacttcactgtagaaaaagagagttgatccaatttataagaaaaattgaacctaaaactctggcattgacacactgaacctaagaacaatagttgaacaagggaaaaaccctaaaacgaagccttcgagaaggacacgccgacagaacggtgacatcgcctgatccaaatgaatctaaggtttttatccggagaaatcccttaatgtgaaatagagcatatctctcagcatggaattcgagaggaaatcctagacggccgttttccacccgttgcccataggattaacgcgattcaattgcaattatttccataattacgtgattacgcgtattgatcggtagcgccaaatccttccatgtttggattgcccccgatctccctcagcgccatactaataggggaggccggtatcgtggatagatgacgatctctccacgatcatcttctccccgaaaatcccaaaaacctatccgatcaactgagcgctggagggagaacgtgtggtggttctgggacagtgtaggtggcgaccggaaggccatcgctaccccacaagtgattaccggcaaccccttcgggatcaagccggtgctcacactgcaactgctaccactactacctctacaccaacaagaacaaggagaaccgcatcaatgacttcaaataatggtcagttaaaccccaattccgcattagggtgatctataggcttagcaaattatatcttagtagatcgcaaagtctacaaatattgcccacacaccaaaactacctacaccactgcacaccgccaactacacaccgcaacaacgtgcacaccaccaatcgagccatatatatacacttggtcgatacatatgcataatggagcagaaatccaaagggtccagcccacagccaatatagtagaattatttacggtacaccatactagtatatatatgtatatgttgcagatgcacaatccaaacaccacaaaggcacaaactgggaagcaatggatcagtcataaccgggaataccagggcgtttccacggacagaagtcatggccagagatccaatccaagtcggccgaacgaaaatttgaccggtggtcggtggcaatccagctgggctgtgttcgtgcgtacgtgtggcttctggattggatatgacacagctgtgcgtccaatcgagggttttattcactcttcttctcgtgattaactaactccctatggacaaaggccacacacacatccaatgtatacgaaaaatcgtatgtgtgtgccgagcgtatacacgtagtatgtccatgtgtgaagaggtatacgtacgttgtatgtgccctcgtaaaagattaatggttggttgaaatggacgcattgttgttcttggcaatatgtgtttaacacctactctctccattctaatctagaagtggtctttttttttcatagagggtgtaccctgcagtagattttatattttaccccctccatttcacgatgtaaatcattctagcgtctaagattcattaacatcactataaatattgaaaatgctagaataacttgcattgtgaaatggaggaagtatcaaagtttctaacagatcgtgtgtccaaatatatgggctctataaattgtagttactctgatgccctcttttcttattacaccaagtgcctaacatggtctgcaccatggacacatggctgtaatcaggggtggatccaggaacaaaaaaattggagaggctcaattgcgcagttttttcaaccttcagccatctagagacttttagtttatcattcatagtgaaaaaataaaaggggtgctccggagggtattcatgagtcttgtgggtgt

SEQ ID NO: 42296 - DNA, 2094 bp, Oryza sativa
cccctgcacccacgttggatccgcccctggctgcaataccagatcaaatttaagatactacacctctctttatatacaagtgggctgagcaagaagagaaagggatatgcgtctatcatttcatagaaactagctgatgagaggaacgggctaaagagaggacaaaatgatgaataacaacatacattttgcatgtacaacttcaccacaagttttacagaccacacaatctaaactttatggtaactcttgccatacacattttgtaactaggattgggatgtattaggaaatacaactatggctatagcactgaaaccttacgccatttttctatggaaggtagtgtatgtgttggagacttgacgtaaggtttcagtgctagtagccggacaaccaaggaaggcgataacatccctggttaatatggttgtatgggaaatatagagagatcaaaatatcggagtgtttcggaggagaagtacatgcttaggtgaagtgtcgttgtgagagacaggcatagagcagctagggcttgagtcttaggcttacctctaaaatcatgtttaattaaattctctaaattcaccatgcatgtaaattttggacattaaaaaaaatattagttgagcctagtttaaccttagtcttaagaaatttttagcttcgtcactggtgagagacctacaagagctagagcagctaacgttgaagaaactagaaagtgaactatattttggtcctccggcataacattgtcaaaataaataattttgtgattatcatcatatcttttagaacttaatgatcgttggatcgagcttgacattatccgcagcaacacacacacaaaaaaagggtctctggcatgatccgcgagcggataatccgacccactaaagcatgatggggttgactaattaattgtgctttcttttgcaaggtataattgtgtatttgtgtagctaggcaattcagatgttttcggccacaagtttctctaacagcttacctacggtagacatgagactatttcaactttttggcaaacggattatttcacatcagctacttgatgattcgttactatgaactttctacaagtgcagtccctttaattacatcaaccgcacgtctattataatatgtacttttcacatgaacacaatgccgttaaattcaacatacaactctctctttcatctttatcttttcctattataaaagtttaagatgtttttgccacaaatttcgtacgtcgtccctgattgtgtctgtatccgtatgagtttatcgcatactttggccaatgcacaaaagaatcacagatccgattcaatttgacacggagaaaaaaagtcaaagtaatcctaagtccgcaccaaatcggttccgatcaggattttacataaattgggctaaatttaaaccggttcgtgttacactaggacaacttgcatatatacaacatataaaaatacaaaaattggttctaggaaaaatacccaatttgcacaaaccctaaattccaaattttcctcgaattagatcccaaatccaaataaagcaaaactccagccaccagaatcattctcaccggtttctatcttcggccgcacgtcgcatgatttcaaaaccctaaaacgaaaaatacccaaatttagaactcaaatttctgggtaaatccctaagcaaatcagattgatggcttaccaatttggcaaatcaccgccatcatgtgatgcgagcacagaattagcaccaccatgcacgcaccctagccgtcaccctgaaccggccttgcgcctgcttctcatgggccacgcaaggtcgaggctcgctgtcgtggccttggctgcgtgcggaagagaaccaggaggcggccgtgcacggcatcagacttggcttggaagcagatcatcaccgtcgaatccactccacgccgctgccgaggccactccgcccccgtcaactacttgagctgagctgcagcccagatgcataaccggatgccgccaagagaggaagatggggcgcaacaggtagggaaggagctcaaagattgttgtgtgtgtggggggggaggggggggga

SEQ ID NO: 42297 - DNA, 41663 bp, Oryza sativa
tcaaatatgcatcataatatattaaaaacgagccttttttcttcgttttttcaaaagtttcttttcacatacgtatatttatgtgttaggctaagaattttttgggtgatccgcccatgacaatatgtttattggaactgacgaatcgatattaaaatttatgacggtctcacttaaaaacacatataaacatgtcccgatttacatacgcaattgtatctttttccattgcaaacatgccggcatttctactatcacatattacaaatggtttaggagagaatttttagaagatgccattcgatttgctgcaccaccttcaggatgtgccactcaattcgcaacactttcaaaacatgccaccaaggacgtgaattgtttcattccgtgccgctctgtccctcccaagccgtgtgtcgtcatcttgctgccgccagcaagcttttccttgccatgccggcaagagctcctgtagtcggccgcactaagcttcgtcggcgatgtgccatcaaccaccaaggtgtctggacactacttccaccagctccgccatgattactccttcgttgacattgcggactctgccatagaacgacgcccgcttccacggtcttttcctcccgtatcaacacacgggtatttttctagtctttaattatatataagtagtggtgttggcaaataatagaaggagatgcgcctcaacatttgtagaaatgagttgacaattaaggggagcaaagatagataagagagagagagagagagagacgcgatgcatactagcatatgctctccgcgcaaaatctaaaactcatggtaactctgtccatgcattgacatggagggattaggattaggatgcattaggaaacacgcaagaatagtgaaagtgatgacaacccaagctcgtgtatcagtattatctcacagatacataccatgctgtaaaccactccactacataccatggtgagggatcatactatcagataacactcgttactttggcatgctagatcaggatgttcagtagctcccagaagtcagcagcaaaagaggcattatcatgtgtttctatcttctctgcttttctgcttttggaacctctcgaaccaccgtcatggtgtggtttccagaaatgaaccactatcattacatcgccttttggtgaagtgtataaggatgctactctgggctgaacgacttcgagaatagacttgtaatttcagcttggaaggatctcctcttttcctcctttcgttctctaaatctgtaacgatcttgtaatgatcttgtacttctaggcacccttttatcaatgaaatacaggtggggaaactctcccctcctaatgacatattctaaaaaaaatgttagatcaggatactaagtcttccttttaggattatcatagcaaaactaaactatattagctgagttgatatgtatcgtgaggtacggaccattctggatagctatcaaaatgtgccttactaattgatcctctactcaataatgtttggctaaattttggattgaagccaattcttttatcaaatcaatattgatgtcctacgaaattattgataataccaataaatataattggatagtaaagaaccaaaatgaccattttattgaactgaataaactttaaagtcattgaaagtttctccatacctcattgttctagaaatattgcataacataacacctccccgttaacactaataatgcatttacctttcaagacggtagaaacctccaattaattttagaatgaatgggcacattatgggtggttgaatcctaacgccaacgtcattggcccccaacaagtgtaataaatgatatttctattaagctacatcatcacctccattattatttttaacctagcatgattaatctacaactaaatcattttccttctcatttcacattatcacactgtcacgggcttgggccctaagtgggctggccatgaagacccaccaggctggaaggttaacctgctactccctccatccctaaatgtttgacgccgttgaccattttaaatatatttgaccgttcgttgtcagggttatgtatactacatacctaatagtagttgactaaatctcggcaggacgcaccacataccatgtcctatatagaaacaatctgcggatataggaggagttccggataaggaaagacaaccagagttctacatgaaaacgacaaggactactcggattgtatccatattggtttccctagttctacttggacaaggggacacctatgggtataaatacaagcccccctaggaggacagggggacaaccatgatgagacgatcaacacgatcaacacccaccatgacgagacaatcaacacccaacacaatcgacatagaagccacaacatacaagccaacatactccaagacaagacgccggatatcgacttcagggataggcatggctattcccctacagtgtctccggataccgtcaggagagacgaaagcgctatctctgatctcgccgggcacagattcgaggaggaaggctaccctgttgtcgattacgagtcagatcttcagaccgacatgtcgataacagttagataggctaccccacatattgtattggtgtgattatggtgaataaaagcaactccggctccggccaacaggatgtagggttattacctgacagctcaggggcccgaacctgtataaaaatcctcgtctccatctcttttacctcagtcttgtgtatatcctagcaccaacgttccccatactgtccaaataccatagtcgagacatcaaacgtcgacagtggcgcgccaggtagggggattttggtgctctaggatttcaacgagatgggttcaaaagacagattctccgacaacaagctactcgacgacttcgctgtggggagatctaacccgaccagagtatgtctctcgacgagatcggaaccatcgtcgtcaacaactcgatctctcgagatcgaccaaacttcaagacgtcaccgccacagagaacagtgacttgatattatcaactaggaggtctccgatctccatctcttcggaagcgacatcatcaactgatttttggtaacctcggtaatgctgctgcctgctcagaaacccggccatcgaggaaccaaaatcaacatctcgatctattcactggattcttttgggatttggatcgttctcacaccccgattaggatccaaattttggacccctgacgcatactgagaacatccatcccgacatcatgtgttccagggattattgatcacggatgtctaccaaggtatcgagaaaacaacaagacaaagatccaactaatatgcttgctcctgacgtgtacacatgcatatgcatggactcagtacgtgcttaggcatgcatgcattagttggccgacgtgtacctgcaaagaagaccaacatggctgtctaaattgcaacgtgttgattattcagataaatcaacggccgcccgtgatcaggtatttagtagattgattttttaaaaatggtctactaatttcgtagatacatccggcatgtatctacaaaggtacgcaatattttatatgcaatttatcgtacctattcagatgatacagcattgtcagatctataatttattacgtttacctagagcatgttttttatacaatatctattgcgcggatgtttccgacgttaaaccaactacggtctaacgctgggggctcactctgttttcttctgtataaatcatgcttgttcacggtttacataatgcttaatatttgcatctgcttgttgtatcctgataatactagaagatccatgcagttttttgagtacatactcgatattatctgctatatatcttgccttctaaaaaatatttttcaggaacaattgagcactcgagtaggttatggtcgagtacactccattatcgagaacattttcgacaaatgcggagttatcgcacccaacctaccaacaaagaccgacgacctatctcatagcatctgccatggctagactactcgagaaaaggttgttaacggataattcctcgcgaacgtcgtcggcctgatcacccgacatgattgcgaacggacatccggatatgctataagttgggtacgtgagtcatactagccacatgagatacacttgcaataaaccaactctagcacttccattggtgttcgagagataattctgctcgctcactggttctcgcaccagtacgcagcaatctctcacaccgcagcgtccattggtgttcgagagataattccgctcgctcactggttctcgcaccagtacgcagcaatctctcacaccgcagcgtccattggtgttcgagagataattctgctcgcacactggttctcgcaccagtacgtagcaatctctcgcaccgcaacttccattggtgttcgagagataattctgctcgcacactggttctcgcaccagtacctagcaatctctcgcaccgcaacttccattggtgttcgagagataattctgctcgctcactggttctcgcaccagtacatagcaatctctcgcaccgcaactaccattggtgttcgagagataattctgctcgcacactagttctcgcaccagtacgtagcaatctctcgcaccgcagcatccattggtgttcgagagataattccgctcgctcactggttctcgcaccagtacgcagcaatctctcacaccgcaacttccattggtgttcgagagataattctgctcgctcactggttctcgcaccagtacgtagcaatctctcgcaccttaacttcagatggtcaaggtacgactacagcagcgtagcggtcctcgtaccacgactccatgtgatcaagggattcctactcaccggttctcaaccagttgatcgtagtgatctctcgtacatttgcttcaagtggtcgagttacgactactgactggttctcgaccagcggtatagcgtttctcctactatttccacttctagtggtcgagttacgactactgcctggttctcgaccagcggtgtagcgtttctcccactatttccacttctagtggtcgagttacgactattgcctggtcctcgaccagcgatgtagcgtttctcccactatttccactttaggtggtcgagttacgactactgcctggttctcgaccagcgatgtagcgtttctcccactatttccactttaggtggtcgagttacgactactgcctggttctcgaccagcgatgtagcgtttctcccactatttccactttaagtggtcgagttacgactactgcctggttcttgaccagcggtgtagcatttctcccactatttccacttctagtggtcgagttacgactactgcctggtcctcgaccagcgatgtagcgtttctcccactatttccacttgaagttgtcaagttacgactactgctggtcctcgaccagtgatgtagcgtttctcccactacttccactttaagtggtcgagttacgactactgactggtcctcgaccagcgatgtagcgattctcccattacctctacttcaacaaagttggcagcaggtacacaatatcgccaagtgttttacccagagatcccttatcacacgacacctagcgttgaaacctatcgtactgtccctttacgccgtcttgacaaggcctccgaggaacctaagggatcttcggctggggacgcccagagccgataaggccttgtcggatcctgtagagacgaaagaccatgtaagatctggtcgtgtaacagttctcgccctgcgtattaaccaagccgtgtaatcggaaattgagttttccaacttcatggctgggggctaggatcagtgcttattcaaccaaggcaggtcaagggtccaagagccttatcctccgagaatgattctccgacgacaaggctgggggctagggacagtatatgactctacaaactgactgatcgaagtcggtaagagagaagacgctcatacacaaaacattggttggtaaatttaattcattttcaatttaccatacatattataacatgtcaccctttgagcattcgctcgggggctatttctatctaatattcttttctgagtattgatttcaggaaaattctattcgacattatcgaagatcgcatgtctctatggttctacaccaagatcgactaaggcgagtacgacaaatgtcgacaaagttccgtcgcggactctatgccttctcgatcgctcgagaacggttgctagatctcgacaaggaatacggaatgaagagatggtgtacccgccgagataaaatttcttgacttcaatccaaattctcgattacagcaagacgggagacttagtcgtacgctctgtactttctcggtcgacatcagagattgacttagacaaactctttcggtgcccgcacgaggctgacaaaggaagtccaacgttctctctaaactcaccgagaactgtcacatgagctcgataatagttactccaatgtctgcgcagttgagaatatgaattcattcatttgcatcgaagtcgggggctactgtcagggttatgtataccacatacctaatagtagttgactaaatctcggcaggacccaccacataccatgtcctatatggaaacaacctgcggatataggaggagttccggataaggaaagacaaccagagttctacatggaaacgacaaggactactcggattgtatccatattggtttccctagttctacttggacaaggggacacctatgggtataaatacaagcccccctaggaggacagggggacaaccatgatgagacgatcaacacgatcaacacccaccatgacgagacaatcaacacccaacacaatcgacatagaagccacaacatacaagccaacatactccaagacaagacgccggatatcgacttcagggataggcatggctattcccctacggtgtctccggataccgtcaggagagacgaaagcgctatctctgatctcgccgggcacggattcgaggaggaaggctaccctgttgtcgactacgagtcagatcttcagaccgagatgtcgacaacagttagataggctaccccacatattgtattggtgtgattatggtgaataaaagcaactccggctccagccaacaggatgtagggttatgtcacgcccggaatttctatccaaaattccaaacgcttacatgtgtgtgaaccctcgtccagaaatcagccgaggcacacaataacaaattgataatagagtacaattattactctaattaataagcgaataaaatgtcattacagaggtagatagttcatctcaatcaataaagatctaagcagcggaaaaaaaaagataaacggcgcagacgactccactccacaggtagcttgaccagggctacacctaatcctccacaccatcaacatcactgtagaactcttcctctgatgaatgattgcaaggtgagtatatgacatactcagcaagccacgcagcaaatatgcaagtgcacaggataacaaaggatggcacagtggggtttcatttgcataaacagcatttaataaacatttcagaatttaataaaacagttaagtaataattaaacaatattaatccaacactatacaacataccctgttgcataggcccaaccattctgaacaaccatcccggctgcacagttctatctccaaaccaagaatataccgttccaaaccaggagctaatcaaattattaccagttatagcatcttttattatgatgagaagtgtgagactaatcacgaaagacattgttagacccgcccataaccgcgggcacggcttttcgaatagttttactctggccagaggtgtaccactgtactcacaagacacagccccacaacatgtcactatgtgccttaataccaccacggtacctcggaaaggagctatgacagtacccctcgcacaacacgatccaccacagcgcacctttcctggatcataatcaatcaccccttataaacaaggcatggactccccagtgacccccgtgggcttatctccgccacttctcagtctggtgctccgcaatgaaccatgctatacaaaaggtaaagccgttgcccacgctggcttgtggttggcacggttaatgtttcacaaccaaaactcgtgaaccggtccttaattgtcatgagcacgactctcaaaaccatgtgctcacaacccaccattatcaagttttagttggcaagtaattaattaaccaatcacgattgaccatcgtgaactatcattaagccatcattaagtaatagtgaatcataagttatcccaatagtgtgctaatgtttctaagcatggctaagcaatcatatctaatatctagctgaaccaatatataaagctcaactagtcaagttataataacccaaggtatcaaggaataaagtaatcaagaacaaaagggctataacaaacaataggttaattccacccaatgacattcgaaaataaatgcaattgttgaatagaaacaatagctttaaacgggatcaacatgctcaaagggttctttgggatctgtgtgacttgccttgctggccttggaactcttcaaaatcttctcctgcaaaaatggactctccggaaacgtcggaatctaaacagaaaggagcaaaatcaccaaaacagcacataaacaagcatgaacagtacatgtggatatttttaacatgtagatctcaattttagaaaaatttagagacttgaaccaactaaatccgagctaagatgaattagttatgaatttttaaagattaaatcggattaaatcacttatatggattttaattgaattatgacgcaataatgaattattttttaaaaggaaaagggaattattgcgtcagcggctagggttcgcggtgaaccgggtgcacggcggcggctcacgaaaacgaacggctgagatctttccatccaaaacgaacggccgagatcgaccggtccacagccggaccacggaagacgacgacgatgacgtcagcggtgacatcaccaccggcggcggctcgggtgcgcaaactcgtcggcgaacgacggcgcgacgacgcgaacggaggacaccaacacgtagagggcgacgcggcgaactcaccggtgaccaaaacaatggcggaagatcaacggacggcgacggcgtcgaggaagaagcggcggcaaccttcggcttgacgacgacggcggagaggtggacgagatcggcgacggcttggtgaccacgacggcgacctccccgagcagcgacgacgaccggagcgacggcggcgcacggctggagctgcggcggcgacagcgcgctaggctacacgatgctagggctctaccggcgacgagaggcgaatgcgagggtggcggcgggtagcggcgggcttgggggtccttttataggagcaaggaggcggcggcgaaggcccacggcgaccggcgacatgaaggaaagtctagggttcggaggagagagatcgatccgaatcgaactcgaatccacgatttccaaacgattttagccgacgattccaaaagagaaaggtagaggagatcccgaagatcatttcccctctattgatttcaccggagaaggaaaggcgtgagcgaatttggaaggagacggcggcgcggctcagctagggttccggccgggcgacgacgcgaggaggacgacgagtccgacaggtgggccccacctgtcagcgggcggacgcgcgcgcgcgagcgggcggctcgactgcgggccggattgggccaggagagagagaaaaggttttgggccgactttcggcccaaagccaaaagaggatttttaaaaccttttacaatttaaattattcattaaatgtaattccatttattaaaaatacttccttagctcaaataaatctcagaaaaatctaggaattatagagttaagcaaagtatttaatgaaattttatctggccccattttatattggaatttattaattaaaattagatcttctcttctaggctttttaaaataaattccaattaaacaacaatttatatatttaggatttttagggtgtgacaggttattacctgacagctcaggggcccgaacctatataaaaatcctcgtctccatctcttttacttcagtctcgtgtatatcctagcaccaacgatccccatactgttcaaataccgtagttgagacatcaaacgtcgacattcgtcttattcaaaaaatttaagtaattattaattctttttctataatttgattcattgttaaatatacttttatgtatacatatagttttacatatttcataaaagtttttgaataagacgaatggtcaaacatgttttaaaaagtcaacggcgtcaaacatttggacaataagggagtataaacgaacagggagacatggcaaaaggcatcgatgaactgaaccaaggaacgagcctctccttctccctggatgcttcctcttcccaaaatccttttctctgaatcccaacctagctatttttccctgtctaattcttctcccagtctacgaacctgtatctcccttcaccacttggtatcttgtgcgatgaatgaaggattaaccctgagttatgctccaacatatcatagaaattaacccgctgattgagaggagcgaagatatcctgttctaataaatgaaattgacgctggttgatttgttaaaaaaacaaaaatacagaggagggaagagagctaattaaagatagggttaattggatccatgccactacaaatataccaaattagaaaaatgtcactacatttcacgatatcagctgagtgccactcgaatttggggaaattggaaccgtgccactccgttgggttttccatccactccctgttaatttcccaactccgacactcggcctcgatgcggcggcgaaggagctcggcgacggtgccatttcccaactccaatggcgagaagagttttggcaatggcggagttcctgcccctctttctcctcatgaactcgtcgtacttcctctttgcttcctcttcttggttccgtccacgtaggtgctgtggaagctgtgcccgcatgccgggagcacgccgccgtccgccagctctgacaggcagatggcacactccacctcggcccacccgccgaccatcgggactccgaacgccgcgccgaccgccctgacctatcggtgttggcgtcgtcgtcggacgccggcctaggtggctgtggttgcgcccactccccggagtcgcgccaacgggcgaggcagcggatgaggcaccgcgcggcggcgtggaggtagaaggcgaggagggagacgcgggcgaagatgatgaggatggtggccacgttggagaagaatgcacgcatcgacagtgaagtgtgaggtgaggaaccacgaggacgacatattgttaacgaccaaatttggtaatatcagcatcggaagaggagactagatcgaggtggagtcgaaggcggagattgattcgagaacagagcaagaatcgactgaagtccatatcggctacgattaggatcggatgggtctaagtcggactaggtaagccgatgcagccgattccgacagtataatttggtgtatgacatcgggttgaattgaggtgcttcaagatgattgccgcacatggatagagtcctgagaaggcaattgtatctattaattaggatgttttatgtaacttccttagagatatgtttgggcaaaagtctaccgcaaagacttatggtatcttagagtgtgttagagatagtggtcgtgtccggtatggacatatcttgtaattcttgggtataaatagaccccgagccctatgtaatttttaacacacacgttcaatacaatttcggcgcatcgccacctttttgctttagttttgttttcgacgagttcttactttcgggttgagctgcatcggttttgatcttcaacaagaggtaaaacttgttatgacgacttgtgttctcgagattagtgcttccatctttatgacactctaatcttgcctatataattcgtcgagttattatatatcttacattagctttggcaatatcgtcatctaacctacaatcggctgacatctgttaatagaaggcagccgattaggttaaatagcgatgttgtcctagattatataaaatatctaccactttatgaaacatccagcgtcttgattgtctagatattgttcttcttttcatacttaatgttgcatcagttgagtttgatctattaagtcgtgcttagaatatcaatctctagcatgtcctctggttgccgattagggtagtatcggagtttcagccgatcttatctgatttaaccatattcgatctatgtgcctaagtgacatgttaaatccgccctttatgtcaagatcttactgcatttaagtatattaagcttttgtttggtatattatacttgttttgatatctttatgtagagtagtatcggagtattagccgatacatgctagatctatctgatcggctatgctataaacatatataatcatgttattaatatatatttcgatctaagtgatttatactgtctcggcatggtgaccgatctatcccaatcacttgatttaagtatatattaatataagaactatatatcgttaatatctacagccgatcgaatagatttagttccttactgtctatttataaccgccgatcgattcatatatgacatcggctcaaagataaatgatatgtcatcggcacctagccgatcggctattatttatagatttaaccacgaattctttgtctctatttcttgttgattacaggatcaaatcaactggcacgctcatacattcgaaggtgagctttggacctgcactggagttaagcagatctcccaggcctcgtgttttctgtcaacacatatggaggtcttgacgacacgggagacgacgaccgcgcccctatggtagaaatctacggcagagacgagctccccaggtagcaacacccttccctgccgctgatcatctccgtcgagtggagcagcggtggcggcagcagcggcgacgtccatgcacgggaaagagaaggcgtcgacgaagttggcactgtggacagggagtggatggaaaacgcgaaggagtggcatggatctaatttcccaaaattccagtggcacccagccgatatcgcgaatagtggtggcatttttctaatttggtatatttgtagtggcatgaatccaattagggatacatatacacacatgtgtgcacaacttcacctcagattttacaagcctcataaaacccaaaccttatggcaactttggccatgtaaattgttggattgggatgcactaggaaaatacaacaatgctgaggtgatctcctacctcgtcgtctcatagtcagggttagaaattttggaccaaaatttcggaaattttggtcatttcggtgacccccgatatgatattaattcggctgaaatttttgaatttttcaattttttcatgaatttggataatatttgttcaaattcaactaaattttgtttaaaattttagaaattttgaaccgaaatttctgaaatttcaggatttcggtgaccccaatagaaacccctaaaccgatagagtgaaccctgctcgtagttaggctagcaccttgttttcggccggtgacaaacaagaaagtatcatccacggacaattggcgtgagactacagctgtgttccgacttccggcacgtcggaattacaatcgaaaagctctccacacaatcaacaattgcactcttttttttttagaactcatgattttatttaaggctaatagcacgttatatgatgagttgatacaacttccatagagtaagaggagagcaagcccaaaaaagagaagctgacaagtatgcccacaagcatacgggctggtaaacatacagcacatattgcaaaagaactcctaaaagatagaaaaatgcaaaagggcctagaaaaaagcaaaggacttctaaagataaggaaaaaaaaaagcgatctggtccttgcgctgcttcttcctctaatctggtgaccaggacaacgaaaccgacatcaacaacgacggcgaaagcaagggagactgtaaaatagagctccaagccgtaaaaccatacggggctttcaccacacaaggcggaagttgacgcacgacaaaaagaataggaagaatacagtcgcacattgaagaacgtcgacagcaatgaaatggctcaccacattagtagcaactttgccggagttggttagaatggctggcatcaccttcaacagaaacaccaacctgcttgccggagaagcagacttattgcccttcaagcagcgaacaacgtgagagcaaacctggaagccacccaaaagcaggcaacaactaaggagatcttcagcagcaccttccatagaggaccaccggaacaagggagctcgacgccggtgaatcccttgcactacacacaaaaggaaaacggaatgaaccctacacggaatatatccgaccatcctatcgcctaagggtaaggaggccaacccctctccctaccctcatcagcggcgaaccaccggatcggaggaggaggaaaaggggtcaagaagaaagaggaaaaactctcaatggatctcagagtatcgcgagagggatagagaaagtcccgccccagctgatggcttcttctactgctctactacaagtgaactcgtatatcgtatcccatgtcatggatggagccctatcccagtcatggatggagaaccaaggagatataattagaacaggtagcagctaatcataggagaagtcatttggtcctccggcgtaatcttctactccttacattccaaaatataataacatagaactggatgtctcatctaataccaaattattatattttagattggagatagtaggaaatatcaacaaatatgctggttgtgtttgagattgattaaaaagaagatgaagtcacagcaagcaaaacgagaaagacattagcatatgattaattgagttttaattattacaaactaaaaaatagatttatttgatattatatatatataaacaccgtttattagttttaaaatcatgctaacaacaaccgagaataaatctatttctgagcggttacgtgtttgtaacttgaaagactaagctcggaatatgaatcgttatcattgttaacaatgatagagaaagactacacaacggtataccgttgaacagtataccacttatccctcatgccgcggccccgcgtgccggcttctcccgagtatgtcgtgtgctgctagaattatcatcacgcaggtttgttgtgtgtatcagtgtatagtcttgttcctgacagctagctagtacccagcatgcctaagtcatgcctttgatactagcctagctagtaaataaaactggaggtactactagcttgttgtgcatgccaaatccctgtaatagctacctacgttacctagatacggggatacggatatggatacacgatacgtcgatacgggatacggcattttccaaaaaaacaaggatacggggatacgcttttatatatatatatatatatatatatatatatatatatatatatatatatatatatatatatagtaaatttgtttggtgctccatggtgcccgggcaccattgttgaaattgagtatatacccaattcaaatgagtatgaaacttttttaattatttaggtattaacattaactacttttactaactagttcaaagcaagtttgaactgaatttgaacttatttttgttagattttgattctaggtatatagcatccatacatataattagttaggtatgtaatcatggattgtgaaataaagttaaatttgagttgttttgttgataggtataggtacgaatcaaattcttataactaggtatatactcacaattagaaaattttgaaaaatgtgagtgattgtgtgcatttgaaaccatggtgcccgggcaccatggtgccccatatgagtgtcctatatatatatatatatatatatatatatatatatatatatatatatatatatatatatatatatatatatatatatatatatatatacacaaaaaaaattaaggaaattgcatttatatataaaaaaaatacaaaaaatcaaggaacttttataaagaaatagcgatataatactagtatcagtgtagcagattccatatcaatattctgcaattttctcttctataagcaattcaaattaacaagcgattaagatcccaaaaaccacatattaatagttcaatcatatatttcttgatgactttgcatcaacattagaagccgcactaagcagtaacctctaggattgctagatgcactagcacttgtatctaataaaaacgatagtactttgtcctaaggaaaacaagaaaggcacagcagattcaagcatgaaacttttgaagataatggattacccggccaggcagtcaagcgaagaaagaaaaagttgctccgtgcttcgatgctactagcctgccactggccaccgctatgcccggcggccggcgtcggaggaagtgcctcacgcagtcacgcggcaagccggcaacagttctggcctcgaggttggcggcaaaagaggtgcgccaccaccaggctggcggcggcggctctgccgtctcgcgtaggggacgttgtggccccgcgcacggcagcgacgcgcgcggctgcagccggcgtccggcggcaacgccgggcacgcacgagaggcatcagccatcaggttggaagctcgtgaggtggcgcatccctgatgcgagcgaagacggaggaaggtcgtggcgtatcgctggcgtatcgtgatttatttatttttttggaaatcgcaaatatgtgggatacgtacgggatacgtatcggagcgtatccgatacgtatccgtatccgttgccgtatccgatacggatacgtgactatgcagccgtatcagggtaacccagatagctactagtagacctgtaccctagctatgtagggtacttattatggcggagcctagtagcctagctacgtgtctaagatgagttgcatctatttgttgtgtcctataccatgcacggattagaccagacaaataattacctagattatacatggatacaatggattattctaattagatatgtcatgttgggctcttagttataccacatcttagaaactctagtatgtgatacatagatgctagattatcatatctgatatctaggtattgggtcgaatacctaggtaccaggtatgaaacctataaatacaagatctgatgctgagttatccggcctgatacctataagtaccggatccgataactaggtatcgcgtctgatacctgagtactagattggatacccgggtatcgggtatctgatctcatacctatgagtatttgttccaatatctatgtgtaacgggtcggatacccaggtaccgagtatgatacttatgaataccaagtctgatacctaagtatcgggtctgatacctatgagtaccggattcgatacctaggtcaggtttgatacttatgagtatcggatccggtatcgcgcatgatacctatgagtatcggatcggatacccgggtatcgggcatctgatcttatacctatgagtatcagttccgatacctgtacgtactgggtcggatacccaggtaccgagtataatacttatgaataccaagtctgatacctaagtatcgggtctgatacctatgagtaccggattcgatacctaggtcaggtttgatacttatgagtatcggatccggtatcgcgcatgatacctatgagtatcagatcggatacccgggtatcgggtatatgatcttatacctatgagtatcagttccgatacctgtacgtactgggtcggatacccaggtaccgagtatgatacctatgaataccaagtctaatacctaggtattgggtctgatacctataagtaccggattcgatacctaggtcgggtttgatacctatgagtaacggatctaatacctagataccgggttgatacatattagtagaggatctgatactaaatatagggtgtgatggtacgagacttcagatgtgataccactaattctaatatttatgggttatatacttctattcaacaatcaaataaaaagatggaccatgcatagctaggccagaaagtacaaccaaacttgctcacatgccgctgacatgctttgtttaggctcatgctactagctctagtgcttaattctaactttactagttgaaccaggtgtcagacccatatggacctaaagaggtgtagaagtagtgctgtattagagtatttcatagctattttgtactgtaggagaaaagagacctctcgtcagtcatcactagtcggcagcctccatgtgaaaggacagcacacgacacgcttttagagagaaaaagaatcggtgagtgattggtaagtataaattataaactataccgttgagacagtacaccgtcccatagtttaatttggaatcaaaccggcccactaacatacgagaaagactggtacattggcccgcaaatatatgggccttttatctgttcatctaggcctacccaatctcggagtttttcacaaaaacccctgatattaactctagcaacatataggtcctgatcttttctaagaagccccccttttcagtccagatatttgcataaatatcccttattttaaccgttaacatcctcagcggtcaggattatagcataaaagcccttgatactgctctagagtcccccccccccccccacgacgccttcagcgacggcgtgcccatccgactccgacgacgttcttccgcctcgccgccgatgatccccgccggccagccatgtgtcctaccctacccacccaccagcagccgattgcacctgccactgccgtttcttccctcaactgtagagtggtcagcggagatggccggcagacggcaggggggcaaccttgcctggggaccgcgcctcgcgccgtgcttggagacgacggtcacgtggttggtcgccgtgatgaagcggcttctcgacttcaacccctgcgccccactggagtcccagcagtacacggggcaaggccccggtacattgttcacccctcgcacatgacttgtttgttgaattgcctgagtggaaatcttacgcttacctgacctgcgctatgtgtttctttgatgattgagttggtacatgtgttctcctatttcatcatactttgtttcaaacttatactccatcccattttgcaaatgagatatgatgatgacatgatgtacagatgaaagaacgagctataagctggactgctagagagctggatggagaaggtcaaagcgcacaacaaggaggagctcttgcgcaagcagagctctttgctgggcactgatggtaaaccggaacaaagtattctcgaggcaactatttgaactcattggaaaatttgtcaaccgtttttctcttgacaaacttcggccaacgaacgcatcgccagcccagcaaaaagaatgaactgtcaagcattctaaaatctaaagccaacactacctattgctttatatcttagggctggtttagttcccaactttttcttcaaactttcaacttttccatcacatcaaaacttttctacacacacaaacttccaactttttcgtcacatcattccaatttcaatcaaacctccaattttgacgtaaactaaacacatccttaatatggtggtagagatgctacagtcagtagggtatgaaagatttgattggaatgaaaggtttcttgaaaggttaaatgttagtcttctgtttttgcgtgcaaggtatacttaggatttcagcttattgaagaaccaaaacttcatcatgaaagcaatatttttttagctttgtaaatcctaattgtagcaacagaaaaatgcactctatacgagagtatagaagatatttgcttcaaaacaatcttgatcacatatgaattcattttatcttttaaagtcactgattccttagcttagtagcccgttcatacccaggctaagatttaaagtggattttagtgcagaacatactaacataagacagccccactgactatttgcatagatacacattgttgatgtgttcctgcgtatttctgcctactgcaatcctttgtttttctcaccgggccggcctacttccatctccacttgggcatgttcttttacattgctgatttatcactttatttttgtactttgattatagtgaacttcatgattgctggcgtacttttaccatcatgttctcccatacaacttagactgcgcagggtgcaatgctacgattgattttcttttttaccttttgaatttaattgtacaatgaattggatgaatgcccaaaaagcaattggaagttttctgcagccagtcttagttttagcacgattagatgtgagctcatgaaaatttcgtcttttgtgatctcaactgctcaaggttcttttgctgccttttctttggactcaactttgactaagttctttgagctactgatgggcattgatgtttttcttggtgcaggatacttgataatgtaacctaaaaaagcaggatggacaatgaaactgaaagaagcaaagttgtgatgatgagatgagttaaactactggctgataacaaagttgcagtaatttctatgatccccctcatgctcctactctgtctttatatctctttatttgttttttttttcctttgcaactgtgcccttgctttggaacaaaactttgataaccatttaacacaatcgtcaaagcagaaggaaagcttatttgcaattcccttttggaactaatgacatctgtttaagtaacaacgaccaacctcaaaacttctgctgcaacattgtgtactttgttgctagactggatgaacatctagctgatgttctgttttagcattgctttacttgagacttgagagagcctgctaccagtttcacttaaccattcgtgtttatcttcccaggatttaatatgctggaattaggaagtctgaacaacattttgtggaggctactttattaaactgcggtgctgctctgtccaaacttgcgctaactgcgggagagaaggggggctagcgtgaaaagaagaggtaaagaaagagaaaggcaaaggcgcgacatgatgcctcgtccaagctttttgttgtcacgctgccaaagaggacaaggatttggccctgcttctcttcttcttcctcctcttcttgcggtaagatcactactactattaccatcaccatcaccgcatcatttgccaaaccatggaccagcttgcctttttccaggttgcagctgcctgacgcagtttagccagccactgtaaagtgcaggtccatttatctgacaaatagagtatgtgagcttaataattgtacagttttttcaaggtcaattttaggggagtaaaacacaattagttttggaggggaaatagcttttgacattgctgtgagatgaggggttggtttggtctgtggcctaaataggtattaccaaattttgtcaatgccaaattttggcaagttttggcatgactaattttggtaagtcaaaattgtgtttggattgaagccaaaatagcctaagttcactattgaaatggcatattttcttaagcatgccaaaatttggattcaaaccaaatagacactaaacactgttgaaattgacaaatattggtaagtctaatttattcctcaaaccaaaccagcccgagatggtttgtgtaggtgaactggtgaacagtttggcctgcatctgcattggtaggggcctaggagcagacaagaacagagcaaaagtgaaaagtggaagcatccagtactgtcaatctgacactggcgccacagctctcgcgaccactcctcatctcacacttaccgaagcaacaataaaaccgttctatcctcgcttcaaaaatcgatcaaaaaattcaaaaatcaaaagtgaaagaaaggaaagcacacgatgcttctcttcacccaatgcagatcgatgggggtcgtaccagtagcagagatcatggctgtgagcctgtgattgagtgatccctttcctccatgccaatcttgaatctttctagctaaaagaatcatctgtgctcttgtgctcgcagctagctgcacagtggtgacaatggcgatgctgctgttgttgcgttctttggagttcttggcgatcatggcggttgcatcgagcttggcaatgccggtggcggcggcggcggcggtgccacagccggagccggaggtgaagccgagcgacaccgacgcgctcaccatcttccggaacggcgccgacgcgcacggcatcctggcggcgaactggagcacctcgaacgcctgcgccggcgggtggatcggcgtcggctgctccggcgacggccgccgcgtgacgtcgctgtcgctgccgtcgctcgacctgcgtgggccgctcgacccgctctcccacctcggcgagctccgggcgctcgacctccgcgggaaccgcctcaacggcacgctcgacacgctcctcctcggcgtccccaacctcaagctgctctacctctcccacaacgacatctccggcgccatcccggacgccatcgcgcggctcctccgcctcctccgcctcgacctcgccgacaacagcctgcgcggggccatcccggtggccgcgctcgccaacctcaccggcctcctcacgctcaagctccaggacaacctcctcaccggcttgctcccggacgtcaccgccgccctcccgcgcctcgccgagtcaacgcctccaacaaccagctctccggcagggtgcccgacgccatgcgcgccaagttcggcctcgcctcgttcgccggcaatgccggcctctgcgggctggcgccgccgctgccggcgtgctctttcatgccgcgcgagccagccccgacgtcaccctccgtcccgtcgtcgccgcagtcggtggtgccatcgaacccggcggcgtcgtcgtcgtcggttgcttcgtcctcgccggcgttggccacaccggagtcgcgcgacggacccggcaagggggggttgagcaccggcgccattgccggcatcgtcgtcggcaatgctctcttcctgttcgccatgctgtcgctgctcgtggcgtcctgctgctgcagcaccggcggcgagagcggcggcgagccacccaagaagaggaaacgaggcggccgcgtcggcctggaggatgacgacgacggcgggatgttcggccaggcaagggcgtgcagccaggccggccaggcagcgccggcatgcgcagcgacgaggcggagacagcgacggcgcgcgcagcaagctggtgttcttcggggtggacggcggcgaggacgacgacgacgacgacggaggcggcagcgacagcagcgccggcaggagggcaaccggcggcggctggacggcggcgccgcccagcctcacgggaggaggagcaggttcgcgctggaggagcttctccgcgcgtcggcggagatggtcggccgcggcagcctgggcaccgtgtaccgcgccgtcctcagcgacggccgcatggtcgccgtcaagcggctgcgcgacgccaacccatgcgcccgcgacgagttccaccgctacatggacctcatcggccgcctccgccacccaaacctcgtccccctccgagccttctactacgccaagcaggagaagctcctcatctacgactacctccccaatggcaacctccatgaccgcctccacggtacacatccatgtctgatgtctcctcctcctagctgtgaatcgccatgagagtggcacgatgagctcgatctcgccattgattgtgtttgtcagggcaccggatgtcgggggagtcgccgttggactggacgacgagggtgaggcttctcctcggcgcggcgcgcgggctggcatgcgtccaccgggagtaccgcacgtcggcgatcccccacggcaacgtcaagtccaccaacgtcctgctcgacaagaacggcgtcgcctgcgtcgccgacttcggcctggcgctcctcctcagcccggcgcacgccattgcccgcctcggaggctacatcgcgccggagcaggaggacaacaagcggctgtcgcaggaggccgacgtgtacagcttcggcgtgctcgtcctcgaggcgctcaccgggaaggtgccggcgcagtacccgcagccgtcgccggtcgtcgccgccgacgccgccgcagacgcgcagaggaaagacaagaggtgctcgacggcggtgagcctgccggagtgggtgcgatcggtggtgcgggaggagtggacggcggaggtgttcgacgtggagctgctccggtacaaggacatcgaggaggagatggtggcgatgctgcacgtcgcgctggcgtgcgtcacgccgcagccggagcagaggccatccatggccgacgtggtgcggatgatcgagagcatcccggtggatcagtcgccgttcccggaggaggacagggacatctccaccatgtcgccgtcgatcggcattaccactgacgacggagatggtcgtctcagctgctagctcatcatcatcctcctcctcattgatcttcttttctgaattctgaacaactctgcctgctgcattttttctgatttctgaaatgatgctctgctcgatcttggcattctgaagtctgaaattgctactgcagctggtattatcttgagctgcttttcacttctgctgaaatgtcgaattgtcgatgtgcctgtgcttggaagatggtgcttgtgttcttgtaagataattttggattatgatgtcgaatgcatgctcctggagaacgctggcagttgctgctatactctgtttgcgtttgtcatactcctctatttttaactttgacacagtcttcgagatactagtttgatcaataatatctatataaaagtaaaatattttaaataaaaagtaaaatgttttaaataaaaagagttgtatattgttatagtttatttaatgataaattaccatcaattacattattgatttttttattttttttgctattaatagtcacaattataaatatttgacttgatatatgctaaaaatacttacttatttttggatgaaggaagtagtcggtatggttgtttctttgtttctattagcgaatgtcgttttgtgacatactaaaatgctataaaaatgagaatatgggcaatcttctactactatcacatcatcattttgttctttttttttctttgaagcggattgcgtatgttgtacaacattttggggtgtgaagttcatggcatgctcacgccagacgatgactgtagactatagtactatttcggttgaaaattagcatttgcattattattctattagttagcctgtgttcttcttgaggaggttgggaaccatccctctacacgcaaagtggtgtgatagagtaacgcatgattaaaaagaattaatatgatttttaaagcaattttgttataattgtttttacaaaacatactattaacacgaaacggaaggggtgagttgagaacataagacagatgctttccgaaagaacgattgagctaccctgattaatcaataccagtagcaaaaatgaccagcaatcctgcctcataaaacaatgacatataggtttgctaatgccaactgctaagccaaatacaaattcgtatctgttctagaagactaaaagtagtctattggaaacagaacaatccggtcaaacagaagcatcttgtatgaaaatggtagtccaggacgaaaaagaaaaaaaatgagccgacaactacgttgacatcgttaggtaaacgtaaacaaaattccttacgaaaaaaaaaaaacaaaaacacatgtagacactgtagagaccgatcagtggtccccacgagaccacgaagaccatgtccattggaagcgtagaagaaaagcggaaagagtttgaccgatgcatcggaacacggcccgccacgctggcaccagacggttttgatgggccggaccagtctcggcggctcggcccaccaccacccatccatccatccatccatcgcggcgcatcgtacggtccagagctaacccagcggcgggtccaaacccgcgtgcggcgcggcgcgtcaccatccaccgtttattcgcagctcgttttatcactacttaaccctttcttcgagatttcccttttcttggaggcgccacgtttaaagggcggagtcgctgtaattagagaagaggatttaaagagagagaaggccattctctcttgattgcttggagaggaagaagaacaagagccgccaccgccgccgttaggtttttatttattttttttctcgatctgatccgaggaggagcgaagcgaagaagggcaagatgcattcgacgaatctgctgctggaggagcccatcaggatggcatccatcctggagccatccaagcccgtaagttgctcgaatgctttgatttcgcttcagatttgtttggtttttttttgttgatgaaccctaaattcgattgatctgcggggaaaaaaatgcacagagcttcttcccggcgatgaccaagatcgtggggacgctggggccaaagtcgcgctccgtcgacaccatctcctcctgcctcaaggccggcatgtcgggtaaccaatctgcttgcttcgccatctcctgctcgatcgagctgttcttaaccttcttgtgttggtgttggtgttgtgtggtgcgaattgcagtggcccgatttgatttctcgtggggagacgccgagtaccaccaggaaacccttgagaacctcaaggtcgccatcaagtccaccaagaagctctgcgcggtgagcccccctcctcaccgccttcagatttactgcaattcgattcgatttgattcattcacggtcatggtctcttagtgtttgcttttgctgtttttgcatactgacattttgggtactctactccattggcattggcaggtcatgcttgacacggtcggcccagagttgcaggtggtgaacaagagcgaagcctccatctccctcgaggagaacggcactgttattctcacccctgaccaggggcaggaggcctcctcacaagtgctgccaattaacttcgctgggcttgctaaggtaatactccctttcagttcttttttttttccgaaatcttattacgctgtgcatgaatggttgcaagcgcataggtaggagtacctttcagtgctatttatgcaaaatcttattatgctgtgtatgaatggttgcaaatagataggtccttcttttatggaacttgctattttgtcactgcgatttccagcatatgctctgtttgatatataaaaaatgacttattgttttgtttgcaggctgtgaagccaggtgacacaatatttgttgggcaatacttgttcacaggcagtgagactacttcagtttggttagaggtaaaaatattcggcatactgcgcttagcgttctgcatttttttttcttatgtcattgtcagtaggatttgctttgtgcccacattttccgataccaaaactctaatttgtctggtttaggtttctcaaattaaaggagatgatgtggtctgtgtgataaaaaacacagcaactctggctgggtcgctcttcacattgcattgctcgcagattcacatcgacttacctaccctatctgatgaggacaaggaggtaaggaactcatttcagaatagtgatatgtatctccttatgtatttgtatttgatgtcttcctttatggaattaagtaaaatgttgtatatttttccttttggagcaccttactcaaaatctgtcctttatggaattaagtaaaatgttatatatttttccttttggagcaccttactcaaaatctgtccgatgccttaaatgcttatgagcatgtactgctttcaggttatcagaaaatggggtgccccaaacaagattgacttcctctctctttcttatacaagacatgtagaagatgtgcgacaggtaatacatttttttctcaacgttcccggtgttttgtccttggaagtaaccattcattgaaaacatggcattgctatatccaaatatgtgatctcctgtatgttttcatttggtacttgaaaaggaagttctaaacagtgctgacatctttcgtttcaatacaggcacgtgaattcctctcaaagttaggtgaccttagccagacccagatttttgcaaaaatcgagaatgtggaggtatttacaacatgcacttttaacatctctgagccagcttctgtttgttgtacagcctatcaaccccctatctatttttgcaggggttgaataattttgatgaaatcctccaagaagctgatggtatcatcctgtcaagaggaaaccttggaattgatcttccacctgaaaaggttagtatttctagcttacgtcgagcacatcagaaggcactgcttaattgtacatccgctacacttagtaccttattaacaagaattgtagttttctcaaattatggtgcaatacttgtctttggtttagttatactttatttattttgctctttgacctttgctgctcatactgtaggtgtttttatttcaaaagtctgctctgcacaagtgcaacatggctggaaagcctgctgttgttactcgtgttgtagacagtatgactgacaacctcaggcctactcgtgcagaggctacggatgtggcaaatgcagtgcttgacggtgagttgtttgagctattggtaatgttaaattttcaattgccttctgatagtttaacatacttctattgtttagggagtgatgccattctccttggtgctgagactctgcgtggtttatacccagttgagactatttcaatagtgggtaaaatttgtgctgaggtgaattttcttcctaaatatgtttttatttacaatgtttaacatgtataaggcaaaatcatttctgcccaattttcgttctgtattagtttgttagcatcatcaagttaatggcatatgacatccattgttttgcaggctgagaaggtcttcaaccaagatttatacttcaagagaactgtgaaacatgtgggggagcccatgacccacttggagtctattgcttcctctgcggtgtgttctttggttcttttcatgtttcagacttcatttaatgctgttcacacggaacacattttctcatattccattgatttaagtctatgaggcaagcattttctttttagtctgaactggttccttcactattttctaggtgcgagctgctattaaagtgaaggcgtctgtcataatttgcttcacatcatctggacgtgctgcaaggtagaaagactgaatataagataagtttgtatcttaatggaaaactaatatcatctctaatctggcatctgtactatctgcaggctaattgccaagtataggccaaccatgcctgttctatctgttgtcattcctcgtctaaaaacaaatcaactgaggtggagtttcactggcgcatttgaagtacgtgatcagcctttctttttctactatgtccatgatctgtttctaactttctatacagatgtttagcttgtcttgtttggttaacgcttagctgttgtagctcatatttcttgtatccttgttctgcaggcaagacaatcgctcatagttagaggcctctttccgatgcttgctgatccgaggcatccagtaagtttggcttctttgttgactacagaaattgcaaaaatattcatgcaaaacatacttggtggatttattttcttgcaattgaaaggcttggccttgtcatgggggctttttcagatttctaatacattacaatataacaaagcttagtagatagaagcgtcaaattttaacatgatagctttcttgcttgcatcatgttccacaattattaacacttcatatatgataaacgtaaaaacaactggtatgcttcctgcattgttaactgaaatattcttgaacttgataagctgatttgtagagaccatttaggcgcaataagccagcttattaagtgctattattctcgggtgcaaattttgtaatcatctttcacttcgtctttcaggctgaatcaaccaacgctacaaatgaatccgttttgaaggttgctcttgaccacggtaaagtttctggtgtgataaagtcgcatgatcgcgttgttgtctgccagaaggtgggagattcctcggttgtgaagatcattgagctggacgattagacaagcagcttgtgctcgtcgtcgatgatactatggcatgttttgccagattttgactaggccaaaaacgttgcttcttggctatgtataatcctatagcttcaaatgagcagtttttcctatggtgtattcataggatttgccttacagcttgaaaccattatgatttagttaaggaaattaaatttgcgcagtatttctgtatcgtatcacttagatgggcaaagggaataatgaattttggtactgaaaccttttaaaggtcgatgcgacctatttttcatggatttttcgtaatgctacttgacgtccatcaaagtgttcatctgagtctgacaagggacaatcgatggttgatcccacggtcacccaccatgtacgaaactcgagcatttcaaggaatatgcagtagtattgtctcaaaagcacatgatcacttgcttgatcctttacacatttcataccaataaaaaaattgccttgtaatgccaactctcgagtacaatcctgccatggttccgcagatcaaattggaaagagcaggcagctagtcaatacaagtaaatttcatgctccacagccattacagaaaaaaatcacggaaaacagctgacatgattgtaattagctcctacaacttcatctctctcctataccaacttttgaagtttccaatctacaagtcgcgggttttacacttgaatgtgctgtcctgtactgcagtctaaacagtgatttacacggtgaaagttaaatgaaaattattttggctcactatactcgtgccgttgccgtttgccaaagcactacggaaaaaaaatggttaaaagtattacttgtacaaaagaatgatcatcgacaaatactactaattacaatggattgaccatccagaaacaattgtgcaggagaacctgatgatacccagtatcttctgaagcttctatcagaagaggtcacaactttcctctttaggacatccttagatattgacaggtaacttaaaaaggaagacaattgttgattgaatcacttatttaagtgacacgaatggctgaactggggagggtcagaagatatccggttagtccacagattagcaactttaacaaaatagtgatcaccatcccaaatgatcacttccattcctacatgaagcgaacagagtaaattaattggttgatagaaacatctgatagctaaaaagttcctatccttgaagacgtcactgtaggacaagtattacctggtaaaacactagtcggcaggagggtatgcctacatgtcatcttgctgttgggaagggaacattggagagtggccacttcaatttcgtcaattttaatgatagattcgagaagaactttagcaacaggtgcatctaagttattgctgtcaacaaccattctaagagccgttcctagaccattattagtccatgcattcaggcagccgtcccaacaaaccaacattttactcaccattccaggatcagcaagaacccagggcttgaaggactgcaaggataaatttagaatctgtgcaactctgtaaatctccccaagagcaataaagaattggccacctgtgaaaccagcagaaagcatgttatagtcaatcttcttttaaatgatcagtgagaaaggaaatgataagctctgctcattgttccaagtttttgcaccttgggaaattactacgctgcagacatttgattgacaggattcttgccaaagcaccacaccatgctgcaattcttgagcacagaacagaagcattctgtaccaggcacggacgtaatcacgttgctcctccttggatgcttgctccaaggtatgtaatgttgacacgctgtgcttgtagagttcaactgccaaactcatgtcttccagtgcttatatttgagtatcagataagaattataaaaatttaataacccaagaaagatcgcattatgacccacgaaaacaagaagcagaaggtagaatggtaaactgcaagattaactgcacatattgtatactgaaacaaagaaaaattagttgtgtgccatctacagattttcgttgttttgtataatctacagatcagttaggaggcaattctaatgcggaatatggaaaagcactaatccattcatttccacataattatgtttatcacttatagaaaattgtgcatgtgattattacatgctatccacctaacaaaacaagtgtattgatctcgagtaacttgagaataaattgcaagatttgaccatctaatgaaatagtttattttgggtctagctcaaggaggtaattcctaacaagtactagtaataagataggcagtgtgccgaaacattatattccccataggagaatgcataccatcggtatcttttctattaaatgatattcttcctcaaaatccttcaaatgaacctctctggcactgtcaagcagttcagaaatgaatacatcctttgcagtatgttcctctatacaaaaaccttcaggtagtttctcacagatttcctggagattatggaaaatgtttaaatgacggactatattaaattcatttttttttgtgccaaacaatagtttcaagtgcttgagtgcggagcacacctgaatctcccttgcaattgctgaacttccctgttttcattagaaagcatagaactcttctggactccatgttatcaaatgaaaaggcactatcttgtgttgttttccgttcaaaaaaaatgttatcaaatgaattgcaaaattacaaacagaaaaataccagtgatttatcaactgaatgtaatcagtggttactgaccttaaaatccttcccattccgaaatattactgtcagtgtttcttccctcagcttatggtagaaatcaatcaaagtcctatcgcttgaagatttaattgaatgattttcatctgtttcaaatgaagagttctgatcactgatcattagtgtacatcacatgaaattaaaaagaggggggtgatagcaaactcaaaatagcaaaaatactcaccatttcattatttgagaacatatcagaagggctctgcacactttctgaagaactttgtgtcatgtgtacagcatcaaccagctcagtttctttgtacaggtcaagtatggctgcatcattaggacctgtggacttacaagtttcaatgtggtttgtagttcgaacatggttcaaattttcatccacactagtaaatagtgaccagtcttctgtcaggaatgatggtgatgatgctctgccgcaagacaatggcgccaagactctgtttgatggtgatgagaacgaaggaggaaggaaggacttatcaccacagaggaagcgggccaggtttcctaacaaacttttgagtgggcctgaatgggctaagtagctggcaagagaggagaggtggcgtgagtgagtggtgctgtattaatactcgaactcttgtaacgaattacttgactaatagaatctggaggcaattggcggcggaggatgcaatccggttggattggcgtgagagaaatctcatctgtgaaaattgttcttgcttgcaagttaggtagctaacatcttcctggtcacttcccaatgattttggtacatcctgtaatgacgaaattattcagaccaatcaatggaggaagccatagccatatcaagacttaatacaaagagaaaaggtttagaaagaagtaatgataggatttgcaatgctagaatatactatcaaagaagtatattcacttgtttttttgcgggaactacaaaaaaagggttatttgtgaattaaaaaaatgaattcctgcctaattctacaacacctataacaatttccaagtagaattaataagttgctaaggcagagcttcacacttgatacagatacagaatgtaagaggaaaaaagttatcacatccctttaggaagcttgatcattcaatttgaacattataatcatgatttattgattcagttttgtgagactggtcgcgacgtccgtttcagcaaaggttatcttcatctctgcaattttctaagtgggctagactatctgagcctacctttcctttatcaccagtttgcctttggtaaaatgccttaagtaaacagtttccacataatactatctcacgcgggcggctcggggagcgaaaaaccctagccgcccgcgcctccatcccttccccccccccccccacctcgccgccgccggagcttgccggcggcaaagccggcagcgagcagggaaggcggcggcgaggccttctttgtggcgttctccctcctcggcgcgacgtggacgagatgatgacgaagctccccaccggcgtggtcaaaggcggcaacggcggggatgtgtggggaggcggcggatccggcgcccccaaggccggatccggccatcccccgcctggagctggcgcggcggcggcgcgaggcggctgggcggcatgcgaccgtggtggcggcgcgcggctgccgagcggcgtggtggcgtgcggccgtggtggtggggcgcggcggctggcgttctccctcctccgcgtcagaggcggcgacgacgggcgttctgctcctccacgtcagaagcggtgatggctggcgttctgccgagcagcgccgtcccaggcgtggaggctgctaggcgacgtgcggccgtcgtggcagcggtgcgcgtagccaagcggcacggcggcggtgttccgggcgcggcggccgtgcctcgccggtgtgagcgcgagcggccaggcctcggtggctgggcaaccgatgccgccgtggtggccaggtggggagcggcggccgggcaatgggagcgccggcgggtggcaccggagccaaagcggcaatgtttccggcgtcggcgcaggcccagatggttgtgctaagggagctggcggcgataggtcgtcttcctcgttgccggtcagcaccctcacccttcctagagctcctccccttctctgtggggagtttctaagctggattgaggcggcagcttgttagcgggagaagctcaggctgctgaagcaatgccatccaatcccgggttctccttcggccagatctggcgaggaggccggcgggtggtggaacggagaggtcctgggccagttctcagggatggtggttcgatgaagccggccgacagaggggcgtcggtcgggtatggcggaagccatgtgctgccgatgttcagatggtggattcggattgggtgacgtaccatggtggtagggggttccgagcgaaagcttagcccaattctttgggccaacagtgactttgccttcgggcatagtaaccctcttgagggcactgttgaggtatccctcctccctcggcaaggagctctgggtgaaaaccttgtccagtctttggatggatgacgtcggcgtcttttggcgtcgtgaccctcgtgagggcgttgttttggagtcttcgtgtcgtagtggtgtcgttagctcggtggcgatcggtctcgcatagtgatggccggttcggtgcttggctttcctctctgtagtgtgtgtttggacggttgacacatggtttggggcgtgtgctctggtgcacatcctttctcgacagccagctgtcgatgtaaaacgtacatcctttctgccagctgtcgatgtaaaacttttcttgtaactttttctttccatcttaattacattgaatgacctttgaatgacctcctttggtcattccggcaatataaataggcacagcattatgtttttttttcttgttaaattgaactgtttcgtatgattttacatttgagtattgatcatgtacgtttggtgggaatgaattttgcatactaccccgggtttaaatatacggcatccttaacttcttttaatttattttcgtttttttaaaaaatatttatataaattagacaaatataaaaaagcatgctaaaagtacttttgatgggtcatctattatcactcttttcatttttacttacctaagtaattaaataaacattgtcgatcaaagtttaagaaaaaaaataaatagtgctgcatttagaaagggagtgagtgtgctgttcctccgatgaaagcaaatggatccttgacgttgagtgaaggaatcccttgcattcataggcaaacaatgcttatttcaaacttcattcgaaggtaatttgcaaaagataaaaaccttcccttcaaggtattcctaatggactaaaagttctaaacatcaacgcaaataaataaatgaaatcaagggacgccttgtcgttgtcgcctactcgccttgagtagaaactatagcatcaagccacatattgttcaaaaaaagtgtacccacaagcaaaaggttaaaagctctatacgaaccatagctccaatgctcacgaagcacaaaaatgtcaggagtttctaacaacaatatttgacaccgattgcgtgctgcacaactcgaatttccaacctacagtacaagatggtcaatactgcataatttttccagtaaaacatgtcctatccctactcatccttgcgtttgaacagtttaacaagatagccaattaaggagaccagccatcgccagaagagaactaggaaatttgacgccttcggtttgggttcaggccttggcccgaacagacctttgtatagctccttttgtttctggtacagagctttatcctgctccgcgagcgaccgaagctcgcgctggatctccttgtcttctggagaatacttcttggccttcaggaagtcctcccttgctgattctgtttgaccaagttcagctctagcttttcctcgtctgaacaacgctttcacgttgttttcatcctctgacaacacctgaagaatgagattatgcagttgatcatgatcagcaattctttgattcttattcaaatggtcaatcaacaggtccgtgaatcaatacaaaaccaaaatcatggttgttttacacaaatgagttggaaaagattacacaagtacactaagatcagaagagtgtctttcatgaagaatcatggacaaatatttctccctgctttagccatatgcctgttttccatatttattttgcaaatttttagtgtctgaatgacaaatcaaattcagttttttcttgtgttatacatgtaatgttaaagcatgagtgtaagagtaaattttatgcaatgtagaagaataacatacaattgtacactgtgcgatagcttcatcaaatctcttcagtttgatcaggcatgcggccatgttgagatggcagggatttttcacagctaaggccatgtctctgtacttcccaaacaattgaaacatgaaatcatcccccatgtatgcaattgcctgtaaagaagaacagctagggggattatgattgagcatcttacaatagctgaagaatgacatcagtagacaactaaccatttcatattgctgcatagcctcctcgaacttcttttctttgaaatattcattgccttcaatcttcctcctgtctgctgcttcaatcctttcttccactgtcatatcacttcgggcttttccctgtagttttacattatctgtaagcttcctaggaacctttggttcacaaatatttttttaaaaaaaatcaaaatcaagggtgataagagggatatttatcctacctctttgacatcatcaaacccaataagttcaacttcatatacaaggtctgccattggagggacatttgggaatgaaaagcttccttctttcccatagccaagctcccagttaacatgtaacaatgcacgctccccacttctcatgttactgacaccaatgcctaaaccagtcatttcctttttctctgttgatgagaagaaaaaaaaaagcttcaaagatttatactaaaggcaagtgtaattgatgctcacgtctgttcgtacaatactactcggttagttatctagttaccctgtccagcagatttattgaggcatgaaaaagaggaggtaaaattactagcaatagaaatatcatacttcgtctttagcctttgcaaggtgaggcaagtgggaaagttactggtgggaaaagttttttccccctcaaaaacctcattttgattggcattatggaactatgtgatgcaaagtaagctgtttgagttcatggaatttacggatgatatgcatatgtgcacagaaaagctgaggataaaataaaggaattaactttagtgttaccttttccaagtactagttcaattgaatgctgttcttgccaagtatcctcgaatttgtgcgaagaaccttgaacccatgctctatagtgaactgcaagacaaagattgggaaaaaaataatttgcaaaatcaggtataatatattatcctcattctaatcacaatcctaagcaaatggaacaaactgactacttatggcatacttaccaaagcatgtggcaaaccttgagggtttcttgccatggccttccttgatgacttgctttttgactttatcattaaggacttccatatcagaggtaaccacaggtggagcagtgccatcttgaggaggctcagtatgcacaaaggaagtttcttccactgttatctcatcatcgctagcacctaaacaaccaaaacacatgttcagacatagtactgaatttcttgaataagacaattcactgttctgtagtgtggccattttataaaggagattcaaagtactgtgaactacatccaacatcaaacatttgatgcgccccagttttttggggaatacacaaaaggattgcgcatcattcgatgtgggactaacccaacacggaagatatacttacagttttctagatgtgcgcccatggatacaggagtatttacatctgttttgcttagaaacaccataggccaaaggtcccagtgctacaccatctatgcctatgtacttatatggtgtagtgtcaactactcaatcaagtagcataacctaaccctgtaaagcatgaatcatgtgccaagaacagctaggttactgtttagttggtacgttacataattgcattgcacttgtataaatcttagagacttttagcaactccagaaaattggacagatttatcagaactaattgtcggtactatcgtcaaaatcaacgggatatgacataatatgctgtcatgccataataatcccgcctaactgcttacaaactactccagtagtattgaagtgcacactcgatagcacttgattcgagcattcggggttcattcggcaaggtgcaaactgcaaaatgatttgaatttgagatgaatttggcgtcctcaagagactgaatctagtttaaacccaaaccggacattttacaaccaaaggcgcctaattttccgaatcccataaaaaagcacatatatgctacgattccgcacggggattcaaaacaacagcctgccgaaccaaccgatccaactcaccacaccaaacacaagacagacacgcccccagggtgtagggagtgcgagagaaagcgggagactcactcaccggaggtagaatcggcggcgggtaccggggccggatcttcttccagcacggccatcggtgcgggacggcgggcaggcggctggtccgcggatttggaggcggatggctcgaggagacgagagcttagctcggcacttcaccgggggatcgtgcagcgcgacgacgtggtgttccctcttcactttcacttgggtggtccatccagtccaaggacggcagcgaagacagagaggtggatgagagagatgacgagccgcattcgtaccttcgtgggcttcattcaacttctaactcgttgccaagcccaactactcagtatggtccatgtgctactatggatctgtttgttgaatttttgttatatttttttgaccttttttatttttaattttaaaaataaacccttccaaaaacttattttcaaaatctgaacatttaggccacgctctggagtggcaaaacaacactgacacaccacctgcagcgccgtgacaatcttgtaatatcatgacagcgagagcagtgtgatcagataacgttgttacgctagcaagaccggcatggccaaataacactgtcatgatagtgagaccggtgtggtagtattattttgccacgctagttcgactggcatggccaaaaagattatatcttgaaaataagtttggaagggtttatttttaaaattatagattaaaaatgtttcaaaaataaaaaaaattatttggaagcttaagatcatgagaaaatagctggtttatagggatctgtagaaactcccaaaacaatggtcacaagaaaattagaattgaaaaaaaatgatacaagaaaaatagaaaacagaactattcacgtgaaatttcgattggaaaccaataatatgaccacatgggttaatgcttacaactatgcaaattgtgaacgctatgggacaaacagaaacataaccaaatgaggtagttagtgttaagtatgcgatagtcaagaatatagggataagaaatactaggatacaaattaatccattccagtaagaaatatagtaactaccggattacggtttgagaagacagtaaaccaagaaaacggtcgataaaatagcaagactatatcttttttttccccatttctgcttctcatgatttctcatggttaccctgcaacacttttagtttttcacccctaattatcaccgtcaacgcccgctagacggggcagggacaaccggacaagacaaccaagcgtaataatactaccaaacaacgaacatgcagagataaaccaaaattaagcggagtctgctacatgtgcgctcacaaatgagaagtcagaaccatatgcgtcagcaaacaaattcttcaaattacatagtagtacacaactgaaacaagctgcccatttcgcagctgctatatatttacaccaatcattctgtatgaaacacacaaatcaccgtcataatacaggctaagctattgttaccatgaccggatatacacttggatgtagaggttgcaatgattttcactatcggaaaaaaaaaaagagctactgttacctttg

SEQ ID NO: 42298 - DNA, 19513 bp, Oryza sativa
  unsure (1)..(19513): unsure at all n locations
atgtactaccaaaaatgtgtcctccccagctcagctacctagcttatgagttatgaaagctttgcttcagtaagagaggacatggccatccagcagtactcctttggcttttatcacccagtgttgagtcttttagctcccacacttgaaacattgtggggcatcaccatctttcttctcaagaacaaggcatagaggagttcattccatgcatcagggacaccaggcaggcaccagtggctgcaatcctgcctgtgatgagatgcaggccctgaaggactcaggtacaccgagaggtgcccgtctttacgcagagctgtcatctgagtcacattcagtatatccagcccgacaagcttggtcgtgatgctgttccccagtacatgatttatgggttcaagcaggtcagcccacggttccagcgatttaattggagttacatctggtagagtttccaagtggcaggtccctccagtcttccagtcaccacctctgtaagaaatatctaatctagttaaagaaatagtttgactgaatatttgaaagatactatgatgtttgttcacaagtccaacaataaataccatcagcattgtttcatgatgctaacaatatattggcacaattcacataaaacaatgaaacaatgtatggtcaaaagcatctgatatcattcgatacaacatacacaatcaatcaagactgtcaaataatgtttgagcaaggaattaaaaccaagggaaacactcactatttgagtaattagagttggtgattcacagacctgaaatgcacaggagcatatgtacggaagatgatctgggtcttgtttgtgttaacttcattgcgaagccaatgaaacaatgtctgcatggatctttggtaagcatctctaacagtcatctccattttgacctcgttgccttcttggaaataggcgccactggtgcaagacataacagtaagaatagcatgatctctcagccataagacattaagtagagaatgctgttcagtcaatagaattcaaacatttatgcttaccctttgattgttttctcatggttccaccagtgccccgtgttaaagatcaaaagatcagcatccttccacttaccccggccagacatccaatccatggcatctactctaattgtatattttacgactgcaggggctccagctggtgcacgaccttgaaggactatgaaaggagacctgtaatactccacagtgcaattgtactctctaaacttgaaaattaagaaacccatgtgttttgtaataggattcccattaacttcaaagatggagctcttgtcaggaacagcagcagcgagcatacaaagcagagactcccattggtttcttgcaatcgaatccccaacaaatacaactcttctgtttctgagtttctctagcatatttctggcattaaatctaagaaacagaaaaggagacgaaattagagtgagacaccagcattgctaatatgggcatttgaatttattgataatggtacatctcagtccacaggtatcaagggagtaccatacaaggtcacaaaataatgaacttacaaggtcacaagcatgctctttccttataaaataattcactgagaaatcaaaaggcatgcaatacattaaaaaacataagtacaacgagattatgcttctaacaaaaaaatgcgagtccttttacatggtactatgtaacacatccctaatgttataatattccacctttgcaaaatttcatacaattagcacttatgaaggatgacaaacttaccctccaagtatagctactgacatttatggtgacaagaatcaagattaaatattcttttcaaaaggtagaaatctaatcttggaaccactttacttttccaaattgaatcaagcaaccacttaactgcaacaaaggcagttagaacacaacaaaacagagccctcaacaattaacaggacaagaccacctctccatcgaaggtaaagatgattgcaacagcatgacagtcgcagatcaagtaaacaatactgatttaataaaatatatcttctgcaggactaagcaataaccatacgggtaacattgtttcctacttttgtaatcatgtgggaagcaaaagggcatcgaatttccaatcgtggcgcacagttccaaagtggagttggtcgttgacagcatcatgatcatcccatgttccaataatctaattttaaccagggtgaagattgtaaaatgcacgcccactgatccaatctcagcaagaatatcccactggaagattgaagtcagaagcactaacccaaacttaatcctcatcatgccagcagagcagcatgtttgggttctagattcaacccaagtttatttaagtccgtcttaatttctttgcctttataagttaacactcaagttgtagaacattccagcagacaaaattaagtagcacggtctccaatccacatctccttaattaatttatactaatcaattaatcattcgccatctccgcaccgttctagatgcttggattgcagcaagagatctcattaaagatttcttcattgatcttcgtcaagctctcgaagtaaacatttactaaaatcgatttctatctaaacctccaaactcgccaccccaatccaacaatggaatcaatggaagcataatatgcaagagtaccaaagatgagaggaagaagtagaaatcgatggaagaggaggaagcaaacccaacctggggagatcgcagcgggaggggcgccatcgccacttggtgtaggagtcgtcggggcggccgttctcggagcagcggaagccgacgtcgaggaaggggcaatccctggaggcgtagagcgggtagccgtcgtcccacacccactccccgtcgaacaggtcgcactcctcgcctccgccgcctccgccggcgccgccgccgcggggctcctcgatggagaccccgccgctgaggagcttcttgggcgccgccagcgccgagccgacggcggccgagcagcggagcgaggcggcgcacacgagcaggagcagcgcggcggcggcggccagcatcgcgaccagccccgccgccccggccttctccagcggcctcctcatcaccccccgcgccagccgcttcgccgccgacgtcgaccccaccatcatcgcatcgatcgatccccccaccgacgaagcagtagcaccggcactagtagtaccactactactacctgtatactacctcgccatggccatggagcttacgcgcgcgggaggaggggagacgagacgaggtggcggagaggaggaggagacggagacacctcgagggagaagacgaggaggtatttatgaggaggtcatttgaaagggaaatgcacggagtttggctgcttccaattggacggaaagcaatgtgattactatttccctatttcataatatataagttattatagcatttcttacatttatattaatattaatgacttacattgtaaaatggagggagtagtactcctctccatcctataaaaaaaactacttaacctaatattgaaagaaaaattttctaatacaacaaatcagaacagatagaaactcatccaatactaaattatttttccaatacaacaaatcagaacggatagaaactcatccaatactaaattattttttttaaagtagaacttaacctattactaatataatatcgtttcgattcaggaaatattatattttatagtagattaatatatttttgagacgaagtaagtacaaattagtagtgtggtttgtggcaattgtgttgtgcgtgtggagaggggaaggaagaagtggatgggagggggagggttgaagttgaggtgtggggcctataaattcggctgtgtttggaggggttaagtatgagtcaagtcaagcacgatctatccctcggtcatcaaaaaatacttgctttaggtcgagcgcaagttaaatttgattaccatctgtctaatataatgtcaaaagatgtactggtattttattttaaaaaaactttgtttaattttaggccgctaccttttaaccacatcgatcattttcgatcggggcagttgctaaaccattttcacacaagcttcattgtccttgttggcttgtgaaaaatctagaactctattttttgactacagagagtacgtctacttgtgtgatggtaacgattccttttggtccttcccacgttttgtttttaactgcgttgttagactgtattgcgtatagattgtgacaaccatcgagtttgtaatcaaagataattgattttggtggggattagtagtagtagtgtgggttggggcaaagaatgatgcatcgaaagatgatgagggtgttacgaaagcaaggttgttggcttgtccttgtacgcaacgcaaacgcaatcaagtttaatccacctggtcatctcgataacagcaaatacactactaaacgagccatgatccaaaaccaatctttttttttttttggaataagttcaccagaggttcctcaacttaacaacgagattttttaaaatccctcaattacaaaactagaaatattcattcctaaactcactcaaaccgttcaccggaggtcccatgacagtatttgcacctggttttattgacgtggcatcctagtcagaaaaaaaataataataatatgtggggcccacatgtaagtgagagaaaaatgtggggtcaataatccagtcagcaatcttcttctcagtcgccgttttctttgccacggatggggagcggtagtggctcgcggccggaggcaggcggagcggcgggcaaccgcggcggtggcgggcgagcgacggctctgggcacgggaggagcaaaggggcgggtgagcggcgaccgcggagcatcggcggtggtaggcgagcgcggctgcggagcatcggcgttggcggcggcaagcggtgggcaagtgtggcagcgggcgagcggcggctccgggtcgccgccatcagagttaataccgagggagaaggagggtacgttgggagcctcataacttcgccgttgctcctcccggcggcgctccttatcgccgtcgctgtcggagtcgatgccgagaaagaaggatggcgcatcgggagcctcataacgcttttgttcctcccctccattgccgccgtcggtgaggtgggactcgtcgccgtcgccctcgaaatcgatttcggcagaggggggaccggcggcggacgagcgcgatagaggggagagcggcggcgagcaagcgcggaagaggggggaccggcggcggggcggagcggccggaataggccggcagaggggggacggcggcggcgcctgcaatgcctccgccgactccgcaccgagtcgagcgtgcaccgtctctctcccctctcccaccatcgccgcccctactcatcgccgtcgccggcgtctgcatcggcctcttatccgccgccgagctcgccatcgcgccagccgtctctttccccctctcccgccgcaggagcccctgctccgccgccggccgcctcacatcgagtctaccaccgcgcctactcaagagaaggagagaagagaagagaaaaagaaaagaaagagagatgtggggctacatcattttctctcacttacatgtgggcccccacatatttatttttttattttttgctgactaggatgccacgtcagcaaaaccgggagcaaatactaccatgggacctccagtgaacggtttgagtgagtttaggggtgaacatttctagttttatagttgagggatctcaaaataatctcgctgttaagttgagggacctccggtgaacttattcctttttttttgggccaaagccttgtccctacacaagcctagttagttagcctaggaaaagtacaccgaaggtccatcaacttgtaatcgggttacaaaatcacccccaaccacaaaaccgttcattttaggtaccgttcattttaggttcctcggtggttttgacccggttttatccaacgtggcggctgagtcagcgtggggaggaggcctgcatgtcagacagtccacgtcagccacttcttaccctccctttcaactcacttcctctctcctctcctctccacgtcgatggccggcggagagcagccagggcgcgacaggacagtgtgacgagcgcggtcgtcggtgcaacagaggagcacgtcgcggtcgagcgccgccatggcctcccttgtctctgacgcgccttcatcaccgctatggcctcccttgtcttcaccgcgtagagcgaggagcgtgcgggcgaagtgatgcacgaggcggtcactaacctcgccccgagggccggcggcggcaagcacggcatccgcgacacggcgtgccccatcgaagtccccccggtcgacgaggtcagagcacgcgagctctgcagaggttggtcggctggtggggaggaggcctgcgaggtgaggcggaaccgtcggcgaagtcctgtaagccatcgcagcccaccaccgccacaccctcgctcctgcacgcggcaggacgctcgtccgcacggcctgccaggacccgaccagcgcgaggatgccgtgcagttgctcccctgctggacgccgcccgctgcagatctggcgcccgcgcctcaacggcggcggtgttggggaggccctcctgctccggcggcgtgggaggacgaggcggaggcggatggcgccgacggggagaggaaggatgccgccgtcgtcatccatggccgcacgtggagagacgatggaggctggcggtgtgggagggcaagcacgggttgacgaggcggaggcagatggcgccaacagggagagggaggtcgccgccgtcgtcatccatgtccgcacttggagagacgatggaggctggcggcatgggtggacgaggcggaggcggatggctccgacggggagagggaagtcgccgccgtcgtcatccatggcgacacgtggaaaggcgacggaggccggcggcgtgggagggcgggcgcgggagaacgaggcggatgcggatggtgccgacggggagcgcgaggacgtcctgctcccacatcgtcgcggctgccgccggtcgccggcctcccgacatcctcctctcctgcctggcgccctcgccccgccggccgtcttgctcggattgagaagaaaaggtgagagaggaggaagggggagaagaggtgaaagagagtgatgacgtgaacaacctgacatgtggggcccacgtgggtcccacgctgactcagccatcacgtcggacaaaactggggtcaaaaccaccgagggacctaaaatgaacgattttgtaagatgagggatgtcatatatctgattttgtggttggggacgattttgtaactcgattgcaagttgaggggccttcggtgtactttttccgttagcctactcagacccagtcacttctgggccaggccgtgataccatagccttcttatgggccgtataagcccaaacactgcctcctcgtgggcctattgggctaatactccaaggcccaactagctcccactccatcagtccacaagtcaccatttcaccaaccacctcgagtaggtaaccggcggcggcagtttgacggcgggcgccgtgccaactccggcgtcctcctgccgccaccgcagttcgacacctccgcccatccacgacgagacacaggtatacggcgctattcctctccaccccagtaaccacagattgggagcagatcacacgaaggaattgtgtgaaaggactggacaaatttgtttcttcgtcaggcttgagagttcagaagcaggtgagaacacttgtatagtttctacgacctcttcttcttctttaccggaatcatcagggatcaaggattttgtctgcatcacggctgtacattgatgaatccaattgcactagtccatgtctctctaaagtcaggccatgaaatgccatcacgcttgagaatctagcaacttttgctttgctagctatctatccagtccagggtacgtggagtagttggttggcctttctatcatcttttaattcgctgccatgacggttgaggtagacagcattctatctgcacctgcattattgttgatccctttctcgtcgtttttttggttttgttttgttagagcaggtaaaacagcaaactataaatcagatataaccacatatcaaaaagaaaaaagaagagagagaagaaagcaggctacagatttgtagccggctgcaacacagacttcaaaacgttatgtgtgtatgagaggtaggaccgggcattaatggtgtagtatatttttataattaactattataagaatagactattagattagctatagatgatttggagtcagtagctggctatactattaaacttgctcttatctttctatctttttgaccttttagcagccagttgaagctagacatgttcacccataagcatgtgaaaatggaaataataaattaaacaataggactaatgtaaaggtgtccaattataaaatgatatgcaaaatcatctaagtttccgtaaccgcagccaccttggaagaatcgtggactaggaatagagtatttgtctgatttggactttggaaactatgggcacatataccgttccacgcatagttcccccgagatgatcgcataagatgcatcgtccaagtatgaatcaagaacaaactaattagagccattttggtttgaagttaaaatacacccctaccaaattattggcactttaaatagtattttggttagtgtttggttttgctactaaaatgtgacaataacatatataacttgccaaaacttgggccataacaaaagtttgcttaggttttggcatggtggcaaaccatgcaaattctaaggaatcacattaaagaggcttagtgctccctgaaaaggtgctcacttcattctattttacctgttgttttaggacatgttatatacgttaatttgatcattgtctttttgactatatattcaataaatattatataactgcatgaaaatatctttattgataaatctttttttaatgaacgcaaaagatttgcttccattaagcaaagacaaaaaaaacagtcttctgataaattatgtcatgtctttttcacatattaatttttaaagtaaatttcacaaaactacagatatttgactaaattatcacaaaactatagatttaaggtgatttatcacaaaactacagatttaacaataaatttatcagaaaactatagattttaggctaagtatcgctaaactatggatttactaatgaaattatcacaaaactatatattttgggttcaaatccttagcactaatgctatgtttgagttatatatatctaagttttgtgattaaattgatattaaatatgtaattctgtgataactttgttactaaatatgtagttttacgattttccacttaaactgtagttatgtggtaaatttagtgttaaatctatagttttgtgatacatcatgttaaatttgtagttttatgaaatttactctaatttgtaatattgaaaatatcaagagtttactccttgcgttttatgttataagtcgctttgacttttttaaagtcaaacatttttaatgttctatcaagtttaaaaaaaatatagcaactttcatatcactaaattagttttagtaaatctagcattgaatatattttgatagtttctttgttttatgttaaaaatattactatatttttaatataaatttggtcaaagctaaaaaaagtttaacttagaaaaaaaattacaatgacttataatagaaacagaggtagtagaaaatatgcgacgttaaataatttgataaataaatagagaaattttatggttctggagaggtaccaaagtaccaaaaattttattgtaaaattcagtaccttcttatacctagttagtaagagataccaaaatttacatgagaaattttatgagaaaaaaatacattacaaatgtggtaacttcttaagggcagtaaaatcacttgaataaataggagtaacatgttgacaagtgcatgacactcattgggtacgtgtgagttggcaattacagcgacaagattctttttgttttcttgtagactgttttctaattagttgtgcttcacttgattctagcaatcgccttctaggcgatagcaactgaaatgaatggagtaatatataactctaggtgtgcttcttgccaactttgcttgcatgatttcaactcagataaacagataaagtattgtaagataattacagtgcatgtctttctcatgataaggaaagggtgaaaacaatagtgctgtgtccaattcacaagttactagtactggcataagatattttgctgaaaatttcattctgaaaaggatgtgataaacccatggtctgatcaaaatacgctacttaatcgaatagaagaatagatatgcaaactattgctgacagcgttagagatgcaaagtccagcccacttaatcgaattttaactaaaggtgacaagtccccatgcatttgagcaatttgcagaacatttcaatgcatttggatcagctaaagaaaaatccccttcgcactgaatcacatggttagattctctctgcagtccacgagtactgcaaaataaaaatcagcaaatctgtgggtctttaccagtcttatctaatcctgtgtgcgcccattggtttccatttattaatgaaaaataattctttgatcagtattcagtataatgtatagaccttatgttagagagagatttaaacacagatacattgaaaaattggacatgtttcttgaattgtagtcaccttgctacctactgcaggtgctgaattctgaattgctgactaggtaactattgtccatttagattagtcatgatgatatttttttagagtaaattgcactttggtccaccttttattatccacgtttcaatttgaaccacccttaaacctatctttttaatttggaccgggtaaatttatcattgttgcgatttggactaccatgaacaactttttctcgttatgtctaaattccctttcggtaaacatatgagccatacatagaggagttcggccgtatatcagagctgatgtgtttaaggtcgtgctgaaaaagatcattcgtggtggtccaaatcgcaacaatgataaatttatttggtccaaagtgaaaagatgtgtttaaaggtggtccaaagtgtaattcgctctttttatatttgaaccttgttctgagccaaattaatacagttgttaacgaaaatttgtcattgccaaatgcttgaccgttcatttacctgtcatgtcaccttgtcaaatccttgccagttgtcaatgattatgtactcgttggtgacccaagaatattcttcagaatttctttttgttttgagcaatgaacatggcgtctgatgttggatgccactcgatctagcaagctgggtttgtttgttactcctttttcttaaacataaatgtgactatcagcatatatcatggcatacgtaagcttgctcttacctagtactcccattgattaaattacttacttgagatcaaaataatggagtatttaattactttagataaaaaaatggagtgttaaattgtctggtgcttacgatctacagacatggactgatagtgatggataaactgaatagaccaaacacagtgaatttatctatccctttttcggtcagtatttctagtgcggtggtaaaatttagtgaagaattacaatatctccggttgttaatactgtacctcaaatgataatgcagcttcctctaaatcacaacaaatggcagcttcacttaagattcttattaaacttcggcaatttattaatagagtaaattaatatattatataagtttgatgttaattcttttctaaggaaaaatgttcatacatacaactgctaattaaaagaacacgtgtagcaaatgctggtattaccatgctttattcagatagtagtgagtacgaagttagtatgtttgactagtgccattaattttcaggtctattgtactattattaaaaaacattgatgatgacataaatatatcatgcagacccatgtgttattaaattaactccgtcaggtttttttccccttctaaaaaagagaagcatgagctctgctagtcactaaaggtagaaagtagagtaaggtttgcagaacttagtgcccttatctctgtgaaaaagtgttgtatctgttgatttgtttgctaacagaaaggccatttctttatacccccaccctttctaaaaaaatattgctatctaatagtataatattttcggatgaagggagtaatttttacatggaaatttatgcacattgtttcacaaatttatcatgttcccgcagtgtggttctatccatttctttctctaaagctcgaaacccttaacaagttgacataaataataagagcaccgctacatgttctatttttttcttactaaatttttactaacaatcgtcttaaccgtttgatttagatagatgaaaattaaaaaattctagatgcaattattgcgtgacacattattgttagtaataagaatttagtaagtaaaagtttatatttatagcttttccccataaataatggtggattcttgaatcttgattccctgccgtgattaagaaattaatttggtttctcgattttcttagtgcgagcacccacaatcacacataatcagtggcacctaattaacggaactgaaagtctgagatattagatgattagtgtaagtcattgttatgacaaagcattgcatggcaaggggttgccttaatggactggatgaacttggggttccacgtcagtcgttttctgcagaacagtgtggctacttatgtccactaattggcgtgtggatctgaatttgtcatcggctgcatttacaattgatcaaccagtaggggatgagggatgaaatgagtagattacttttgattaagcaagtaactaagagtcattatcaccttttatctgtataatcacataaacatcttatgtatctttctttgctgctcctccttgattgaacaggcatagctgccattaatattttcgacagagagaaaagagtcattgtcattcagatatatctaatcacggaattagggagggaaatcttcgtagtgagactctcctagtgattggtcacatactgaattcttttctgaaaggtataacaagcgggtcaacatcaagagagaacctaatctagagcattattgttgtctactccgccaaatctggtgtgtcacaagtttttgcttgtgccaacaagaccgggccaatactggatttcttttttttctccatccctttgcaaaatacggtacaaacacaagcgtttatatctacgttcttttatgaataagcgcatataaagcttatccctataaacacgtttataagattgggttggtaatatcttaatattaacaaagttactattgatatctcatgatcacatcaaccattaaaaattaattaactgtaagctagtggatggttgatctcctccagaaacgcagcatcaatagtcactcggatgcctcttttgcgctcaggatcttgagacggcgaaccacattctcctcgactgcgtgtttgctcagcaggtctggctccgtgtactgtcgtcttctggatgggttgccctctctccctcgtggcagctggttctaggactggtggccgtcctccagggcctatttacctgagcatctccgcgctagcttcgactccctggtgctccttgtctcttggcagctgtggaatgaacggaactctaaggttttcgactttgcactattttcagtcaccgtggttctggagtccatccactcggagggtcatatgtggtctttagctggtgtagccgctttttgggacttgttaggagtgtagcgtggctcagcccttcccgctacttggagtttgtgtttagccgccgtagttttctagcttcagttttttatttcgctttttctcccttcccttggcataaactggtctggttaattgcgttgtgtaactataacttttttcttctaatatattaacgtgcaatcttttcgcacgttcgcgaaaaaaaaactgtaaatacgagcattgcatcggtatactctcgatatttgagaatcggtacctatttaaacatttcgaagacaatctaaaactgcacccttcgaggaagaaaaaggcatcaaagtaaaagaagaacattttattacttggcgaatggggatgtgtgctgaacaagtaaaatatctgcccaagaggccaaaatggccgttgagcgttttcctggcttgcgtgttgttcacaataaatcgcaataaatcaaataaaaataaaactgcacacgatgcatcatccgtcaccatcttcacacctcactaattcattacatgcgtttgtttttctctttttatcatcaatatagctaaccggtctccgtgcacacaatattttctctagaaatttctaggttccgtttcttgtaatctcacatccattaattccataaatccccaattgtccatatatactagcaacagaaagttcagacttttgtttcagaaaaggccataaagttactcattttaatttctccagggaaagaaaaagtaacaaagctctaacttcccgtgtcaaatatgtgcaccaatacccacagattatacaagacatgattagcaccggtaaaaagtgggcattgacacgtccaaatgcacgagaagtttgtactttttttgttgctgttttgtttcgtctatgcaaaaaccaaaaataaaaaggaatttgtacaactgaaatgatgatgaaccacaagaaaagaaaaacattggtgtggtccccacgtaattagcaaaaaaaaaagaaggaaaaaaaacaaaggctttgtggctatttaagccgcttcttctcctccatttctccatccatccatccatgtcgtgttgttagcttcgttttcttcttgtttcatcaatccaaggagtgtggaaggccacacgccaagattatatctatgctaatttgattagcagtaggattaattcagtggctagcgtagcttgattagttggtttaattagttggagagtaaagaagatgttgggagtgttcagcggcgacgtggtggaggtgccggcggagctggtggccgccggcagccggacgccgtcgccgaagacgcgggcgtcggagctggtcagccgcttcctcggcggcgccgagccggccgtgtccgtgcagctcggcgacctcggccacctcgcctactcccatgccaaccaagccctcctccgcccaaggtactaatcatcctgttcctctgaataatacagcttttgattaattgtagctgaatttgcttaagttctactgttcttcaccatggatttctcaagatctaaccaaggacagaatcagtgattgctttcatgtgttcttcctgagtcagagtcatttactatatgcttttactctttggttagtgaagtcttctttagctagtgatgatcaactgatcatgtcataatagctctcaatattttattttattttaaaggggactcccaaatcccaagatccgagtgtctgactaaatcagagaaaaaatagtttcttatcgtaacactttgctgattgtttcgaagggaaaaaaatcacggggttggtaaaacatatgcttagaatgagcgggtgtttgggatgtggtacccatctggggaaaaaaatgatttcatctcaagtaattcagtaacttaaacaggcttttaccacaaaaaaaaacacaaaatggtttttttttctgggtacggcacacatcttgagtcaataattgggcagtttttctcctcatataaaggcaggtttgctttcgtaagacaaactgaacaataaatacaactccataatccatttctgtaggttgaggggccaagctaccaaacctcatattcagttcatagattctcatccgaattatgggtcgcatgtctgagatgataattacatgattaactatggtatagatttgtttgtttcagaagtagaatgctaaacaaagaagaatatgcagagattttttgagaactaaatgcacaaaagtaactatcaaaaatagtagttttgccttggtgctacgatatctgaatctttcttgccatggcactccggtaactaggactctcttgccacgtgttacggtatcctggcatcaaatggttggtgccttggtataaaaaacgagagcagaagaagacatgaaagaaaaaatataatcaaaatgtctatgtcgatgtggacatcatcacatatcaatggaagaagtccacatcatgccaccttccacaaacaaggtgttaattgacctaacaacgaacaagaacttatattcttcactaggaatctaatggtatttcaatgtattagatatagtttaagaaaagggataggccaggatgatctatttccaagtctttcaaaagaaaaaggagacaagatagtgttggttgttggacaacttactaggttgcttatgaaaacctctcttgatttatgcatttacctggtattattgtgctgttcacatggcccagttcatagtagagggcactaactttgcaatcagttgctaataccagaagtctatccagttttgatacccacagatctgaaaggaaaaggctggactaggtgacccatatggtcaatcaatccaccactatgatttgtgggcctggttactctttgttcatatcttatctagtactagacagattcagtgaagaagtagcatccaaggaattccactccattgctccaatttttccagtacaagcatctttgtccttattgtaactagtagtagtacaatcttcaatgtagtacaattcaatgttaggtacatcttacccagatcaaatcattgatgttgcacctaattcttttcactctccaattattcttaaagagtagaaatgctgagcactaatcaagcatactaatgctgttcctgaatgccaatatatgttcttttctcctatgttactattaagatgcatgcatcataatacagtagttatgtccttttcctttctgtaaaaacctttattcctcttaatacaaagatacacaaatcttttgcctattcctgaaaaacagtagctggttgagtaacatatgcagctgtcttgatttgtgcaggtcatttgcagcaaaagatgacatcttctgcctgttcgagggagtcctggacaatcttggcaacctgaaccagcagtatggtctgtccaagggtgccaatgaggtgctccttgtgatcgaggcgtacaagacgctgagagacagagcaccttaccctgctagcttcatgctctcgcagctcgccggcagctacgcctttgtgctcttcgacaagtccacctccaccctccttgtggcctctgtaagttttgttcatcactgaatgctgttgctgcatcacttcacttgcattgtcagtgcctgaagatttggttgattttggttacagattatgacgtgttcttgtgctgtgatttgctttttcaggatccggagggaaaggtgtctctgtattgggggattactgctgatggatctgttgccttctctgacaacattgacctgcttaaaggatcgtgtggcaagtctcttgcacctttcccacaaggtaatgtttaaactttgaacagtaatgcagcgacgaaagatgaagcatttactataaaatttgatctctaactattgatttagttaggcacaattgaccttttctttgtttctgttcactaattcatttcggttgcaggctgcttctattccaatgctcttggagttggaggcttgaagtgctatgagaacccaaagcacaaggtgaccgcagttcctgccaaagaagaagaaatttgcggtgcaaccttcaaggtaaaaaaataataataataattgatggcaacctaaatacttaactgaatacattgtaaccgactgatgtcaaatggtgttttcaaccctttcttgggtcgatgtgcatctcttctttatcaatgaaatgaggcagagcttctgcctttgttcaaaaaaaaaaaacattgtaactgactattttctcctgcatttcgtctgaactcaatagacatttttgggtgcactgttaattaacacttttgatttgatatatgcaggtggaaggatctacaatcctcacagcgctgcattaggagatttttggatctccagctgttgttgggaaaggaaaactctgtagtctgtaaatggtggtgtaacatagtcgcaaggcatgcatctgatctgtatcatcatcttccgtaaagactagtgctgccagcatggttagcacttttcagtgtttgggtgtgtgtatgatctgtatcctatgctgttcaggcggaaatgaacttcaggcccagctgtgtcagttgaatgtagttgtgttgcaaataagtttttcttgtttgttatcactgtgattgtgtcttatgcagttatgcttgttgccggatactattcataccacaaccttaaccactcctattttaacaaaaatattttaaatgtttaaaaatgtattatattattgaaatatgttacatgctaaaaattttctttacataatgatatgatctagtagtaccacctaggaataatatgatcttaccatagccatgtaagtacaccaaaccagatttacttccatattgggcattcaaacaacaagtaatttatggtttccagattccggaaacatagctggtagaaataattatttgaccatcccctaagttgcaaacgatctattgtccatacccgattttgtagcgcaagccaactaaatatctgcattttgctagaacccacgccttccaaatcaactctgcggatggcgacgctatcattccgttgaattgaaactgataagcggattttgtgctatacttcccattggctgtccttttctaaaccatagagttctctactacatctgtcaattctaaagattcatgcgttcgagcccctcatacttgaaagaactctctgagttaaggttgtgacatatgtcatttacccaccttcttgttgcaagggctcctggattgtgtggtcttcctcttggtgcttctgtagaggtctggagctaagttttgaggctttgaacactaatccaatttgatttccaaagatcgcttttcactcatcactatccagtactttggtcgatgctgcaaacaaatttcgaaaaattataggtcaggttgacacgagaactgggccagctcttagtcggcacagnnnnnnnnnnnnnnnnnnnnnnnnnnnnnnnn

SEQ ID NO: 42299 - DNA, 946 bp, Oryza sativa
tcctgcagccccacaagcgcgtatgaagcactttgctgatatgaatcgcactgaacgagtcctgactgtcggcgatatggtttatctcaaaatgcagccttaccgtcacaattccttggggttacattcttccttgaaattgcattctaaatactatggcccgtttcgtgttttggaacgcattggctcagtggcttacaaattgctgttaccggcatcctcccaaatccatccagtctttcatgtgagccaactgaagaaacacatcggtccaaaagtggttcctgaacctggcctcccactcactgatgataacggtaacattctttcccagccaacggctgttttggaacgcaggctgattcctcaaaacaatgcacctgtggttcaatggaaagtccaatgggcgaatctacctctttctgctgcaacttgggaagatgctgctttcatatccaaagtgtttcctgcttttaacccatgaggacatgggtgcttaagggggggggcattgtgagaactctgacgaactgaagccatgattgaacgctggaagggaaggcaagttcagttacccaatggctgggattattcgataacgcttgggctggagattatgaagatcggacgatggagatgagcttggaccgtctacagcacacccctgttgccgtactgttgacatcatctcttttgtcttgtattagcgagtccctttataagctagtgccgccgcaatgtctgtatcgaacaattgaaccctaatttactttactcttgtcttgcggcgcccatctatttccttgtactgtgtactcttcaattcagtgcaaatccttcaatttaatcccattaggatagctacttaagcctcttttctctgaaattgttcttgtcaagctctgaatctggccggggcttgacaggtgggcgtgtgcaccgtggg

SEQ ID NO: 42300 - DNA, 40167 bp, Oryza sativa
tcttcagggtttgaaaatagatgataaggatgcttggggtgatccgtttactatcacaccggatcacgtgtttatttaaggcttgtttggaggactgatatttgggccaaaccaatcatggtctttgatcaattctagcagtgcacccacaatgacaatcctacacagagcttgagaacaaataggaaggcgttcaaatttcactctatagtcctgttataccttgtaattctgggggctcaatattaaatcttcaaacctgttggaaatccccttcttcattgcgttaattttcgttgttgtggccattgcggtgtgctgacccgtcagcggcgcccggggggggggatttagcagctggttttgctgccttccggttgctcgtctcggtggccctcggatcgtcatccaacagtcgtttcggcccctcgtcttgctgcggcgtctggcatccgtccgtcagatcacgatccaaagctaactcattctctgcttgtttccccgttttttgacaaattgacccttttcaaaaacttatttcgaaactaacccctgccaaaaacttcaaccaaaaataggccgtttgctcagcgccaatacgcttggcgctgaggttgggcgtggcagctacctcagcgccaaccgcattggcgctaagatggcgaatctctgcgccaaccgcgtcggcgctgaggtgccaaacttcagcgccaacgggcctggcgctgaggtttggtacttagaggccggccgaagccgcccccaaccagcctctcctctattctcccccaccgcgcgctagggttcgtcgccctctcttctcccctcaccaaatctcccccaaatccactcaaatcgaaggggatttcgtcgggattgatttggggatcgattgagaaggtaaactcctctagaaactctaatttccccccatgttttattggatatttcgcattgttttggttccaaccgtggtttgataattattggctcggattgggatgttaattggataatgtgggtggggatgtagtgcggaagatacatattaatcttgctccatttggttcatgttgatttgtgggtggggatgtagtgcgctgaccttcctagtctcagcgccatttccgctggcgttgaggtcctccccccctcacgcaagccagacagaaggcctgctgggtcgggactcggccgaaaaggctaagtcccacctcagcgccgacgggtgggcgctgaagttagccagctcagcgccgatgtgcttggcgctgaggtagatgccacgtcggcggggggatcggctcggccgccacggtggcacgaggtcagcgccatgacctttggcgctgacacgcccaacctcagcgccaatgagcttggcgtggagccgacagtttattttttgttgaagtttttggtaggggttagtttcgaaataagtttttaaaaaggttcaatttgtcaaaaaaaaaaacggttgtttcccttcctgctccggctcccgcgcaatcccgcgatggcaatgcaaaagccttcgcttctacttccacgagatctacgtgcggcggcacacccaacgcatgcatgacgcgcccctgcatgcatacatatcacctcagtcgtacaggatcggaactcgtacaggccaaataatgttcacggtctactctttaggtactgtttagttgacacccacaacttacttagtgttgtcatatctcttaattaagttagacaagtttaatagatgattgtttagttcataaccatatttatggtaagatttattctccattacatagtccacatatgtcattgagataaaaaagtgtggcaggagtgcctcatgctagctaacgagtggttctaattttattagtcataccttagacaagttagccaaaaatttgtgtcaaacttgggtaaattgaattacccaaccaaaaggccgtttattatgcctaaaacaatgaagagtttcccacgaaatatatccattaagatcggctaatatatggggcccaaattttataagacaaccaacaattttatccagaataacttttattatgctcaagatatgaagagttccacataaaatagacctagttttcatataaagaccatccaataatacatttgtaaattccattacaccagtgaaagcgagcatagaatatgggcgaagcacatttcatccacaagctcctcggcacgtatttctgcgcggcactgcatccggatgaacagctcgtcagccatcgccccgccgatgtgcgtgttgacgagtggcccaaagagggcacgcatgtagttcgctaccatgcgcccgaccacgccgcggttagcgggatcatccacgacgggagggcttcccatcacgagctccaactggttgatcttaaacgagccgtcggcgtccacagcctccttgaactcctctactgtagcagcgtaaagggggacgttaaagttgtccatcttctcgccatcgaccatctcctcttcgatgagatcacgcaatgagtcctcgaacatgctgcaatacacttcatagatgtagccttgctccgtggggccgcgggtggatgataggcggccaaggctgacaatgaaaatggcaccaccaggcttcatctcggcggcacgacagtgtagaaagcgcatcatgtcagaccggaattgtcgttggtatgccgtgcccgtctcctcagaggcaccatgcacgaacactttacctttgttgtatgccggcgattgcttgtcgacgactctcttcggcacctgtgtaataattaaaccaattaaacttcttcacttattgcttacatttaagggtggttgataagctaactcgaaccgtagcttgactccgaaaattggttgagttaatgagccgactcgctcaactcgttaacataacaagttaaaaatgagcccagcttagttcgctaagaaattcgagtagactcattgaaactattaaacttgctacgacgcaatacatctttattattataaaaattgaagacgtttttgccggtactttagtacatcatctgtgtataagtcggttttcaagttcgttcacttttggaaatacatattattatttgagtcgtttattatgtttgcttttggaaacacagaagagtcatataagaaatctttgtaaaaaaaactcgtatgctaacttgaggcgatcggactctaattacagctcatgattttaagcgaattctaatagtgaatttcaccttaattaaactgtataacaataataaaattaaaatagctttcacccgccgcaacgcacgggtattttttctagtgattttaaatttaggatttgctttttataatttgacataaattttgggagaaaattaatattttatattgttcgtcatatccgatgggctttaagatccctgaccgttggatgggttaaaaaccaaagcgtattgcgtgaggtgggcgtcgatcgaactagctcgcaaccaccaatagctcctgcgtgcgtccccctactgagctagtgcaacttttttttttatttacataccgcttacttcctctggttctatattaattgatgtttttgacaaggttgaggttaaacttttataactttaaccatcaataactttaaaaatatttagtttaaagaaactagaaaaacatatatagatttgtcttttcaaaacactataataaaagtaaacatgcatttatttattgtatatattataatagaaaaataaggtcaaaagtatatcttgtagagcgtgtcattgtccaaagcatcaattaaaatgaaactgaagggagtatattctaggtacatgtgtacttacattgttattgtactataatgtatcgtattaatttacattttaaatttttttgggggaatttctatagaacgttagatagatatatatactccctttaaatttacatttggtatgatttataggcctatgtaattggagttatggccgacgtgctatgtatcatgacaatataaggttgtactataataagtggtttgtgagctgcttgtgtcatacgtgacactatctagcatgtggagtggacttttaatttcaacacgtcacaagctaaacgagctacacaagtaactcacaaattagctcaaggtagctgactaagcaaatgatcgaaatattgaacttaatgatcctactcgatcattaactgctcgagtcaaaacctgaattttaccagtcgagtagctcactttgatcccaaccatacttaactacatgtataacgtgcaagaatttttctcagattgaacaacacattgaaatcaatataatccatattcattagtaacacaaacgattttcttttctgtactatcttcctaatttaacacatattttcattagtaacacaaacgtttttttaattttcagtagtacttgtgtgctatcccttctttttttaaaagaaaaaaattgcgttcgcaaaagaaaatgttttttttaatttcactgtgaaaatcttgaatacacacgctcagaatcctacgttcacaccactgattggaaactgaagcaaaaattgtatacatatcaaattctactgaaaagatgtacaatatatttatctccacgcaaaattgggtgagaagatatgctagttagtctgaagatcaacacaaaatggaggattcattggggaaactattttgattcctcaaaggggatgtccctcatttacttcaaaaccatctaaacggttatgaaaaattctggaaaaaattggcaacactcatactatatatctatacaactccacaaaatcttaaatccaaactcaattcacacgttgagatttaaaaaaagacaaatttagtatatgaatagtaatataatgttcatatctgaatttgtctttttttttctcgatatgtaggtcgaatttgaaatttatttttggtggactagtagatatcgctatactctatattgtcaattttttttaaaatttttcacaaccatttgcatcgaatttaaaagaaaaaggtacacgaggggatatctcccctcgacggattagaatctactcccgattcattatgattaatttgatgtactctaaaaaaaacctaaactgtatattatacagcgtacctgtgagagccagtgcaatgagaaggtggaggtgaacacgttgatggatcgctcggggaacaggcgatcatggaaagagccaggtacggcggcggcgaagtagcgccggctctgccgcccatctctgcccgcggcagcagcttgctgtgggaggaggtgaaatagggtgttgaagtcgttgctcgggaggtcggaaaagtagaagcagaattccaggccgtcgtcgtccttgctgccgaaggatttgtcggtcatgtggtcgacgatcacgtccgcgatcaggagagtattttggccgcatgagcatcccaggtcggcggccgtcagtagcggcttgttccccggacggtgacgagggagctggatcttgtccagtgtctcctcaagggcgtacagcatcattttcaggtttcgggactgcaccggcagttttactttgctcgatcaggcgtagcaatcttactaatactctccgtcccaaaatataattacttttaaaataatgctaagtcaaacattttcaactttactattaatcactaaaaataaaaaagatcaatcatttaaaattgatattactagattaatcattaaacaagctatcataatatgcaactctttttatttaaaaaatcttaactttatagatatttgttagttaaaatagcatctcgaaaattatgtcgaagtccaaaaatgcttatatcttgggacagagggaatagtaattaatagccacctctaattgcatatagttatgcttgtattacttagctaattagtcttgcttaatttgttaattacctgagattggctgttgttgatgtaactggactcgccctggccaccctccatacagaagacgttcttgaagtcctgctgctgctcttgcatctttgatcgcgaattcaccgcacgacgggagaatgggggtgtatgtgtataacttgttcctgagtaatttagttggatcgagttggcaaagctgtactgtatcgatcgtatatataacttgcctcgatgataccttcagccttttttttttattgaacacatcagcgctggtttgttgaaccgaatatgatgtcatttttttagtgggatataaagtcattttaattagggcccgtagtacacagaatttgaacgaacccatatggccatatggttgatggtaaaaatcaggagtagagcaaaaaaggaaaagacgactcacgcgtggtaccgacgaggtcgcgcggtggccgatgggcggcacgtgcgccgtgagtccatagatgctacgctagctctcagtggcccagttgactagtaatgttcaggtcgcttcttttaaaaaaaatagagaagggtttgtgtagtatttttaaattatgaacttagtctatgaaacaactcaatctaaaattagtttctataaaaatttaaaatcatgacatttagatgctactcagttcattgcaacaactatgtagatttagattagaaaggcagtgggatgcatgggggcgtcttcagggtttaaaaatgagatgacaaggatacttggggtggtctgtttacgatcacaccggatcacgagtttatttaaggcctgcttggaggactggtatttggtccaaaccagtccctttgatcaattccagtagtgcacccacaatgacaaccttaagaagagcttgagaacaaataggaagacgatcaaattccactctatggtactgctgtaccttgcaattccggggggtcaatcttaaatcttcaaacctgttggaaatccccttcttcattgcgttaattttcgctgttgcggccattgcggtgtgccgacccatcagcggcacgcggggggaattaagcagctggtttttctgccttctggttgctcgtctcggtggccctcggatcgtcatccaacggtcatttcggccccttgtcttgctgcgtctggcgtccgtccgatcacaatccaaagctgtactcattctctgcttgtttcccttcctgctccggctcccggcaaaagcctccgcttctacttccacgagatcgacgtgcggcacacacaacgtatgcatgacgcgcccctgcatgcatacatatcacctcagtcgtagaggatcggaactcgtccttgctccggcaaataagtactcaacccggcgtcgtggttgatcagggagctaggtggtggtattcaggaatgtccgtgcacacgtacgcgtcgaggtggcttcacgtacggcgcgtatatcggcagctcagctctctggccacgctgctgggccgcatccgcacgtttggcccgtcggaacagacatcggcaggcataaatttacaagttcactttatgtccttcaaaactatggatggagcactattgtctcggtgtacacatacgctggccacatgccacgtcaaaggacaaggacaacgagaatcaagaaaattaaatctaaactttaattagtaaataacaaaggcaaatcttatctgaacggaagatcaagcaacaaatgaacattccaacagatacagagagagatgagttacgactaatctcatgtttgatcgatcatgatgcgcgcgggcacaggccggaccagcccttgccgacgactcgctgttgtccacgttcactcacgctcatatatatcgatcacaatacgccccttgcgcgcgtggaacaacgcctatatatggtgacggacccccggcttacgaaccttttgcgaacgtgccgtggctcgacctacatgcacagcgccgaagaccgtcttgcccgcggtagaaccgccgtcatttcctccggtagtcgtccccgtgcgcgtcctgatcctcatcagtattcgtattcccgaccatgcatgcatgacgcatgtgtagagtcctactgtcatagtgcatcccggggcctttcgtgaggtgttgtgtgatctcggcttgatcgaggctctctgagtgctgagattactgatgtacctcctccaaacgaaacgattctgcattattttcttcgtcttttttcctgagaagattcaccagcttgtctagtgtagtattgctagcgctagctgtgtggtgcacatgatcggataccccgagggaagaacacgagctttgggccgccgcgggggactgcaagtctgcaaccaaccaccgcctcacgtcgtgctagctcccgggcagggcatgcagcccacacgggcgtaagcgggttgcttttctcgtctcctctccatccatatgcacgagcgcgcgggcgtcaccgtgacccgtctcgctcgctcacggtcgccgagtgtgcgcgccctcggatcggcgccgtcgcgccgagcgcggcaggttgcagctcgctcacaccaaaagtgtcgggtatatgtggtggggcgtcgcaacggctaaaaatcccaaggtttgccttatctcacaagcaccgatcgccatttccgtttctcccttcttgcatctctctccagaggcgagccgctgagacggcgccactcccctcggcatgaagcaccacgccatgaagtcccagtcccgcgcctcgtcgtcggcaatgggcgcgcgccacgcacaagttctgacaagtcatgcatatatcacgcatatgtactccatctaagcatgaaaataaacattccagaagagggagaagatcataggaacatttggatcttattgaccggcatggttacagaatcatagaaacactatcatataggctaacattagcacaacgagatagactaacgccgtatgggtggttgtatgcgttccaatgtacttcttggatgaagaaatactttccatctttgcacgctcacaagcttcactcctatgacgatcaagcatgatcttctttagggcttcttctcgtggcatagttttcaaatggctacgcacaaagtatgaaatttcagtaaggtggggaactagataaaaaaccctggctttaatccgccgttcccgatacttcttcaaagcatttcgaatagcagcaatcgacacttcgatatttgttttatgttcattatattcttcccaatcgtacatcccttgttcatgtaagattttcatctcattatcaattcttcttccagcaaagcgtagcttcagttcacggaacaaatatgtttgtttgatcataacttgcctagtcatgtcggtaataccatactcatcacggcggcaaaaggtcaatatttttgttcccacgaagaatttatttttctttattgatctcctacgagtagcggcatcgttgataaccgttgttttcataaagaagttggctctatctttcttttgtgttttcctgcgaccatggatcaataagctaggttggagtatataagcacactaatataagtctctctatatatatagctttagaaaatccacgtgacagattttaacacgcacacacatacgtacctgcagcttcggttgttctccatgatatatcgcaatccctaataattgcttcacctggatatatatatcagaggactgtagtatatcatgtataaaagaacatatgggagaccaaattaatctactcctatgagagtatatctctaacaacgactatagcgtggaaagatcagctctctatataccagcactcgggcaggttgatggatggatttaggagggcttgcactgttccgctgtcgtcgagtcgtcctgtttcgaaagtgtacgttgtcttggagagtagatcgaatatatatatacactccatgttggatatatatccatataagaaacgatcttaatttaagcctatatgttattggatcggattaggaacgactggccgcaccaccagttcgatcataagaccatataaaacccttttattactctttttactcctactagcataaatgcctgtgcgttacaatgggtgaagtagtcatatatgtttagattaaaacaaaatcacattgtgtgcatgcaagttatggtccggttcgtttccactacaaagagtggataaaattttagatatttttaccacgcttttcaaactgctaaacagtgtgtttcatgcgaaaactttctatatgaaaattgctctaaaatatcatattaatctatttttcaagtttataataaataaaactcatttaatcatacgttaataccgtatcgttttgcgtaaaacactttatttttatctttatctttagaagaaaagaacaccacctatatctactagcatacttgcacgcatacatactactagtcataaatgcccgtgtacaagttatgcgcagcatatatttttacgtactactaggcatacatgtttagattaaaatcccatggttgtgtacggcagtgtgtgtttctaacccgtctctctcgtgatccgcgtgtacgttttttgaatggttaaacagtacgttttttttacaaaaaatttatgtacgaaagttaatttaaaaattatattgatctattttttaaaaaaatagttactacttaattaattatatgttaacgggccatttcgtttttcatgcacaggagatttgtatccatctccttcaaacgagctcaacataacacccccacacaaaagacataacttcggactcgtcgtacatatcagggggtgtttgggatctcaaaaacataagtcctaaagttcaaacacccctgaactttggactcctcgcacatatctgcctccgtcctaaagcagtcctactccctacccacctggggcgaagatgctgatacattgacagagtagcagacatgcagtggaaagaaaagtatagagaacacaattctggttcaagttccagagatgacaaaattgggaaaaacacttcagttgtatttagttcttgaaattggggagaagtttggaaaaatttgatagtttgaaaaaaaagttagaagtttatgtgagtagaaaagttttagatgtgatagaaagttaggagtacgggggaagtttggtatactaaatagggccttcatgaataaaaacacttccgcggtgagacgcgccccgcaagtcacaaaagtgtatgataagttctctcctctccatcatacacgagcgcgcgggcgtcaccgcgactcgtctcggtcgctcacggtctccgcgagtgtgcgcgctctcggacgagacgactcggatcggcgtcaagcacggcaggttgcacctcggctgcttgcactgcactgcacacatgtctgcagctcactcacaccaaaattgtcgcgtctatgtggtggcgttgcaatggccccgccgcccgcgggcggctttgcgtcaccgttgctgctcgagccaactagccccggccggcgtcacctgctccgctctcacgtggcactgcacgccgggtaattgtgcgaaatatatccgctctccggtggtcgttgccgtggatgtcctgatcctccattatacgtattcccgaccatgcatgacgcatgtgtagagtcttgctgtcctagtgcgccccggggcttttcgtgaggtactgtgttctcggcttgatcgggaaaacccaatccatcccttcaaagggatattctctcatttttgcatatcacttaaagagttatcaattttttaaaaaaaaaactgtaggatagatcaatatgtgatatgccacttcacaaatatgcaaattcaaattcaacttatacaattagaaacaaaaataacaaattttactatggatagaatgagttatttacggtcaaatttgtttttttaaaaattgtataagtcgaattttagatcgcatgtttgcaaaaagatatatcatatattgatctatcttgacaattttttttatttttttataaaaccttttaaacgatatgcataaaacgagatgatgtcactgtagatggccatatggcccgtggcccacggcccggcccaaagcacggctgtttggcccggcccaagcacggcacggcccgactggagtcgtgctcgtgccggctcggcccgacagacgggccgtgcttgggccgcaccttcggcatgctaggccggcacagcacggcccggtcaaataaaaaaaataggaatttaaaatagacttaaataatcatataaggcaaagcctaagataagaggtatacaaaatagacttattttccagccatttaaacacagcccacagagttgagggaccaaaaatagactttttatgtgatgaggtatacaaaatagacttattatccagccatttaaacacagcccacagagttgagggaccaaaaatatactttttctgtgaggaagcacgatgggccatcgtgccttcgggccgacccggcacggcccgagtagtattgggccgtgcttgggccgtagatgccgcccgtggactggcacggcacggcccggtgtgtcggtcgggccgtgccagcccgacaagccttggcccaggcacggccgtgcttgggctgggccgtgccaggcggcccatttgaccatctatagatgtcacctcgagggacaaaagcccacttccgcttgatcgaggctctgttattgatcgggtgctgagattagtccctcctccaaacgaaatgattctgcattatcctgaaaagattcaccagcttgtctagtgtagtattgctcgcgctagctgtgtggtgtacatgatcggataccccgagagaacacgagttttgggccgcagaggactgcaagtctgcaaccaaccaccgcctcacgccctcacgtcgtgctagccgcactgcccgcagggcagggcagtacagcatgcatagctagcccacacgagcgtgagcggattgcttttctcgtctcctctccgtccaagcgcgcacgagcgcgcgggcgtcaccacgacccgtctccgctcgctcgcccacggtcgccttcggatcggcgccaagcgcggcaggttgcatcgcggctgctgcactccaggtctccagctgatcgctcacaccaaaagcgtctgcaggtctgcaggtggggcgtcgccatggctccgcgggcggcttgcgtcaccgtggtacgccgtacgcgggtactgttcgagccaattagcctcggccggcgccctcacctgctcccctctcacgcggcgcgccggatcataattgtgcgaaatatattacgaggaaattagtgacggaaacaaagagatggatcatctatacatgcgcgtgtacatagattttttttttttggaaaagagattgctaacatataaatatatatttatacacatcacacaatgacacaatgcaagatgtagaatcaatcatagaagtaaagatgtcctagtagggaatatcactttaaaataaaaatgataaaatagattatatgaaaaatattactcaataaacatacaagtttaaattcgacttatagaagttataaaaaaagataaattttgctacaggatatctcgacttcatggttttaactatagtacaccacacgaaataatttttggggaatacactatgtaaatatagttatttgcaacaggacactgcatccactaaattagtatttttgtgctgacaaggcgagaggggacccacatttttacacggtgtgaccaaattgctcctcttcctctcttctcttcttccttacctctgtcttctttctctcttctccggcgagccataggacccgcgagcggcgggcaaccaatgggcggagcgcgcgcggcgaagatgggaggggtggcgcagagtactgtgtcacttgcggcccttcccaagtcaccattgcctcgatccacctgcgttgttgttgatgataccggctgtggctgtggcgggtgacctcgcgcgcacaaccggctctatgtcgcagcaaagatgtcaccacgccgccaacctcaggaatcgcctgggaacgttgtcacctccggagccctcagtgtcgactcctccaccggatgccgccatcattgaagtccggcgtcgattcctccacatggaatcgccactgccgccgcaagctcctccacgagctccgaagaatgccgcgccgagcaccacacctccgcgcgccgcctgcaagatcgactcctgcctgatcccaaaccggaaagagagatgggaaagctgacatgtgggccaaagggcatttttgatatttcacgtgatttttttctctgttcaaccagaaattattgttttaatgagcgcggtgtccaccagcaaatatccaacttttgagtgtgtcttcccccaaaagtcacttcacgcagtgtcatacaactaaaaccgtgaagttgcaatgtcctgtagcaaaattcatctacaaaaaatatcaaatatgactatgatggtacgtataagtttaagtttagggcctatttggttcacaggattttcaaatcacaggaataggaaaaacataggaatagtgtaggaatgcacgtgcaaaacaatggattggaacacatgaatttttcctacactgagctaaacaaaagaggttggagtggatgttttcattcctatggaattagtacattttagaggatttttggaggattggcatagtgttcctatggaaaattttcctttgaatcctacaaaccgaatacatgaacagtgtttattccaaaggaattgagatttcctttaggaatccttcaaaacgaataaggccttaacttgtatttttttttataacttgtaggtgttgagttttaatatgtatgtttgtggagcggtatgtccatgttaatttatcttgtcaacattttctaaaatttttcaataactatctattaacttattagaggaatagaaaaagagcctccacgtttgctctcacggactagaaattctaatattaatcgaagaaaaagaaaaacagagtccatatatagaaatacaatttagaaatagttgaaattcggaattaaaaaataaggaatattggaagaggaaactagattctgtcgacgagcgatacccgtagaccggatatagagggtattggggtacgttggtgcaaggatctacgtagtacgacatcaagcaacaaaagataaagattatactggttcaggccccttgataggtaatagccttaatccagttgatatgggattatatgatggaaaaccacagattacaaagggaataatggaactcgatgaaccctgcaggatcgtaatcgagttgattcgactagatccctagcgatgtggctcttgcaagctccgatttcgtaggctgtgggggttgtgttggctatgagattcgatgccttaggtcctcccagggggtcccttttatatcgcagatcaggtggtctccaagtaaaacttggagacatcggaccctacacgatataccgatgaccttgtcttgtctgagtaggacttaaacactgtggaagattttcttagtatatgcagataatgtccgtgtatgcgcgggtatgccatgtcgatatgtggcgtatatcgaagggtaaggggtatacctaacccgtaaccctgacagattccatatagaaatacaatttagaaataactgaaattagaaattaaaaaataaagaatattataagaagagtatagagtccatatagaaatataattaagaaataatagaaattcgaaattaaaaataaggaatattagaactagagtatagagtctatataggaatttaaaacaaactaaaattcgaaataaacataaacataacaaaatttaaagtagagtttagagtccgtataaaaatacaatttacaaataactaaaattaaaaataaaaaaaacatgagaagaagagtctaaagtcaatataggaatacaatttagaagtaactaaaattcgaaattaaaaattaaagaatattgaaagatgagtttagagtgcaaatagaaatacaattaaaaataataaaaattcagaattaaaaataaataatattggaagaagattctatagtctatatagaaatacaatttacagataatgaaatttggaattaaaaaataagaagtattgaaagacgagtctagagtccatatatgaatataatttagaaataactaaaatttgatattaaaaataattaataactaacacgtatataaaatataaatattacacattattagtttcataaagttagtacaaaatttaaaattatgttgtcattttaatatattttaataataaattgagaaaacatatacgctattatatgagagaaaaaaatataatgatgctagccgcgcaatctacgtgggccaccatactcgtttaggtgaaactctaggtatgaaaatccatctctatcatgtcattcaaaaattgaaaatcagatgagctgttccttggaaaaaatattctgaactcctcttttgaaaccataccaattaaaatcatgcttatctttgtaccaccgaaatatatataaaaaaactttttatatatggaccattggatcgcaggctcacctcatccaacggctaaaaatccacaagggttgcctatataagccaaaccctttcggcgtgtgctctggctctgccacctcccgtctgtcacaagcaccgaccgccatttccgtttctcccttctggcatctctctccagaggcgagccgctgagacggcgccactcccctcggcatgaagcaccacgccatgaagtcccagtcccgcgcctcgtcgtcgtcggcgacgcacaagctctcccacgccatcgcgaaggcgccgccgaggaagatcaagatcgtgcacgtcctggcgccggaggtcatcaagacggacgcgaggcacttccgcgacctcgtccagcggctcaccgggaagccggccgccgacgggcccgccgcggcgtcgtcgcagccggacccgtgcgacaccgctggcgacgagggtggctttgtcgccgacggcgccggtgcggcggcggcggcggcggcggcgacgatcaaggcggaaataaaggtggaggaggccgtggcggaggcggaggcggaggcggaggcgtcgggaggattactgcacgcgctcggggaagacgacaggaacgacatgttcttacagtggctacagagtggctcttgcatcgacatggatgctgttggtttctcatgaatccgatcaggtgatccatgcattggagttcatagccttgaattctccagatcattgatccggatccctcgcgtttagatgatttcgcctttcctgacatgattttagatttgattaatatataatggagatctcctattttccttgtttgcgttgatgaagcgtcaaatattatcttcctcagtttctttgcatttttgtcttttgaagactctttgaaatacactacataactgataaagtgaaaatggaatagaaacacccatttcttcttttatttagatgggttttagtagcttccagcttttgtctgacacggcagaatttttctgataaagtgtctggggctaacctgtcgtgcatagaaccaaaattaggacctgcaatgcaatggggagaagcctaatggtttctcattattagaaagtaaacatcatttcttggagaattacccagtgatctctgtagaacattgcccttgactaaaaagaaagaaccctctatgcttgtaaatcgatctcattaacagttggctgtttcaaatgtttgcgtcattgacgtgtggagtggttgctgtagaccccactgatgctgcaagcctgcaactgctgatacgagcagagcaggctttagtttgtgctattggaaatcagaaacagatttgtttgcctgttcatatctgggaggaggcctgctcaaagtggtttgccagtccaatgtttatgtcgagatattcatcttattccatgagctgacagccataacaaatcctgaagagcagtatcagtatgtactctgctcacaagaaaggaggtaagttaatccattcaagtggatgctgttacgcactacagttattatgtatgtgcaagcgtgaaaagtggctgaacagaagaacaaaaaactaatcacgacgttctaattagtgcacccaattaacactagctttcatattctgacagcactgcgtctgatgtgccatcaattgaatttggctgtggcccttccaatcttgttaggacatcaggtgctccagatgcatctctgataatctgcaagagaagatattgtgaagacgatgagttatcattaacattagctgaaacagttaagacttaaaaccatccattgtatgctcaggagacatgattatactacctatattaaaggactcattcaaaccagacttgtaaacgtgcaggatatatgatacagtgtggattatataattgatttcacacttttgtgtacatgagagctaaggcagcctactaattaagtgtaaattgggttttagatcaaagggataaggatcatattttgtttgactctgaatgcacactagtacaaactaaatgtcatacaatatgattgcggtcttcaccggatgtgtgcatagaaacgtaccagtatttcctcatccaagtaagaaatcatgaataggcgctggaacatcccatctgccataagaaaacaaggcatcaactctaagtaactaatccaagtgttttccgcagttatcacgttgaccaatgccagcatgaccagaacaaaaaatatcaaaccgttgtttataccgagcttcagctaagaaaatatggcaagctgtgtcaaacttaaatgagaaaaaaatataaactaaaggtaaagttataactcttttagcataagcgaaatactgcagatggaaatgagaagtgtactccttactaagtggcaatttaatcccctctgaaacagcgtcccttatgggggcagggagttgttgcagagcacctgcagtttgtccaaagaaaccctttagttgatcaggcagtgtttcttctctgatcctagggatctctattaggccctcgacatattcctctttcatcctaataggaccctccacagacaactgagtagtcagcaggaacttgctttgcacctgcatacatcaaaggctgctagttaattgtgacaacatgagtgtgacaaaagagtttgccaaaaacagaaacatacaaatcccagttaacatatatcaattaatcttgcaagattattgaagatattccatgtaatctactacaaataaatgcaacaagaagagtctgtgcaaaatatcaatcctgcatgttgataaattatggtaagtcctgtaaaatgtgtaattgttaaatttaaactgcttcatcttttgaaattaccgtatttaagaacttcacgttggaagaaattttggagtatccatccttgatcaggacatcaagtcctgtaaagtgtgcaacagttgtaggtgacctcctacagatagatgatatttgttatgtagttagatttttatgttattaagaggaagatcatcatggaattatgcattttgatcatcataacataagacaattttatacataatacataactcataatcagaaaaataagtaactggcaacttaatttcagaacattatgtaaatttcaatttgcaaatatcaattgcatccagcaataggacatactcaaacagaagacgggctgcaagtgctccaggactgctgtcaccaaaccattcaaagttccatcgaccttccagaaagggagatctgtgaagtgaaacagacaaattatggaagttctcctggagacatgcaaccaaaagcatggtcatcaaactacaaatgatctgcagaacatgataaattttctgagctggacacttacgttgtgggccgtggagtggggtttagacgctcgagcccaacaatccgctcattgacatcaatcttctgcatccctgtagtctttccactaaccaaggattcaaaccctccagcatctctgaactgaaatttgcaattttacatatcctagttgagaaattaacatgaagctcacaattggctataatattgatacaaactgatattgcacaactcttctgaaaagatgggaatgcacagctcttcttagataactcgagaatgcacaattcatctttagaatgttgagaatgcacaattcaatacatatactcattggtgggtctgtggaatcgaggttttcattagtaagtgtttttttttattttttcataagtacttgttggtacttatacgctattttcttgttggcacttctccaaagacgcttgaacgctgaaggcatgatggcaaattagcaagttgtggaattacaaacatctccaattagacacggcagtggaatgagataagtaaatgcatggatcaatacttgttccgtgtacacactaatcaatcatgttgctagttgaaatggcacttgctaggaaaatggaattgatactcctgcgtgtaccaggtagtacgagcaagggtaggtcagaactagcggattcccaagtagaagacgagggtagagaggagctcacggcgaggaggagggactccttggcggagaggcgctccatctcgcgggcgtagctggcggcgggtcccccctggaacgtcggcgccgaggccctgcagcgcccggcgccggggcggcgaggaggcgaaaggctcaggtggccatcccgccggctgcggaaggagaccagcgggaaaggagtggaggcggcggtgatgagcgccgcggcggcggcggcggccatgcgggacctgagtgagaagagcggcgtggtggtgccgagatgagttgcagatgcacacgcgacgtggaaaccgtgggagaaaatagcggaaaaatcaaatatggggctgacattttattcccgatttcctcaaactcgcaggattcctgaatatttttttggctacttccaagtcatactagtacgcatattcaatcatgctagtttatcttttggcacaggttcagagaagcgtagcatcatccaacaagttgttcaagggtctcagttttgggcaaaatgaactccactgtcctcaactgatgaaactactatagatgaataaagtgagggtgaagatactgaaagagggagctctacactggcatacaccccagaaagactaagttatttgcttcttagacatctatcaaaagctgaaccgaaaacgtaacaatccatatagaaaatcgcaatacaacaggctaatcacctaaagatgcagagatatatatagtcacaaaaggcaatggagaattagtgcgccgcgcccaagatgcgtttcggctctcaagcagcgcccttccgctgctcgttctcgccatgagcgaagtggcatcggtcgccgaacgtgcaggttcccttcacgaagttctcgcacagcttggtcttgtagttgctcctgcccccggggccgcctcggcctgctggtgctgctcctgctgctgaaccagcgggtttcttggctggtgtgctcgggctgattgttgcaatgagctcacccaccatgttgcttgcctgctttatctggtcgaaattgccttcgagctcaatgttcttcaggtttgaatctgattcatggtcacgtattgagagcttgaccccagttactcggcatatctgcttcgtgttgactccacccttcccaattatgccaccagcaagcgaggcatcaacgctgatcttggcagtagcagatgcaccaaagtttcctgctggaggacccatagcggctggtggaggtggttcaggtcggcctccatatcgaccacccataggaggagccatggcactctcatgggacatgtaagctggcttgccaagttccctctcaccatgggcgaaatggcacttgtcaccaaatttgcagccttctgcagtgttatacttggtgcacatgcgtgtcttgccagaagaagctggatgagaattaccaccagcagcatgatccataggagctcttgccggtgcaggcacagctgggttgcctagattgagtgtttttgctactgcttgatacccaccagggacaaagtgcgagaaatgacaaccctcgccaaaagggcatccgatagtgctgcataaatcaaaacataacatgttaatcttctacattccaaaagacaaaattacagtgtagcttcagtccaagttgcataaacacaaagcatcttgagatacataattacatagaaagtcagacattgactagtgccaacaaacttcctaaaaagtaaaataaaaatcagagagaaccaaatcaatcaatcaatcgtggaactgtattgagacacaaaatagtgcatgtggaagcataggacagtaggttggttagaatctgtaacttaaattcaacattccattatatcacagatttagtatttcaccaataagcagcagcatagctttcttatagatacataagctaaacctggaaacagcataactgcataacaagtttagtttaaacttatactaagacgatcaatttcaatgcttgtcctgtgcaatttttataaatacaagtgcatttggaaatgggagtcatcgcctaaaagactccatgtcagtggcaatggccatcacgtttgtaaggcttgttgatgtttaattaaaacaaggattccattccattcaaggtctacacatcaaacttccccaggggctgttctgggagcagatgataataataaccgttttcaatatgcagaaacataactcagaataataaccattttatcatgttagaaattatatctaataatccataagtcattggacatttaataggcaagcaagatctactgaaaatacgattcaatcagcaaaaaactgaatttaaggcacccatgcatctatacactatcttagaaaaggggggaccaatatgtctagtgttagacgtacagcttctgaataaaaaaaaacttgcaagggtaaattaattcgtaactgtaataaatagtgaatattagaagctactattctgatgttatcttggataggttaagattgtaacctgaaaaacttggtgcaaggcttcaatttgcttgatagaccagtttgaaatgactccgtttctgttgcataaaattttgttacatcttctcacttgttagaagttgcattgttaatcttctaatgaagtaaacatataaaatttgcgtccaatgaatgtgatgaataaacaataattttgatatgatattgatgatatttcacagtgatttatcctgcagaaatcattcacatttacattcaaccgcttcgcagatggtaaatatcatttgtccaggtgtttcttcttgtaacctcatttggagcatcctcaggccccattctgattataagagccacaaggtactatgcttttgcagatagtttcgatcaatagtgctacatatttcttgtctatatatgaatagggcctcgctagcactatggtcattagttactacagacaggcccacagctcaaaccatacaccatttcttgtactttattttaagcagtaagggctcacctgttctatctataaactacctttccaaattattaagcagttttcttttgcttcttgaagggaaacaccaatctaactggctgtcctggactatgtaatcatctgagtaatcctacacacttaacatgggtactttccctaactcccctcagaaacgttctgttgtattttgaatgaatttcactcacaaattaaactcaaatagcccatcaaaccatccgaatcagcacaaactgctaggttacgaagtccttgttgacgaaaacacgtgcatactcatgatcacggttcatcatagtaagtccgagcacaagattgactattctaatcttattactggggctcatcagcccggcgcactcgctcgatgctcgcggaacaaaccctaaaattaccaggagagcgtcgaggcttgcagatccagcagcatagcgcacagaagacatcgaaaaatctagtacgcacaagcaaatgcagaaggggataatgaggcgatagagagagaagggtacctctcgagcgcttccctccggcggcgcctccgttggccgtgtccggccgggatctcttgcgggcggcgccggctccctccatggcgagccttcgcgcggagggaggaggagggaagggaggggaagccggtcgggggcgagatcgaaaccctagctcgtggttggcggagggaagcggaaggggaagcgaccagccgcggaatcgagagggttaacgacgagagagaggagagacgtagggaacggctggttcatatggggtagttgggctttgggcctccaccgagtcagatatttattggatctcgaggagagctttgtcttcgtcatgtcgtgtacgtcttgggctttgggccacaattcgtattggacagtgtagatcgaattttggttcgagatttcctcactgcgtagtttctcattgtctgccacttcactgcttgatttcttgaaaaaaaaaacaattcactgcttgtgaattgcgatggtaacaaactacttacaatctgattgataattgttgccttttcgggacagaaattcttgggctatcctaactcgagttttacattaccccaccattaacgcaagtatgccttccagatcgaaaagcaaccctctaaattcaattcagggcacaggctgcaacatgaacttgcccactgctaacactgcatttgtacttgcataatgtcgtcgatcaaattcagaagttacagagagttatttcacaaaaccaagctgtgcagtgaatcctccatggacaaaggaactcacatgctcctggccatcatctcctggtacctccggtacgactcctgcttctccagcaagaacttggcatggcacctcgcgatgaacctctccgcgagcctgtcgatctcgttcaccgcaccattgccgtcgccgtcgccgttgccgttgccgccgtcttctccttctccggcagccggcaatgcaccggccgacgtctcctcctccagccagcacaggtacccgcagtcctccccgtcgtcgccgccgccgccgcgcagctcctccgccgcgccgtcggccggaaccaccacgttccacgtcgagtcgtcgtagtcgtagtagtacgggtggtagtgcagctcgagatccttggcgcgagccggcgtgacggcggcggcggcggcccagttgaagcgcagcagcttcatgaagctggcgatcctcttcttgctcttctccggtctcgagcggtagccgatggcgtacttcttgccgccgccgcctctcgtcggcgccctcttcttgcggacgacgtcgaggagcagcgacttgaacttggcgagggcacggaagacatggccgacctgcgggtagatgtgggagtggagaatggaattgagcttgggagagatcgagctcggaagcagagcttccatgtgaaacaatggagccatggatcggggtggtgaatgcggtggagctagacggcgtgagctcttgggcttataaagcttacatgtatccaaataccaccatagttcaaataaattgcgacaataccattgcatagtctgaaactctgactacagcttacgtcgttttcgttctgtaaaactctgattactgaatacttgtagtcaaaaagaaaagtaaaaaaatgatgcactgcatgcctcatcggatgctttgcctgtctcaagactttggggccaaaaaaccttggctccatgaagcttttgttctgcaacagacaaatggagcactgaacaatgtcaatgattcagataattcagcaggttgttactgtttcatccgagcaatattacagcagtgcttgaggggtttagggaacagaaatcagcaaggctcaggaggtgcctgtcagtaactgagcatgcttccgataagtggaccagcctgctatgctctaggcccgtcgaagaagacatttcatctttgtttctgaatcttgtccccgcaatgtttacgaagatattagtacgttggttgtaattcttcaagtcaaaatattccctgaacatcgtttgttagcctgtcacgtgatagtcatatacattatattcatcttgatgattgatggaaaaaaagtcaaaattaactgaattactctgcccctggaggcatgcagagcagtgacaagtgctgacatgcatggagcgttccaagcagcaacaaagtaggatgaatgttacaaatcatcaattggagaatccgaagaaaacagagagtactggatgtatcatagctagtcatggtcttttcagtgtattcttactattctgacgacttaactgcctaattacttactccagtcatgtccttctcaaaggaaagagaagcgacgaacaactttctgtgagcaagcctgctatagaaattcagaaatacaatcgcagtacctgttggcacaaaaatggaccttaatctgttgtttgattctttctgcacgccactgactagctgcaatatggattagtactggctcacttaattatcagaaccgagctgggaacagctggaaacgaagcaaatattagtacatcaaattgtcatccttgcagatgatagtcctcccacttaggagtggcagaaccaaatcaagaaatcccatagacttctccacgtaaatgttgcgtggtatctcaacctagtcagtttcagtgaaggacagtaggacacagcaggagctccggtctaattctcttcccggttttgttgcgtccaagactcccaagttggtgatccatgagaaagcgcaccacataattggccatgacttacaattgttcagctggataacagacaagagagagatggagcgatgaactgtgtacgcacttgacatggatggtgtggatgatgcattcatgcacctggctgctcatgcattcgccgtgtgcatcccttgcagcagcagtaggagatagagatggtgtgaggcccagttctgtgtcgtcgtaggaatctagttgttgggatactttgcaaattgcaattgcaaaggaacagtgacacaccacgcgttgcatccgtggagaattggagatatgcgaggaagaagacttgaggaaatggcaatggcaatcattcgcagaggctggtgttgtgattgtaaccggaggagatcgcaggagatacacgacgtggactcgtaccggatcaatgtgctcatcagcagatcatgcgatcatgagatgatgcaaagcgctcgatcgctcgctcgcttgccgctggattggagcctgcagcctgtgtctgtgtgcggcatgcgtctgcgtgcgcgtgcgtaagtttgacgtgcccacttgcacggcgaggtgctggggatgagcgaggagaattccttctagaatgtcaataaagccgctgtcaatggtattgttttttttctcctattgccatattgatgtgtaattgcgcgtttatgaaaatttttcctattacgcgaaggagagaatgcaatggaggaaaaaaataggacttggatgcaatccgcttcgattttgctatatatttgtcagataattttttttaaagaattaacatatataaattaaataaagtataatcctactatgattgattttatggctattaagaaggtaccatattttctaatgtaaatttagtatctctagtactatgaggtaccaagttttcactaaaaatgttggtacctcccagttccagtacctctcaaagactgtaaaattactatcctgctatagttacattataacttgtatgcaccttcacatgattttaaactgttagatttgcttcaagatttgtgcacgcgagaaaggaaaaaatcacagtgcacacatgtgaggagagtcagttccacgatgtctgcttaccggaaatagtatgtttcctatgcaagttacaatataactccactataactatatactatagttacatctatcgaaatttttagaagaaatttgtcagtaataaatacataggtagtcctcgggccgtgggcctgcagggacacggagtatctagcccatcacgattcgcgtaggccgtttgggccatacagaattctatagtaatatagcccatctgaaatcagcagcaactgtcgttaggcccaatttgttttttttttttggtttaggagagggggatatgcggcggagcggagccccggtgcgtgggtggccggagttcactcctgttcacgcgcggcgcggcgaactaatcggatgcggcattgacaactgatgtgcattttttgtttctgcagccacaagaaaattactcggagagccgcgtgcgtctagttcagataaacctcgcgtacagtgcattcatcccgacagattggaacaacttggagacaggtgaagtaatcctccaacagaacatcattaactactcacaatttgccaaatcttcgataaaaccagggattaaactacgcccaagatgcagtgccagggattgacacaaacgcattttggctttccatgtcgtttttgaagctgagtcaaggcctaaatccacgggattaaacaaggttcgagccttcgaggagccaatgaggcgagcatgttctgctgccccttcagggtttcagaagacgagcttgcgaattccatccccctccacccacgaagcaccaaccggcgcgcagcaaaagaccagaaaattaaagccaggtatatgtatatcagtatatgtatgtacatacctatccagataagattctttcttaatctttccacgttggcacaccagcatgtccaaatctgcaactgcataagtattgtcgttgatcgaattgacgaatcccattttttatcacctcttttgtcagactcctgtaaaaccctgaccaacttgagcatacagagttcagctacatgtatactgtatatacagataacgattatatgtgtgcgtgcatacagttttgatcgattgacgttacgattgacagtttcacaattgacagtgtccgtgtctgtttttgggtaggatcaggaattcaggatgacagcttcgaccttgatttctcgttcttgtttctgatcagggagattccaaagacaagagtagtccaatgctcatcaaacacctgtatttcttctgaagggatgtgtggacccggtagattccccataacactaaaaaaaatatggttagaagattttattatggtttgactttgtttttagttagggatcggtgcacaactttgctcaagaaaattatttgatctgtcagttgtactagtgcatgtaatttctgatacccctgagaatgtcaaagctgatctccatctattctttcttttcaggagaacttgttatcaggtgaagcggtggtgaaatgccaacgtgtaaattcaacacaccttgaaaattttgattactagaatcttgcttcagtacagcatcctcctaagtcctaacaataaaatgaaaaacatctgattaaaatctgcattgataaagggggcctaaaatgactgacgatgcagatgtgtattgcaacttagaaggagtgagatgatatggacctagaagtcatcacttagatttgaatttacggatgctagtcttttttaaagatgacaggatcaaacgagaaagaaaatggtgccttatacgacaattgaattagatgaaacaaaaaagcatcgatgttatcgtgttaacatgtgatgacttcctatggcatagtgttggtcctatgaagtgcaagcttttcctttagtttgcacttcggtgacgatattggatcaccgatcaaatgtgccgtcacgggatggatagtcactccatgtgccctatgtgtgcacaggagcagaaaacaaccaatcatatcctgttggagtgcgtctttacaaagtaagttttgcacaagttactggccaaggtcggactgcccttatcttcgcccagtcgacagtccaccccccaagtccggtactctggtgggagtgcactcaccggtagctgcctgatcaccttaggagaggattcgactccttcatcctctttgttacctagaatatcatgttggaaaggaatgctcgtgtcttcgatgggttcatctcccaggtggatagagtggttgatcgcatcgtgcaagaataaaggatctgggtggaagcgaagccgagtcctcttggagttcttcttgtccatagtcctttttcctgcctttttgcttgttcggggctggttttgcctagcttaactggtcattgatccccttttctccccgtttaaactccccatgaccgctacggtaggtcacggttgtacaaactttttccttgaggaggtaccatgaggtactattttttctattataaatttggtacctcttggtacctatgtactacgaggtatcatgaggtactaaaattttggtacctcgtggtacctcctcaaggaccgtagaattgctctttctaatatattagcgtacaaggctcttgtgcgttcacaaaaaaaaaagatcagtttattttgctgctgatgaagttactgctctattttgactactttgtctacctcatggtgacacagagagttgtttacttgattatctatggatctaaaatttacccgcttcgtttggccaataaacatcacgtccaagaagattcaaactagaaacattgtatgattcgtcaggttatctacccttgttgggacatcaaaagacaagcaacacacaaattatggagcatagagatgtcccctctgatcctaactgtaatatgtttgaagcttgcaaattatgttcagctagagctggagactaaaaagaaccagataagcaaagaaaatgatagcgagggtgagggcaccaaagtggctatttgtcaccttagccttgtccgacatgcgagataatttatgctctgctatatatatgtagcagttggatttatatacatacacatatatacatctctttgcatatttatattcttgtcagttgtttgctgaggcccccactgtgagaagttcatattccatttgggattatcaggactccttcagattattccaatccttccctgcatacagaaagtgatctagctgaggtgagatcagagagagagagagattgagctggttttaccaggaagtttccagtggtgtttgctttgctgcacatgtgatgcccttcaagttgtaagttcatctcaaccatgtgtgtaataatgcttactttttgccatgcattgcattgcgtcctctccttctccggcggctgctgctgctgcatggtgtgatggtggtggtggtggtcgtcgtcgtcggctgttttgcgattctggagattggttttgtacttttgtgcgtatccggggacatgcaccgccgtcgaattattctcgccgttgttgcgtgccacgcctcccctccttccctccctgcgaatataggccggtgcggattcccaattaattcccattgatctatcgtatgtgccactagcttcccgttcgttcgatcgagagcctatttaagcttcgccgccgcgttaatccctctttcctcctccaaattaatctcatcctaattctgttttaatttctggtgggaatttcgctgtttgatctggcctcttcacgtaaccgtaatgttctatgtgtaaattgaattaatggagttggttgtgaaatcgttgaattgatggtgattcggttgttgttagttcagttaaatgttgcaagatatcatgaacaccaagaagattaagctgcacgactgccacttcggctcgccgctatgtgacccttcgccggcgccgcacctgctgagctccgccgccgccgccgggctgtcgttccacccggggctcgtgagctcggcggcgcagcaccagcagcacggcgcgggcggctggctgcacgaggagtactacgcgccgaggtcgtcgccgccgtcgtcgcttctcgcgcagacctgcgtcggctccaacgcgaccgcgttctacgccgccgagaacctgccgcagttcgacttcccagctctcggtacggcggcggcggcggcggccaaggcgccgttccggtcgtcggagagcgagctgtaccggccggtcgacccgctgctcctccgtgcggaccactcggtgaggacgtactacgtccggccgcagaagcgggattccggcgagaggacaccattgccgccgccgtcgcagcaacagcatcaggacagaatccacgggctcttcgccggcgctcccaccactcggcttctcagcggcgaacccaaaatccactcgtttccacctcaagtaagcatggaacaatcatgaacagaactctactaagaattctactgtttgtctttaattcttttctttgagatgcctgtgaatttttttatcgtaatctgaaaattaactccgatgaaggtggcggcgaagccgattctgccggcgatggatgcgccgagcctgcagaaccagatggagaatcagctgacaaggaactgcatcggcgcggcaactccggtgacccccaccggaaacctcgccggatcaggtgcgccgagcaagacgcggatcaggtggacgcaggacctgcacgagcggttcgtcgactgcgtcaatcagctcggcggcgcagacagtgagtgttcttgatcagcaaaaaacaaaacaaaaaaaacagagaagcttttgtcatgcatgacgatttctcatggcgcatagttctttcttcttcttgcatgcagaggcaactccgaaggggattctgaagctgatgaattcggatggcctgacgatctaccacatcaagagccatctccaggtaactgaaactctgaaactggaaagcagggtcacttgatcaactacacacgaacgattttaaacagatgacatagatgtgtaaccaaacagatatcgtattaatgtcgatttgtagctagggattggttgatctagttgaagtttgtttaataaacgagctgtagttatctaacaattttctctcatcttctttctgtgcagaaatatcgcatagcgaagtacatgccagcgtcatctgaaggtaagccatcacaacttcgttactgttttttttttttttggttgggagggggggggtctaagctgaatcctgaaatagagaagttaatcctccattagtagcagcatttgtaagagataagcataaattccagatcccctgagttcaggaggatctggattcgttcgttcgttgtgttgctttattctaggtcatttcaacgccgtgcttttatcctactactgttgtttggtatgcttcgctatccattcatccactgacacatgtcctcattctgctgctatactgtcgaattttttcagggaagcaactggagaaaagagcaacaggaaatgacatgcagaatctggaccccaaaacgtatctctctttctctctgtctgctagtagtaatagctttgcgaaccagtcccaaatcccaatggagtgcaagtgctgctagctatctactgtcaaatcatgcgtgcatatattaacaagaatcgcctttttgctgtagtggaatgcaaatcacggaagcactgcgtgttcagctcgacgtgcagaggcgcctccatgaacagctagaggtgctagctccatcatttgccaacactttgacactagatactttacaattttcagaaaaggaacggcttaattatatagccatcattgataatcatgtaactaacttctttatgcctgaattttgtgtgcctcgctagattcagagaaatctgcagctgaggatagaggagcaggggaagaggctgcagaagatgttcgaggaccagctgaaggcgagcaggagcgtgatggaaccgcaggagctggacgacgtcgtcgccttcgccgccggcgacggagacgacgacgcgttcgatgacgtcgacgtgcagctgctggccgtcgctggcagcggctatgacgacgccgggttccagtccaaaataagctaggacagccttttttgcgttttgtgttttggcactttgatttgacaaatattgttctggttcttcgacgtatgatacgcacaatgctattttttgcccgtgtagttggcgaaagtttcaaaaagatattttaagaaagagagtgggatccacagattcgcgcttaatttttttttttgtagctagtttgatcagagttgtaaaatttaggctttttcaattggcctgcactgcatttcttaatggttttagttaggtcttagcaggcaaaaaacaggttaagttcaagtggcaatatattgctcatgtcacattcacatatgggcttgggatgctctacgtgtaccaccatgacaccatcctacgcagaaaaaggaaattacaaaatggatatcaaccacagaacgcaataatgctgttgtggattgtctactagataccttgaattaatttgtcaatagttaagaaataagaccttaatgatttgcacttaactttcagcagcaacctggactgatgttcaacagtagaagtatcatcaagaatatggacatggtcctcacgcgcatcttcataatgcaagcaccgaaatgctctccttttccccttctttaccaaaggggaatgtaaagataaatcagcgctggccttaaaagacatacaccaatatagggggcacacattcaataaccaagaggtcgtgaatccattacagctttttaaaaagttcaacctggcactcaaataaaaagcttaactttacatagtcagccaaagacattttgacatttagaaactaacgctacgaattctgtagaggttacaccaaagtactgcggcagtagccactacgtagaattaaaattacaggctaccacaaataatctggttttctctgacaaacttcataatccagagcatagaaaagatacataagctagctgtccatttttttgtcaagaacaccatattgtaaagttaggcctatctggcaccactgcaatcctagatctgcatggacaggtaacagaacagaacgaaacaaatcaaatcaatttagcagataatagataaatctctgatgtactagcatcatactgggaatgtcaaactagtagagaattaatattttatatattgtaacctaacaaagaaaaattttcgccgggtgtaacctaacaaagaattcagtggctatggcacttgacaaaggaaaactaaccagttaatgaggatatgctatgtttccttaatgaagtggtgagcaagcaactctgataatccagaactaggaatgctctcgcagccgaacagctcctgaagttttgagtcacataatattgatccagtaatagcatcctgtgtaaaatcagtaaatgaataaaaagcacatatcagttggccaactttaaggatcacattctcaagattggaacgattacaagggagacagaaagaacacaactttgctaagatacttggcaggttaatctagtaatctaggataaaagaataaaacaagaattacactggtagtgcgtaacagatatccagtaaccgtgttacatatcagataagctctgtaagcagtcagcttcccccccccccccaaaagacagacgtagtaataaaacgttagcactttaacttgacacaaaatacactatttcagttgtctctaacattaacaggaatgtggtgaattacaagccagcagattattcttcagtctctgccataatactactattgcttatggacaattataactatatataatacaatgatgtttcaaaacattgaaagttttccagcgtttgcagccaatacttagctccaacttgcatccatcagaagcaaagagcaaatcgatatcgtgcaacaataaatataaagttaaaacatattcatacctcaagttggtttgcttttatgtaatcccaaaggtacctcaaagcatcatcttgaggcactgtgccttccattccaataaacttggctagtgcatcagaaatcaccacagagggttgattaatcagaggcataggctgagtagctacattggagggcttaaatttctttgcttcccgaatttgatcctctgcagaaccaagaaaacataattaggaacttccatcagaacaaaacattagcagcgacatctagaccaaaagaagcagaagaacgtacttgggtcaagtggagttatatgtttcgccaacaatttattcatcttaaacatgtcagttgtgtcagttccaaaaaccacacgaagttcatcattgcagattatcttccttttgtcatcaggatcttgaagattattctgccgaatatattgccaaagctgcttgacaatctgaatggaggaagcaagttactttgtctcggttgattcattaaagagtttatcacaggattaaattggatgccattttctctaatacaattggggaaagctgagattacctgagttcttgacatgacagtctcaccaacaatagtctgaagttcaggtgagattgcacaaactttatttaaaccaccaggcccacctcgtttccgctttgaagcactagaggaaataatacagatatgataaaccaatcagtttgcatgcatgagtaaattccacaggtttgaatcaatgtacaatccaaggacacatgaatctaatggttaaaccagtatatcttcaagcagaacaaaataacctttatatcagcttcaaaatagattcagcgtgacatttgcatattatccagtgagaataatatcatgcgataatacttatatggcctaagaaatcttaactgattgtgaataagaaaatgtgcaaaaactaagaactataacccatataacattgagctctgttttggtatacaataagtgggaacatatttctttggttcataggggaaatacactacaacaggtcaacagtacaagctatacagtgtacagaatcccatcatgaaaaatagatgtagcatacagatccaatgaatctaatgttaacgatcatgttttttttattacaaatactatgattcatacacatacaagaaaaagaaagcttttcaacatactaccaaaggacaaaccaaaattaattgactgtaccttttgtttgcaggatcaaaatgtcattgtttgaaaaaagagaaaagttcacgctgagcagtctgggcagaaaacagtatccagacaggggggaaaagcaggaagttctatttagtggcttgcaagaaagctgacgattccacaagtccaaactatcagattcactacttaagaaataaagcaagcccaatttagcattttgtacattctaggataacagctgtaatatccttcaagcacttggtaccacaatcaaacaaaatacatataaaacggactattgtgctttttttttaattataaccttctgaagctcaacacagaatacaccagtcaaacaaaacatgcctaaattccactatattcgaccagttaactaaatgagatagaaactaactaacataactacaaatggatggttacacaaccaacatagtatatggtcaaaaagtagataccaccataccggcatcccaagcatgtgtcctaaaagctatagtgtatataaattggtgtacacgagttggaaccaaaatcactttgctaggagactgaaccctaaaccctaaccccactcagctagaggtgccaattcacgagtgcaaacaggtaatctcaagtcaaagtcattattattagcagccctaattaaacgaaacaaccaactaattgtccaaccaaactagatttaagagcgaatcggaaatattctgcccatatatatctcgattcgattgggggaatgaaccctaatttcatccggtggctcacctttccttgttgtcgcccgcggcctgtactgcggcggtgggggaagcagtgccgccggttccaggggctggctgctggaaggagacggtcccaccagtggcgaccccagccaagccgctggtgacgcggaaggccagaggaggcggcgggtagaacgccatggccggcacgggaggctgcggggagaccgccccagcggcgccgcctggtacaccagcggggagctgcggcatggcctggaatatgagctggggctggagcaccgcgagctgctgctgcatctgctgcaactgcgcctgcacctgcacctgcggcatggcaggcgcgggagcggcgaccagaggaggaggattaggagccgccgccgccgccgcctgggccttggcgacgagcggcggctggaggcgcgggccgaagaagaggtccatctggtcgcggatgaaggtcgccttgtgtgcgaggtcgacgccgagcttggcctccgcctgcgacagcacggcggcgagcgaggcctccccggcggcgccccccgacgagcggaggacggactcgacgcagctggcgatctcctggtcggacaccatggcgcgcgggagggtgccaaaactcaaatctcgcccaaaaaaccctcccctccctcgcacgattccccccccccctcccccctctctctctctctctcccctctcctctctgtgtctctgccgcctggtctctctcccctttgtctctctctcctccggcctctctctctctctctctttctctctcctcttggggtctaatctattgttaagcagaggggagcgtttcgtcggggaggggaggaaaagatgggaaaaggacaactcgctaaggttaccttagatttgttaccctaatgatgacgggtggggacatggattggataaggttggctatgggcccacttgtcatgggaggggctaggtacgaggcccgtgcggatggaaagtctgcagacgaggagtcgtggaattacggaagtgcccatggttttggatgcggttgttgagtgggtgagggggtgtgcggtttttctgcgctggtggggtctccatggacgtctcttcggctccggggagtagaagggatcgtggggcagagatatcatgggctcatgggctgatgggccgggctaaataatgtcaggctgcgccttgcctgggagtgacgggccaagaaataaagtgttcttaaaaataaaattccacatatatcgaacatgattttagtttcaaaaaaataactcgtcattttttaaaaaataaccaaaaattttacaggtgattttttaagaaaaaaaacttaagatgaattgaagtttgttacacgaacattggatcttactgattatcattttcatatgccatctatgtcaaactaatatgtggcattgcgactttttttttagattgcattgtgaccttgaaaatgtttttcttatcctaaagccacgaggcataactaggtcaaaccttaatattgaactcatagtcttcaatcccgatgagttgtttattagcgtgtaacacacataaatatgttcattgtctcgcgttatatttgatacctaacttacttttgctgtagtgatggcacatccttgtataaaccatccttacttttttatattcaacatttgacaatctgttttatttgagaaaattttatggttagtatttttatttttagtatatgataaatttgaatagtattttatgtctgacttattttttattttttataatttttttaaataagacgaatataaactcacaaccacatttaaaattggatgggagagcactgagcaacacgattacatttcgcacatggttgttgaagtttaagtgaaaaatgaataaatctgagatataatcgaacctctgaaataactggaaaatagcgtaatatattaaaaagagtaaaatacaccagcggtccttaaacttgtcagtaggtttcacttaggtccacgaacttgcaaaatacatatcgaggtctctaaacttggtttattatatcatctcggtccaaagccgcatttgaccgtggtcttgcctac

SEQ ID NO: 42301 - DNA, 10834 bp, Oryza sativa
  unsure (1)..(10834): unsure at all n locations
gtacgcaagaccacagttaaacgagacattggaccgggatgatacaataaatcaagtttagagacctcaatgtgcactttgtaaatttgtggacttaagtgaaacctcatgacaaattagtaccgctggtcaattttactctattaaaaaacagaatactatacaaatcgacattgttattttatttagagtattaaccttgatgctaacctaacaagggtgggcgaactagcataacaaccgtatcatgtgctttaatccgcatcaaatcatcctcgagctagagagattagccaagaagataaaacccgtctaaaaaccccccgaatcctcaaaaccctaggaggagagcacggtagatcccccatttccctcctcatctccgacgcgcatttcccccaaaagaggggagcaaatggcgtcggcggcgtgctcctcgtcggcttccgccctcgtccgcctcaccggcccgatccatctgtgcagcgccccgccccgtgggtccgcgcggcggcgccacgcttccgtgcggtgctcgttcgcgccggtggagacggcgaggataaaggtcgtgggcgtcggcggcggcgggaacaacgctgtcaaccgcatgatcggcagcggcctccaggtagggcgggcctaaccttcttgacggaactgggcttcctcggttggcatctagatccatttggtagttatatttgagcataggactgatgaacaagttgatctacgactttatttccgtccttccgtgcaatcccatgctgccattcgcgtaatacccctatctagttaagcgtacgagcacctttgttgggttattattcgctattaatgctggtgtccgtggtatacttatcatacttttgaattatatcagcatctacgaaatgcgaacccagtgcattgtttagcctgaaattccagcatgaccgttgtttgttttctcaaatagtaacatctggactgtacaatttcagggcatcgaattttatgccataaacacagattcccaggcgcttttgaattcgcaagcgcaatacccgctacaaattggagagcagttaactcgtggactaggtaatatttgttgttctctgctgaactgacacaattatgaaacgttctgtatgtaaatgttacatctttcatgctgattagtctgcctacaagaacatattgatatctgatggttgtctacgatgtatcgataacatgattcacatgtctcgatgcactaataaactgtgggaaatgtatgagtatgacatattttaagggcagcaaatttcgattcaaaatagcaaaatgttgactgcagtcgctaatttattccatgcatacaggtactggtggaaatcctaatttgggagagcaagctgctgaggaatcaaaagaagccatagccaatgccctgaaggattctgaccttgtcttcataacggctggaatgggagggggtactggatctggtgctgctccagttgttgctcagatatcaaaggaagccggttatctcaccgttggagttgttacctatccattcagttttgaaggacgcaagcgctctcttcaggcaagtgtttgagtcttctccacccgtatacaattaatgtggcgttacatttgataaatagttttggttaagcatggaacaaacatttccttaggggagctgtgagttatttaagatgatgattaaacacgttttaatcattggactggtagttataatgtgccaacgtatggtacctgtgttttgttgttttttcagttcaaggtctggtgccctgtcctctgctagctcttttcaatttttgtagcagaggatctttagaataatatttagcattttttaacgaagtaatatttgtttgagttgctgttgctatacacagtttgtagttatttgccctatgtgaacccatttggttctgttggactttagtttctatacactagctgtttgtatttttcttaaaataattgtctgttaaaagctgttttgcttttgtctagctaatttatctggtctttctccatttcaggcgttggaagcattagagaagctggaaaggagtgtagacacacttattgttattccaaatgatcgattattagatgttgttgatgaaaacacgcccttgcaagatgcgtttcttcttgcagatgatgttcttcgtcaaggtgtccaaggaatatcagatattattacagtaagtattcttcttatctatgctgctgtaacttgtgatcacacaatactcatctgaaaactttgcagatacctggacttgtcaatgttgattttgctgatgtgaaagctgttatgaaaaactctggaactgcaatgcttggtgttggtgtttcttccagcaaaaatcgggcccaagaagctgcagagcaggcaacacttgctcctttaatcgggtcgtctattgaggcggctactggtgttgtgtacaatatcactggtggaaaggacataaccttgcaagaagtaaacaaagtctctcaggtgcgtgtaatatttcttgccattgtcttgaactgtctttgaagaagtatgatatagcactgtaatatgttaagtcgaaaaacttaagatgctattatcacgatcatactccacaatttagggctactggaattatgtggcctaggtgattgaagtgctttgttttgaccaatgcttatgcacgttttgcagattgtgacaagcttggccgatccttctgcaaatataattttcggggctgttgttgatgaccggtacactggtgagattcatgtgacgatcattgccacagggtttccacaatcctttcagaagtcccttttggccgatcccaagggtgcaagaataatggaggccaaagaaaaggcagcgaacctcacctataaagcagtggcagcggcgacggtacaaccagcgcccgccgccacttggtctcggaggctcttttcctgaacacggttcaataggaaaactagtagtttgtgtaccttagattctcatggaattactgagttggcgctccaatcaggcttctatgtgttattctttttggatatgtaaacacttaacagttacacatagtgattagcttcacttttattgtatgtatcatctagatgaggttgaggtcttcaggagttcagcagccgtcacgaatttttattgtatgttcaagacgacacttggtagttgttcgttgtaggcgcgacttgctggccaaatctattgagttgtagatgtggatgaatttgcacttgattgatcttgcatttttactcatacggagacgccacgtgactacatgatcgctctggtgtcttgagaaatccatttattcattcttgttggatacccagaggccagatgaagggcctgtttggtacatctcagagtttcagcttcatctaaaataggagcgaagctaggtagagctctctcacaaaataagcggagctggcagttggagctctaccaaacaggcgtaggcgtgaactattccacccagtgacttccacaggtgtgcttacccggcccagcacgtctgggctgcgtcaggccatgccgttttcttcactggcccatacataagccatagccacagaaaccagcgattagtaccataccgctgattcggatgcagaacgctctcccggaacagtataaaacaagtgccaaggcagctgttgaaaggcaggcagctgcgcagtgggcacaaagcgaactattctttcgccttttactaaagaataccgtgtgctcgctgcaaatagcagcatactctaattttttgaggggatttccagcatttggagaaccccaacaattctgaaattgaaattagaccttctaatttatatgattttcaccgtgatttgacctctctggcctagcacccctgaaccgaaagcagctcctttgtcccaggagagctcctttatatgattttagtttggatgacaacaggagagttcctttgtcccaggaacagggctcttctgcactctactctacagtgcagctgcagttcatatctcaatgaggtagattggtcctgacatctgatctcgacataggtaagcgatgcatataacgagttgttcatccaaatttgtgaaggtgaattgatctctagacgatttatagattagatagtgttggcaagagaaggtggtgatgaccaaaggggagacgattgaccttcaagctcaacgctgccgagtttattgttgcgtgcggcggcgccgtgagcccatgacagacgggaggcttggatgagtaatgagcgggaagcaagtgacggccagggtgcgcgcggcgcgccggcgaggcacgccatgatgcgctggcggcgtccttgctgtgaatgggggggggggggggggcttatcaagaaaaaccacgtttcgatcagtctttgtgcggtgcagatgatattttggggcgggaagttgtattgtattccatgtatcttctttgttactctgtacaagacaccattctaatgttctgttgaatttatgtgtggacgaacttgtattcgcttgattttactcgatgcagaaatgctagagaaatgatccttctgttatgtttgaacgcagatgagctttgcctgaacatccgtcatccggcccagcaccagtgggctacctggcagtgaatgtcttcacccatattggcccatcgccgctgatggcaaaggtagcagagcagccaccgattagtaccataccgctgctttgggtgcagaatacttccctcaaacagtataaaagaagtgccgaggcagccgttgagaagcaggcagctgcgcagtgggcacaaagcgaactattctttcgccttttactaaagaataccgtgtgcacgctgcaaatagcagcatactctaattttttgaggggatttcctatctaaggacaaaccccaacaattttgaaatagaaatttgatattttttttcaaggggtttcctgtctaaggagaaacctcaacaattatgtatgaaatagagaattgacgtcttacactctttctccatcttatatacagttgtttacttcgtcaaaatccacaagttgctgatagaatcctttgtgacgttacgctaaaaacacttcagcaaactgatctgttctttgagtactctggacggctgtcggccctactcgttttgggagataaacttttggattaaaatgacatgtttttcaaacggttaaagggtgtgtttcgtgcgaaaaatttctatatgaaagttgttctaaaatatcagattaatccatttttcaagtttgtaataattaaaactcaattaataacatgttattaacaccttattttacgtgaaatacttaatctttatcttcatttttagaacattcaaacaccaccaagatttgcatgctttagctgagatgacagcaagaggtatcctttgccccagcccccaggaacagggctcttctgcaccaacactaggcttcagttcacatctcaacgaggtagcttggacctggcttctcggttgttgagtatataactagttgttcatccagttttgtgaaggtgaatgaatctctagacgagttctagattggacaatgagctaacaaattcgcttcttccccatcgttgtcaggagaaggtgatggtcaatcacctaaggctgccaggattgttggatacttggatgcgtgtgacatccgggagtcttggaggaagaaggagcgggaagcaagtgacagccaggatgcggcggcgctccggcgaggcacgccgtgaggaggtggcggcgttcttgagacgagtgtgggagtcggagttttaaactccgagcccccttggatctctaacgaccgttcgatcaggcttctgcgccccagattaaccgaaaattattcaggggcttcatcgccaactaaacggaggcccattatcttgaggcggagtgggggcaaggcccacttcagtcggccgaaacgaggcccaaaattgtgtggcggaatatgaggaagagctctcgtggcaggtagaagcgattagtaccataccgctgctttgggcgcagaacacttcccagaacagtataaaacaagtgccaaggccaccgttgagaggcaggcagctgcgcagtgggcacaaagcgaactattctttcgccttttactaaagaataccgtgtgctcgctgcaattagcagcatactcaaattttttgaggggatttccaggatttggagaaccccaacaattctgaaacaagatttgattacctcctgttcatctgttcgtaggcatggtgatagatacgcttctaattttgcaggtcttaagatttcatcttattccctctctagtagagatacaactgtccattattcacaatccgatgtgctgctggcgatctgttccatagaaccgcaatgagagacgttgcaaaactaaaatcagaatcagaatctgctgtgacttcacacgtattcgctatactggttcatacaggtctagagcaaaccgatttgattggttgtaggttttagtactctgaaatttgcagctcaatgcttcagttaagatagcaacacaggtttctcctgtgtccaagtagcagggctcttctgcaacctacagctgcagttcacttctctctctctctggaaagatgattgcagttcacatttcaatgaggtagcttggtccatcttggcatgtgtaagtcaatgcgtacaactaatttttcatccagttttcgccgtgtttagttacaaagtttttttttcaaactttcaactttttcatcagatcaaaactttcctacacacaaacttccaacttttccgtcacactgttccaatttcaaccaaacttctaattttgatgtgaacaaaacacagcctttgtggatgtgaattgacaacttctagattagataatgtgaatccatttttaaagtttaaaataattaatattatatcaatatacgctaatggcccatctcgttttacgtatcttctcaatcttccaatattctcgctatgattcttggggaattagagagttggcgttccaatcgggcttctctgtgttatttcttttggacgtgtaaacgctgaacagttgcacataatggttagcttcatttttcttgtatgtagttatgtaccatctagacagggttcaggccttcgatcttcaggggttcaggttcagcacgttgtgctcaagatggcaccaggtggtagtagttgtattgttcgttgtaggatgggaattgctggctacctttcgtcgcatgagacataacactgttctatcgaattcatacgtgtcatccctgtattcgattaattttactcgatgtagaaacgctgcgtggagaaatgatcgttctgtttttctcgagacttctatatgtgttggatacgcgacaaagcccactagcgagcgagggaaaatattggcattttgcacttctctcttgggaataagttcacttagcgactctcaaaagtaatcaaaatctaatccgtgaccctaaactataaaaccggatatcccaacccccaaactcttaaaaccggtgtaatttgactcccttggcagtttcgaagggcgattttgctgacgtggcgcctacgtgacggtattgaccgggtctcctctacacgtggcattgacgtggcgtttaaatgtcatttagaaattaaaaaaatatatgcaggacccatttgtcattgacacccaaaagaaattgtgggacccacgtgtcctttctctctctcccctccctccagttccttctcctcgctgctccctctctctctctcccgcggcgggcggcgagcggcggaggcatggacgtggcgcggcggcctgcgagcagcaggaggacggcggccggcgacagcgggaggcacacgcggtgcggttgacacgacgtcatccaccgtcaccgtcgccgcccaccgtcacgcgacctccttctccacctcctcgcttcatcgccatccgtattaacatcaaatagttactgctaactcgcacatttactggaaaaaaaactaatcttagcatagttgcatcacccctcatccaaaaccaaaatctactcctcacctttccatggacaaatcattcgcatgcataaaaaagagaaaaggaaagagaacaaaggaaagagatccccaaatgcaatgcatccaccaaaacctcccatttgcagcaagcaagattcagtgtatttgtgggacagaaagatttggcaagacgacagctactggcctaccgctgcgtgtagatgaccgccggatccaacgaagtagcagagcaagcttggaattgagaagaaaacatccttgtggtccagcaagggcgacgccgctgggcttgctcactgcctcttgctcgccgcggatcctgcttggtgcggcttggtcgggtcagtggcgaatctaggatgaaaatagaggtgatgctttatatttaaagtcataatacaaaataatcatatactccctcctttcatattataagactttctagcattgtctatattcatatagatgttaatgaaactagacatatcatctatatgaatgtggataatgatagaaagtcttataatatgaaatgaagagagtatctttgaactatatcaacaatattttaaaatcctgcgagggtagaaaatggaataaagaataaagaaaatggaataaagaataaagggagcaagttgattggaagatatatatataggtcatgggctgcagactgcaacagctactggaacacaagagtaaaaataatccacaatataattaatgattacaaatgatctattaaattttcgtgcacatcgtttctttcaccctgaacttctctagccaaagagccatcactgcttggccctttgctttttgctgtcaattttgctggcagtgtaaactcactaagcatagatatctagggtcgattcttggcagccagagcaggggctggagcccctaccagccccaacagtggattcgccagtgggtcgggtcacggatgacggctgttgcttgccaccgcctggctggcgtactgatgccgcagccgtcgccgctctagtgcttgccgccgccactcccgcgcctccgccgctcgcaggcggccgcgccatgcccgcaccttcgctactcaccgccgccgccgccgtcgccgcttgagagagagagggagcggcgaggagaaggaactggagggaggggagagagagaagggacacgtgggtcccacaatttcttttgtgtttcaatgacaaataggtcccacacatatttttaattctaaatgccacctaaacgccatgtcaacgccacgtgtaaaggagactcggtcaataccgccccataggtgccacgtcagcaaaaccgtcctctaaaaccgccaagggagtcaaattacaccggttttaagagtttgagggtcgagatatccggttttgtagtttagggttacggattagatttcgatcacttttgagggtcactaagtgaacttattcctctctcttgcccagcggcgtcaccagcccagcatcgttgggctgcctgggccatgcacgctgcgccgttttgtatcttgcctggcccgaatccacggatagcacacagcaccacgggaaagagtcgcgcaaccagtgattagtcccataccgctgccttggatgcggaacgatactgggaacagtataaaacaagagccaaggccgccgtttaaaaacaggcagctgcgcagtgggcacagagcgaactattctttcgccttttactaaagaataccgtgtgctcgctgcaaatagcagcatactctaattttttgaggggattttctatataaggagaaccccaacaattatcaaaatgaaattaaacttatttttatttttcctttttttttatgtctggtcacctaaattgaagcctacgaagggcctatgcagttgctcacgcatgttacgcagtactgtattgctgttttgctctcacgctgtcacgtgatatcagaattgttttactctcacgatatgtcgatcagaattgtatccaaattcacaactcgctgatggcatcccgatttgctggtgcagaggcgaatggaggttttgcttcgggtggtgatcagtcctcaaaacaagaccatctgtctgatggagtcagaatgaggcttgcaaaactgaaagtagacaaaaccgtctgtctgatggaatcagaatgaggcctgcaaaactgaagttagagtcaaaatccgctgtgactacactaatgttggctaatactgatccacagtccagagcaaactgatctgtttgtgggtagacagcgtagttttttagtagtaagtacaaagacatatgcagctcaatgcatgctttaagtcgagatgacaccaggagatcagtctccttgtcactgcaggaagtgggctcttctgcactcaaaaggtgcagttcatatctcaacgaggtaacttggtcctgacatagtgacatcttggttcacatcacgatgcatctaattaattattcatccacttttttttttttatctccagagtccagacaagggctacattagatcattccaacaacctctacaaatagaactctctaaatacccatatagccaactctccatctaatttggctggcnnnnnnnnnnnnnnnnnnnnnnnnnnnnnnnnnnnatctatcctctatactttgactctatgacaccgggacccatatgtcagcctctcccttctttctccccttccttcccct

SEQ ID NO: 42302 - DNA, 1900 bp, Oryza sativa
ggccgacggctgtggcgaggggaggcggcgggccgcgccgcgcgagggcccgcggccacggcgaccggaggcggcgggccgacgaccgcgacgagcggatgcggcgagcagtcgcgcgggggccggcggccgcggcgagcggaggcggcgagcgtcgcgcggaggccggcggccgtggcgagcggaggcggctgccgtgctcttccctgtgctcgagctcctcccaatgcggccatgcctcctcgtgctcggttgccgtgtgggatggaggatgggctgtgtggggcccactattggtcagccaaatagactagccaaatttggctagtgaagggagagttttggccagagccatccggttagagaaacagttggagttagtttttttagttagaatggctaaattttgacttaaagagtggaatggagaggctgttggagatgctcttagataatgtgtcgatgaaattgcctcttccaccattgttgttacttgtcagaaggtgatggccaaagggaagaagattcatctggaatctgccgttggtgcgtgcagtggcgtcgtggctaaagaggaggaaggagcggggagctggggacggcgagcacgcggcggcgctccggcgaggctagccatgacgcggtggcggcgtttttgctacgaacgtggcgttcggagttaaaaaccccgaccccgtcggacctgttacgaccgttcgacatgtcttgcgcggtccagattagcttgaggcgagatggggctcggcgtgtcaaacagaaacggcccaagaaggcccaattttaggatctctcccatcgatctgatccgcccaactccgatcggacggtttaagatcgacctgaatcggatccctaccatttggtgcacgtttgggcataagtcacagtgctagggtctcttttgcaaaattctcgtggcacttcttttccggaccgatctgacccgtctaactgcgatcgtacggtcagctctgagcgtagaacgccgccgccggaggcggcatgtggcggccgcgctcctgccggagacggtgccgctgccgcgttctcgccacgccggccacgctatgcacggcggaggagcactcccagggtatccgcttcgtgcgtgccgttaacctcgacctccgactctccgactcatcggtaagtcattcctcccctacctctccccgctcaccagctgctcgacgaaatgctcccctacaaacactggagtcccgaacgcgcatgcgcataccatgacatagtacagtaatctgatctcaactcttccttccacctagcagtatgcatgatgatctggtctattcatctgcgggaacaattcctcaaaacaaatgcacataactagttaaaaactgtatacgattgctgctacagatttccgaatttgatcctagcagcctatagatagattggatggctatccattatatagcgccgtgtgctaggtccaataatgatccttatttcttaagtgatcagttactaaggtgcatgtgcaaggcagcgttctcttggtcaagaccaatctgttgtgacttgaagcccttatcatgatatataattggataacaacaaaaaacccaattaattaagctgccatggtgagactgtaagagtgaaaagaacgagaactagacaaatgggccaggctacgaatcgaagctatgattcatcaaatagatgctagtcaaggcagaaagatacaggtacatagagaattagatgtcagtcacccatgctgataaagaatgtctccatgttccctatatataggtgtgcaggagcaccaaccgaccgaatgcttattgtccatagaaatcctgatgcgttcaggcaaaaacatatcttgcctcgtaatgtgattggtgtc

SEQ ID NO: 42303 - DNA, 5827 bp, Oryza sativa
cacatattattggatgccatattcaggtctcagggcttgatcgtagtacaagtaatcacatgcaagctgcacgcagtttcatgtagcatgggcttcaaacttgtgaactacacaacatggcaccggggtccgggaacgacttgacctagctatgttaggcttgtgcatacactactaggctcgttttcatgtcgtcgctagcttgctagctaggccggctattagaccgtgaatcaaggtttaatatgatctattcattatgaaaatttgttattatagtcgtatcaaagattaatttaattacactcttttgacgagcacaacttatatgtgattagaagctacattttcttttctcccatgtgcaaaagattatcagacttctacaggaaattagggttgggatgggatgaaaccatccttgattttagggttgggatgattccactcgtgtgtttggtttgtagaatagtacgatcccagtttttttcttatttggttgaagggacgagagagggatgggatggacaccgtttgtaaccaccgatgacggccggccgggcgaaggagcgcgactatagcctggcaacaagaaggcggaggagaggcgtgagcaggcaaagcaaccatggccgccgtcgccgcctctgccctgacctccctctccaccaccgcagccgccgccagtggcaagcgcctcctcctctcctcccttggctccctctccctctccttcgcctcctgtggccgcgtcgccgttaggccccgtaggcgggcgtaggagcgcgacgacggacgggcgggcggatccgctgccaccgagtcccccgcctccagatctgccgccgcacccgtccccatcgccgaatccgccgccgccatccccaccacgggatccaccatcgccgaggcccccgctgccaccattgccgagcccgccgccatcgcccgagccgtttgcttcgctcgagcccgccgtctcctaagggcgagtcacgccgttcgctcatcccaggtgggacgagttcatccgccacatttggctggatcggttggtcccggatctgagagaaatattcttctccaggggactaacccatcccactcacctctaaactaaacacctctaaaagtgggttcgttccaacccatcccacccttgcaaccaaacactaaggagctaagcatgcatcatgcatcaatgagacaaacagtatagcttagccacctaacaaaatcagtatctcctgccttttcactggacaaaatgacaatcggccgttacttttggggtcacatggactctgattaataattaatcgaaaattgtgcaagggcataaagtaatgcgtgttagtcacttgtcgcattcgaatatcgttaaaaggtcgcattactgatagcaccatttttatatgcaatatgcttatcatcatcccatacttgatcagactaagcaaactaactgttaaacttcctgtataaatatgcatggagaccaccatgcttcacactccactccacactggcacactgcccatatccatctattctgaatagagcctctgcattgagttaagaactaatccgtttgactaattctgtttttgcacacaagtcgccataatcaccatgacaatggccatggcgtcaatgaagggagagaacgtcactgtatctgcagcagcagctcctcggatgaagaagctggcgagcatgctttgcatgaagggagggaacggcgatggcagctatctcaacaactcccaagctcaggtacgtacgacgtttccaaacacgagctttacagaaagcaggggcaaatcctgtgaaatgaatcactgggatcttaactagggaaactattctaatcgctcgaggggatgttccctcgtttgctcaaaaaccatctaaacggttatgaaaaattctaaaaaaatttgacaacattcatacaacacatatatacaacttcacaaaagtccaaactcaactcacacacgtcgagatataaaaaagacaaattcagcgtatgaatagtagcgtactgtttatatctaaatttgtcttttttgtttctcgatgtgtagatcgaatttgaacatgaattttggtggactagtaggtatcattatactttacattatcaattttttttttagaatttttcacaactattagcatcgaatttggaagaaaaatgtatacgagaggatatcccctcgaggtattagaatccactcctcttaactatacatttagcaaagaaaaagttaggatctgaactgaacccttgtgctctatgaaatgatcatgtggatgtttcaatcgtctaacacttgtgtttaatatattgaatatggctttcagttactgcaacaattttttttacaagtacaaaaactcaaaaattttctgaagatgtgtgcaaaacgacgagtgtttttgtcctgcacaagatatcagatgtagctagccatccaatatttagtcctactttactgtacaagtaaatgcatggtagttactataatacaggttaagaattgatagcgtcagtttttaactgtaaactggctataaataggctctgcacgcccggcgcatgcttcactttctggaggagacactggacgcgatgatggaacgttcgtccagcgacaagctcttcacggcggccgacctgggttgctcctgcggcagcaacagcctcttcatcgtcgacgtcatcgtccgccgcgtctccgaggcgtacgagtcccgcggccgcgacgcccccgagttccaggtcttcttctccgacctccccagcaacgacttcaacacgctgttccagctgctcccgccgctcctcgcgccggtggccggcagcctcgaggagtgcctcgccgcgggcgaaggcgcggcgacggcgacgcggccgtaccacgcggccggcgtccccgggacgttctacgggcgcctcttccccggcgagtccatcgacgtgttcacctccaccttctctttgcactggctctcgcaggtgccggaggaggtcggtgacagcgcgtcgccggcgtacaatggcgggcgggtgttcgtccaccgcgccacggaggccgtcgccgccgcgtacaagcgccagttccaggccgacctcgcccgcttcctgcgttcgcgggcgcgcgagatgaagcgcggcggcgccatgttcctcgcctgcctcggccggagctccggcgacccggccgaccaaggcggcgccggcctcctcttcggcacgcacttccaggacgcgtgggacgatctcgtccaggagggcgtggtcgagggggagaagagggacagcttcaacatcccggtgtacgcgccgagcctgcaggagttccgcgacgtcgtgcgcgcggacggcgcgttcgcgatcgacaggctcgagctggtgaggggagggagtccgctggtggtggaccggccggacgacgcggcggaggtcggccgcgccatggcgaacagctgcaaggccgtggccggggtgctcgtggacgcgcacatcggcgagcgccgcggcgcgcagctgttcgagcggctggagcggcgcgcggcgaggcacgcgagggagctcgtggagaagatgcacttcttccacgtggtttgctcgctctctctcgcgccataacagcatcgcaaacggatgcgtatagcagcatccgcatagtagtaggttcggtgaacccgttttgagtggttgcacacgaatttgctgcagctttctttcatttccttggcttccaatgaaacgagttctacgtgtacgtttgtaccgcacgtccacgtgcacagtgatttgtagttgtattccctctgttttatattatagctcgtttaattattttttagttaaatttgtttaagtttgatcaagtttttagagaaaaaaatatagtaacactttcaatataaaacaaacatattatctaaatatattcaatgttaaatttaataaaacttatttgatattatagatattgctattttttctataaacttcatcaaacctaaaagaaaacttagatcaagaaaaaaaatcgaacaacttataatatgaaacggagtactagtgagcatgcgtatttgaaacagatcgcttgattccatggttaaacgcaactacgcaaatatgattcacatagggaaattctggaagtgaaaaataaattcagcaaaaatattctacggaagaagcaattgctgtaccctctcgcagtcttgcttggcactgtacatgtattgtatggtgtgttggggagttctgtgactatacagcaaaatatgtgggtcaaagatccaggattatgcaatcgttctggaaataccatttatttgggaaatttggtcacgaccaaacagtaaattatcgtctcaaaccttacatttcacactgaacccggagaggcagagaattctctactgtttctaacttcacaagctaaaggaacatcaggaaataaaagtcatccgttcacgtgcttcagactaacatcttatcgcacatcggtcctctgtactgctcaaccaaataatgaccgacccttgtttcgttcaagccgagcctccctctgttaataataaaatacaaaggaaatgaagcatactcaactggaggaaatagtatgagaagtaaaatgttgtgatcattgatcaagcatatatagaactccttggtcattcttgtttatgatataaagaaagatttcgataggcattagtccagataaataaaaacattcttgcaaataaagctcatcccagcatctgaatatatttatgatatatagtcaagttaactttgctcgcaacttgcacgtaaagatcatataccagtttttacttgaatagatttgtcatgggcactgggaccagaggccgaggcccaagattatgtatcaaatatttaaacctgtacgccattatcgcttctctacataggtatttttcagactcaaatattactactgaatcagctaatgtgtttgagagagatgtaacaggagttcaattatcaactaacaattctgatgtagcagattgttgttcatgtgttctggcaaatattccatcacaaacaagaacacatcacagagaaattctaggtgaaagtgatgttttttatacaagcactaaaattgcacattgagggcgctttggaatcagaaaaaaaaaggtttaactcaggaagacggggaagatggagagactgaaggttcagatagacaggcataagatgacaaaatattcaggccacctagaggcaataattttatggtgagttcgtaatgggttcaataactgactactgtaaatatctacttctacggtgcaaacaattggttatacctgaggagaaaggaagtgtagatcaagtcaatagtgcttactagtctatggaaatcttatataatggcctcggatttttatcagcacatggaaggaggaaaattaacagacaagagcattggtaagataggataagaacaaaagcaatcacagtgataaaagagggccataaaattaaactctaaacagaaacagtttccaagcgtttttctggtgaaacaataactactaatgtttgtttgaaggattaacaatggtacacccatggagtcagggacgctcaacaatgtacttgttggtgaactgaatgaaggtgtggcacaccatgtcgcgctgccctttgggtaagcacatcctaattcttgctgtataccgagccattctacatctacacaatttcctgaatagttttgtttttttcaatatcatgtacagtggcggagtcagcgtg

SEQ ID NO: 42304 - DNA, 12419 bp, Oryza sativa
ccctaccccctaatgaatcattagtgtccccattaagaccccctaaaatttaaatccatatatctattgcaagggggctaaaatagaccttgtctgagattgttagaaggtccaaaaggctgagtagcccccactataattttattctggctccgccactgatcatgtaggaacatgaagagcatatatagtcactaatattagcaccacatgacatgatgacagtagaggggaattatcatacacgaacaggacaatatggtgaatatgccaatgccactggtaaggtaatcagggtcatctttggccaaactgtgccaaaagttataatttaggatccaccaaaagtgcttaaggcatgtggccagacaaaaaaccgtcaacaagaacagaaaacaaaacatattgtcttgcacgatcgattggggtcgtaaatcatacagtaccatcactatttactttagacagattaggggaaaataggataatagcaatacctctctctttttgcactccttatagtcgtcgaactgctgctggcacttgctcttgtcttggttggcctccaaacctgaagaaccaacacgaacagaatcagagatcaaccacacacgcgtgaaaatccgagctctccacatagtatgatgactgcgaagggggtcaaggaggcggcgaggagatgggggtagttagatcaagattaggacggatgcatcatacacttgagggaggcggtgtactgggggaagcagtcggagtcggcgatcctggcggcgctggggtacggcggggacgccgccgccggcgacgacgcgcggtgggtggggggcgccgtggctgccttcgccgtcgccatgatgccttcttcctcttcctcttcctctctctgctcagcgttgcggggctttggatttttttttcttttttctttggcctgaatagagtccacatcggcagtaatgggcagaaatatctatagacgttgggccgtgcagcaactcgttttgggccggaatccagcccaacacttgcaagatgattttttatttcagggagttgctaaccgtatatatggggaaaacttgggttcatttgttactcctaaagtcctaaagaagtcatttggaagagtggaatcggccaaagttaaacaattcttggcatgatatcatggttggttggcatgatatttagcttcagaacaaaaccttgtacaatgagctaaatatcatgcaaaaatgtagtacacgatcaaatttaggcatacgcagttttcagaacaaaagaagaaaaaaatcaatgactgtatagtgtatacacttccaatagacatcttgtgcctacagatagaggccattagactgtgtacaagagctgagtcactgcgtcatagataactatttctttgttgattactgcagttgaaatttcgtcgaagtatacgagatgttgagttcctccgaagcaaactactcccgagttgctcagaatatcatctgattagctgccatctaatcgataaggtgtaagcacgaaatagaaaagacggagtgctatcatattgacaaagcaaagtcttctacaaaagtattaaactgacctggacggcaataattttgcagtctcgtgcaacttggtcaataaaaaaattgttttatgcaacttttggttcctatatataaacgtcattcgtccatagcaattcaaacttcaaagtctcgtcctgttcatcttctccaatgtgccctgtgaacggaaagctgcagctgcacgatggcagaactgcctaccacttccagcctgccaagttctggcagaatggtaatgtacaccttgcccttattgttctatcattgtctgcttgaatcatggcgaagttcataacttgtttgtcaaatcgtgtttggatctctgaatttggatggacactgccgctggcgaaactgaacagatccaaatggtacgatgccccttcttcctcctccatcattttcttttcttccattatattcagtcattcagaatgagtccatgcacgaactcttcactcttgtgagcttaaaaacctgtaatcgaaaggtattagtccacataattaagcatattttaccatacacaataaagtttggatgatcattgccaatcatcaggttgtcttggtcatgatcagcataattgcccagtaatggcagtaattttccattgaaatggcagggcctctgtaccacaacggtttgtaccatttcttctaccagtacaacccgcacggcccgctctgggacaccggcaagctctcctggggccactccgtctccggcgacctcgtgaactgggccttcctcggcacggcgatcgaccccaccgacccgttcgatgtcaacggatgctggtcgggctccgccaccgtcctcctcggcggccgccccgccttcctctacaccggcagggacgccggcggcgtgcaggtgcagaacgtgtccttcgccaagaacccgctcgacccgctcctccgcgagtgggagaagcccagctgcaacccgatcatcgccttccccgccgacgtcatcaacaacaacttccgcgacccgacgacagcgtggctcggccgggatggcctgtggaggatggtcgtcgccgccgaggtcgccggcgccggctccgccctggtgtaccggagcgccgacttcctccgctgggagcggaacgccgcgccgatgcactcgtcggcggccgtccccgtcctggagtgcccggacttcttcccggtggcggagcacggcatcgacggcctcgacacgtcggcgaacggcggcggcaccggcgtgaagcacgtgctcaagctcagcgagttcgacacgcaccaggacttctacatggtggggcggtacgacgacgagggggacaccttctcgccggaggagcctgaccgcggcgacaactgccggagatggcgctgcctcgactacggccaggcgtacgccgccaagtcgttcttcgacgcgcgcaggaatcggcgtgtgcagtggctgtgggtcaacgagtacgacagcaaggccgacgacgtcgccaagggctgggccggcgtccaggtcacctcccgctcgccaccatgcacgccggcgacgtcgccatcgatctgattcggcgacgaactgaatatcttgagctgccgtgcaggcgttcccgaggaaggtgtggctggacggcgacgggaagcagctgctgcagtggcccgtcgacgagatcgagacgctaaggacgaagcgtgtcgggctgcagggcacggaggtgaaggccggcggcctgcacgagatcgtcggcgtcgcgagctcccaggccgacgtcgaggtggtgttcgagatcccgaacctggaggacgaggccgagagcttcgatcccgactggctggatccccacaagctgtgcaaggacaagggcgccgcctccgcgcacggcggcgtcggcccgttcgggctcatcgtcatggcctccggcgacctgcaggagcaaaccgccgtcttcttcagagtgttcaaacaccatggaaagtacaaggtcttcatgtgcactgacctcacaaggtaattgaaagttgaaactcctccaagccaattaaaacttaaaatttgtgacccaaacgattaccaatttttgcacaattttcgctgaaattgcatacttgtaggtcatcgacaaaagcagatgtgtacaaggacgcttacggaggattcgttgatgtggacatacagaaggacaagagcatatcactcagaacactggtaaaattctgtcactaaaatcttagttcttcagtacgtaaaccatgcgcatgaactgaaatcgaacgaaaattcagattgaccactcgatgattgagagcttcggaggcggtggccgagcgtgcatcacaacccgggtataccctgagcacgcagcaacaagcagcagtcacctgtacgtgttcaacaatgggtcaggcacggtgaatgtgtccaagctcgaggcgtgggagatggccacggcgaccgtgaactctgcagatgcattggacgcaataacgcgtagctgaaacgtcttagtatgcatggcttggctaattcgatcaatggttactgtgctgtggccgatcgattttatcatttatcattcatcagtcacacgaccttcaaggccatagcctgcctgtctggaggtttattgccttattcccaggataaaataaaggttgtatgttacaaatgtttgatcggttctcaagttcacacagtgatggatgttgctattgcagattatattactcttaagtttttaaacgaaccgacactaacaccaatttcattgaatatagtaggagagaggatacttacccgtaaaaacaggaaaaagatgttatatacagagttttttccgtaggcttaccactctatttataaggataagccaagcgaagaattgttaatctttcatttggctctgaaaattctaatcacctgcaaaagaagccgcttgatcgatcgagtgcagcagaggcaaatggatctcttgtgaattgtgacagccaaggtttagtcaaaagacaatggtggtaggttgatgcaccgaagtaaacaaatattgaattactcagcagagctgatctgattagcaccgatcacaggttggtccgcatgcttacgtacaaatatcgtcgcattttatatgacctaatggtcatcagcgattaagaaaacattagtgcgcacatggtggcaggtgcttaattaacatgtattaaactcggagacttgtaagtcttctcaaatttgcaaactctactgttttgtttgatagttttgctagctgctgcttcactctactgttcggccatggcgttggctggattgcccctctccgtctttgccatcgctgtccatttttgccttgttttctcctcctcctcttctcctccggtttgccctgcaaacggccaccgtgaccgaacggcgtaccacttccaacccgccaagaactggcagaacggtgcgtatgcaattacctctctgagtttctgtgaattcttgcccaaaaatactatcaattcccgttctctgatagtgtatactgtattttcatttggatatatctggatgaactgaaccatgtgggaacggatgaaaccaattagatccgaatggtacgtgttttttttactgatactctgctcatatttctgtcttcttcaatccatggtaatttgtaccttaattagggcgtagtgaccattaggttgttcttaatatgatcagggcctgtgtactacaatggcatgtaccacctcttctaccagtacaacccgcacggcgcgctctgggacgtcggcaacctctcctgggggcactccgtctccggcgacctcgtgaactgggccgccctcgacaacgcgctcgatcccacagcgccattcgacgccaatggttgcgcgtcggggtcagtcaccatcctccccgacggcgtgcccgtcgtcatgtactccggcatcgacgcccgccgccggcaggtccagaacgtcgcgttccccaagaaccctcgcgacccgctcctccgcgagtggaccaagcccgggtacaacccggtcatccctgtccccgccgacgtctcgccggacaatttccgggaccccaccaccgcctggctcggcagcgacggcctgtggcggttcgccatctccgccgtggccgacggcgtgggcgcgacgctcgtgtaccggagcgccgacttcctgcggtgggagcgcaacgcggcgccgctgcacgcctcgcgggacgcggtcatggccgagtgccccgacctgttccccgtcgccgagcacggcgaggacgggctcgacctcgacgcgtcggcgatcggcggcgccggcgccggcgtgaggcacgtcctcaaggtcagcatgccggacaccctcgaggactactacatggtcggacggtacgacgacgcggacgacacgttcaccgtgccgccggaggacctggaagcccacggcgatgactaccggcggtggcggcggatcgaccacggccacctgtacgcgtccaagacgttctacgacgcgggcaagaaacggcgcgtgctgtgggcgtgggtgaacgagtccgacagcgaggccgacgacgtcaccaagggctggtccggccttcaggtcagcgcgcccgtcacgatcaacatatacaatggcaacgcaatcgcaaccctgtgtgctcagtgctcactggctcgatcgtgcgatctgttttatgcagtcgtttccgcgggcggtgtggctggacgagggcgggaggcagctggtgcagtggccggtggaggagatcgagacgctgaggcggaaacgcggcgttctgctcggcggaaacgaggtggaggcgggcgggctgcgcgagatcggcggcatcgcgggctcgcaggcggacgtggaggtagcgttcgagatcgcgagcctcgcgggcgccgaccgcctcgagcccgaccatttgcgtgaccccgacgcgctgtgcggggagaatggcgcggcggtgcacggcggaatcggcccgttcgggctgctcgtcatggcatccggcgacctgcgcgagcgcaccgccgttttcttcagggtgttcaggctctcgcacgggtacacggtcctcatgtgcacggacctgacacggtaagtgtaaaaaaactgacatcttactcgggctgggctaggagaaatccccgtattttgggccaggccgcctgaaggctgaaacgtttagtcgagatctcatgtctgttcttgggccaattttctatttgtacaggtcaacttcaagagcaggggtgtacaagccatcccacggaggattcgtggacatagacatagagaaggacagggctatatcgcttcgaaccctggtgagttcacttcacattttgagcgctcacctgacaaacatttggcactgataacatgctcgacctaacgaattgggcagatcgatcattcgatcgtggagagttttggcggtggggggcggacgtgcatgacggctcgagtgtaccctgaacatgtagcaacggggagcagccacctgtacgtgttcaacaatgcgtcagatgcggtgaaggtgtccaagctggaggcatgggagctcgcgacggctagtgtcaatgctggagacgacgggctgatttcgtatggtggtcctgtatgtgctgctcaagtgcagtaatagctgctggcatatgctctatagtactccctctatttcgaaatgtttgacactattgactttttagcacatgtttgaccgttcgtcttattcaaaaacttttatgagatatataaaattatatgcctacataaaaatatatttaacaatgaatcaaatgataggaaaagaattaataattacttaaattttttgaataagacgaacgatcaaacatgtgataaaaagttaacagcgtcaaatattttgaaacggagggagtactctgtttactccagcatgcacgatggccattcattctgaacttctgataggaaatagccatcgattggacgcagtgtgtttctaccgggcgcggatgaggtggacgcgcgcgagcggcctgctgtgagtagtgacttcaattgggaacaggataacaaataggtgttgggttgccggctgcgtttgatcgataggcggaatcgcaaggatgtgttgtgtacttgtgttggagatggcgagcattgatcgtgcctcggcgacctgtcaatcctcaccgggacggcgagaccgggtgcaatgtatgggctcatcgatctaaatcgggtagtaaaggaacaagttcatctaaggtcctttaacttgacaacgaatccgattttcattctttaaccaaaaacgtttttgatacaacggtccttgaaataccaaaaccaatacaatataggtcctaactcctaaggtagtatagtcggtggttttgtacgacgtggcaatttgacttgggtcagcgccgctgagtcagtgtagggcccacgtatcaattaagttcaccgtcttccctctcttctcatttctctccaggcctccaccttggtagccaacgggagaggtggccggcgacgagcaaccatttcggtgggagaggctcgcggcggtcgtcgagagaggacggtggagaggtgcacggcgggtgcaggctcgacggctgagggcggcagccagcggggagaacggtggggctgacgaaggaggctcacggcggttggcgggtagaggctcacggcaaccccttcctctttccctcatcgccacggccgtgcgctgctgtcggacgtctttatctgtgtgtagatctggaggtgaggaggacaataacgacgcagcaacttcccatcctgatttggtgtagatcttggacccagtcatcgccgcccctcgtcccgtcctgaccttgggcagcggcggaccttgggatgggagttgctgcgtgtgggtaaggcactgtcgccagtgtcccgctggatccctgttggtggattccgccagccgaccgtcctcctcaccacccgccgtcggccgccagcctcctcaccgcccatcgcgggccttctcctcaccactgtaacgccccgattttcgttcgggattaaaaagcaattaataatgcatttcaagaaattatattaaaagttaaatcaatttaatcaagtgaaattatagaggaaattaaaatttcctttaaaaatcattggccgagaatattttgtaatattctttgtgccctaaaatactctctggatttttttcgcaaattttcggagctcaagaaataattttaaagtaacaaagatcatttaaccaattaaataaaaagaaaacaaatttaattctccttccttcccttttgggcttgacccaagccttcccctcctctcccgcaggccgcgcgcctcctctctctctcggccggcccgcgccttgcgaaagtctactttacgtcccccggtttccttcctctctctccatccggccgacaggtgggaccggcggtcccacctgtcagctcctcctcctacctctcgccggccaaccccaaccgccattgccgcccacgtcgccgcaaaatgcggcgccctcccgcacccgagctcgcatccaaccacgtggacacaaccccctccacgtcctccaccttttcccccactcaccccgcaagaaacggcgccggtttgacctccccacgagctccacttcacctccccacgtcaccggccgatcccgcctctcccggccacgatctccatccccgagccctatataaagcaccctcgtgctcccctcctctgttttcccctctctcccaagctcccccatgcccggaaccccctcctccccgtgagcccaagcgccgccgctcaccggcggactccagccggccgctgccgccgctaccgccgtccccgtgccgcgccgcttgcatcgccggcctcgccgcgctttgccgcatcccgtccaccgctccgcttccgcaataaaccacccgggcaccgattccaccgtgaacccgagctccaccgccactttgccgactccggcagcgcgccaccgccgccctagccaccaccaagccacgccactgccaccgtcggcttcgccgcatcacgtagcaccccggcctctgcttcgttttcccgttccaccgcagcaacaccatctccaccgcgaagccgaggacgtcgccgcgtttgccgtcttcggccgcctcttaccgctgttccttgccacctcgcgccacaccaccgcctctactgcgttcgccgcgctcccccgtaccccggccgctccttcaccttcgttggagaccgccgaatcgccgccgtcgtcttcgccccgtggagcgccgccgcctccctccgcggccgctccctccgtcgccgcgcctctcggtgagccgcctccctcctccttttcctcttcgccggccgcctcccgtgccagcgccgcgttgcgccaccgccgccgccggttgtctggccgtctgcgcgccgcccggccatccccagccgtccgatctgccttggccgatctgggccgtccaacccgtggaccggcggtggaccgtccttgtggtcccggtccacggtggaccgccacctcgtctcgctgacatgtgggccccgcctgtcggcgccggccccctctcttgctgacgttagcggcagtccttttcctttgtgaaaatatttaataattgcgcaataaatcattaataattatagaaattcatttagtggctcaaaacttctaaaattcatatctaattcattcgaactccaaattgggccatttaaattgcaaaattcatctaaaattgagttctacatgtttgtttactttttaggtactgtgtccttcgtttttattaggtttttcctcgttttgcgtgctagcgtgtagaatccgtcgttttggaagatcgcggtcgcgaggaaaagagttcagaaaatccaagtgaagaagcaaggcaagtcacacattccccttgagcatgttgatcccaatttacaaatgttttactgtttgcaaataaatatgcatgttttgctaattacatggggtcagggttttacctatctgctcgcttgtgccatgtttacttgatatctgtcctttgtcaaccatgggtaataaatcgcctagcttgtgttactttgatgacctagctagaactatatgcttagccatgcttaattaccactagctcagtcgatgggataattgcagtattagacattctagtatcttgttgagctgcgtgctcgagacatctggccatgcttcatggtcgtaattatccaactaaaatgcgactgaatggtgggctgtgggtgcatggttttgctggtcgcacccatggcagttaaggactggttcgcgggatgccctggaagaacttatcgtacttaccacaagccagcgtgggcaacggctgggcttgtagtgtagctttcctctagtcaatgcatccaggcaagggtgggcgtgatggagcggggcgggccctgcgacggcctctgtcgcttccggattcacctaggcacgagaggggactgcccgttgcccgctggggacgggggtgtaacctaaggtgtggtgtgcttggctagagggggttatgcgaagggtcctgtcacggcctctttccggtatgtcgtggtggcatgtcggcgcacggaaacgtgtcgtggggatgtgtcttgtgggtacagttgtacacctctgatcagagtaaagctattcgaatagccgtgcccgcggttatgggcggtcgaccagattcaccgtgattagtcccatcttaataaatcgacccaatacactgtagttcaggtgggttggttggacctgttcaacgtggtgtagcgttgataagtggagatttaatgttactttaattactcaacagttttactgttttgctcaataaaatgttttacaactgcctttatgcaaatagccacaaaccatccttgtatccccttgcacatctgcattgttggtgtggcttgctgagtacggtggttgtactcagtcttgctattattcccccttttcaaaagtgtagtgcttctgagctgaagatggagttagaggaccaaggctcagaccccagttgagttttgcctgtggagtggagctgaagcctcactaggatcgcctttttccgctgctgtcgttctgtttcggtgtgaggactaagtgcctgttctgtaagtattttacgctttatttacgtttggaactgtatattacttgtcattttgtgtaccctggctggtcctggacagggatttaatacgcaaaatagtctggaaatttgggttaaatttctgggcgtgacaaccactctcccccttttctgcatcttccccatcgaagtaacggcggtggcttagggatggcgtggcgagcaccttctcgagctctacactaaccagcctcgtcgagctcccatgccgaagaagcattctcatatggagagctggttgctggagaggctctccaaggccgagtgcgaaatctcactgatggactagactgagaaggaagccaagaagatccaacaagaatacttcacagatgctatctctttcatgctccaaccacgatatgatcacctccgcctatcatgaaccccccaccgccagatgtcccaaccaccattggcgccgcagtcagcctcctccggctcctccaacaacgggactgtggtggccgttgagatgggaacaagggggaggaagggagataggtgacgaggccttgatatgtgggacccacactaactcaacactgttgatctgtgtcaaactgtcacgtcaaacaaaactaccaactatactgctttggggacaaaactaccat

SEQ ID NO: 42305 - DNA, 7167 bp, Oryza sativa
  unsure (1)..(7167): unsure at all n locations
nnnnnnnnnnnnnnnnnnnnnnnnnnnnnnnnnnnnnnnnnnnnnnnnnnnnnnnnnnnnnnnnnnnnnnnnnccaggctccagcaacagtgccctaatttcctgaacaccgctatatatatatgaggctgaacaccatccaggaaatgcacacacgattgtacacttcgccggacacgtaccacgtcggcctaattaagcagtccaagaacgtatatactcaccacttcaccagcacatttgattctgcacatgaagatcaccgtgcactcatccaaggccgtcaagccggcatacggccccggcgagttccccaccaccaccggcgacgtcgtcccgctcaaagtgttcgacaaggcgaactttgacacgtacatctcggtgatatacgcctaccgcccaccggctccggccaacgccgccctcgaggcggggctcgccaaggcgctgatcgagtaccgcgagtgggcagggcgcctcggcgtggacggcgacggcaaccgcgccatcctgctcaacgacgggggcgcgcggttcgtcgaggcgacggccgacgtgacgctggacagcgtgatgccgctgaagccgacggcggaggtgctgagcctgcacccgagcggcgacgacgcggtggagctgatgctcatccaggtcacgcggttcgcgtgcggctccctcgtcgtgggcttcaccacgcagcacatcgtggcagacggccgcgccaccaacaacttcttcctcgcgtggagccaggccacccgcggcgccgccttccaccctgtccccgtgcacgaccgcgtctccttcttcgcgccgcgcgacactcccaaggtcgagttcgagcaccgtggcgtggagttcaagccgtacgacgacgacgaggatgtccatgcgtccggcggcggcggcgacgacgacgaggtggtgataaacaaggtgcacttgagccgggaattcatctcgaagctcaagtcgcaggcgtcggctggcgcgcaccggccgtacagcacgctgcagtgcgtggtggcgcacctgtggcgatgcatgacgaaggcacgcgggctcgacgggcgcgagtccaccagcgtgtgcatcgccgtcgacgggcgcgcgcggatgagcccgccggtgccggacggctacacgggcaatgtcgtgctctgggcgcggccaaccgcgacggccggtgagctggtgaccaggccgctgaagcacgccgtggagctcatcaaccgggaggtgatccggatcaacgacggctacttcaagtcgttcatcgacttcgccaactccggtgcggtggaggaggagcggctggtggcgtcggccgacgcggcggagatggtgctgagcccgaacatcgaggtggacagctggctgcggatcccgttctacgacctcgacttcggcggcgggcggccattcttcttcatgcccagctacctgccggtggaaggtttgctcatcctgctgccgtctttcttcggcgacgggagcgttgacgcgtacgtgccactcttcagccgcgacatggacgtcttcaagaactgctgctactcattcgacaaagaccaaactactagccttgcatgaactatattattgaaaaacaagacatgcagttaatgctagatcacttgattgagactagttagctaattagtatttgtttgatgttgttgattcaattattatgaattgaattaattacgcgagatgttctgccgatgaaagttgaattgaataaataaagttatctgtaaaaaaaaacttgaaatattgtagtactactacgatcgatcggtagctttcaagcggttcattttatctgaaggaaaggaaaaccaaagtaaaaaattgcgccgttgtggccttgtgggtctaaaggaggatggattctaatatctcgggtggacgtgcacccgtttcttacataccacctaaataattataaaaaaaattacaagataggttaatatgtaatatattatttcacaaacatgcaaattcaaattcgacttatacaagttgtaacaaaaacaacaaattaaactctaactagtatacagatatttacagtcaaatttgttatttttgttacaatttatagaagtcgaatttgaacttgcatgcttgtgaagtgatatattaaaaattaacctatcatgttaattttttaaaaaaaaattcataactatttagatgacatgcaaaaaacgggtgtacgtttttcgggtttaaaacagtttttcgggtctaaagctgtgtataatgttagcctttgacctttatcttgcagtcttgcttgttgggctgggacttgggggctggggctgagatgtctgctcttggatatgctgtacgccagtacgtgtgctcatgctactttggcgtactcgtttcctgataagccgaggtgaacgtgccgcggccaaacaattctctattgtgaactcattcttttatccaaacttctccattttaatgactctcaaggcccttctggccaataacaaactcaatcctcttaatagacttatcacgacagggattggtacaaacgagtagatagccacctagatcgaacactactgtgatactatcagatggtttttttttctcttgagaacttatttggttaatccctcccacaaacaaattgagggagacttggaggggaactattcattcctctctgttcccctccaatcccttccccttgggatctaccgaacaaaactacatgtcgtttaaaaaaccatcgaaaaatttgaatttgaaaaaaaaataaagaatatagatcaatatgtgatatagcatttcataaacatagaagtttaaattcgatttatacttcagaaacagaaataataaatttaactgcgaattacaagttttatataaagtcaaaatttgttactccctgcgtcccaaaatataaacatttttagaataatgtcaagtcaaagatttttaactttgactattcatagcaataaaataaaaaaaggtcaatgatgtaaaactgatcttactatatttatcaataaacaaactatcataatatacgacttttattatttgaaacatcctacttttatagatattgttagtctatgtagcatcttgaagactgggccagagtctaaaaatgcttatattttgggacggatggagtatatttgtttctacttgcataagttaaatttaaacattgcatgtttctacaacgatataccacatattgatttcccactgataacgagtacggcagtaggcccaaacaattcaattgtagtagttgttgactcatacatatagttccggtaactgcgaaagctgtgaaaaatacaacaatgtactacttgaaagtacagttttaatattgcccatacataatcctttatatagaggctgatcggtagtgattgttgtcgcacccactgcagttgcgggagctccaaaagctactgccgctggcagccattttcaatggccacagccgctaccgctgcaacagccaacagaagcgaacaatctcatggacgtttaggtggatagacactaagatgaaatggactcgctaatatacctaatgtacccaccgcaaatatgaagaaaagctatttccatataacaaagggatcaaaactttctaaacccacgctggattttacggcttataatttttttagttcttacttattttttaaaaacttttatgattttttaagcgacatggaaaaacaagatgacatcccctagagaaatgaatagacgttttgaaagacacaataaaaaagatgggacacttcgtgcagtcaacgaccaagaccgccagcagaattagctgagttcagggagtacatagcagcagttcttgaaggtgtccatgtcgtggctgaagagtggcacgtaggcgtcgacgctgccgtcgccggagaaagatggcaggaggatgagaagaccctccaccggcaggtagctaggcgtgaacaggaatggctggccgctgccgaagtcaagctcgtagaacgggatccgcagccagctgtccacctcgatgttcgggctcagcaccatctccgccgcgtcggccgacgccaccagccgctcctcctccaccgcgccggagttggcgaagtcgacgaacgacttgaagtagccgtcgttgatccgtgccaccgcccggttgatgagacccatcgcgtgctgcagcggcatggtcacgagctcccgcgcggtggcggtcggccgtgcccagagcacgacgttgcccgtgtagccatccagcaccggcgggctcatccgcgcgcgcccgtccacggcgatggacacgctcgtggccacgctcccctcgagcccgcgagccatcgttatgcagcgccacaggtgcgccaccacgcactgcagggtgctgtacgaacgctggccgccaccggccgacgcgagcgccttgagcttggagatgaactccctactgaagtgcaccttgtgtgtcaccaccacctcgccgtcgtggccgtgtccatggccgtcgtcgttgttctcgtttctgtcgagcttttcgcaagtcttaaactccacgccgcggtgctcgtagtccacccgtggcgggtcgcgcggcgtgaagaaggaggcgcggtcgtgcaccgggacggggtggatggcgacgccgcgggtggcctggctccacgcgaggaagaagttgctggtggcgcggccgtcggacaccatgtggtgcgcggtgaagcccacggcgagggacccgcacgcgaaccgcgtgacctggaccatcatcacctccgcctcggcgccgtcgtcgtcggcgctcgggtggaggctcgtcacccgaggcgtcggctccagcggcacgacgctgtccagcgtcacgtcggccgtcgcctcgacgaaccgcgcgcccgcgtcgttgagcaggatggcgcggtcgccgtcgccatccacgccgaggcggcccgcccactcgcggtactcggccagcgccttggcgaggcccgcctcgaggacggagttggccggagccggcgggcggaaggcgtatatgacggagacgtacgtgtcaaagttcgccctgtcgaacacactgagcggcacaacgtcggcggtgctcggagcggccacggcgtcgccgtacaccggcttcacggccttggatgaatgcaccgtgatcttcatagccgatcggtagatcaatctatccgtatggttaaaatgcaaagtaatttaagctagcaagatttttgaagtgtgtatatgtgttcttgaactactgaggcgggtgcgtgcgtacgtagtaattccgataaaaatggtagcagatgtgtgttgggtggtgtggcacaatgagctagtcgtagcgaatgctttatatagaggagagagggccgggacggatgtgcatacgagatagctaggcatgtgggtacacgaaagatctgatccccacaaccacaatttgtacaattgtactgtcaacgtccataactccatactgtaatcgcagcgttagaattttcgtcttctaagagagaaaaatcgatccaactaatgtgctgttgatggcggctgcaggattttgccgctatgtaaatcacaagaaaagttcacgcattttgtagtacaaggactagggttttctcgtacgtgtactttgaatgaattaaataatacgggaatttattaattgtggagcattaccctcactctagactctcaagtctcaacagataccggtcttaatgaggtgaaagctgccttaattagaataggtacaataaacctacgtcagtgagctatagtaattattacatcagatatttgtatactctcaactctcaaggcagacagcactgagccttccttctccggttctcctaggtgtgaactcctaccaaccaatcgtagatggtccaaaactgggaatgggaaaaaaaaagagaagatattaggagatagcttctcccagttgtgaacgctgttatatgtcttcctatcgaccaatcaatcatagaatcaaaaaatcgagaatagaaaattaaacgatgtcagtagatagcacgcagaaatacgtacacatgcagccaataagcggcaaacatgctgacgtggagccactggttatcgttactatattagctttgatcttatgtgactttacaaagggcttcttttatctctttgggttgcatacgttgatctttcatcctaactaggatttggtccggctgaacgaaatctatgccgttcattcgcgattcgacgatcccacggctgaaaaagggccgccaagttagacacgtggacggttagatggactctaccgtgagatcgaacggacgatgttggagggaaccggtatgtaattaacaaaaacacagggtatttttttgcaaaaatcgctgatgtggcgctcctaatcttcaagcgatcactcggcttttaagtaaacctatattattacatgcatgcacactagacatagaactacccgtctcatattatagctacttctaacatttaaatttttctcgtaatataactactttttaattaattacttgctttttttcatttcaactatctctcatttggtttcatcgtatatttttttatgtcaaccaatcacaaccatttttcacctgggatggaggtagtatatatatgatttcttctaccaaaattcttgggcaattaattcaagtgaatacccataaatcacatgggatccatgtcgttgattaactactgcattatctggctttctgtaaaagctgggcagctggccttttcttaaaaaaaaaaaaacctgcatgatctatccccagcctatgacatcccaaaatataaaggtgtccaaagtcaaactatatacaattttccctattaatatataccacattaaagaagtaattatgaaaatatatttcatgatagatctaatgatgttcatttgattgtaaatattagtattgtttaggatagtttgacttagtgctacatatagaatcctcgatactttgggatgaaggagtagtagttaaaatcttacattatctaaaatagtagttaaaagctatgaacgttaattttttttaaactaagagcaccttatatttttggaggaagaagaactacccagataaataa

SEQ ID NO: 42306 - DNA, 727 bp, Oryza sativa
catgccatgctcatatggttattattaaactacccgaccaataatagcttaatcacatgaaagttgcacccgtaccaacaaaatattatatgtgtctgactgaattattctgaagaactcaacagcattagcatatatcaatttcaaatctacttgcagaggagaaatgtaaatacctcaacagcatcagcaacagttgttgccatgtcatatgtgatctcttcaaaagtttcatccaagaaaaaaacaattgttgtaagcttacggctggataaaagagcctctatctcctcccgtgcaggaattgtaaccctagggcctgccttaactgagcgtttcagtgcatttagtgtgttaagtgctagaactcgaacatcagaatcagttgtagcgccatgagcaatgtagtgaacatactcagacaagtatgctccaatatctttgcttggtggcatggatgacgcacataaatacataagctcccaagctcttattaaccaagccctgtaagtacaaataataacattcataagatggttgtatcccatcgaattgctatccatgagaaatctgcttcatacctgtcgggattgttacgtgtttgttttgaaatctgtgcaaagagctcatctctcagttcagaacgtttcaaagtatgcttgtaaagctttgcaacaagttcaattctttcatccaaacttattattgctggggaatcgatgcccat

SEQ ID NO: 42307 - DNA, 1901 bp, Oryza sativa
atctcatttggcagtttgaagaattctgaagcagcttcaatagcaccatccatgactgattgactgatcccatgacttataacctgcaaaatggcagaattagtagagacttgggtgcacaagtaagctttctttgttcccttactgcctgctagttagtgatgatgtaggaaaagaatgctttggtacttatcttatgaagtagcaacttaatcaggaaaaatagcatttgaatggtccttctctatatgcacaaattgcacttttatatacatggtccgttcttgtcattactgaaaggtttataaaacaccccagtgatagtgctggcagccttgatatgtccacatggacggaaaaagaaaaaaaaattgcagtggtttagaacccaaagctaaaatatcgattaggtgtagagtcagtttcagacttgtgaacttgaaatgttaaccaatcttgtaaaaagtagatgatcatatagaggttttacatatgtcttttttaacctagaaagagatactttggcatatcttttcaaattttgtgaatactaatttacagttcatcattgaaatatttattgttacaaagaactaaggtctcaattcaaagtatcaagtcattcattgcattgcaatgatacggtactttgcatatgtcatgtatttgtgtaccttcggtttggcaagctaatcaagtctagcatgctcacagcacaaggtttgcttccgcttcatcatttgtgggtttccacataacaaactgataaagtttagttgttttttttccttatctagtttttcccattttcatgaaagagctgtttagcccatacatagagttggtgcagtgaattgtactatatgtacagttttcctagacttgcacagatcaaactctccattttggtgggagcaaaaataggatgcagctcatcaaacatgtagttcagtagatacagactgcccatatcaccacttccagaaaaaggaggcgcataccatattcttcaccgttagcgaacaatattatgctgccattgctacctgcaggatttcaaagaagggtcccgatctgatagctcctagggttcaattacttgctctttgatttggagttttctgccagatagaaatgtggctgggacacaaggataagcttccttggttgactaccccataccattctagcacatgtcaaaatggcgtcaacgtaaactgtcttcagtgtttggacataggaaaagaccaagtctagagagtaagaacatgacaaaaaggctgtgtcactacgttgcgttaaaggaaatttacctggaagtatcccagatcacggcatgctttggcgatatcgttgaccacccgggaccgcaccgtgggatcatcaagactgaggtggccaaggttgatcactggcattggcggcgggtggagctcctgtgatggcagctgctcttgagggatacccttcgacgtgtcagacattgttgatcagcgaagaagccacacgcagctcaggtacgccaattggttatgcagaattagaactgtacgcagtgtgagagctgtggctgcatctcttcttataggaagccgaggctgatggttcattctctccttcagctgcaggttggtgcaaaaaaaaaccgccgttcttctctgttgtctgtgcagaagcagaacgcatacatgtgcataatacacctgatggatcctcctcacctggacagggggctccaaaggagaagtcaagttaggcgacgcatttccatccattcatgcactttgcagcgtctcgaaatggactacatggatcctgtatctggtccaggagaggagaagccgctgggcataggcagcgtacctacctacgtacgctgggaacgcgtggtgtgcgatgtt

SEQ ID NO: 42308 - DNA, 1478 bp, Oryza sativa
tttgattgcaacgtttgatcactcgtcttattcaaattctttttgcaaattaaaaaataaaaagttgtgcttaaaatactgtagataataaagtaaatcataaataaaataaataataattttaaaaatttttaaataagacgagtggtcaaatgttacaaataaaaactcaaaatcccttatattatgagattgggggagtatacggcaagggagtgtgctgtgtgtggtctgagatgatgtgtactgctgctagcctctcgccgtgtcggcattcgttggaacggcgcgagacttgttgtcatggaaacagaacttgcatgatgcattgttctacgtgaagtttgactccttttgatatattatcgttttaaatataattaacaaacaaaattcagaatgatcaaactggctaaccagtaaccagcatctgcatcaccgaagaaggacatgagcgtatgcaatttccgtttgaagttggcctcaacaggatcatttccaatacacggcccgcagattgcaagaagaattccgcttcggccgcttgggaatctgcagcccatgccgcgatggatcaggccgaatctattgcttaccacaagcctatggttatccgtaccattagtccagcccataatccccctctcaccatgggcggcccacagcacgaggaggagctcgccggcgtccggtgcgcggtggccggcgaaacaccggcgactcgccgccgccgccgcctccggatcgcccaagtcaagaaggcgagttttttccatacatattttacatttaccaaaaaaaaattaaagaaagcgaccgctaatacgcgacttcagtaactgacagggtggccccactgtcacagtgtccctaccaaccagagggacagggaggctgggaagaacgcgcgtcgagaaagggaagagagtgggtgagaccgtgagagagggggatggagatggaggcgtccgccgccgagggcggagccgcggcggcggcgcggacgctgcggtgggcggggcgcgcggggcacctcgggggattcccgcgcgccgcggtgatcgccgccgtcggggcggtcgccaaggcgtacgcgtcgctgctcaacaccaccaccgtccacaacgccgatgccctcctccgcctcgtctcctcgcggccccccggcacgccgctcctcaccgtcagcaaccacatgtcaacgtacgtttttccctaacatccccattccctggtcatatgttaccccccatgtccgattgctatttccccttgttgatgtgagacctgagaggagagagactggagattccgtgttgctgagttgcgcttgatctgtcgctgatccggttcctgtacgcaaaatctcagtggtttttttgggtaacccgcctgataactaaatgggatcacagcctgataacatttgactccataattggtgctagcatgttatatatagtcaattagtcatactt

SEQ ID NO: 42309 - DNA, 1097 bp, Oryza sativa
ctttcttcttttcttctttttttttttgcattgatttgactggctgactgatgacaactcagaatggtaaaccataagagaataccttgtagaaaattgggcattttgcctgatcttcgcttaaattagattctggaattgacaaagttcagctacagcatgaaatgaaaagaaaaggcaacgaacactggcagaccacacaacaaatggtgccatccattctgtgtgatccctagcgcatagttcatttcaaagatatgaaccattttcttagtggttttctgaagtttagcaatggagatttatatgttttagaatgaagtgactgatttgtcaaccatccttaattgacattctcccctgttggaatatgttattgattgtcaaaccattctctgttggtaatatttccctgttgaactatgggactgctgggcatagtattaattcgtcttgtacttgccatatagatggcattaaccatttaattatccctctgattttcagtatctcccaccaaatgatatgttctggtactttccgtgctatttgtgctggtgctaacacaacagcaatattatcgtgtctaacacatgtgttgtgtctagttcatttgctatttgaaatattctgttctgttttcagcttctttattcttttgctgctcctgaccttacattttagggaaattcagttcgtgcaacattggtgtttttgtgcacatcacaatttggcaatctttgtcttaataaatattctctgcatcatgtgacaatcctgctgttgacaaataattgtgtgcacagggaaatgtgtgccgatcacacgaggtgctggaatttatcaggatcatatgactgaagcccttgaagtgcttagcactggagactgggtatgcacattttcttcattttatcaccgaccattctatcattgacagttcttgtatctctactcataattttggcctttatttaatttcaaatctcgtcatgacatattcaaacagttgcattcattccctgaaggaaaaatagctcaagatgatcagccaatcagacgtctgaagtggggaactgccagtcttatcgtccgag

SEQ ID NO: 42310 - DNA, 731 bp, Oryza sativa
  unsure (1)..(731): unsure at all n locations
tcctgcagccccaagttatcagctgtgagaaggatattggatcgaggagcagtaatatcaggaaaggttagtgactgcagcccattgtgatgtattgtcaatgctctagtcttaagatcaatggtgattgggctatgctgagagatccagtcacagccaaagatgatatcaaagcctttaagatccaacaatctgaagtctgagataaaagagacattatgaatagaataaggaacctgagagcaaacggtccctgtattcaaaatactgccattagccactctgactggtataggtgcatgattaaccatatgtaacccagctttacttgctatcttcggagagatgaatgtagtggtactaccactatcaactaaggctgtggcctgtatggtacccaatagaacatgtagtgtaaaggtagtagcagcaggagtgatgccctccagggagtgtaataacagatgtgtatcctgctgatctgtcttctgtggactatcaggaggagtagagtaagctgcatcatctaggatttcagactcatcctccattgtgaccaaatagacttgcttggtagctttacagactctgccgtgtcctggaacccagggttcgttgcaacggaaacacttgccagaaaattttgtatgagtgacagtggactgcttgtcatccttggtaggatgctntggtggaattttgggagtctctctgttggaaggaatagaaga

SEQ ID NO: 42311 - DNA, 4648 bp, Oryza sativa
acattgcggcggcactagcttataaagggactcgctaatacaagacaaaagagatgatgtcaacagtacggcaacaggggtgtgctgtagacggtccaagctcatctccatcgtccgatcttcataatctccagcccaagcgttatcgaataatcccagccattgggtaactgaacttgccttcccttccagcgttcaatcatggcttcagttcgtcagagttctcacaccaccggccaccgcgcgaccttgtctgtaccatgcgcgagtcatcttttccttttttttgctctactcctgatttttaccatcaaccatatggccataagggttcgttcaaattctatgtactacggaccctcattaaaatgactttatatcccactgataaaaaatgacttcatattcggggtcaacaaaccaaaaaggaagcgttgaatgttgatgtgttcagtaaaaaaaaaaaaggctaaaggtttcatcgtggcaagttatatatgcgatcgatacagtacagctttgccagctcgatccaactaattactcaagaacaaattatacacatacacggatatacacccccattctcccgtcgtgcggtgaattcgatcaagatagaagagcagcagcaggacatcaagaacgtcttctgcatggagggtggccagggcgagtccagttacatcaacaacagccaatctcaggtaattaacaaattaagctagactaattacctaattaatacaagcataactgtatgcaatcagaggtggctattaattacctagtaagattgctacgcctgatcgagcaaatcaaaactgccggtgcagtcccgaaacctgaaaatgatgctgtacgcccttgaggagacgctggacaagatccagctccctcgtcaccggccggggaaaaagccgctactgacggccgccgacctgggatgctcatgcggccacaatacgctcctcatcgcggacgtgatcgtcgaccacatgaccaagttgtgtggcaccggctcccttaagtggtacgtaaacaataaaataaaagtggcagtgtggcactatagctcagtagggagacgcacgcaggagctgctggtgcatggttgcgagttcgatcgacgcccacctcacgcaatacgctttggtttttaccccaaccaacgtgcacagatcttgaagtccatcggaaatggccaacaatttgatatattaattttctcctaaaatttatgtcaaattacaaatagcaaatcccaaatttaaaatcatgtattgtgtcgtagcaagtttaatggttttaatgagccttctcgaatttcttagccaactgagctgagctcatctttaacccatccaacgtgcacagatcttgaagtccatcggaaatggccaacaatttgatatattaattttctcccaaaatttatgtcaaattacaaatagcaaatcccaaatttaaaatcatgtattgcgtcgtagcaagtttaatggttttaatgagtcttctcgaatttcttacaaactgagctgggctcatctttaacccgttgagtgagtcggctcataacttaaccaatttttggcagttaagctatgggttcgagttagcttgttaaccgcccttaaatgcaaggaactaagtgaagaagtttaaatgatttaattattacacaggtgccagagggagtcgccgacaagcgatcaccggcatacaataaaggtaaggtgttcgtgcatggtgcctctgaggagacgggcgcggcataccggcgacagttccagtctgacatgatgcgctttctacactgtcgcgccgccgagctgaagactggtggtgccattttcatcgtcagccttggccgcctgtcgtccacctgtggccccacggatcaaggctacatctatgaagtgtatggcgtcatgttcgacgactcatggcgtgacctcatcgaagaggggatggtcgacggcgagaagatggacagctttaatgtccccctttatgctcctacagtggaagagttcaaggaggttgtggacgccgacggctcgttcaagatcaacgagttggagatcgtgatggcaagccctcctgtcgtggatgatcccgctgaccgcggcatggccgggcgcatggtggcaaactacgtgcgcgccctcctcgggctactcatcgacacgcacatcggcggggtgatggctgatgagctattcatccgaatgcagcgccacgcggaaatacgtgccgaggagctcatggatgaaatatgcttcccccatattctatgctcactttcactggcgtaatggaatttacgaatgtattattggacggtctttatatgaaaactgagtctattttatgtggaactcttcgtatcttgagcataataaaagttattctggataaaattgttagttgtcttataaaatttaggccccatatattagccgatcttcctggatataaaactcttcattgttttaggcataataaacggccttttgtttgggtacttcaatttacccaagtttgacacatatttttggctaacttgtctaaggcatgactaataaaattagaaccaccctttagctagcgtatatggtctatgtaatgaagaataaatcttaccataaatgtcgttataaactaaacaatcatctacctcaattaaacttgtctaacttaattaagagatatgacaacattaagtaagttgtgggtgccagctaaactgtccctaaaagtcatccaaataaaagtgcttgttctcctataaaattaggcaccttgtaatttatcgaagtgaactagagtagaccgtgaacattatttggccaactaagccgcgaacgtttgaaaaaaacacttaagccgtgaacatttgagtagttgcgatacaaatactgggcgagcttaattgagtcgttaattagtattatttggcatccaaatttgatagcctaattgtgatatatacttaagcgtgaacttggggtgtaaccgcacattaacaggacgggttgatagcggacccaactctttagcctaaaaaaaattaagggctgaatttaaaatgaattaggctcaatttctatatatttttatctaaaaatatttaagtagcgggtagggttgtaaaagaatcggttattaccgttggaatgcaatatactgtaatgttcaattggtcaatcaaatatcacatacaaggacaatacgatgttcagtggtcgacggctgtgttcttctcctttctttcccaactcaccactctctctttttacgcgcacgcttttaaacttgtaaactgtgcattttttacaaaagtttactacagaaaagttgctttaaaagtcatatcaatctatttttaaagttttccttttctttctccctgattcttcccccaccatctgtaaatatttctcatgtacattaactactacttattaatatattgcagtaggggtaatatattacagtaggggagcctctcttgctgttttaaccgtaaaaaaaattaattaatcacacgttaataggtaacaccgttttatattcatggaggtagaactaactccatctcccaaagtcagccccctaggtacatgtgttacatgagattaggcgcccgaagtcagccccctaggtacatgtgttacatgagtttaggtgcccgtgcctggccgtacggtcgcatcaaccagctttccgttgcatgttgattcatgtgcgctcagcccaccggccacccacgtaccgcgcgtcatcgcagatatacgcatcaggtgatcccagctcatcaggtgatgatctatctgagctagccatctacctactgatccaggaactagctatatacgcatacacatatacctccattttcttgttgtgctgccgatccaggaactagctatatacgcatacacatacctcctttttgttgttatgctgtgaattcatcaattcaagatgcaaaaagtgttgatgaaggacgtcttctgcatggagggtggacagggggagtcgagttacatcaaaaacagccaagttcaggtaaaacaacaacaaaaatgctgggttacatacctatttagcacaagtcatagtaagttcaaattcagctgctctggaggttatttagagtatttttttttagttttgttactaaggtgttttcagtttgcctgatcgagccaaattaaactggcaatgtgcagtctcgaaacctgcaaatgatgctgccaaccctcaaggagatactggacaaggtccagctccctcgccggccggggaaacatctcctgacggcggccgaccttggctgctcttgcgggcataacacgctcatcgtcgccgatgcgatcgtcgaacacatgaccagaaagctgcgcagctgcatcttcgacgaccaagatgacggtgacgccgctgatccagaattctgcttctacttctccgatctccccagcaatgacttcaataccctcttccacctcctcccgcaacacgctactgctgctgctggcgcggcagtgagcggcgctacttcgctgccgcggtgcctggatcgttccatgaccgtttgttccccaagcgatccatcaacgtgttcacctccaccttctctttg

SEQ ID NO: 42312 - DNA, 18815 bp, Oryza sativa
tactgaaaaagtaaagttggggtttgttacacaactcatttgcgttattattataggattgctaaaactgtagggccacatttttttttcacttaaattcggttattttttttccttacgtgattgctctctctctctctcgtataatgataaggttagctaagttttctcattcggagatggattttcatccctcgagaagacatctctcgtttcttacgtgtcacctattaaatcatctttttttaaaaaaaaaacaagatacaaggtcaaatttatttttttccaagttataataaaagaaccaattaaactgaaactagttaacatacatttaccgttatatttttttacgacttgtagagattgaatttaaacttgcatacttatggagtgatatatttcacatgtatctatcttatcatttttttaaaaaaaaatctaataactatttaggtgatatatgggaaacgagaaatgtcctcacaaggataaaaatattttcccgtctcattctactttatattactacaatagatggatgaaagagttttatcattatattttattgaccttgcaagagatctagtcttcggcccaagattaattttctcttgcaatttgattcaaacctgtcattcaacttggaatcgattgcacgttctaccatgcacgaagtataccgtattgaagaataagtttaggagaaattttataatcctgaagaaagcatctcaagaaaacctaaactttaataataacacaggtcccggaaggtgttgctgacaagcggtcagcggcgtacaacaaggacaaggtgttcgtgcacggggcctcgcaagcgacgggcgcggcctaccggcggcagttccagtccgacatggcgcgcttcttgcggtgccgcgccacggagctgaaggccggcggcgtcatgttcctcgtctgcctcggccgcccgtcactgcacgcctgcccaacaaaccaaggccgcgtccagcttctatacggcgccatgttcgaggagtcgtggggtgacctcgtcgaggaggggacgatcgggcgcgagacgatgggcagcttcaacgtccccgtgtacgccgcgacgctggaggagtttggggaggccgtcggcgccgacggattgtttgagatcaaccggctggagctcgtaattacgagccctctcgctgtggacgaccccatcagagaccgccgcgcggttgcgaactacgtgcgctcgctcctcgggccgctcgtcgacgcgcacgttggcagggcggtggctgacgagattttcgtccggatgcagcgccgcgcggaagcgcgtgccgaggagctcgtggacgagatgcgtttcccccatattgtgtgttccctttcgctggcgtgacggacgggtattacgtgcgtatagacggtgtaatatgaagacgtactggatgtattttacgggaaagttttatagctcttggtcataatgtcctgtttcgttatgaaagaataaaactgtttgggccaacaatgaagtaatttatatttttcgctagtcgttttaagtttttcgagccagccagagtaaattagcagcagtaaacagtttaactgagatgtccgtggaagtgtggagccgcgcgcgaacagcctgccgatcctctgttccgacgggcccaacgcgcggatgcggcccagcagcgtggccagaggcctgccctacatgcgccgtgaagccggcccgactcgtccagcgacgcgtaccgcgtacgtgcaccgcaatgaggtgatcagccacgaccccgggttgagtccatttttgtcgaatacgttcgttcccgtcggtcaacggagatgaattctaattgctcaagtgaacattcacccgtttattatatgtcaattagatggttacgaacaaaatttaaaaaaaatttgacaagataaatcaatatgtaatatatcactctacaagcatgcaagttcaaatttaacttctacaaattgtaacaaaattaacaaatttaattgtatatatacatattgtaatttgagttttgtttgttatttttttatatttgtagaagttgaattttaacttgcatgtcgtggattgatatattacatattgatatatcttatttatattttttttacttttttaaaaataatttagatgatatgtaataaatgggtagacgtccactgctcttaaaacagtttcccgtcggtaaacacatggacgagttccgatcctgcacacatgtacgcccgagtgatgtatgcatgggcacgtcatggtcagctaccggccgtgcatgcagactgggcgtgcggcgtgccgctggagatgatgacgacgtacgtatacggtcgcgttggccgtgacggcgtatgtcgacctcgcggaagtagaaatggaggtacgctcagcgcctcatctgttcgtcaggaagcagctctccgcggcagcgattgccgaggggttcgtggccgaaacgcggttgagtggttcccccacgtcatgtgtgtttgatcaatttttggcacgcgtgacggggggtattttaatttggtgctcgtgaccgaaatggacgtgcgatgcatggtcttttgtagcaccaaattccgcagctatcacgtttttgaaaccgatctatttcttgggcgtacgcaagtgtagtgaggtggctccgtacagagaagaatttgatactcctttcatttcaaaatatagtaatttaaaattaaatgtaacacatcttaatataacgaatccggataaatctctgtctagattcactgtgtattaggatatatacgtgtcatccttggctgtaggttgtaactcgttaagcaaagcccggaattatattctattatctaaagaaaatatatgtcatccaatattgtgttataatattttgggacacgagaagtattagttatcacttgaggagtgtctataactctaaattgggtcaattgaagcacgaatattggattgcctatggccgatttccaaaattttcagaattccggtaacccaatattaattgttaaaccgaaatgttcaaccctgaaacactgtctgatgagactgttcagttgacaaaattaatcaatctttcatgcatgttagattgttaggtagctaggcgtacgtcaaggtgttccgttcaaccgtgcatgtatgcacgcacgctatatatagttaattgatctaccctgcatctcatctcacaaaaaaaaaatcatatcatcacctttctttaaataaaatggttgctggcctaatctggttgcctataaatataatctagtttaatatcccttctctcttacacaaacttatcttcttatgtcaatttttttaaacactattatagatgtaggtgcatatataaacacatgtaaactcacctgtataaacgtaaaagtgtattgtgcccattatttatcacttttttcaatatatagacttaccaacttctttaccttaattatataatccttttcagaattgtgtttcccaagtcttaacttaaattttgagaaaaaaatttcttgcagatatttacttctcaataactctatgcacgtctccgttgtattatgttctagtcttacagtccatttggtaagcgagcaaatattcatcaatctgtttttaaagaaaaaaatcccctaaaatcctttggtgcgcttaaagcactatatttaaaagatgatatttttctcttttccctagtgcctgcttataaaatctcccctttattgtgtccactttcttatgcatactcttggaagtttatagaagcctatggtgtatatttggaaaacttgaatgcaacaacatgtgatgttctcaatcaattagagcctttcacctcttaatttttcacacctacttatcttctcaaccaatcacaatcttttcctatttatttttacctacttttttataataactatgttctaacctaaatttttttgtatttttggatgaatgtagtaagaatttatcaaaaagtcgcctcgccttccccacccccaccaaaaaaaacaaataaaataaaatagatgggtgctttcccaattgtaagaatcaaatctcttccccactttctgaatcacgccatataactactttccaacttttcctgtatcaattgtcatgccgaaataagttataggaaacttcccactttgtagctcagcatatcagccactctttcttctctctttatcaactcttaccacaaaaaccttttttgcagtttcatttcagacaaagcaaattaaagagcagaaatttcaaggccatgaagtttttgtcaatgactttagcaacaaaactgtatcatcagagagacagagacagagacaactatatatattagatatacgcccccatcaactctactcccgcagtgtgcgcacggtggaaccaagataagatgcaagcgcaggacatgaagaacgtcttctgcatgaagggtgggcaaggggagtccagttacctcaaaaacagtaaagttcaggtaacaaatagaactaaattaattacctaaatgctataacaattaattgaagttcaaattctattttttatacgtaaagaattaattgttgaagttcaaattcagcattcaactttagtttttaaaaaatcagcatgcaagtatgcaaccagaggctattatgtttcattagcaagttgcttccctgtgcttgatcgagcgaaaatggcaactaaatgcagtttagaaacctgcaaatgatgctgcgtgccctggaggagacactggacaaggtcgtgctcccacaccacgggccggggaggcttctgctgacggcggctgacctcggctgctcatgcggccgcaacacgctcgtcgtcgccgatgcgatcgtgcagcacatgaccaagctctgtcgtcgtcgcggcaagggcgagcatggtgacgacgccgcggctgatccggagttctgcttctacttctccgacctaccgagcaacgacttcaacaccctcttcggcctcctcccgcaccgcggcgccgcttcctccggcgaaggcggccgtgggcggcggcactacttcgccgccgccgtgcctggctcgttccatgaccgtctgttcccggagcgatctatcgacgtgttcacctccaccttctgcctgcactggctctctcaggtaacgcaccattatagatttcgaggcgtgttcacctaaatgagaatcaaggagcttgattacatatttacataggtgccggaagaagtcgccgacaagtggtcgccggcgtacaacaaggagaaggtgttcgtccacggcggctcggaggaaaccggcgcggcgtacaggcggcagttccagtccgacatggcgcgcttcctgcgctgccgcgccgcggagctgaagcccggtggcgccatgttcctggtcttcctcggccgcccgtcgtccgccggcccgaccgaccaaggccgcagcctgagccagttcggcgccatgttcgaggagtcgtggcgcgacctcgtcggcgaggggttgatcgacggcgagaggatggacagcttcaacgtcccgtcgtacgccgcgacgctggaggagttcagggaggtcgtcgacgccgacggctcgttcgaggtcaaccggctggagctcgtgatgggaagccctctcgccgtggacgacgacgacgacgactcccacgaccgccgcgcggtcgggcgcacggtggcgaacaaccagcgatcggtcttcggtccgctcgtcgaagcgcacatcggcaaggagctcgccgacgagctgttcgtccgggtgcagagccgcgcagaagcgctcgacgacgagctcgtggacgagatgcgggtccacatccacatcgtctgctcgctttcacttgtgtgacgatacttaaatcgtacactgtcctaatgaaaaaagaataatcaaattccgggtacaataatttaattaaggttatatttggcacatctcataattttagataagtttgtatgttaaattatagtggtttaaacttttatatttcaattaaaataaaaacaaatgatgcatccattatcaatgtaatcgcagattcagatccatagatttatggagttatggatattcatctttaagaaatttcggatctagagctataccaaatagcatgtaaatataataattgaatttgttaaataattctatctcatttgttggacatgaaagttgggagtacttggcgatgcaaatagtagacgagcaacatgtttagtttgaccaaatttatagaaatacatagcaatatttttaaaacaaaataaatattgtcgacagggatacccgtagaccggatatagagggtattagggtacgctggtacaaggatctatgtaatacgacatcaagcaggcagaaaacaaagattatactggttcagaccccttggtaggtaatagccctaatccagttgatatggaattatatgatggaaaccacagattacaaagggaatagtggaactcgacggtaccgacgagatcgtaatcgagttgatccgattagatctccgacgacttggctccgataagctccggcttcgtaggctgtggtggatgtgttggctctgagattcgatgccttaggtccttccggggggtcccttttatatcgcaggtcaactgtctccaagtaggactcggagaagccggaccgaacacgacacaatgacaacccagttctgaccaaataggactccttccatctgtgaactccatgatgaatttccttaacgtatgccgagcacgtccgtatactcgtgagcataccatatcgatacgtgacatatatcgaagggtagagggtataccttacccgtaaccctgacactagcccctgacttctgcttatatgaactcgtgaaaccgatcgcgacttctgatgtcgaagttgtcgtcgttcttggcgtgatgaccgagagacgaggagtgatcgacaacgccgggtgaagctcaacggtcatgagtgaatttaaattgaagtccgagaaactgccgcatgtaacggacccagaaatttccggcgaccatctctctcctttccttggaattcgcaccatcggggtttaagggagttttggggatccaatttgaggtccgcatgttaaaaaaaaactctccagcttccaagcatccctcgtcttcaccgctcccgcaagaaccctagctagttcatctcggtcccttctccggtgatccccggcggcgatggatctcgacaagtctacctccaccagcgcgtcgctgaagaagctacaggcggatggcacccttcccggtcacgggaccatggagagagaagcaggaggtattgaaccccagcctgtcctgggtcgcatggttgcgattgaggactacattctctgtggttttcttcctccgccttctgaatttcttcttttggtcttgaatttctacggcctttctttgctccatttgagccccaactctatcgctttcctcagcattttttcgcatctttgtgaggcctatattggggtagagccgtttcttaacctttttcatttctactatgagttgcgctggatggaacccaacagggcatccgggtgtgccggtttcagactccgagatggcctgaagtcgcgctatatccccttccagtgtccttctcatagcaaatggcgtgcgaggtggttctatcttcagatagaaaatttggatccagtctttgttgttcctgaggaacaaccagacaagatttcgtcttggaccgcaaaacccgccttgaccccatccctccaagctttcattgatatcattgatgaccttcgagtacgggggttgtcgaggtatgaagtcgctgccgacttcattggtagacggatccagccactccaggctcgagcccatccaacctttgactattctagaccggaggacgcgacccgggtttctcctcggggtatttttcttgtatttacactgacttgcttatgtgcatgttcctcctgacttatcgaattttggttctcgattcacaggtctgagcagcgaagccgttgagcgccgtgtgggctagttgattatcagcggcccgacaacggcaagccacgtccttgttccccttagcgagaagggggcagccgaacgcgaagctgccatcaatgtaagtgtactcggcagcccttctgcacttttattccaagatcgcattgtgacttcataaagcgtaggctctccctctgactgacatcatcgggccgctcgtggatcatcaggtggcggcatcgctgaaggaggacatcgccaaggaggcgtccgatgttgctgccgctgctgccacaacgagtggcggctacgttccaaaaagggggaggaaattctcctccgtgatcggaaatcgttggaagacacccactccctcggtaagctttcctggtccctcatcgcgtactcggaaaacttccacctcacatcatacccgttatactccaggcctcggacgcgtctcccccgcctccgcgacggcagcggcttgtgacacttggcgagaagtaagtggatgagtttgaggttttgtcacttcgccaaattcttgtagcctgtctcaattgcaacctttcgcggagcggcgcgggcaaaggcgacgcaagatgggtctggaggaacctccagcgcgtctcctgctgtggcctcgacaaatgtcgtggtcgtgcccaggagccgcgaggcgacgcctagtgggccggccagtgatctcacggctagtcggggtccgccggctgccgtccttacctggaaggagctccaggtcgagatggggcgcctcctcgaggctggtgctcgcggcattagccgcgagatcgcggaggcgagggcagcagcggcgtcgtcggcgaatgagcgcgccgatcggctgacgtgtgatttggtggaggttcgcgaggacctccagaagatgagggagttggtggccggcaatgagcgacaacgacaagggctcgagcatcgtatgtcggagcttgagaacaacttgtcggagatccatggctccctacgggtcacctacaccggtctgcaccagctcgccggggagtgtggcgtcaagactaccatcccgacaaatcccgacgagttctcgctgacgtcttcgcttgcagaactggcgacagcgatggagacgtccaacgggatctacaccggggcacaccatgtccacgcgtgtgtgaggctggcacaccctgaactcgatctccagaagatcttggatcagggggcggctagcgacgcgcgcaaggatatgatagaagaagttggcgatctgggagagtctgtcctcccgctttttgaagagtaggatttcggctccctcgtactcattagacatgctgtataaaactctaattggttccaaccgcctttgtgcgtgcagtcatcaccttaattttctttagcattgtgatcttgagtactttgttgtcttctgtagagacgttgatgtcgaggatgtccagcagtgcgggcagcctgagttgccagcgatcgttccagcacttgcgttcgagtcacatgtgctacagggcaatgtagatcgaagttcgcccatggaaacgggcgtggcagcgacttccttaggttggttatttttgttttcatctccttcacccttctgtctggattgactaaatttgttgtattctcgagagagaagagcagtttgacttagtcgtttccatgctgagtagacctcgagagtgcgctagctgaccaggatcgtcgtattcagtattggaagacaaagtttgaggtcgcggaactcgagagggctatgctagaagtgaagaaggaccaggccatggagacactccggagtcgcaaggtgtggttcaactcgtatatgaagagttgctgcatctccatgtcgagagtttgtagagagctccgagtaccccgtggggatcccgaggaatcggcggccggatacatctcgtggctgaatggggcctgcacccagctcgatggcatcggccagcgtatcgacgaggccttgaagcaagagtgtcatcgatcgagccgatatgccggggggcatgtattggcttgtatacgagatcatcgtccgcagctgcaccttgagttcctccacgaagggttttctcgttctcggagaactcctacggagatagacggcctggcgaagtcgatggcgccgctggcggagaaagttttccagtcgatggaccggcattggccttcctagtagtctccgtgtcctgtgacaaatgtcttagggcaaaagtgtaatatagttttggatttttatgggattgtaagaaatacttgtgaaatagaaaagaaatctatctaactaagcttccttactctggatgtagtgtgtatgagtgtcttctcacttcgcgactttgatcagtcatttgagttatacactctccctagcccccagccttgtcatcggagaattcttctcggaagataaggctcttggacctttgacctgcctcggttgaacaagcactgatcctagccccagccgtgaagttggaaagtttatttccgattacacggcttggttaatacgcacggcgagaactcttacatgaccagatcttacatggtctttcgtctctacaggatctatcaaggccttatcggctctgggcgtccccagccgaagttcccttaggttcctcagaggccttgtcaagacggcgtaaagggacatgaggataggtttcaacgcaaggtgtcatctaggtaagggatcctcgggaaggaacacttcgattgtgatctggacctgaaaatatgctttattgaagctgtaagatgtcttacaagtatggatactattgacttatacatagaatttacgtaattgatcaatgttccaggaatttgccaactcgtgaccatcgccgtctgcaattttgaatgcgcctggccacagaacttgtgtgatcgtgtacggtccttcccatttgggtgagagcttgtttcgccctgcttggctttgaacccgtcggaggacgtagtcaccgatcgaaagcgtgcgtgctcggatgcgcttctcgtggtaatgacgaagggcatgttggtagctggctgctcgaatggcaactcgttcgcgatgttcctcgagtagattcacatcgtcgtttcgctgctcctcctgatcctcatcggagtacttatgtactcgtgtactttggtgtcgtagctcggtggggagcatggcctctgagccgtacatgaggaagaagcgtgtctccttgttggatgttgtcggtgtggtacgcacggcccatagtacagatggaatttcttcgacccacttcttgtcatgtgacatgagcctgtcgtagacgcgggtcttgagtccttgtagtactatgccgttttccctctcgacttgtccattgctctgagggtgagaaaccgaggcgaagcagatcttgactcccaacctgatgcagtaatcctggaaatcggcactgatgaactgggagccgttgtccgttatgatacggtggggcaatccaaatctgcagaatatccctttgatgaatttgatggcgttgtcggccttgatttcccccgtgggtgtcgcttcaatccacttagtgaacttgtcgatcgccacgaatagaaacctgtagctgccctgtcctcgtgggaatggcccgagtatatctagcccccagcactagaacggccaagtgagagggatagtctggagtgcttgtgctggtagccttgtgtgtttactgtggaattgacaggcttcacaccggtgaaccatgtcgcaggcgtctttgagggcggttggccagaagaacccttgtcggaaagctcttccgactaatgtctgaccgacagcatgtgacccacagatcccttcatgtatgtcgaggaggaggtgtctgccgtcgtcggacgagacgcattttaggagtaccccgtttggtgccttcttgtatagatcgttgccgatcatacaatagacttttgctttacgggatattttctcggcttctgcgtcgtcctcgggcaactcttcgctgcttatgaatttaatgagtggggtgcgccagtcgtccgtggtctcgatatcggcaacggcgcgctctgcctctatagcccccgagctggtgtcaggggtgaccgggctatcttcgccccttgcctctttcactgatggcctcgtcaggacgtccagaaaggtgccaggttcaagtggttctcgtctggacgcgcgtcgtgctagatcatccggttcgatgttgtctttgcggtatacgtgtcggacctcgatcccatcgaaccttttttccagcttcctgacttctgcgagatacttggataactcggggttagagcacttgtaatctttatgcacctggtttgcgactagttcggaatcccctttcacgatcagtcgcctgactcccaagtagtccttcatattcggctgtgttattggttgccctgaagttgaggtgaattgcatgcttgaattgatctcccgaaggtgatgtcaagatgaatcctgcccctgctccccggctgttgagtgctccgtcgaacgccattgtccatgtatcattgtcgatttggttgtctggcctattatcaggcatggtccaatcggctacgaaatcggcaagtacctgtgacttgatggctgttcgtggtacgaagtggatatcaaattggcttagctcgactacccatttcgcaatgcggccgacaacgtctttgtttctcacaactttgctgagagagaaggaggagacgactgtgaccctgtgggcttgaaagtagtggtgtagctttcttgatgtcatgattactgcgtagagcagtttttggatctgtggatatcttgtctttgcgtcgtggagagcttcgctgacgtagtagactggtcgttgcaccttctctctctcgacaacaatgacagtgctaacggaatatggcatggcggcaatatagagaaataattcttcattacgttggggggcaacaagtacaggtggattggataggtagcgcttgagtgcaataaatgcctcttcggcctcctgtgtccatacaaatttgtcttgcttttttagcagagcgaagaaaggttgtcctcgctctcccatcctaacgacgaacctgtttagtgctgccatgcatccggttagcttctgtacttccttgagtcttgtaggcgacttcatgttctcgattgccttgatcttctcgcgatttgcttctattcctctgccagagacgaggaagccgagtagcttgcccaatggtactccgaacgtgcacttctctggattgagcataaggcgatatcgtcagagattgtcgaacgtttcccacagatcgtcaatcaatgagtcgcttgtcttggtcttgacaacaatgtcatcgacgtaggcctcgacattgtttccgagctggtcgctaagtgcaccttggaccgtgcgctagaaagtgtttcctgcggttattagtccgaacggcatcttaacgtagcagaataccccgaatggcgtgatgaatgttgtcttctactcgtcttcttttgccatgcttatttggtagtaaccggagtaagcgtcgaggaagctcaacaactcgcaaccggctgttgagtccaccagttggtctatttgaggaagaggaaaatgatccttgggacacgccttgttgaggtcggtgaagtcgacacacattctccacttcccgttggccttccgtaccatgactgggttggctagccactctggatggagtacctctctgatgaaaccggctttgagaagcttgtcgagctcttctcgtatggcttgttttcgatctggtgcaaatctccgcagtttttgctttactggcttggcatcgggtcgcaccatgagtttgtgctcaatcacctccctgagtacccccggcatgtcggacggctgccaagcgaacacgtcagttgtcgcggaggaaggtgatgagcgcgagttcctatttctcacctagtgatgccccgatcttgacggtcttgtcgaggttggcactggagagtggaacgatcttgattgcgccgtctggtttcggcgtcttgtttgtcttgctcactttcttgggtggctctattgtggcaggcgggctgggcgtgtgctcgaccatgtcgaggctccgtttgtcgcattgtactgctagcttagcgttcccttgaatagtgattgttcccttcggtcctggcatcttgagcacttgatacgcatagtgagatgcagccatgaacttcgcgagtgcagttctcccaatgatggcattgtatgctgtatcgaattcagcgacatcaaaggtgatctgttccgttcggaagttgtttgcttggccgaaagtcacaggcaacgtaattttgcccaatggtttggacgatgactgaggagtgattccatggaagggttgatcggtgggtgtcaactcacttcgtgggatccccatcgcgtccaaggcgctggcgaagagaaggttgattgagctgccgccgtcgatcagtactcgggcaaccttgatattacgaatagtgggttcgaccacaattggatatcgccctgggatgacagcagtcttggggtggtcctcttctgagaattctatcttctactcggaccacttcatcttgggcacagccccctgccatgtcgaacagacttcacgttccactttcttgtattctcgctttgaggagtatgccgtggaacctccgaagatgtgtgagacatggacatcggagtctgggtatgctgagtccaattcttgagtaggcgcctcagcgtccttctcaaccacgcgtactcgcttgcctttttccgatgccatgtgttttgcgagccactttttgaagacgaggcaatcttctagagaatgtctgtccgtcttgtgtatagagcaccatgctttcttcgtgtcactgccttgtgggtctgggcgcttgggagggtccgcgtattctgttgcgagaatttccgatttagctttccttttcccactcttgcgatttttcttcttgttcgactcaagtgcgtccttggctggtttcttctctactccggtctttggtttgtcgttcttgcgtctcagtgcgtcatccgcatgagcacattgatcgacaatttcgaataatctccgagtagtcgtgatgcgcctcgttgtcaactcctgagtagtgtagcgatctctgacaccggatttgaaagcgcgaattacagaagcatcggtgatctcagggattgtgtttctgcactcgttaaagtgccgaacataatccctcaaggattcgcccgggttctgtgtcaacgcatgtaggtcgtcttcgatcgcgtggcgcttgtaagttccttggaagttggctacgaactgctgccataagtttgcctatgaagagatcgagtaggggggagatgcatcaaccatgaacgtgcagagcctttcagtgcgttggcaagtaattcgccaacgcgttgtcgtccgctccggcggcgtagagtaccgtggagtaaacctgaaggaactcttccgggtcagtgctcccatcatatttctctattgctacaggtcggaatctttcaggccatcggacatcccgaagtgaacgaccgaaagatctacacccagcgctaggggcggtgagttgtcggcgatcatacgttcttcgtggatgtctatctgatgatgaagatgacgaggatgatgatgatgacgatgggtcgcttgtttccggcgtacgattatggggacgtcggccgggttctcgagaatcctgtcgtcatctcccgctgttgtctcggcgccgatctccatcatcgtcgtcattattgcggcgtcctcgaccagtatcgcccagcacccgccgttcgcgatcgtcgtgatcgtggcggttgtggcggttatcacggtctcggtcttcgcttgaacggcctcctcgatcttcgttattgtgacgccgtgaagaaatatgacaccgggaatggttctcgttatctcgtgtgcgtcgcgcctctcgacggccattcaggtgatctcggagatcaccggtgccgcgaggtggaggggtggctcgatgaggcgattcccgctgttcagggttttcaccattagcatcgccagttggtggctgttccgggtgcgctgcagcagcggtctcttcgaacgcattgctgaggttggtcactgattcccgtagtcgttttgtccaacgtgcgagatcgtcgttcagaacgtgatcgtagggggtttccctcagtattgcgttgacggctctgatgagctgggccggagtagtcacttgattctccgcttccgcaccggtgcgcgctgacgtgccgacatcgtcgatagccaatacctcacgcggcgtactcattgtcgatgatccatagtcttcgagtaggtgcaagactgatggttcatggggatcgatgtcgattatcccaacaaatcgatctgaaatcggcatcgctcattgttccttgtcctcatccctgatggggatgcgtgactgctggaccttaggaggtggcgtcttcatggcgctgagaaagaccttgcagctcgagagatcgtgattctttgtcttgtgaataggacaatagacatcacgagttggagaggtacgctgaattccacgctctttacaggcacgaatttcagcatggacgttgagaaagacccagcatgcttgcagggtgtgtttcctggttttgtggataagacaccaggaccttgtcacctcggaagtaatccttgtcggctcgtgattcctgtcgggaagacaaggcttggccgcactaggatccttctcgggttcggacgtcgtcgacgttccgatctccgcttcggcgggtagatccttcgacatggagtcgccccgggttgtagccactgcgttctcattttcggtcattggcggaccagctgagatcggcatagtggtataaaccggaaagacgatttcgccgacttgagtccacaccagtgttgttgaagtaggaactccttagttgaggttggtgttgacgctgttgtcgacgaagctggatgtcatagtagtagaaccttgagcaccaagtccccctacctggcgcgccactgtcgacgggggatacccgtagaccggatatagagggtattggggtacgctggtacaaggatctacgtaatacgacatcaagcaggcataaaacaaagattatactggttcaagccccttggtaggtaatagccctaatccagttgatatgagattatatgatggaaaccacagattacaaagggaatagtggaactcgatggtaccgacgagatcgtaatcgagttgatccgattaaatctccgacgacttggctccgataagctccggcttcgtaggctatggtggatgtgttggctctgagattcgatgccttaggtccttccgaggggtcccttttatatcgcaggtcaactgtctccaagtaggactcggagaagccggaccgaacacgacacaatgatgactcagttctgaccgaataggactccttccatctgtgaactccatgatgaatttccttaacgtatgccgagcacgtccgtatactcgtgagcataccatatcgatacgtgacgtatatcgaagggtagagggtataccttacccgtaaccctgacaaacataatatcaaatatattgaaggttagatttaataaaattatttttttataagagttgttatatttttatataaagtagcacggtggtccacgcaaattatgttgctaacaccgttatattttcacataaataacatatacattttcacattttattattaaattatattaaaatggaaacataattttaaattatattctaacttatcaaactaaccaatatgcaattttcatattgtagtatagacacgtggtagtttgacttagactaaatttactgcgtcttatgagagggggtagctagctagcattgtttgcaagcttaatttggttggctcgattaggaaacccgagcatatattccattcagtatgctacccttcagacgtagggcctgtctgctttattcatatccatctatcctaatagtctcgaatagatcagtgtcgaagctaaaattatttttaacatgagtggagccaactagttaggtaatgactatagaaaaaaacaacataacagtgttggttgcctctgttccaagcttttctatgcgggtcgttgtggaacttatattgatgctctaatattctgaccaagccgtgttctctctaaaatttttagaatataaggatgggaactaatatgtaataacaattattttcctcttcgtgctagaagaattgaagtttgactaaattgaagaattgaagagcatagaaattagatctctgtgttcgaaaaaaaaatgttctcaccggaataacccaacaaaatatctaccttgtaatatcgtaagcaatatgtactgtggcgtcccggaataattgatggagaaaaaaaacataaattttttacaccgcacgaaatcacttttggggaaacacactctataaatatgattatttgtcatgggacactccatccattaaattaatattttcgtgctgactagacgagaagaggcccacttttttacgctccttgaccaaattacccctcctttctccttctcttcctctcttcttccttatctcttcccccccccc

SEQ ID NO: 42313 - DNA, 3017 bp, Oryza sativa
tgccagcagcttgctgtagtggacgccagttacaaattggctccaaatccaaaaggctcagggcgtcccattccgagcacgcggagagtggcttgcaacggataatcaatcctaaatttctaatcccaagttgatctgttctttttactatttagagcaggtacaatagcaggctataagccaactgcaaatatattttaagtggataaataaggagagagaagagtagcggactacagatttatagccagctgtagcacagactccaagacgcagtgtgtgtatgacaggttggaccaggtattaatagtgtagtatgtaactattgtatgaataagctatggctatagatgaattagagctagtagttggctatactattaaacttgctcttagatgcatgtttgaatatcaaagacgtttgtctagcttgcatgtacaaagtcctaatcatgccgccgagcaggccgcgcgtgctccgggcgccgccaccgccgccgagcttgtcttctaccgtgaccacttgtccgcagaggccatgtgcctgcaaaagattcgacaccattgccagccacgccgcgatgcctcagcagccaaccctgccgcgttcttgccgcaaagtgccgcaaagcgcgcttatgggagcatctcgacaaccacagcactcaccggtcagccaacatgccgacaacctcaccggagaagagagaaaggagggagagagaggaagagaaagataaaggaggagcaatttggtcaaatcatgtaaaaaagtggatcccctctcatccagtcagcatgaaaatattaatttaatggatggagtgttccctagcaaataaccacatttacatagtgtgtctcacaaaagtcacttcgtgcagtgtcctacagctaaaaccacgaagtcgtgatgtcttatagcaaaatttgccaaaaaataacgctagaattagcaagctgttggcacatcagcctcaagatgaccgatgactgttgggcttgtgggctaattgtgctaggcgtgcagcactagcagcaaccttgggctttggcccatccaacgagtacgagagcaagcagcagcagcagtttgcaagtctgtagggaaagaatgatcctacctcgagaatttgaggcgaaatgttatttataaggatgctttgccctgagcaattataacaccgagtttatttttacatgagtgtgtcagtacagcgtaggagtggtgaattgggcctatgagacgatgggtcggaaaagaattctccgaaccccagtattcgtcacgatcgccgtgcatacatatgttcaaccgaacaccaaagcaagcactgcacgatatataacacaccacggagtagtattcaatggtcgagggtgaagtacatgtcgaagacgacgacgatggcggtgtccgtggagctgagaagcttgctggtcatgtacccgcgcgcgaaccggagcttgcccgtgccgccgacgatgctccgctccgacgggcccgtcgtgatgaagtggccctgcgtggccagcgtgctgccgctgtacgcgccgtagtcggagaagacgaagttgatggccgtgaggccgcccgtctcgtccagcgacgcgtgcaccgcgaggccgtgcgccctcccgatcagccgcgacgccgggtccggcccctcccgcagcgcgttgtccaacacgttcacgtcgccgaacgtcgacgagttcctgcagtacatgttgtacgtacgccatcacgcaggtggtacatactctaattaagagctattcagattatagccaaaataacccttacaaatgtcaaaattttaacaagcttataatattattaaaattttaacatgatcttttatgtatttagtaaaatttgacaacaaactaaatacaggtactttttaacaattttataaaaaaaaagatacggttgaaaatagcattaatctgaacacgccctaattaagcttccatggactcatggtcaggtacgtaccggtgaaggctggcgacgttgacgacggtggcgttgggcgtgccggcgtcgacctcgtggaagtagaagtggagatgggtcagctccgcgtccacgacgctgcagacgatgatcggcaggaggcagaggacaaggagaggaaaccgagcagcggccatggagtgagctaattatctcctcgatctgtgcgtggtgtcagtgattgctgagccaattttatggtgaggaaataggaataagaggctgtgtggtctattacattgtactcacaaaaatgacccttcgatgcgcctcgtcttgtttggttgcgtgacttccgcacctcgcgcgagaggaactagtgtattcttccgctgccaaacgttggatagtcccaatctgatgtagccgcaaggttgttgcatggaacagttgtactttatttatttcaagtaacacgcatcttatttagaataagacgcctgtgttcgttagtgatagtttggaaattttttccctccgtatgaaaactagatagttcattagcacatttataattaagtttaaagaatttaaaaatagattaatataatgttttacaacctttttatatatttcttttaaaaaaagtattgtttagcaattcaaaaaaacatactataaacgagagcagaagctgagaaatgagttcagaacgcagaggctagctcacgtaatttctactatatcctaggtcaacttgaaaggattgatgtcacactaataattagcaactgataggaacattttatcgaacgataacgtggaaatcaccatccgctagtccatctgatgccacaaacatttgctacactgctatagaagtgagcagaagcagtagtcgtggcacaccaatgttcaggggacaaaaaggagcttagttctaataactcttccaccatctgattctcctatgaatgtgtgctacggttccctttgtacaagaggcatcattgccataatataatctgttactatacaattggtgtacaacatt

SEQ ID NO: 42314 - DNA, 1528 bp, Oryza sativa
tgattggtgaacacgtcggcgtcggcgagtcgaaaatgatcatcaacatcagtcacctctgcagacggtgcaaggatgcaaccaggggcatagaattctgatggtaccttgttctcagctagtcaagcgattatctgctttctcctttggtgtcctctcttcctgtatttcctccaggtcgtcgtcttcactacgcttgccagcttgctccttccaataagcaattaacttcttcaacctcatgatttcctttggggcaacatgcttgctcgtatcattgacaatgcaacgcactcgtgaagcatacctgcaagatggaggaaaaaaaatgccagtcaatactcaacaggtgtacacgagcaccaggggcataacacaaaaagacttgtatactggagcaatagaaattcatacatgagtgaattgtaagtctcctccaggttggactctgctggtgagacattcacaaacatcaaggttttcgcattgcctccaagagaatcactcatcagcattgtcaacttatggttccgataaggtatatgttgtccatcagaagataaagccccaatcacatcagccaatgcagaaagagacttattgatgctttgagcttctttcagttgttttcctgctgagccggactttttcaccctctcagaaccagcaaggtccacgaaacttagctgttcacacggaaaattttgacagcttagaatagcatctcacagcctagcttaacatatagtgtgttctgtgcagagtttatttattcttaattaattatagcaaataaacaacacaagaaaaataaaacttagaacatagtttgatgtagatgcctaaatcaaatatgcaagtgctacagcaatgcgtcggttttatgaaatatatattccgacaagcattctgcgatagatactcccagtcaaaactcaaaacaaaaggctgtcaaattacgaaaataactagatgcaaagagttattatgggcaaacaagtgtcatacataagaaggcaaaacttatcaacttgaggtaaggtatggtaatcaatcttcataatacgtccactgaaatatggacatatatggtagatgtttagtttgatatctgaggaacgtaccatgcaaaggtatatgtaaataggtattttgtaaaagcggcaaatttaaacaatatacaggtaagtgatagagacggttaaatggagacaataagaatactcaaatatagtttttttataaaaaaaattgtgaaacaaattggttatgcgacacagcaaggctagcatgaggtttccagttacaacccaccatacctttcctcttgcataagattgagtctggaggttggtactttcaataatgattgaaagaattaaatgagaccttgagctctcaacattcatatttgttccagcggtgtgtcttctctcggaacctcttaaaattatagccctcagttcttcaaaacttgaaatgttcacaactgtcacattttcaacagtaacaaccccctaaaaggaaa

SEQ ID NO: 42315 - DNA, 1690 bp, Oryza sativa
ttgcctattgtgcatttggctttgaaaaggtttgtataaatctatatatttcctgcatgtcaacattttttgccagtagcagtttcagcttccaaataaaaagctatcttcctctttctggaatatgaaaattttgcatgatgtaccgcccatccttctgttattcgatgaacttaacatctgaattttgggtttgattcccaaatcaattggatgagattaaaatattgggaagaattgacgcaagaagctaagttgtgtgataagtgatctgataggttaaaattttgtctttttttatttaattacaactaggtccaagatatatggattggaggattgcttactctccattgatgaaacctcaactgaacccaagcaacttgtgaatctgtatttgttttttccggataaaaactatgataattttgatagaatattgtccatatattccccacttggttgtaggtcatgccagagaaatcattttttgggcgtcgaccgccagtgcctctttggaacaaggagatacatatcatcgttggagagccagtggagtttgatctgccaagcttgaagcaggcagcaagaacagtacctcaggattcatcttttgaaaggaagggttggccaagcatcatgccagacggactagatgaagcggctcagagatggctttaccagaagatatcagataagatccaatcagttatggagacattgcggaagagacttctcgacctgaagcaacattgatatttggctgtttacttgcaatccaaggaggcacctcctttttttgaacaataccttcttgaaatggtagaatatatagcttcattgaacagtttcagatgatgcaaagacgattgagagtaggcagtggacgctacatctgttgaggtgaaaatttgagacgacggtgagagatagaactcagcatgttagattacgaggcatttctttttcagtaggtcaagaatatttgtcaagcgcctacttttctttttattgtttggaatggtttgccatgtttacgaggcatgaataaagtcatcgcctattcaacttgttagatgttctattcttggcttgtttgttatttctgtcttccccggcactatgtgcagctttggtttaaaacctctttgcaccccagagaagataggtgccaaaaggcccaaaaccgtggctcgcacacatgatctgttagtatagactgtagtagtgcttctgcatagtgtgttgcaagctgtgcccttttttattctgaacctgtggatgaccgttttactttccagatcccagtagtgttggtgttggttgttggatactaccggctcaaggaccaaagatccagaagggacaagttcgagcccagacggacccgatgtgcgatggctttttctgaacattattcggctgaaccgcacgaataacaggtatgtactactagtatatcgaggacgaaaaatgcaatcccacggaccactggatcacatgacgcaacaactgtgcgggcgagcaccgtttgctgtacgcattcgctgttttcttttcctcttttcgaaagtgacccaacatgccgccggccagccagccagccatccagccatggtggaaaccgtcatttttctgttattctgtataggcagaagcagctgtctccacgggcaacagcaggagcagg

SEQ ID NO: 42316 - DNA, 1304 bp, Oryza sativa
aatatataggcttgcaaaatgccaggacaaattaagaatttgagatgggaggaacgggacagaaagcgatgtcatatcctatttgctctcccgtaggacccataatcgctacacgtggaatcgcgggggggggggggggggggacatccgacatgggattcgttcaattccaactcatgcggggtaaatgaatgcattttggtttagtacgcttcacttcattgcacaaataaattgcgtgattcagtacgtactataaaatccaaaaaaaaaagagttaccagtattaccattagcatatcattgcataccagatacgactctatgtttatactaatacgtgaagctgcaaataggcaaatgaaaatcaactcatctactgcctggactagagtacgagaagtaaaaatcttcacgtcaggatgcatgctgtgtgtcacgttgctcatcgcgcggttcacgcttgacggccatgtcatcactgtagagtgggcccaacaggacacctccccccttgcttcttctttttttttttttttttaaaaaaacaacgcaaactgttctcctcaagcgcacctcccccccgaaaaatcaaaatcgaagcgagagcgagtagtaattccctcgctggcgctgctgcgtgatttctttaatcctccgcctccgcctcctcgtcctcgccaccactactcctccctctcgtgagcccctcgcctctccctgtctccctcccacctctctctctctctctctcctctctctctctctctctctctctctctctctctctctctctcctcctcctcctgcaccgccccgcgccgccccttggcttggatctcgtcctgccggccgcgggcggacgcggcggcgacccggtcctctccccacaccccgacacgccgtgcgagtagctgtctgtctatactttcgaggcctgcattggcgggatctgcgtccattcgtcgagctgcacggagcggggaggggcgcggagctctgagctggtgcttctgcttgcgttttttgggtgtcgctggatctgagggccgcgctgctcgcctgctccacgccggctaacgggggcggggttcagggggttcagggggttctggtggtggttggtagcgattgctgcgtggtggatgggagttgaggcttgaggttgaggggttgcgtctctgaggagcggggtggataagggagatggcggccggcggcgtcggtggaagcaacggcgcggctactgccgccacgccgctgcatggctcggcgacctccagcatgaacggtggcggcgccag

SEQ ID NO: 42317 - DNA, 857 bp, Oryza sativa
tgtttacattacgattgatgaccatgttgtgcctttagtggtttacaagagcgtacactttagagctgaggcattgttttgctgaacaattgcaacagttgattgtttgagacggaagatgcccatcataattatcaccatgcaataaatttgacgagatcctgtaacaactaagaattgatgttttctctataaatggatggtgacatattgagagaaaggataagtattcatatagctatgcattttgcactattctaacttgaataaataggcttgtctacctcgttgtcattagtccttttgtccttaacattagtatttgcaagtaggaaacttaccaggctgaagaattgggaaaggctcctcacaatcttctcattggttgtaaactggatcatacttgaatcttggatttaacttagttcgttagagttctgtgtttatttgtaaattttgtccctgcgttcagtacctgtagactgcagtgattcaataggagcatggaaatatttcaatagaatcgattattagtgtcagtacgcatgcataatgaattaatatgactgccatgttaatcgtagtactgaaatatgagtatatgacaggtagagggctttctgaaggcaatgcaaaaacagatccattcagctggaaaacgtggttttttttcgaagaaatctgtgggaccacatgttcgtgaaaagttcaccttggaagatatgttgtgcttccaaaaggtgatgccatcaatccccacattatctgttaggttgcattttgagcaatttgtttatgttttcaaatcctttgcaaaagtataagattatgataaaaatggcgatgcttctattatt

SEQ ID NO: 42318 - DNA, 772 bp, Oryza sativa
aaaggctacatatatccgatacgatgtggccgagttaaaaaaatatcattctctaaaataaaaggctataacttaatttgtgagtaattatagcataatcttgtgaatcataatatatactaaaatgttaatcatgagactgatcacaggctcacgaatcacactacatgtaatgagtttaacgagctaactcggacattttaacgggtcaagttaagtttcaattcgttcccaacttattgtgttaatgagtcgagccgaacaaactcgttaacttaacaagtttttacgaattacttcctccgtttcaagttataaagctttcacattgcccatatatatatatatatatatatatatatatatatatatatatatatatatatatatatatatatatatatatatatatatatatatatatatatatatatagagagagagagagagagagagagacctatacctattaacaaaacaactaaaatttaactttatttcacaatccatgattacatacctaactaattatatgtatggatgctatatacctagaatcaaaatctaacaaaaacaagttcaaattcagtataaacatgctttgaactagttagtaaagtacttaatgttaatacctaagtaattgaaaaagtttcatactcatttgaattgggtatatactcaatttcaacaatgatgcccgggcaccatggagcaccaaacaaatttaatatatatatatatatatatatatatatagggctgcaggaat

SEQ ID NO: 42319 - DNA, 949 bp, Oryza sativa
tgctagttgatgattggaagcttctcgatggcagctttgattaggctaacaacagacctggtgatgctattgttcatatcttgttctggatcataaataccatcagagcaaatgttgccccaaataccgatcttgactttggtaagggcggagaggtgctggatgccgaaatcagaagcaccattcaggcaatccattccatgtaaacggaattccacttggaagttatcaagctttggcattgattctggttcaaactctagcaaggtcccacatctcttgattcgtaatgagaaatatgtcagacttctgaatcctttgttgctacatatgatgatccttccattgatgccacacatagttttaagtttgagaaaacacaagctgggtattgcgccaaggatctcaatatcattcggtcccattctatggatccagagttgtaattcagtgaggcttccaagcgagctcatccagtttgggaccttacggatgtaacagcctatgatatgaagcttccggatgatgcaaggactaggagggtaccacttctccatgatcagtgggccaccggtcaaatatagatgatgaaggttgctagatagcaaagctgacacgtaattttgacactcctcagcatctgaccaccaaaaaagatgaactttcaacgtcctaagctttgatagctgactgaatccttgcagagacttgcctagttcacatgacacgccaaattcctctagttctaccaggctatgcatcttaccaattaatctgtccggaaatctagtccctcttccaacatatagattggccaggcactcaagttttgcaatacttagcggcagttctagaatttcagtataagatatgtccagtgtttctagacagttcacttgtccaatctttcttgggagcttagttattaatgttgaccggagagataaat

SEQ ID NO: 42320 - DNA, 22747 bp, Oryza sativa
  unsure (1)..(22747): unsure at all n locations
attcctgcagcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctattcatattatttaaaaaattatataaaattacatttttacttgttttattattaaagaaattttaggtatgacttatactttagcatatatatttacactaaatttttaatttttaaataagataagtggttaaacgttattctaaaaatcaacgccgttatttatttagaaaatagaggttatacactccaacattattgattaatcatcataatctctgtatgtggagtgtgctcaactcgtcaattcccatcgtcgtcaagccatgagcccatgactgcatgcctagtgtgaacacataagatgaacgacgacccgatcagatcacttctctcccgcggggaccggggtcccagtccaacttgcacatgtacactacacgtaggcttgccattttgacttgttgaccggtcaaacatcaccatgcattttgacacaccatttcactctcaaggtttacgcgtacatgaaatacatgtaaagacaactataaaatgcaagagctctcgtgatcgagatcaagatcaaccacacaccaatccactctaacacctacgagctccgagctgcagccatggccatgaccttgccgtcaccgacatcgccgtcgttctacgtgtcgtcctccccgcgccaccagccgggcctgctcctccccctcccgtcgccgtcctcctccgaccggcgccgcccgatgcagctcgccgtcgcggcagcaatggacactactccgagacaaggcggagtgctcctggagatgaggcctagaggaggaggtgggggagctccccggaggccggcgccgccggccggtccgagagaagggcgcggcggagtggtggtcgtccatgcggtggcgagggacgctcctccggagacaggctctggcccaaagatccattgattcacaagaaatacaagatcgtcaagagcaagattaactgaacgttgttagggaacaaattagtttctgaacttaatatcttcgttttttaatatatgatgtcgatgatttgtacattatgtatgagcatttgttttaccttaattaagatgccatgcatttctgttacatttttgcgaacgattttggaagagttattcattatatgggtatgatgcacatgtctgaattaattaatgcaatcaagctatcatcaattatatatgatgcacattgtatttcttaattacaccttttgtacctctcacatactgtcacacatggtccatcgccaaacacatcacaaagatatataaattgatactaccatttgcgatcattcatgcatatgccaagttgaattaaaaggacgtatattattttaccatcattaattcagtattttaatctgatataacaaatcgcaacttgtttgatatagagcgtgcatcagtacagcagcaaaaggttgacgtgcaatttgccttagcatatcacaacattaatcctatatacctatacaaatcatccctactactagaattctctgcttcctggtgcttccacgtcaccccattttcttcccaccgttcgatctcaatcaagcggtcgcatcgctcctctcctctcccacatctcgctgcttcaccggccccacgcgcatcaacccctctctcccgcatcgctcctctcctctcctctcccctcgcacgctcgcatcgattccctctcccgcatctcgctctgccgcccccttcgtatcaatctcgccgtgatcctctccatctcccgcatcgtgctcgcccgtaccggcgctggcatgtcatccgcctcccgtgccacacagaggcaggatgagggtgtggcgcttcccctcccgtcgcccccatggcggctcgtgcgctgcttccccttcctctcccatgtctaaggttgtttgcctctttaggttgccatgattaatgaaaaccgtccacaaccaccgaggaaaacacttcacggctgttatcaagtaaatccattaatggcttaatgcgttttcttctcctcttatccctttatcagttctgcatctatatccaatttatcatctcgcttattcgtcgatctaccacactctaccaggctactggcgttttactaccgttcttgcaactctgcttgctggattcatatgcagccctcacctagttgatcctctccaattacttcaatgatctaacacaggttacctaccgatttcccctttccttatgttcaataaatctgatacccagcagagaattttattgttgttgtatcctctttttccaggttttaggttcttggctactgatttagttgattcatattctttatttatcctgaattatagaccacttctcattcttaagtggttgaagacgtggcaaatatgcatctattggttgatttgtcgtcacccgatcagatctaagaactcatcgagctaagtaacaatcatatgggctgctaagcggatggagctttcttcttttggtattttaattatggtctttaactggtgaagctatatatatctcggtacatctatgacgttgatgtgcttttcacttttgataaggtcctcatcaagaatgatgtcagattctccacacacagacacacaggtttgctcttaaatagattaggttgtcttccgtctcaaagttcattttattttctgatcatgtatactctagatatgttttttaagtatcttttgtcactcttgaattagcttggtgatataaatatttttggagttttctgaaagctaaaatcactccaaagagttaatcaaggatgagtacttaattatatatacgaggtaataatccttttcccaacttcccatatcttactcaagcatgaaaattttctaccattattatataatagtttgacaccttagttatgatttccttgctatcagtgataattggactatatttgtagatgtttaaaaatataaaatattgatgtttcagttatggttattatcagttttgtaattgtaaagtagtcatcactcatcacctaggtttgctacatgacttgactacattcctgatcagctatgcaactacaaatgcgctcctaatgttcatcgcatatttatacgataagatatgcataataattgctacttccagttaaataaacatttcttaccacaattatatatgatattctagcaccttatccatgaatcaattggcattcatttgcaagattaactacagaatttccaaaactgagatcaatgggtcaacgagggaagcggtactaggaaaaatgtcatgctgaataaaggctatcaagttaacgaggacagcagtatgacaccttacttacttttctactgttatttttcatacatgctatgttcataaacacatagtacataattttgggtaattttattgatggtgtatatttttcattttccagtaatgtttagtggccttcaattttgtttattaatacttgctctatccggtcaaaagccatatatttgagttgtaattctgttagttgcattggccaaccactgctacctggggagatactccatcatgtaatatttagttataattaccactgtatatactccatcaattatatggtaataagtagtttttttcttttttcttctcaaatgttatgcacatattgcatgtttaaaagttatttattatgtccgcagcaacgcgcggggtattatctagttaatcatcaacttgaccgatcgaccgagacagcagcaacatatatatcagatcaatccagggtcgagtcaattgcaagcaacgcgaagtcaaacgacaaatcgaaatgcatgtctcatatatatatcacaattaaataggagtaaattacgttcagggtaagaacttaggattttttttttaccatatgtatcagccggacacagcattccatatattttccacaaagttccaccgtacggtgaacgtaatttacttattaaatagtcataaacaattctagaaacatttaataacatatattataatgtcaaatatcgctccataagcatataaaaaactaaattttcaataatctatgtaatataagaaagggaaaattttggtaacaaatagaatctatccataacaagatttttttttgatagacttaatattttgcaagtagataagaaactatttatataagtattttcttttttaagggatttcttataacaatttgattgatacatttgaggagtaaaatcgaaacaaacgagcgctctcatgcgaatcccaagtcagagcatttctcattttactatattcttaattgaataattttagctcctgcagtcaaaaataataattttaattctaaagtaatacgccctccgtcctaaaatataagtatttttagtatagtgacaagtcaaacatttccaactttgactattaatagcaaaaaagtaaaaaagatcaatcatgtaaaattgatgttactagctagatttatcattaaacaaaatatcataatatgtaactctttttatttaaacatcttacttttatagatattgttggtcaaagtagcatatggtagaccatatcagagtctaaaaatacttatattttgggacggagggagtactaagatagcccagagaaatttgctccgtgcatatatagatgtccatatatcccattgaagtgggttatttttttcactcgagtgatgtacaattgtttcatgcatgccatccacaaaatcataaaataatttgagaaaaaataggtagctggatatataggtgaatatttgatatacacattcacaaacatgcccccagcaaaaataattcacaaacatgaaattttcaaatttaacttatacaagtggataaaatatttctagttgtataaaattgaatttgatcgtgcatatttgtgaatgacgacatatcacacatatattacctgatctatcttatgaaattgttttaattttttaagaccttttctaagtgacatatattaaacgagtgtacatctacttagggaaaactcttttaatcgcccgggtggatgtccacctgtttattacatagcatctaaatagttatgaaaaatttgataagatagatcaatatgaaatatatcactccacaaatatataagttcaaattcaacttcaacaaattgtaataaaaataacaaataaaactcaaattagtataggtatgttttcatttaaatttgttatttttgttacaactcgtagaagttaaatttgaacttacatatttatggagtgatatattacaaatattgaactatcttatcatttttttaaaaaaaatcataaccatttaacatgcaataagcaagtggatgtccgctgagtgattagaatccatcttcatctacttagtgacaaaaagaattttccagtgatacagtgggagctagacgtactactggtacattgaaacagatgtagaacatttgtacacacatacacaaatataattaaggtgtgtgcccattgtgtattactagtattactacttctctgatcatggagacagtcatatacttacacacgtactatgccatacacaattaacaacacatcacaattaattttaatccatgaccagatcaactcatcatgtatcggtcaagtccaacactgtgaatacacacgtacggaccaacaaaaatccattgaccacttcctctctctcttcgtcaacaccagtgcccagctactgttcggtcaaacgccacggttagcttagctcacctgaccatttcgccgccgcggcgtgtcgtggcgcgtggcgtggcgtcgccggctacaaatacggcagatcactcgacaacatttcatatcctcatccatccatccaggagcatccactgggcattagctcgaagctcgggactcgccgcgacgacgcgatcgatcggacatcggagtgagcgagttagtaggtgactaggtgttcgatcaccgtgcctggtggctgtggtcgatctaactagctagctagctcgatcgatcgccggaattaatggcagccatggcgtcgccgacctcgccgtcgtcgttcctcccggcgcacctcctgcggccccacgccgcgtcgctcgccggcgcaaacgtgttggtgagggacgctccgcctgagacaggcgggggcccgcaccacaacgccgtcctccgacagccgccggtgatgttggcggcggcggcgggcactccggagcaaggcagtggcccacactacaacgcggtcacgcagtggaagcccaggggaggagatcaactccgactgcccgcgtcgccgccggtgatcttggcggcggcgagcactccggagcaaggcaacggccccaagaccaacgccgtcctcaggcggccaacgccgcccggtggcgccggacctagagaaggcagcggcggacgcggcggagtgatccacgccgtcgccgactccgcgccgcagaggccaggcgcgccggcggagggcgccggcggcaatggtggagctgtccatgtcgcccctgctgctgctgcctcttcttgagtagaaagctaatgaaaaacgcacaaaattaaattaagatctgattaatttccaaaattaaagtaagattttctagaggtagctagattactgtatatgatattatgatgtagtggtagtacgtacatgtacatgtctgagttgaagttcagataaaaatgtctgaacttcagttggaaatgaagggaataaaatcaagcagattatataaaatcaagcagattaccaaatatcatgccttgcatatactcctattcaagttcctttctactttgattttgtaatatattatagttcagatctttgtgcatgaaaccctgtaattaaaacgagctctaaagcctacactagtgctatacataatactttttcgaaacaagttgcataagatagtgcgacgtttctattatatagttggaaaaaaaatacaagtccatggtcttggaagtctatagtcaggaaaaagaaaaagacaatcacatcatacgtatacgtatgatcctactgctagaaatagaacaaacagacaacacccataaggaatgggtcttctgaacgacgccaatgcacgagcaccgtccgcctccatccgtcctaaagaaccaggacttggttttcacctaaataacccattaggagtaataagctgttatacataatacatttgtaacaaactgtttgatatacatcatgagtaaattggcaccaggatatattggaccatacaaaattcaagctagacgtgaagaagttgcatatcagttggaattactagaagaatttgcaggtatacatctagtatttcatgtatcacaattaaggaagtgtctcagaaaaccaacaaatcaagttccactacaagaactagaactacaaccagacctaaaatatgaagaaatgcctgaacggattttagagacagatgaaagaagacccaggaatagaagtactacattttgttgagttcaatggaaaaatcacactgaagatgaagctacttgggaaaaacggttggaattgtagcgtgatttttcagaactattcttcctttgagctgaatctcggggaagtgattctctttatggggggtaggtctgcaacatactcaaaaatttcaaatttttgaagaaaatttatcgcgacgattttttcatttggctcttattgaattttactaaattggagcattttattttttttattcttttcaaatttatatcttaaaataaatacctttcgttttattttaaaaaatatatcaaacctcttgatactctgaaaatcttatttaaattttcttgccaaagttcaaaaattcctcaaacttctccctttagattccatctcctttgaatcctattcaaaaatcaaaaccctccacacaaaatccctaaaggttcctatttgttagggccgaatttcagtctatttggcccattccttctttcttcctctccactccactccctcctcctcaggccgccagcccacctagagtgtggcccagccgagccggcccaatcaagagcggcccagccgggcccgcgaggtcacctcctctctctcctatgggcgccgccgccgccgccaccgcgccaccacgggcgccgccacagcccagccaatcccgcgctccgccgccgccgccgcgccacccccgcgccgcaaccacgcctccaccgccgcaaaccgggtcaccccgtggcgcccccacagccaccgccgccggctccatttccgcggccgccgccgctgcccaccgttctcgccgccgccgcacgacgccgcgccacctcccgagccgcgtgtcgccgccgaccaccgaacctccatcgccggccaatccgacgaggacacccggcgccgccatccgtatcccgagccgacgccgcggcgtgccgtcgccggctacaaataccgcagctcaccggacaacatttcatatcctcatcaaccgcatccgcatccatccatctatccacctcgctcgaagctcgattgtcgcaactcgccgcgacgtgatcatcggacatcagactgagttagtctcgtaggtgttcgatcgatcgccgggatggcatcagccttggcgccgttcctgatccccgcacacctcctgcagccccacgccgcgtcggcgtcttccggcctgcagctcgccggcgcaaacgtgttgctgagggacgacgctccgcccgagggaggccgaggcccgcaccacaatgccgtcctcctcccacagccgccggtgatgttggcggcggcggcgggcactccggagcaaggcaacggccccaagatcaacgccgtcctcaggcggcccacgccgcccggtggcgccggacctagagaaggcagcggcggacgcggcggagtgatccacgccatcgccgactccgcgccgcagaggccaggcgcgccggcggagggcgccggcggcaatggtggagatgtccatgtcgctcctgctgctgctacctcttcttgagtgcaaaactaattaaagacgcgcaaaattaaattaagatgtgattaatttaccaaatccgaggcttgtttgacaggttacagtaaatacatagattcataattttgtaagattttctagaggtagctagattactgtatatgatattatgtagtagcacgtacatgtacatgtgtgagttgaagttcagataaaagtgtctgaatttcagttcgaaatgaagggaataaagtcaaacagattacaaaatgttatgccttgcatatactcctattcaagttcctttctactttcattttgtaatattaatattatcattttttttcaaaaaatatctatctattatattattaaaacagtcttgaaagaaagaaatatgttcgctgtggaggctagaaattcccacattaatcgaagaaaaagaaatgaacagttcaaatagagtacaatttagaaatatcaaaaattcgaaattaaaaataagtagtattagaagaagagtccttattgaaccaaatacgagattaattaaaattcagaattaaaaataaaataaattctgaaattagaaaagggaaaaaagagttcaagtagaaatagaagttagaaatatctaaaattcggaattaaaaataattaatatatgaagaagagtccttatagaactgaataagagaataattgaaatttagaataaaaataaaataaatttcgaaaatagaaaaataattataagagttcaagtagaaatacactttataaataaaaaaatatcagaataaaaaaatatggaatttttttttaaaaaaattaatcaatctagaactcaacgacaacaaataacagtaaaagaggacaagtaataggcatgtaaatcagtaaggtggtgaagggttgatgggacatctaaaaattataaacaaaaccagaaatagaaccccaaggatgattaagaggtggaatgacagacaggacattaagcagcatagtcatgacagttggcgggacttctataaagtaaaaaaataaatcgaaataacaatcatgttttatttttaaaatctcaatgataataaataggggagacaacgggcagaccatacaggagtatagtggtgtgaagccgctcttctagaaattaaaaaaatgaatccttaaaattcgaaataaagaataaaataaattttgaagatagaaaaataattctaagattttaagtaggaatacactttatagataagaaaatatcggaatgaaaaatatggaattttcaaaaaaaaaaattaaagtccatgtagacctcaacgatgacagataataataaagaggggagaaacattaggcccgtaaaggagtaagttggtggccgttgatgtgacatctaaaaactataaatgaaaccacaaatataatcccaatgatgattttcttttactgaaataatcccaatgatgattaagaggaggaacgatagacaagccgttaagcagcacggtcacaatggttggcgggacttctagaaagtaaaaagtaaatcgcaatgacaatcatgttcgatttttcaaatctcaatgataataaaaatacatgagtatagtatggcgaagccgacggcggttgggcagatttctacaaagtaaaaagatgaaccctaacgataattatgttcaatttttaaaatcctatcaacaattaatatgggagacaataagcggatcatagagaaatacaatattgacgtttgacaacactcctaaaaattataataacagaacgtgacgagacaatggactctaaaaagtagaaggtgtattttttaaggtttaatggaagataaataaaagccgtgatatagatcgggtaaacaaataaaggggtgataaaagagcaagagttaacgactggtgtgacttttaaataaaaactataaaaatttaaggatgataaggttcggtcttttaaggttataagacaacataatggctatttaataaattttaagtaatttcaaatatagaaaaatagataattttacatgtgtgctagcttttgcgcggatcacccagctagtttagaaatatttgaatgatatacaaacaccaagagacatctcttgagaatttaaggccgttctatatgtactccaaccgcaaacttcaatttactcgtttttcgttagcacgtttcctagactgctaaacgttttctgttgcaaaagaaaaaatatgtagaagttgttaaaaaatcaaaatttcaaatttacaataattaatatttaattaattatgtgctaatgagttttctcttttcgttttgtgtgccctgcaaatattcttggtgaaacaaacgaagccaaatccgttccgataaccccaaaactcgcactttcgttgcacattaactaaaacacaatttttaagtcacatgccgttgccgttgccgttgccgggccgcttctccggcgttttcctcagttcaccacatgccacctcctgcagctggtcctatacccttactgcaggtctgcagctgcagctccgccatcattcttcttcttcttcttcttccttctttttcttcttcttccagcagctcatgccggcatcagcagcgtccccatcaccaccaagaacagcagcatgctagtcttcgtgtccagctccggcggcacccatgggcagggcaaggaggcggcgagtgcgcaggagggcagagccggcgaagttgctggcagcggcgagagcgagacagaggcatgccgcgccgaccaaggcccgctcggcggctgcaagtagaggccgaggcggcgggataggaggaggagggagaccgcgacggcggcggcatctgttgagcggttaaggtggtggcatgactgtcacacacactccaagccgagacgtgcgggacggattcaacatcaaataactttgatttgatctaacctcttaaagacgttataactggaaccaaatttcttatagtcaaataacatacttagggcatatttagcagagcttgaactcataaatttaacaccatgagttgagtctggagtagagttatggagctgcctaaacctagatccacctcgttagtttattttgtgagagtgctccacccaactacactcccattctaggtggagctgaaattatttagctagactacagctctagtagagctgtagaggtagagttagagctgtgccaaactgactcttcgtacttacggtgacaccatgaaaacgagagtgaaaacactgacatgtatataatacatacggtgtgtccactgtccactccatggtgtattactgcttctctgatcgagacactgatgcacttcagcacttcgcaatcgatgactagatcaaacacgtacgatcaccacatgtaaatcggtcaagtccaacactgtgaatacacacgtacggacgaacaaaaatccattgaccacttcctctctctcttcgtcaacaccactcactagctactgtccggtcaaacaccacacacctgaccgtttcgccgccgcggccacgcccacacgcggcgtcgccggctacaaataccgcagctcaccggacaacatttcatcgtcgatcatcaaccgcatcagcatccatccatccatccatccgccgcgctcgaagctcgattatcgcaactcgccgcgacgtgatcatcggacatcagactgatcgccggaattaatggcatcagccttggcatcgccgacctcgccgtcgttcctcccggctcacctcctgcggccccacgccgcgtcgtcgtcttccggcctgcagctcgccggcgcaaaagtgttggtgagggacgctccgcccgagacaggcggaggcccgcaccacaatgccatcctcctccgacagccgccggtgatgctggcggcggcggcgggcattccggagcaaggcagtggcccacaccacaacgcggtcccgcagtggaagcccaggggaggaggagaactccgactgcccgcgtcgccgccggtgatcttggcggcggcgggcaccactccggagagaggcaacggctccaagaccaacgccgtcctcaggcggcccacgccgcccggtggcgccggacctagagaaggccgcggcggacgcggcggcgtgatccacgccgtcgccgactccgcgccgcagaggccaggctcgccggcggagggcgccggcggcaatggtggagctgtccatgccgctcctgctgctgctgctgctgccgcctcttcttgagcacaaaactaatgaaaaacgcacaaaattaaatcaaattaaattaagatgtgattacaaagattcgtaattttgtaagattttgtagctagattactgtatgtgatgtagtagtacgtgtacatgtacatgtgtgagttgaggttcagataaaaatgtctgaatttcaaattatgtgaataaaatcaagcagattatcaaaagttggtcttgcatattcaagttccatctttctactttcattttatatatatcagctcagatcctgtgcgtgaatccttgtaattgggaaagaatttttgtcactcgaatagacacacaattatttcatacgtgctatctaaaagtcattgaaaagtttttaaaaaattgataacatagctcaatacgtatactaaattgttaaccgtggtttaccccagagttagctgtttgctatacacgagtaaattaataatatattaaacccagtttggtcacatatacagttcgattattatgcttgaaaaattgtttcacacttttactagtaccaattcaacatgatttgctgttaataccacattctgttcatgatcaactgctctctagttgacctgaagtcaatgttcacacttgtcgtcttggtcttcatctcctaggtgttgcaacttgtatcactggcttctttgcagtaacgaccggttcagtttgatggatatataaaatctcggacattgtactattataatctgcatccacttcaattctcggattatctgtggtcccccaatttcattctttctgttacatgaacatagtaaaacgtagtcgcagtttcccgattttgagatgttgtatagcatggggtaggaaaaaaaggaaatgctacgggttaccgcacacacttggactatgttcttcgttcaaggatcacaatctcatctttctcctttttagcatgtacgcttcccaaaatgttaaacggtgtgtttttttacgaaagtttctatataaaagttgttggaaaaaatatattaattcattttttaattttaagttgatacttaattaatcatgttttaattcattgctccactttgaatgcaaagagtaggggttcccaactcctccaaaataacacagccttagctaccagtacatctttgttttttttaaaaaaaaatccatgagctctgcaacaatcgtgttctcactaaaacctggcacttagtaaataactaacaattgtgaagtaagtgtagctccattgcgtttccagtggtgaaacatatccatccgagttcacgttctagacttaacagttggcacgagtgctcgtatttatggttaattatttttaagtggtagatgacgttcctttcggagatgttcacaggagtgtgtgggcaatatacccctcgacaatgaagatctccacaacaaggtgatgcccagtctttagagatatgctcacgcgcatgtggtaactttgtaaatacgtggtctttggaagtgtttatatgaatgagtgtacgcacgtttatacgagcttctctatctcactgtactgtattccaaaaaaaaagtatagtaccaagtatatgagcatggtatgatgacttaattaaccttaaaccttacttttttttagataatagaataaatcacagcatttgcttcaaagaagctattgctaattattacaaaattcgctcaacaaatagcacaaaccatcctctcaaagaagagcacaaattatcctctcaacaaagagcaccaaagagcaataaaagatgcacaaacaaatgacctccaacataagacaaaaatccaatattattggaacctatttgtaaatctccatccattgacgaaaatctgcataatcattgactctagattacgacatgcaacatacatgagttcactgctatcatcaaatctctgtagttgtgtccaaatccagagcaagtgcgttaccctgaaaattacttgcatatatgatttagacggggatttatcaaacatcatattatttctactaaaccatagagcctaacatatagcagatgcttctacaatgataagttttttttagtttttcatcaattcccacaagccaattctcaataaatgagatatactatgtggatgatatagaccaaaagaaatatatattgatctccaaagtaatctagcaaaaatgacattcaaaaaaaataaatgatgaatcgtctcatttttcataaaaaaaacatcttatgctaccattttaattccttctcatcaaattagttagaactactcctttaaaaaaagcacataaaaatcttaattttaagaggtattttaagttttcagatagtctttttcttgttgatatggttattatatactctacataaataaaacgaattgaccattttgatagaaattccatttgaatatatcattttctttgatcaaatcttactaggttttgtggaatatatagtattactgttatatatcctttcgtcttaaaaaaacttaattccaacaataatcctgaacacatgcgtgtatatattcattgcgagaattgttttttttttatggagtagtattacctaacgaccaggcaaaaaaaatgctacattggcctactaacacgaatgacctggacttgggtcgttgggaaaaaaacaaatattgctttatcaaaaataaaataaacacgctttaaataattaactaattactcataattaattaattgcgaaaacatatagtattatatgacgacgactggagtggactgactattgatctgtttacataagagtagcagagcgagatagagtgatcagtgcagcagcagcagctagctctcttctcctccagcgactagctagcttagcttagctaggagcctaggatatggcagccatggcctccttcatggcactggccggcgcgtgccgccgccggccgcagctcctccggccatcggcggctcgccgcctcagcttcgtcttcctcagtcgtccatttcctcctgctcctgcacccttgttgcagctgatccagcggcagcgccatcgttcttcttcttcttccagcatctcggagaacggtgcggcagcgccggtgaccgagaatctgcaggcggcggcggcgaggcggcggaggcaatcggccggcggccgcccggcagctccgaggggaggccgcggcggcggcggcgtgagaccgacgccgcccggtaacccgagagaagcgcagaagggcggcggggtgatccacgcggtggcgccgccaccggcagcgccgacgagcagcaagcctaagcctgagccgccgggctacccgagggaaggcggcggcggcaatggcggagtcgtcgacgatgtttctccttcttctaccgatacctcgacgtcttcttcttcttcctcctcctcttgaggatcgagagattgaaaaaagagtgaagaagaagctatgaattgctactgcaacatctccattgatcgattggattgcttagctttgctgctgctcgtttaatttcctctgtttatgtttagcactggattaattagttgcaagtagttcaagttcaggatatatataatttgggttgctgcatatttgcaaattgtaagttaatttgtaacatgtagtgtttgtataattgtattgtatggtgtatatatatatatttgtactctactcgatcgattagaagaagatttaatttagtgatatcgttctaatgagcaggccataactgcaattaatgttcagcttgattcatctacgacctgaactggataatcttatcgttacttttgaacaggcaggcgtagctagtcagtacactcattgttagttggtgcagttgagcaaatgacaagagagatagatacatatacatagtactagtagttagtaatgtgcattaggtactcagtactaagtctggatgattcttgagcaaacagatgagacaaacaggtagggcaagatgtgaggtacatgaagctaattaacaagtaccctctccggcccacggtcaagattcgtattgctaagttgctgtttaatctaattttagtttgctatggccgtgtttagttattttggtaaaaaaaatttgacatatacggacacacatttgaagtattaaatgtagactaataacaaaataaattacatattccgcctgtaaattgcgagacaaatctattaagcctaattaatctatcattagcaaatgtttactgtagcaccacattgtcaaaccatgtcgtaattaggctcaaaagattcgtctcacaatttacatgcaaattgtgtaattggttttttttctacatttaatgcttcatacatgtgtccaaatatttgatgtgacgaaaaagttaaaaattcgaagggactatatttcaaaatgatacgagtaattaactataagcacatatatcatatcccactggtccgttccagcagacaagagcagtactgaagccttgccaggtcatgcatgtactactcatcaagccaaactatgatatactcatgatataagagattttaagttttttttatattgtttgaccactcgtctttttcaaaaaagcttaaagtactttggataataaaataagtcaaaaaaataaataataattctaaatttttttttgaataaaacgagtggtcaaacagtgtatgaaaaaactcaaattcgcttatattatgagacggagggagtatattcgtgtaaataatctggcaatgcaatgctaactacgagttggtggcaatcgaaatcgagttggtagcttaggtttcaatgcaggagagagcagtagtaaatcgaggtaggtgagagtgatcggcaacaggagcaggttttagtaattaaattcgtccaagctctttataggctgctagtgtttgtctgcatcgttttggctttcatctgcatgcatgctcagctcagctccatttcgattcatttaatttcttgagtttggagagcaggtggagagttttcaagacgagataggcagcagagacctcggacgactgtttgattttgatttttttagccaattattatcgttaattgtctatttgattattatatgaaataaatttagatgttttttttcgaaaattcatttcttttaccgaattttaaaaatagacttaacagaacaatttaaaacaagtcgtctaaaagcttttctttacaagaaaacatggttttcaaaacgtgatgtaaatgatccatttctaataatccaacgaataagctgaaaagatcggcaatgcatatatggctcaaatgacggcagtttgcgtacgtttgtatgcgcccttggacactaaggttgattaattaattgcatgccagcaacacttattatcaagaactttttcgcgttgatcatgtaattgctcagtttgaccaatcgttaatgggatcttcaatatgacagtaacagtttgtgcatgtgagtatcaagttgatgagggcaattagcagaatcaatacgtgctttcaacgtaattttagtagtggctagattgtttgtctcttacaatatatgtgaatagacgcatttgtaacaacatggatatggtgttacgtgtatagtagtgacggagacagtgccctatcaccacgaacgggtgcccgcgctccatgcatgccacaacacactactcccaaggtatatgcagcgttatgtaccttgcatacttgcctcataggttctaattaatggagattaattagatgataaatcagaaaacgagaaagcaagggccaaaccatcaagctgtagccataaaaaacatcaaaggccaaataggttcaaaacaatataacttactagcacctagcacctatgctcaatataatactagccttaaaatctaatttatctgcaataacattaatcttatccaggcatcagaaaatttctagatccgtaacgggtgtgcagtggtgtttgcgcgagtacgtgtgccgtgtaatcttagaagataaaaaagaatcaacgtgcaaggcaggggcattattggcaaatccaccttcaaattgtcctggactaaagcagtagagcagcagagagctcacctccctctcattatcaaagagagatatggaggaggaagacgacgagaaggttgtgaagaagagcagcgctagcggcggcctgcacggcgaagagcaggtcgatggcggacatgtcgtcacggcggagacggagatggcggcggcggctgcaccgtcgcggcagccgcagagcattctcatccgtgccttcgccggctgcctgctcgcgctgtgtggcggcggcggcggcgatccctccgatccgccgccgctgcgtccacggccacacggcgccaccgcggccgtcactgatactacttctgccgccgccgccgccgccgccgctcatcatcttcaacacgaggcagacggaggcagcaaacatgttgtaaccgtaagtgcatcattcatataaagcactggaagtaactatatttttttaatataaacttaatgggtacagggtttcaatttggaaattagattttatgccggggatgaccgaaatttcagaaatttctggtcgaaattatttgaaaatttaactgaatttgaataaaatttgatcaaattcacaaaaaattcaaaaaatcaaaaatttcggacaagatttgagcatgccggtggaggcgaaattaccaaaatttcaaaccatacattggtatcaaaattttaccgtgtatctcgagatatttttccaacaatgataaatcttctctttttttcttttatactaagcctaacttaattagtttgagtttttatgacagttgttgatcgataggttatgtataagtatttatagaaataaatatataatttaaaaatagtttacaaccatttgtgttagtcatatattggtactgccaaaatctagaaagttttgtcactaccaacatatatatatcaacatatgtttgttattcacaacttttggtggcaaatctaactttgccaaacacagattaaaatgctaacaacttgatagggcaaaatttagcttcgaacaaaaacaatctagagtttttggagatatcatactttgataacgatagttcgtttaatcagtaaggttgtatttagtttcacaccaaaattggaagtttgaagaaattggaataatgtgacggaaaagttggaagtttgtgtgtaggaaagttcgatgtgacggaaaagttgaaagtttgaagaaaacatgttggaatctaaacagggcctaagtctggtaatttgaaacaaggtcatctttagtttgtgggaggtgtgagcatatatatacacatccccatcaaagtttgggttctcgttgaaatcattttcagtgctatcttttctacattatttgtaccgagttctattttagtatcttttaattgcccctcaaaagtactaatatactaatacattttttcttttttaaatttgtaataagtatttaagatgtcgatgtgtatctcttattattgttactccctccacttcataatataaggatgtattttaagtgaatgtatcaggatgtgtcatattaatccaccaaaattttcttatattataggacagagggactactccgtaattttctatcacattttcaactgagctagagagatgtatccgtatcgtcgtctgccgtatggcagctgccatctgctattactgagtcgaccacataaatatatttataggttagttaaatagtttgatccatcagtagcactaacggaaactgccgtacggcagaggatacgagcgcatagagatggtattgaagatttcggttaattaaatatttcatatggtgtccttagttgcgatactgtatatatttgggcccaagtttaacgtggttttatttcaggatcgtatttttacattttaatcagcatgtacaaagcaataattttgacacatatgcaggaggatttattaggcactaatcggccaatgctgctggctagaacaagacctccaagaggacccggtcctccaagagaagggagaggaggaggtggtggatcacacaactaattaccctaattaagttcacagcttagattaatctttctgctctgaagtttgtcaagcacttttagccaggaaattagctaggaatgtacaagttttgtacttagagaaggcatattttcggatgtaaaaacagatcgatatacacaactatatgtgcaagtacagagttgattgttttttacatgtcaaacagtagcaaatctggtacataattaacagtaccatactctttccattatataaatataattaagtaacctcttagttgttgatcaggtcaatatcaagtgttcagacaactgaccagcaaaagcaagagaaattcaggatgtgtgtgagagatgctgcagttcacatctggttcagtggcctttccatggcttagctgaacctaaccctgcaaattggtatactactagtttagtttgagttaattagtgaacgagttcagtgtgcaggtttagtttattcagtatctacaaatgcatgaaaaaggctgggaatattgtttctgcttaagttgactgccagggagcagataaggcctggcactgcctcttctgttctggcttgtgatgagttgatggacagtgaagcaagaactatattgtgctgagcacacataatatgctcactagcccttgattgtaaaagttatttcctaaatagaagattaagtagtatctaaaagaagaagattatactctacatctctttagcttgccactaatcaggcatgtatgcatgtgctggaaatattcctcttataaacttttggagccacaaacattgaccttgccctaacagtactaggaatgatgcatggttaattcctgtacagatttatgtgtagtatatatttttctaattgatttctgtgtagtatattcagatggataagaataattataacacagttgaaagggagatgatcacaaaaagaagcacaatagtacacacaaaagacagaaaaagaaagatacttcaggggttaatagttaccaaagactgcagtcagtcaacagactgcattcaacaaatgatgattctattctcctccagtcagtcaacagactgcattattgtagcaagtttcagtgaacttctggaagaacagatgttgactaaacaaatggagataaa

SEQ ID NO: 42321 - DNA, 57750 bp, Oryza sativa
agcatcaataaatagagctgaaatgcaacccccattgctcacaaaccccaagaatttcaccaaaagggagtgcttactctgagctaaagaaagagtactctgaagtctgaagtagtcttacttcttccaagcaatctgaagtctgaaccttagaatggatcagaaggattagctgcagatgaaggagaatacattccaggaaggaacagccatggcgtcgtcctcctcatcatcgtcctttctcgctcatccatcgtcgctgctgcgtcaggtcgtccatggcttcgccggctacctcgccggcctctgccgttctctccagaatctgaaaccatctgcagctccgaaacaagacgctgacgacgaatttgccgtcaataacactgctgcgtcaagctccgtaagtaaaacatacaactgtaccaattaatttcaataaatttcatgtaattggttcgttcaaagaacaataaatttcatgtaattgcatgatctagccatctaggtgctcaattgagcgagcccagtgattgatcagcaagtttggttgctttttttttggtcttctgagctgatgattaattttggtgtgtccttgtgagagcaggaagaagttgagaatgttcagatgagaacaagagcaatgccgcgttctgaaaggccggttttaagagaagggaacgggggaaaaggcggagcacaccacaacgctggcctttagcttcaatcgatgcaaagctttgatcgatcgatcgacgcgatcattatgtacaataataagttcgggtaatccatgcatggattactgttcttcgaaccgagcagtggctttgatgatttgttaccctgactgtacgaggaaaatatcaagtggaaataaaatttgcactcacagatttaaccatgagtaaaaacttagtaaaagttttactgtggataaatctcaaacatattccttatcctatacttgttttcgggttttcacagtatatgggaagtggatttttgtctctcgaggagacatcccctcgttttgtgcataacgttcaaaaagttataaaaaaatttgaaaaattttgttaagatagatcaatatatgacatatttttgcaaacaaagttaaaatccgacttatacaattcgaaacaaaaataacaaatttgacagtgaattacgcattctattcctagtcaaatttgttatttttgtttctacttgtataagttgaactagcatggtggcccgcgcagattgcgcggctagcatcattacattttttttctcatataatagtatatatgttttctcattatattattcaaacatattaaaatgacaacataattttaaattttgcaataactttacaaaactactaaagtgtaatattcatattatattttatatacgtgttagttatttattatttttaatatcaaattttagttatttgtaaattatatatattcctatatgtactctagactcgtcttttaatatttctattttttaattccgaattttctgtaaattgtatttctatatagactcaatgtttttccttcaatattatttatttttatttctgaattttcatattatattttatatatgtgttagttattaattatttttaatatcaaattttagttatttgtaaattatatatattcctaatggactctagactcatcttttaatatattttttaattccaaattttctgtaaattgtatttctatatagactctatgctcttcttctaatattatttatttttatttctgaattttttattatttctaattgtatttctatgtggactctaaactcatcttttaatattctttaatttttaatttcaaatttcagttacttctaaattgtattcctatatttgtattcctatattgatcttaaactcttcttcccatgtttttcttaatttcgtattttagttatttgtaaattatatttttatacggactctaaactctacttttaattttattatgtttattccaaattttagtcagttttaaattcctatatgaactctatactctacttcaaatattccttatcttttaattctgaatttctgtttttttcttaattgtatttctatatggactctatactctacttctaatattccttatttttaattccaaatttatattatttcctaattgtatttctatatggactctatactctacttctaatattccttatttttaattctgaatttcagttatttcctaattgtatttatatatggactctagtctcctcttctaatattccttatttttttattccgaatttcagttatttcctaattgtatttctgtatggactctatactctacttctaatattccttatttttaattctgaattttagttatttcctaattgtatttctatatggactctagtctcctcttctaatattccttatttttttattccgaatttcagttatttcctaattgtatttctatatggactctggtcttctcttctaatattccttatcttttaataccgaatttcagctatttctaaattgtatttctatatggactctgccttttctttttctctgattattgtgagaatttctaggccatgagagcgaacgtggagactctttttttatttctttaataatataatagatttgaatatatatgtttgttaagtgacatatcacatggctattcctgctcttatagacttatccttctctttaatttctctcagctctctcttatgccgatcttatcctctccttcttccttacgctgcagagatcttaacctctcctttttgtgctctgcagcgaggagcgagcaagggcggcggcggccagtgcgcgccggagacgggagggcaggcggccgggctggggaggtggctgaccctgaaccatgatgatctgaaatggacgaaattcaaaattttggatggattttgaccaaattgagatgaaatgggagttccactgtcttgttgaatttcagacgtttcgatctgaataaccccgaacatcttgccaattgttcatctgaatcgcttaaggtaggcatagtgattgcaatttggacaccacaatccacaatccccaccccccccccccaacccccctcccgggcaagtaattatatcgcccaacattttcgaatttctctcagaatttatgaatttggttaaaatttaaactaatttcgtgtcaaaaagtaccaaaaaccccccaaattttttaaaaaaatttcggtgtcagcgatcaaatttcgtccaaatacgacaaacttgggagttaaacaagagagtaggttgttgggttttgatccaatactctaaaaatatgaaataggactacatgaaaacaaatcagaaaattcataaacgccaaactgtatatgcattggtgtgcgccacatgtgcgtgttaatcaatctctcaaaaattaagctaatcatcattgattatccccagtgatgactgatgacagcttatataattatcctgatatttctgatgatcaccaggttaattaaattaatcaatcaatcagattttgctaataataaaacatggaacccgatgacgccggtgggacgctctgctgatactggaagctctgcaggatggtcgcgatcgtcagcgactcgtcgtcgccggcctccacttcctcctccgccgccgccggcgacaggtaatcatcatcgtacagcggcgacggcggcggcggcggtggcggcggtggcactgccggagacagcgcgtgctgcggcggcgaagggtggtggtggtgcatgtcggggtagaggaagttggtgcgcgcggcggcggcgccggagatggagatggcggagaggtcgtaggcgacggcggcctcctcggcggtgtcgaaggtgccgagccagtggcgctccttggtgtacgggttgcggatctccgccgcgtaccgcccccacggccgccgccgcacgcccaggtactcgctcgacgcgcgcgcccgccgccgccgcatcatcatctgctgcggcgtcgtcgtcgccgccgcagtctcttcctgccggtgatgctgctccgccgcgtccgccattgctgacgtacttagcttagcttagctctgcctgtctgtactgtggatgtaggtggtagggcttaattaggtttttagcagccatggaattttataggaaagcatggaggtgatcgacaaagcttggtggagacgttgcgggctctgcatgcatggcatcggaaagcgtgccttgctccatgttttcctcgacatgataagcccatcatcgatcactttcatgagttggcaatttgtaagttgatcctacatttctacttactccctccgttccatatcgtaattcataagttgttcttaccttttttttttctagtcaaatattttaaagtttaactaaatttattagaagctatactaatatttttaatataaaacaaacatattatcgaaatatatcaatgttatgtttcatgaggctaactcagtgtttgtagatatagctaaattttcattcaaacttaatcagatctaaagaaatttaacaatattttttatagttaatgagatcgacatacaacctttatatatacgtttttacataagattaaatatgaaaatagaaatagcaacctaagtgtcatgccattaccatcatcattttatttttcttataaaaaacttggatatgtcattttcatatgactaataaagcttactttcctaaacaataatcgtagtcaaaattaacttatgttaatagtatacatattctaaaattaatgacattcttacacgaccagaagaaaactccctaacccaatcaattcataacatgttgtttgtgtcatctttgaccgcaaattatgcatgtactccctccgtttcaggttataagtctttttgattatggtcaaagtcaaaccgctttaaatttcaccaagtttatataatatatagtaacattttcgaccaagataaatttattataaaaatatatttaattattgatttaataaaactaatttgataatgtaaatattattatatttgtatataaacttagtcaaacttaaagtagtttaactttaaccaaagtcaaaacgaattataacctaaaacagggagggagtatttgagaggtatcatcaacaaaactagaaacaaggttgcacaaaagtatggcgggtgcgtagtgaggtgctcgtgtatgtctcttccgtgtaatcgtaaaaagtatatatacattatggacaggtcacaacatggtcctggcacctgatgttgcacaaactgttgacacacttaactgacatgtctataaaaatgtagcagggcgaatgttctctgcaactttgcgtcttaatccagtccagtctcgagagtacaaagcactagtactgaagagtacacaaagctcattcagagacaactcatcagaaacctctccaagggtcttctgaaaacagattaatatatataccccccaagttggaggcagaaacatctgtcagccagctgatcttttatcagcaggcaagggtgacacattgaatgtcaagaaaatgttaattaatccatacactgcgtgcaccccactagtatagacaggcaccatcagcttcagcacctttacagagtcagtgccccttgtttcctgacctctgtttacatacctaatacccaaatgatatatagtgcagattcatattcaaacaaaatactaagaacaaaagaaacaatatatatgtatggccaacagctgtgttcaatttttacaatgtcatccagggttaacatgtacaaatggagataaattcactaataatgttattacatttgacaaggcaataagtcaaaattgcctcagatatctttttttttcataaaaaaactgcttactctggagacttcaataaaaaaacactacacataaatttgagtatgtatcaaaccaaacaatacgtggatttccatatcaggtattttactattttactatcatataatggatggatgaagaagatgaaccgctgcatctaataattcgcatgaaagagaaatacaactaagtaaccttgttcagctagatgcattgcaaccaaaattcctcatatgccagagaatcagagatgaaatccaattttttagctgaaccccaaaatttaaagagaaaaagctccccccaaaattaatggcggctcacttaccagcttactacagacaatgacggcgaagacgacggtgcgaactggagaaacgaagtcgagcgggccgcttaattgggtgggctactttcaatttgtgggaaaattcagttcccgaggtccacgaaagcccccgagcacagaacagaacggcccaatagaaataacagcccaaataagacaaccacatccaagagaaccagcagggtttacgtttccgatgaaagccgaccagttgtcccgaaaacctgacttcctgacacggtttggaattaggtgctgacggaagattatgatgtattttgacccaattcaaatttgaaataaaaaaatcatttaaataccatgatatttaaagaacttaatggcataaatcccgtaaaaataagtaatggaataaaatattttcaaaaaagcaagtagcttcaactagttagggttatggtggtagtacctgtccacccaggtgctcgtatttacggctaaaattattttttcaattgtcggtgatgtgcccgttgacaatgaggcgcaatacactgttgaggatatgttatgcgcgtgtatacgggagcatgcgcctttactctatgttggtccaactgtgcgcagcaacgagctccgctttggcctctccgtgtgagcccgagaacaaaccaggggcaagctcgagctccactttggtctctctgcgctttggatgtcaccctcaattgttgttggtcaagctcacccttggccgcgggccctcgagctcgtcctcggcggtcacccttgggctcgggctctcatcccagtgtcatcctatagtagtccaaagaaagaagagaaaagaaaagggagaaaataaaatttctaagtaggccctaattgttagtcggtgtaggattgatgatggtgtcacgtcagcgtttgtgtgatggaatttaggccgtcgatgatacatttaacaaatttaagggtttaaaggtgcaactttaagtttttgacatagatgacgcccacttacaagtttaagtatcatcagtacattttactgaaaagaacaacctcaataagaggcagaagcctttctcaaaaagtttataaaatctttatgatgatattatcctaggcaaatctacacataccatactttagtttttaaaccaagcaaattgacaagttcaaagtatataagttattcttaagtaacaattattaattccggagggagtatagctgaagtgtgaattcacccatttataaacaagtgaattacctcgcactcgaaccatcgctagttcactagctcactgtcagtcaacccattgaccctcggccttctaaatccccgcccacccaacaccacacctcacatgtgtggcacacctgctttcttcagcatgcacacctcctccactgacactagagagcgccacaactgttgatgctatgccaaaaatggttgtaatggcaactctccctcctcttgccccctccacctctacttccctaccattctcttccctgccttttcttccccaactatatatggagaaatctccctgcaccacctttctcccttacatttggtggctcccatcaccacatcatccaccacctaattatgtgtttggttggaggaatttggtgggttgggataggtccatcccatttttgtaggtgtttggttgtagaatcaagtgggttgggttggatccaaagagaatattcttgtgatatccgggatgggctgatccgccaaaatctggtggaccgcgcggacccagctagctcccacgggtcatgtgcagcgcatgcgtgtagttatgggcggggaccctatgtctctcgtacgcgcacaacccctatcccctttttttttctcttcccttcttcgatccagatctgcgcgatgcgagataagaggcggcggcgaccgcgcgtgtgccaagcgacggtgagcttgggcatgtgctctcagccgcgacctcctcctcatccgtcctccctcgccggttacccaacctcaccggcttgatgcagtggcaggaaggaccggcgactgtggcagcaggaaggacacagctcgtcccctcaaggtagcaacggccgcgacctcctccttcctcccttgtccctttccccatcaaccctcatcgtttcccctcattgcaggattgcgtctaggaatctgtggtggaaggatgcggctgcagcggcttctggcaacatcacctccttgccctccactctcgtcgtcgcatactacatagctagagtaaggaaaccctatcacagaatgaatttttgttttcatggtcagatctgttcaagtattaatttgtgatgttggcaaatcagttcaagcaaccctagcactgtcctttgttgcaaagaaaatcagttcaaatattaatgtgtgatattagcaagtatttttttatgagatgatttgtgcttcagcatgatatgtcaacatgtttatttttctttgattgctgtattgtagatggataagacgaccaagttttaatttttgttgctgcttcaaatatattattgtcgatgatgaccatgattattcagtgtaggaaaagaaagagaggtgcaaggaagggaactcctccctctagcttcccctcccccacccctaccctcattacgaatgctaactttgtagagtttgatggagctcatcagagctcaccgaagctagagaaggttgtactacattaatcgtatgtagagcaaatgcatgtgaagatcaaagaatttgtaagattttgatttgatttttttgttgaataccatttagcacatccgtacatttacgttccaaattaattctcaaagtatataaattacccaaaattagttcactataaataaattagcaccgtgtatcaacaatctccgcgtacaggcatgaaaaaagaatttttcttatttttacagtgtattcttgtgtaaaagaggtggaggagatcgagattcctaatgtgctatatatagtaataaatgtatacacaaggagagtttatgtacactacggttctaataatgcaaaatgagttaaattagtgtgattcaaaccaattttgttggtaatgttaaatacatttatatgctatcacaacgtcaactatattgtattttgcaaaagtgttaatcacattttttgccaataagtgttaataacattttttgccaatatacgatattaattacattttcttgcagctattatgttattttcactagatagcttaaaattgaaaggcacataacactttgcaatctcttttacatcctcacatgctagcagccactaattatctatccatttttacattctcacattcaagcaggcacttgtccatccatttttacattctacatgcaactatgcaagcagccacttatctatctatttttacattctcacattcaagcagtcacttgtccatctatttttacattctatatgcgactatgcaagcagccacttgtccatccattttgacaagcataagcggcaagagaatggcaaagtgcacactgaatgcttgttataaagcaacgtcactggatttttgacaaagagatgaagcatttttgaccgacggatgaaacactatgctcttgtgtgtcccatgcattatgttgccttccgtattatggtctcaacatttttgcaatgaaacagtaccatatcacactagattatcatttttgcaccatattgcaccacggccaacctactgtgataaaatcacactgttaattacattttatttttggaaatatgttagttacatatttcggagatattgtgtgagttacattttttttttgccaacgcagtgttaattccatttcttttgcatatatagcgttgattaatgcatgatcatcaagattgaaacataggggctgtttggatgcttgtttcaatttaccaaactactatatagctaaagtgtggcatgccacaatttatgtggctaagaaattcttggccacaagttaggcaaatgttggcaaaggtatgtgcctatgataagtggggtcacaaaataaaaaattgtggcatgataaagatatggcaaccaagcaaacactaggctaagttggtcaaagtagcttgccaaagttgtggcaaagtatggtcaccatccaaacaaccccgtagtgcataactcattgcaatatatctacttcatcatataccatcgatcggccaaatatccttcctccggctggatgagcacacaaggcatgagaaggttagagtgctaatcaaatgccagttgttaaggttacatgactaattggtctctaaaactagaggattttaatggaaaaactatgaaaggaatacaaaagttaatactacctccatattttaatgtatgacaccgttgattttttgtccaacgtttaaccattcgtcatcatttattttattatgacttgattcgtcatccaatgttctttaagtatgatataaatattatcatatttgcacaaaaaaattgaataaaatgattggtcagaccttggtcgaaaagacaacggcgtcatacattaaaatacgaagggagtatgaaatgttggtaacaccgacgataactggtggtagcgggagaagcactcaatgtatgtcatatgccagttacttagactaccaattttgtacatacacattatagctcacttccgttttctttttctttttcgctccacgagaaaggatcaaaaccggtattgcaagatatttgaaatctagttatgtagttatttatgttgtccaactcttagacaactatgaatatgatattaaaacactagttattatatataacaccagttacacatagtatgtagggacctgggacccatgaccccacgtcgtccctagcaggcagctcgggggaaaaacgccaccccactcctccaccactccctccgtcttgccactgcaagagcaatccgccagtcatcgtgcggtgagccgagatggcggaggtgaggctagaccccggcggtgagccaacgcaaggaaatcaaggcgatgttggtgcgacagcatcaacgaaacaacaccacgacgacgatgatgggaaattcggtgtcctatggagaaaggcggagcaactgggcccctccctactcctaggatggcggtggtgggctactcctcgacgtgccagtagtgggccttccccaacctccactcttctggatggtgatggaggtagagctagggttgatggcatcgtcgaggaaatccatgttagtctctagttataccctgctttgacacctaaagaggacctttgagaagtcagagctaccgtatcgagctagcgttcaacgagctgttggcaacaatgactagaagggttctgcttagtttcaagcagggtttggttgttgtcttctaagtcagagctgcagcacttttgcgagctcgccaacgatgaccgaagtctacaaggctcatcagtctaactcttgtgtggggtttcaagcttttcgtttgcaaggctcatcagtctgactcgaccatgcatcaatgagtttgttggtcgcgaagtcgaagttgcggcattgaccggacacaatgtgtggcaacgttgacatgagcccatttgagttatgctttggcacatgctaggttgttgcccttatactagtgttttctggcgaagtcacagttgtccaatcacgaggatgatcatggtatgatggcaataatattgtatctttgccagtgtgcgggagtcttgtttccttctagcttgctacttgttcatgtggtaaatgacatttgttgagtgtcgcagttggctttcctgttcttgctgccttggtagtttaggttagttggtaaagtgtcgttatagttgtaatttttgtcatgttttttcttaattaactgtgcaccttattggttctattttctctttaaaatagacatctttctctttatataaaacaccaacaatggcttgaccgtttggagaaaaatacacagtacgtagctctgtctagctactggcactctggcctactcgaaggccatgcaatttccaggattagctctgaataccatttattggccggcttcacacctactccatccgtccgtgaatataagggattttaactttttttacttaaccattcatcttattaaaaaaaattaaaattattatttattttatttgtggcttactttattatccaaagtactttaaacacaatttttcgttttttatatttgcacaaattttttttgaataaaatgagtggtcaaacgttacacgggaatagtaaatatcccttatattcacggaggagggagtacatattaatggatcaattccgctttcttcaacctagctcggcctaacgcaatgtaatccttttacttgattacatgcaaggtacatgtctttcctccggccgaatgagcatatatgcatgagaagagtagagcggagcgttgcctggttatatcagttgtcaaggccacatcactgtataggttctaaaattgctggattttaatgaaatgagtgtcgaaattaattttgttgtgtcaaattgcatgcctccggccacaaccagcagtgggccatggccactccattgcatcttcatgtagtaatttttaaaattggagggattcaatagaatggtgttgaatagttttatataaaaaaaaatatgatggtatttgtataatgcaacgtctttaattatttttacgccaataaattgaatgtttgtaaccattagcatgcatgtttctgttcggacgcgctagttgctacagctgctgcggctatgataattgtaattgagctctatgctactaccggtttaaactgtcgcagctgtagcaattaggtaaagcagaacacgttcaatgattgtagaatcaaacgacctaaatttgtactccctccagttcattttaattgacgttttggacaataacacgatctacaaaatatatctttgatcttatttttctattataatatacacaataaataaatgcatgttaacttttattatagtgttttgaaagacaaatctatatatgttgttctagtttctttaaactaaatacttttgaagttattaatggtcatagttataaaagtttaacctcaaacttgttcaaaacgtcaattattatagaaccggaaggagtatgccagtaattaaaatgcacttcttcttttttgggaaattaaaatgcacttctgtaaatctgtaactagaaatgttataacttataaacaacaaacaagagggataacacagcccagcacgtatgtccaacttgaaaggagcctgagaaaggagcctgagatataatcaaatcacaattggataccttttgtgacgggtgctacacatagctatcctttggattcgtcctaccgtaaccgatcttcatcgatcacctcgaacaatccgtttgatatgaccgacgatgacacacactagctagctagctaccaaacgaacgtttcgctaggcaacaatggcgctgccgtcaccggtgacgaccaccgtgccgcgaagcatgcacggcgcgccggccgatcatcacgcccgtggttttgttccttgcaaagttgcaaacgttgtcattgctgcagaaaaagccaaacctcaccaaatcttaaaaagagttctatgtagaatttgtgcgtaaaatacactttttagcagttcggtacacattttcaggtgaaacaagaaagtagacgaggacctaagttgacacgtctttatagtaaactatactcccgctgcctaaaaaatatatgattatattgacttttatataacgtttgaccattcatttcattaaaacaaattatacaaatatcatttattttgatctaacttattttatcatcaaagaaactataaccttaatttatgctggtacatatttatactaaaattttaaattaattccatagaaaaattataagttacaacaacttttaatagatcaaatagtgctaaaactactactataaatgcaaaaataactgaaattagctagaattttaaaaagcttattttactgatagatgaaaatccgatccatcaattctgaaccgatacccgtttcatatttttatggtctcaatattatgtgagtggtctaggagcatggttaggctgaattagaaaggaatagtgcccaaggcactgttcattgtcttccctagccgaagccggaaaataaaagaggagggaagaagggcactgtgctccagtgatcaaacggcgatgaggaaggtggtaggatatgtcccatgatgtgactcgttcatagatggtggaggttggcaataaagaaaccagaacagcaagaacgcagatagcaatgacgtggtctagatagagagagaaatgacaacaacgagctctggtaataaacacgaccagatgagtgtatcaaaacgcattcccaaataagggggttccgttttccttgaatgtgtaggaagaacaaagatggagaaaaaacgactaacactattcattgtcttccctagcataaacaagaaacaaaagaggaggaaagatgggcgctggtgctccggcgaccaaatggcggcgagtaaggtagccgtacgcgtcctaacaatgtgactcgtccataaatggcagcggttggcaatgaataaaactaaaatagtagggaatacaaccgataacgatgtggtcccaacagagaaagaaacgacaacgacgagctctggtcatgaacacgaccaagtgagcgcgtcaaaacatgttcccaaacgaggaggttccccttgaatgcacaagagggagcgggcgcaagggagaataggggtgttgagaggaggggcgacaggaaggagaggggccgcgtggggatgggaagtgcaatatttgttggggatcgcgagggagagatgggggcgccgagagggaggagatgggctgcatggggaggggagtgcaacatttttttggtattgcgaggaagagatgtggagcgctgggaggaagggcgtagggagggaggggtgaggcggacacacgaaaaataggtccgaaagctttacttattttttaattaggtatatagtttctttaaaataacatgaatgaccaaacgtaatgtaaaaattcacgacgtccgatattttaggagggatggagtagaaaaaactattactttgctgtttaactttgatttctgacactaacatcagaagtttgattacaagacaggcaaaaatacaaataataatattattattattattaactaattaattgatagtgccaaatgttactcctatggcactgagtagcatcagctagccgaggacctgcgccttgaaggcgtccacgtgcgccgggtcgatggacaccgagagctgcacctcgccgtcgcgccggccgccgacgagcaccatctcgccgtcgtggttcatcgacacgagctcgacgcgcgccggcctcccgaacccgaagtcggcggcgccgtacgccccgaaccgcgggctcgccgccacgttcgccatgcgggagaaggggatctgcatcacccgcgcgatcgccgacccgtccgccgtcccggcgagcggcgccgcctccatctccgccaccgccgcctgaaccgcccgcgccgcgcgcagcagcccgcgctcgccgcggagctccgccgcgttggcgcagcgcgccaggcacatcctcacgcagttcccgaggtacccctcgccgacggcggggtcgagccgcgcccggaggtcggcgaggaagatcaggtacgtgtcgtccccgtcggcgagcgccttggaccggacgaacgccgcccaccccatcgccgccagcgccacgaacgtcgacaccggcttggcggcgccgccgccatcggcagcctcctccgccgaggcgagctcgtcgatgcgccgcttcaacgcgcggatggcgtcggcgccgaggtggaacgtccggcgagccagccggaatcgctggctgaagtcctgctgatccccgctcgcctgcaagcatccatggcgggtggtggtgatctcgtcagtaaatttgcattcacggcgagcgagagagagatcatgacgcgtgcatgccattgcttgctccgccacgccaccgcggcgagctccgcatgcgcttaacattggggggagaaggaaaccatggttggatggcgtaccaagcaaaggttgacgacacatacacacttcgaagaggctacactacactacagtacatgcttcatgcatgatggaagcttcgatttttgtttatttatttgaactaccagaaagattttttgggctgttttttttatttggttgaattttattcagaattcaaatacattacaaccattttgcaaatctcgctgcctcgggacctctcttttggaagatgaccctgcctcagtgtaacattgtggaattgttgacttggtgttgaccatatatctgcacatctcctactctttttttttttgttgttgcaactttgctttagtcccaaaaatttatgtattctatgaaaatcctggtgaatttctacattttgaaaaatagccgtgtggaaacatctatagataaaattacgatatcacggaaatagggaattcttatatctttaaaaattgaagtcacttttcgtatatcttgcttaatgatctaacaactcatacgattgttcacattttctatttagacacaattttatatttcttcaataaaaggttgaataacaaattattctaaatgtaaaagcattcaaacataaaaaaacatatgaaataacaaaattttcagttaaaataaacaaaaaatgcaagtgatgcaaatcttcttaattttggacaatttacggttaaacattggtgaaatcgaagaattttatttttaagatgtgaaatgaaaggagctaggaagtgggagagtgacgatagcttaccacggccgggagcttgggcgcgaccaacttgagcatgtggcgcgcgagctcgccgccgtcgggttgggggatggccgcctcccggcggtagtgcggcgcgccgagcgacttggtcaccggagagccgacgcgcgcggccgacgaccacgcttccatgaactgccacacggcgcggccgtcggcgacggcgtggtgcacggacaggccgagcgcgaggccggcgccgccgccgaggcgcgtggcctgcacggacagcacgggcgccgggagcgcccgggtgtcgagctccggcacgagcgcgaggaacgccgcgacgtcgtgcgcctcgtcgccggcgagcctgagcacgtccatgtcctcggcggcggcgtcctccgcctcggcctcgacgaacgccaccccggcgtcggcgtcgtcggcggcggcgcagtccaccacgacgtcctccgtctcctccacgtagaccagcttccctgccaggggcaggtaaagcaccagcgtggcggcgagcgagcccttgagccgctcgaccgccgccgcgaacccatccccaccgccgccgtccgccgccgccgccgccgacatctcgtacaggaacacgcgctggatcggcgggagcacgacccacggcgtgtcgaagaaggacagcccgacgcgctcccgctccaccggcgccggcgacggcgcgacgcgggacacggcgagcacgcgcacgcgcgcgcgcgcgccagcgtcgccggacacggccgcggcctcccccatctctccctctatctctctcccaaccccggcgtgcttcgttctcgccgtcactggagcgcgcgcgagatgttcgacgaattgatctaccgtttcggctcgtatgatcgcgacctcatttataagtgcgaggtgtccgtgacgtcgtcgtcctcctcctcctgcataggaggcaacggaacattggaggcaatttttttatttttttgggggcgaggatttttttttttttttggagggtgaggtatcattaaatttttgtggttgatactctacatttcacagctcaccacacagcacacagcaataaaattcatatttatgctgatttggtttgagaaaagttcacagaaaatactatcaattatcgaaagcaattgaaatatatctaaaataattaatgtatgaagttaagaaaaggaaatgtaaacgcggtagtaaatttctattccctttttcaaaatataagtatttttttcaaaattatttaattagtaaatttccattgttttctacatgatctcttatattactctttcacaattaatatttgttctaatgtattatcaaacagctacaatgtaaacatcgcttgaaagtttttttaaaatacgattataatcatatggcataaatgactctaaatatatatagcttctattctaaaatataagagatcttggctacgtgactagacgtacttgttaaaatacgattaccctccaggttaataatacttgtcgtttcaaataaataagaacacaacccctaaaaaatatctttatcactattttctattgtaacatatatagtaatatattttattggaataccttttaaattaatctggtagtctataagaaaaatattttagaaattattattagtcaaatataaaatttgacattaatcttatcctaaacgataagtattatcaacatgtagggagtaatatattgttagtttggctattagtactccctccgttcctaaatacaggacgtaacttcttttcaactggattccataatacaaggcggcagcttctcggtgcatgtgcatctgcatgcatgctggctattcgctcggaaagtgcaggtcgagcgcatgctgcatgcatggtggttaatgctagcgtatctaccgcgcaacaaccgaaacgtcgctcttcgaacggagagaattagtcagcataactgctatttaaacagttttattggtctttgcaactacaacaaccacgtcctatattaaggaacggagggagtagaagttaacaaatatagaccttatattttagtatactaagggttttctcgcagaaaaaatatattctatttttgatgcagtttttcacattaattgtgcaaaattattccagtgacaaactaaagaaatctggagactaacgtaatggaactgaaactggtatacagctcggtttatatttcctgtcaaaataaacacggattttgcgttccatgactcggatttgatttttctgtcaaatcaaatctgcattttgtcccgaggcttcaaatttcttgagacagctcaagtacactaaggacaatatataattggacactaataactgctggttgatcgatgtagtattagctggttaataacaactagctggacgtcccgcgcaattgcgcggttagcatctaaccaaaatcatatattattcagcatgattttacttaaaatttattaaatagctatccctgtattatccccatatttctaattatgtagtttttaaagtcacaccagctgctaccccttacttctgtcatatccttatttatttgcttgctcggtctaccactatttctattcattctcctgaaacctttaaaaattagattttatagttttttaagtttattatctcgttgggtttcgtttttataatttctggaagtcccatcaaacgctgccattatactcctctatggcccgtccactgttttttctctttattgtcattgggattttacaaatcaaacataattatcgttcgagtttattttttactttttataactcccgccaaaccgtcagcggctttgcaattgtactcctttatggctcgcccgttgtctcccttctttattgccattgagattttaaaatcaaatatgattatcattattttttttactttttagaagttccgaacctttaaaaattagaccttgtagtttttagaatttattttcttgttgagctttattttttataatttttagaagtcgcgtcaaacgatgccactatacttctttacgacccatccgccgcctaatctttattattgtcattgggattctaaaaatcgagcataactatcgttggaattcattttttttattttttaagaagtccccgccaaccatcggcggctctacaactatactcttatacaccctcctgatgcttctctttttattatcattgagattttaaaaatcgaatatgattatcaatggagtttttttcttttactttctaaaagtcccagcaaccatattacccgtttgcttcacggcctgcctgtcgtccctccttttaatcatcataatgattttatttggtgttttactagcagtcaaccaccaccactcttatcttttataggcttgttacttaatttatcttatcgtgtgttttatatggtcttctttttcaatagtctttatttttatcaccaattttagttatttataaattgtattcctaattgaaatcttgtttctttttctaatttcagaatttatttttatttttattctgaatattaactaatctcgtatttgggttcttatatggactcttctctcaatattccttttttttacttctgaattttagttatttttaaattgtattcctagatggactcttcttttcttttctaatttctgattttattttatttttattctgaattttgattaatatcatattggattcttctatggactgttctttcaatattgcttatttttaattccgaatttcaaatatttttaaattgtatttctacttggactatccttttctttttctccgactaatgtgggaatttttagcccccacagcgaacgtggtgtctcctttcaaagctgttttaataatatactagaatagataattggggcttcaaattttcttctgtccaggtttcagctttgctcatttggaagctaccagctacagtagctaaattaagcatatgtccatttggaagcctttcatgctggcgacgttaatgacttaattcacatgacatttggcagctactgtactacgtactgccagagaaaaccaactagctagtcaagagatatctcaatgtgtgattacagattagaaggttacctactgtttcttttgacaaatcaggcaattaatcagattaattgatggattgtatgactgagcaccagtgagcagcaattccaatttaattgcgattgtgttggtttcagaaattttgatggatttttgggatgtcagtttcagctgggtgacgggtgcatgatgaaacctcaggtttaaaaactcaactacttcctctgttcaaattacttgtttttttttaactttgtcgtaagtcaaatactattaactttgatcattatttttctaaaactaatatagtttaacaatatgaaaattatgtattatgaaaacatttattatgatgaaataaaaacataattcttagaatgttaaactataaaaatttctgaaaattgatattcgaatggaggaatctaagttagtacaaagctaaaacaataaataatgtgaaacaggggaatataaggtttttttaaaaaataatatttttcaatagagaattgaaaatataagggttaacgtattaaaattaagtttaacacctcattgaacaatcaaagttcgacacgggataaaaaaaatgacaacagtcactgcacaacgctgtgtgacactgtacaacatatatgtgagtagtgtgagacactgttcatgcattttcatttttttaaagtggaccaacaaccctatcggataaccgcagctcgacaagtgtcgaactacggttatttgacagggtattaaacttacgattttagctgatcagcttctatttttataatttttcattaaaataatattatttctaaaaaaaattaataagggaggcataatcattttcagtaaaatcaacgcacactagtacagaaaaccccatatgtgccggttgggaaacccacataggtgcaggtttcctaaccgacacccccaaagcagcaccaatgagagaaatggtaggtgctggtgtctagaaccggcacttataaggtccaacgaatcaaaaaaaaatccgactcgatgtatcggctcgatttgagccgatactcggctcgatttgatccccacaatatctcatcaaagaacaattcatcaatatcttcattcatcaacatcccatccaacaagaacaaacaaggagactccgagatcgagattgaaagatacccaagaacatcaaagaacaaaattaagcacataattaagaatttcaagcacacgagactccggatctggaagatttggaaagctctgaggccatcgggagggagggtgccaccggcggcgacgtgtgggaggtcgccagcctccccgccacacgccgccatggtgaggccgccagccaccccaccgcgcccgtggagaggtcgaccagccgcccgtacccccgcgtgccgccatgggaaggcggcgttcaccccgccaccgccgccgtccgccgcgaccggctgctagcccagacactaaccccgtctcctcccccctccccggccgccgcctggctggatgcagaaagagaatgggggaagagagaagagaatgggggacgaggaggaggagagagggatggtgagtggagcagtggaggagaccgggtgagtggataagtacgcgcgactttatccactttatcgaccgcgcccccggcttctctctcgatcggctcggctcgtttgataggtgccagtttttttagaaaaccggcatctgtaatatattataggtgtcggtttttatttaaccgacacctataatatatcataggtgtcgttttttaaaaaaaaaccggcatctatagtataggtgtaggtttttctattgaaccggcacctataactaattaaagataccggttttttttattttcagcctgtgaaggtgggaaaaacactataggtgtcaattttagctatttcggtacatatagtgccgaactgtatgtgtgtttttgtagtagtggcatgatgttttcgatccagaccatgcatgttgaaaattaaatgttctcatttttcataaaatcagtagtcaatcctatagaatagttcaagaatatattttggccgaatatgtatgaccacaagacacaagtgtgatagagattagagatcgaatagctgtggcatgtaaaccatctagagcttggaaatgtatacacttttcgaatataaaagacaaactagtagttttcgctatagaagaagagttcaatggcacattttggtcgtatttataggcaatcaggaatagatgtgactgagaaaagtaggagcatttgtggctacatattcaggtgaactcatggtatacagtgcatcagcggcagagctgcttctagagacgacacgctggacactagcttagctacaatgtctctaaatcaccggttaaattaacacaaaggattgacaccgtaagagatgacgtcagataatttagatacttatggagtcttcgtttgaaaattccctttttccaaccacatgcatggtggtgtgaaactgtgaattcgaattcaagttgatacggctagctatatgtctgtgagtccggttggaatgacttgagtagtactccaagatactgagttcaaatctttatacgagttaatttcagattaaattgtttgaggagactaagtttttaatttaaaaaggctacatatatccgatacgatgtggccgagttaaaaaaatatcattctctaaaataaaaggctataacttaatttgtgagtaattatagcataatcttgtgaatcataatatatactaaaatgttaatcatgagacttgatcacaggctcacgaatcacactacatgtaatgagtttaacgagctaactcggacattttaacgggtcaagttaagtttcaattcgttcccaacttattgtgttaatgagtcgagccgaacaaactcgttaacttaacaagtttttacgaattacttcctccgtttcaagttataaagctttcacattgcccatatatatatatatatatatatatatatatatatatatatatatatatatatatatatatatagagagagagagagagagagagagacctatacctattaacaaaacaactaaaatttaactttatttcacaatccatgattacatacctaactaattatatgtatggatgctatatacctagaatcaaaatctaacaaaaacaagttcaaattcagtataaacatgctttgaactagttagtaaagtacttaatgttaatacctaagtaattgaaaaagtttcatactcatttgaattgggtatatactcaatttcaacaatgatgcccgggcaccatggagcaccaaacaaatttaatatatatatatatatatatatatatatatatatatatatatatatatatatatatatatatatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtaaattaactggtgctacatggagtatgggctccaagattcaaattgagtatatacccaatttgagtgagtatgaaatttttttaaatgcttagatatgaacattaacttctttactatgttagttcaaacaagtttgaactttttttttgttagattttggttctaggtatataacatccaaacatataattcgttaggtatttaataatgaattgtgaaataaagtttagtttgagttgttttgttgttaggtatttgtatgaatcaaattcatatagctagatatatactcacaatttgaaaattttaaaaaatttaagagaatttgtgtgttttataccttaccctaccatagccgccacagtcaatcaatcgctacaaatacaagtactgagattgtgacaacaacggaatccccaagctcttcgcaaaaactgcaccaatttttattttccttccaccaaccgagccgatcgcaggaagccgagcgagacgtctttccttcgtctcgccgccagccatggcgccaccaccatcggtcaccgtcattgaggacggccgcgtcgccgtgccgcctccgccgccgccagcttccggcgacgccgcgccgcctcctcaaacgacgctgttcaagctgaccgcgctcgacgcgcagtggatcccgctcccgctcatccagcgggtgctcgtgttcgacggcggcgaggggcgcataccgccgttcgaggacgtcgtcgccgccctccgcgcgtccctggcggagacggtggcgcggctactgcccctcgccggtaggatcgtccacctgccggagacgggggaggcggcgatcgactgctccgggcgcggcgtggccggcggcggcgtcaggttcgtcgtcgcggagtgcggcggcgccgacgcggcgcgcgtcgcccgggacgccgaccacgacgtggcgctgctggagcagctcgcgccggtgctcgacgccgacgcgctcccggcggagacgatggccgcgcaggtgaccaggctgggcggcggcggcggcggcggcgtggcggtcggcgtggcgctgcaccacgccgtggcggacggccgctcggtctggaggttcatcgaggcctgggcggcgtgctgccgcggcgacgacgcgtggagcgccgcgccggcgccggcgttcgaccgcgccgccgtcgcgctccctgacggcgaggagctcgccagggacgtgctccggaagtacgtcccaaacctgccagtggtaagcacgcaaattcacaggatttctttgaattccattgtttttttaaaaaaaaattacatttcaaaagaatatgttcaaatatttttaaaaagaaataaatgttactccctccgtcccataatgtaagggattttgagtttttgtttgcattgtttgaccactcgtcttattcaaataatttgtgcaaatataaaaaatgaaaagttgtgcttaaaatattttgaataataaagtaagtaaaaaaagaaataacaattctaattttttttttgaataagacgagtggttaaacagagcgagtaaaaacttaacatctcttctaatataggagggagggagtatttttttcaaccgtgcgatcgatcagattagtgggccatgaggtacggcctttcactgtccaacttttaatgtcttcattgcagtgcatgccctgctactgctagttgtgtggttctatccaaatttgaggctcctgtcagatttgagggaatggcttcccggcagatcaagaaaacaaacacaaaattttaccgtaacttaccccccgataacttcaaaacagtaattaacagccattccatttggaatttacagctggagttaaatgtaaactcattatatttatacagtgtaaatttcacaagaaccagacctacaacataagctaaagaatcatatagcctcaaaacaatatagtaccaaaccaactaaaaaaagtccaaattttccctctaaactattgcggtcgtctgatttatcatactcatttcaaatactagatattttacaccttaaacttttcaaaccggaccgataattaacctccttaacctcccataaagcagtatcagtcttacgtgacacacgtacaacagtttagccacatgtccatctagtcaacagtttgggaaaatattttttcagaaaatataatagtggccccacatgtcatattcttatatcttcttcttcctcgctctctcatagtcccgtgccgtcgtcgcccccgccccccgttgatctctccagctctccctgccaccaccctccacgagcttgctagctccactagtgtggctgcagctcgttgcatccatgtgccatagcacaagccaatcaagctcctctcaactgaagaggaacacacccatgcgaccttccgagccattcccccttccctctcactgagatcgatgggtgagatgatgcatgatgcggcagggttgctgcctttctggggatgacgccaccgctatcgcctacacatcaaacctttcttcctctgccgtctcagggaggccatcgccatcttccttcgcctcctcactgctcctcctgttgtggggaggagggagggagagagtgggagatggaaggaaggagacgagaggagaagaagatggagctcgctgatttttttttctatctttaatttctagcttactagactgcagtcacgtaatatcaaaatcactccggattgagttaggggggttaagcatctagtttaaagagttcgagatacaaaatatctggtatttgttgaatgggtaaatcgaacgatcgcaatagtccaaaaaggtaattcggattttttcctactaatttatagtcacttttttaaaaaaaataattggagttacaatctaacatcaacatatttacactgtaaattgcagaacttcgtagaaccacacgtagttagggcataatcggatagctgtttacgttttacagtcattttatgctggggataaagcatttttagcatagtgacaaatcaaatatttttaactttgattattaatagcaaaaaaaatcaatcatgtaagtaaacaatcataatatgtaactttttttatttaaaacattttacttttataaatattattggtcaaagtagcatctcgaaaacagtgtgaggataaaaaatgcttatattttggaacgaagggagtattagtttttttttttgaaaaatggactaatatgatttttcaaaacaactttcatataaaaatttttgtaaaaaatacacaatttaatagtttgaaaacgtacgtgcggaaaacgagagatatgagttaggaaagtgaggtaatgacgtggcatcctaatgactatactaactcaatcgaattggctatggtgttatgttttggccttggttcacacgtgttacacaagtcactcatcacataaaagttctctaaacttttgtactagtagggcaatttataccttttaagttcgagtaattctatacaatttactcaaataacttttataaatatagtgtttttttaaaaaaatgcaaaataagttcataaatttggcttattcgcgccatttccgatgagcaggcaacggtacccaagttcctcgtcaagggccgcctgcagctctcccgccggacgttcaccgtcgccgccgcgcaaatgctccggctgaagcagcgcatcgtcgtcgccggcgccggcggcctcacgccgccgtccggcttcgtggcgctcgcggcgctggcgtgggtgtcgttcgtccggagcaagcacgcggcgggcgccatcgccgccggcgacgaggtgtacctcttcttcttcatcgactgccgcggccgccgcgccgcgttcgacccgccggtgggggagggcttcttcggcacgtgcatctccggctgcctcgccacggccaccgcgcgggacctgctcggcggcggcgacggcgggctggtcgccgccgccagggccgtgcaggaggaggtgcggcgagcggcggaggacccgctcgccggctgggagtggatgtcgctggtggggcggatcgcgctgagccggctggtgaacatgtcggggtcgacgaggttcccggcgtacgaggcggcggacttcgggtggggctcgccgagccggacggagttggtgacgatgaaccatggcgggcaggtggtgctcgtcgccgccaagggcggcggtgtgcaggcgtcggtgtcgatgaagccggagcacatggacaagttcaagtcggattttgagagctacttagaatgattatttgactagaaaaaatacccgtgcgttgtacgggtgaagtttattttaatcttattattattatatggtttagttaatataaaattcactgcgagagttcgcttgaaaatatatatttttagaaaattatgggttgtagttaggaatccaatcaccttaagttagcatgcgagtttttttaaacatatttttttatgattccttctgtattaaaaaagtgaattatcttaaaaaccgactcaaatacggatatgtattttcaaaagcaaacgaacttaaaaaccgactcatacacgaatgacgtaaaaaataccaacaaaaatatttttaatttttattatagtagagatcgaagaagatgaaaattccaattggaaaccatcgatcgtactacgtgtttcttgtttgtagtcaaaaattttggagtgcttttgaattaaatggccgaaaagacgtcatgtcaagttggcaaccaactgttaagattttgagaaaaataatatattgtccccgatatcttggattgtactgtacatgttgatatataagaaaggataatagaaattcttgcattgtccctgataacagcacacatggatattaataggatctggtcttaaataattaagcaaatttcataaaaccttactcactccgtccttaaaaaaaaactcaatctagaaagagatgtctagaacaacgaatctggacaaagggttacatcccatcctaagttaagtttttttttgggacagagcaagtatgttttggaattggagcgcacgtcacacaaaacccattaaagcttaaaccttatgaaacattgtatcataaaacatgagattcttcaaaacaaactattatacctgaggttttgaattatagatgcttcaaaaccgagttttatgaagttattacattctagaatcgctggattgctactaaagcacagacaggttactacaataggaaataaataaatgctcatggtttaagagaacataacgcccctgttttttttaaaaagaaatcattcgtccaattagtacagtatattatttacatgattatagatataaattaaatattataataaataaacttaacaaatagcttacacaaagcatcttaaaaaaatacagaagaatgttttttttagaaaacatattaatccagtgaagttcatgatgaattgattccacccaccccaaaccaacttccaagtttcttactacgaattactctagttttcgccacttggacactaaacaaaaatacagtactaaaaatgaggtgctctttcaagcttcacttgttctgtggtgctaccaatttacacaaccgtgtttggcatattccttttaagtgaagtacttacatatttttcacatttactacatatgaattaatttatccttccgttctactctctccatcaaaaaaaaaccaaacgtaggactagatgtgacatattcagattcgttgtagcaggatatatcacatctagttctatgattttctttttggaccgaaagagtatattatataagtcatcttaggttggttctaaatcaaaatacttttagtttctagcaaaatatataaacatctataatcaaattaggcttattaaatctacgactaaacatattctatggtacatttattttgtgttaaaaatattgctatgtttttcaataaatttagttaaatcttaaaaagaaacagaggtagatcagactatctaggcgcataggccatggcccatttacaaaactagcccgatgccaaattgagcgggatatataccacggcccatttgaaaagattatgcaacgcaactacctcccctccttttttttccaatttattttcctactgaaaaatggtggttgccggacacggaggcggcggcgggcgttgctgtcagaggcgatgaggctgtccgcgatggatgccctgtggctcaccgctgccgctcatccagcgtgtcctcattttccttcctttaagaaaataagagatttgaaacatgttgagaattaaacaagagagactttacggttgaaaccgtacgtttcttattactgcactcgtgttcctaccaccgtccagcgacgtcgccgtcgactgctcctcatccgccacggtcgctggcgtcaggttcatcccggccgagggccgaggggctcggcgccgacgcgcgctgcctggggccaaagctgtgcccttgcttgatctccaattttgtgttgtaatgtttaattcaagtatcggttattgaatcttcagctcacttggagaccttggatggaatcgtataaggtcagaattgtgatcgaaagacacacaagatttacccataggaaccagaagcacgagtaatccaaatcatagagcccataaaacatggaaatttaactatttgtaactattaagtttggtaattgtctaaatatccttcttaatttatactttttttaccgcttttaagacgtgatttcttaactatttattatttttgcccacgtagcatgccaacgtggtaacgtatggtaaaaaccggtgtgagattcactggtcagtgtctctccctccgccggccttctctgtcgccgtcgccactagggtgagcatgagggtgggcgcccaccgtctcgttgttcaaccacctccgttgcctccttgctggcggctcgctcgataacgacaacagcatgggcgacgtcacccgcgttgctagggttcgttatgacccgcatgcccacgttgtctagattgaggaattcctgataaccaacgccaagttacgtgccagtgccaagaggccgcacgaatgcgatactggcaacggtccgaatgtctagttccccaccgccggcacacatgggatagttgtctcactaacgatggtgactcgtttcgtcccaacgctgctggtgcagcagcagacacagcatcgttggcagctgccacgccgctggttcatgcgtggagccggagcgacggtagtgaaaaagggcagtacaacagcatcctccaggccgtgtagagcgcgacaatgagggaaaggtggacaccgacgatgtaactcatgctgccattatcatcgtgcaagccgccaacgaggaggcggtcgaacaccagggcagctgtcgggtggtagacacccaccctcatgctcaccctcacggcgatggcagcaaagagggcctagccacggcagcggcagtgagagagaaggccagcggagggagagacactgaccagtgcgtcctacacatggtttgcagtttcgtttttggtgaaaatttcggtagcaccgaaatttacaaacttcttggttttcagcacttttgaaccgaaattatttaaaattttaacaaattttgactgaatttaaataaattattatcaaattgaacaaaagaaattaagaaaacccgaaaatttatgtcgatgtaatgacttgctgggggtccgaaaatttgaatcaaaattgcaattatcggtcccacaccattttcaccctatattgccatgttggcatgccacttgagaaaaaaggaaaatagttcagaaaccacctcttaagagtaataaaaaaatagcaaatctagaaagaacatttagataattgagaaaatttatagtggaaaaaaaattaaattttccctaaaataacaacaggtgactagaagtcttccgtctaattgaaacgaaaaattaccgtgcgaatgttgttagccacatgttctttttagcttatttatcatactattgaaatagattatttgattcacacttcaaaaagtatatgtttaaatatatgttttccccaatgtgccaagcccagatgagcgtgagccgccatgggccaaactacacatatctgattggatttggatcacaaccgaactcctacagaaatttcaaggactatttttcttcaattttaaaccataccatcaaacatttcatgcaaaaggagaatcaattttaaacagcatcagcatcaacaattaattaacgcggtaattaagtaataataaaactacgcgtgtgcctagctagctaattagtattcctctttagtctaaaccattgcacgccatggaggtggccggcgaaccccctctcgccgccgccgccgccgcctccgctctcctcctcgccgccgatgccctcgaactccatcaccctcgacccgtcgccgccgcagtacgccttgttccctgacgccgccgtcgccgccggcgcgtagaacgccgtcgtcgtcgacccggccccggcgttgtacccgacgccggcgtcgccgccgcccatcatgagcccgacgtcgccgccgccgtcctgctgctgatgaccatggtgtgagtgtgacaggccgccggcgagcgggtaatgcccgtcgatgacgacgccatcggcgccgccgccgccgccgccgcagcaaccgccctcgccgtggcgcgccgcggcggcgccgccggcgccgccgagcacgtcggccttctcgccctcggcctcgcggtagcggttgaggtaggacttgagcgggccgacgtaggcctcgaaccccagcgtggtcatggcccagaggaggtcgtcgccgttgatggtcttccgcttctcgcgctggcacttgtcggaggcctcgcctgtaacgaagctgatgaactccgacacgcactcctgcaccgtctccttcgactccttggagatcttggcgttcgccggcagcgaccgcttcatgatgcggctcacgttcgcgatcggcaggaacctgtcctgctccttcgccggcgagtccccaccgccgccgccgccgtagacgacatacccggcgctgctcccgcagccgccgccgccagccgcagccgccgccgccgcctcgccggactcgttgtccaacggcgggctgcccaccgggctcagcaagtgcccatagctcttcctactcttcatgtgaagctaacaacactagctatagctagctagctagctagagagagagtgtgtagttagagagagagagaagggggaggttatgggagttgaggatggagtggtgatgctctccttttaaagaaggaaaggaggtgaggagatgcgagtgggaagacggtatcgatgcggacacaaagcaaacataaggacgctactatatatattatgtgtgtcgcgacattctcgtccctacccgatcacctttcatgtaaaccatgtagtaatagttcagcggtttaatttattacctatgcaaagtgagtagagattaaggataacaaaatctacatcatgctgaaattaattcttatctatcaaggtgctctatcgctgcattgcgtcacgttttaaatagtgcgcgccgttgcaccaataaaaattaacttggttgtttgcattacatgtgtgcagcgcattcaatgatgctcatttacttcttgcacaaataaataaagatacacttgttagctgatgatcattttgaaaagactaaaaaatcttaggtgatgatcaaactacgacgaaaaaatattgtttaaggtgtttaattatttaatttatactaacatatactaatgaccgaaggaagtattacattttcttttgttattggagtctaggcaagggattgatttattttatgagaattgagatatgtataattgtgcatgaaagtatggtgtatagctagagatgaaatggaggtggggagatggaggtcgatgagagagagagagagagaggggggggactagttgccattgctgacgggctcgaatatcatgttgaagaacatgagaccagagttccaaaaagatcaagacaggggaaaccagaaaatattccaaaggatatcatggcacagtccacagcctggatgaccaccactagctagccatgtcacctcaagaaaaaaattgctatctacaaagatttttgatttcttggggttcctaggccaatggcaaggcatcacattagtggcattgatgcactgcaatctttctacccaaaaaaagggggtcacacacttacatctcatatagttttgcttgataataaaaaagataatgcatattgtaagctcattgctaaagatggcatctgcgagtgcatatattacattgtgaaaattgtgacatgaaaaagaaaaatatctctgctctcacttcacttgtgatggaatatggtatcttgtgcattttcataaaaggaaaaggcaggacaaagggcaaaggggccttgtgtgagatgcttctcttatccccttttccactctttttttggcttcaaagttctatggattattcgcgccatcacatcgcacaataatagaagaatatatgtgataacaacttgggtagagtacgcggattaattaacataacctcagaagcttaaggttgaaattactaggttttaatttccactacttcatcagctgcaggcttctggattaggaaatcaattatatgctttgggaggtttgaatggtaaacgggtgattagttttagtagttagcaaccggagcttcatataaacaactgagatcgtgccatttgtcagattccagaggaagccactgccgtaattacctgttgtttagtgtttaaaattattgctctttctcaactggattcatttcctctgttgtgctcgggcaaatattctacatgattaaataacatccgacctctgcatcaaggatgcgggcaagtactcattttagaaattctataagtttagtgaaacataagaagcctgaaaaaaaatattcaagctttcctaaaaaaaattaatccaatctgcacatatatagctgttactaaaattttcaccggtgcttgacaaacatattcactgacaaaagacgagctacagtactgcaggcatacgcgcaccgttggatcggctaaacattcggtcaagatcaaagtatgacttcttttaattagagaatttgctggaatatttcaaaaagcttagtgaatttttcaatggaaccgtgggtcatttccaacgttccattactttgcaaaccgttaatttattattgctcttttttttttgttaaactgcacactttgtgtccagccgattgaaaacaactcattttttaaacccgtttcaagagaaatacattgcaaaaataaataacggggatattgggagcacgacgatgcaaaggcgagagatgtaaccaaacccggattatctaaaattatttggaacatgaggattcctctaggagttttgagaaactcatgataatttcatcgaaaatgtttatcaacgactcaaacttgactaatatcccaaccaaattaacgacgaaaatagattcggtttgggcctccaaaaaagcctttgagtgttcctcttcttcatttttcccaagtggaaaagggaaagatcaggaaatgaggctgagaagacatgataaaactaggtgtttaacaggccaaagcccaaaagcagcccaaaaaacacaaaaggagccaagtgaaagtggaagagcttttgtcaaagtgtgttcctacctttccttaccacttgcacttttcccccctcagctttcaagctttttgtccaacacgtggccagaaccttctaaagcaacatgtacttaaactaaaacaagagtactgaaactagtactaagctagtaaaatataaaaatagttagattatgatcagagccaactatacacaatacaatagtgatagggagtaccatgtttcttcatttttaagcttttgaccttttcatcttctccgagttgcaactttaacagttcctcagtgtaagtgaacagtaaaatatactaggagaaccaaacatgacaaaagtattcttaaattaaggtagtgtaacaatataatatttgtgtaaccagttcaaatgatttttatttgattattgccagtcaaaattcaaacagagaagctactaggaaattaaaaaaaaatcggcctacaatgcgcaactcctcggcaccacagccaccaactttaataacctaatttggaagacctaggcgccacgaaaatgcaaaaccttcacatggctaatcatccaaaacagagtatggacctccgacagactagcaaccagaggatggccaaacagttccatatgtcccttatgtcgtcgatctcaagaaactgccctacacctcttcacgggttgtagatacacaaagagaatctaggaggcaattgcagaatggacggcgtgtgaggggttgaaaccatgtcggtggcagcaaacctccacggtgttagaatggtgggaggctacctcaaatatccaggaggcacccaagaaggctcttcgcacactgatcctgctggtcgcatgggagatctggactgagagaaaccgcagaacctttcagcaaaaagagctatcgaccacctcccttctggctaaaatcaaggaagaggccaaaatttgggccttagcgggcgcgaaaaatcttcataattggctttcttttagttagctcggaccaaaggtcttgagctcgttttcgcctttgtacagttttactccttctatattcaatgaaaattggcagcttgccttttcttcaaaaaaaaatcatatcaagttcatcacatttctttgactggttttgtgcaatactaattaatctactactccttccgtcccaaaatataagcaattttaccatagtgtcaagttaactatttttaatttggactattaatagaaacaaatcaataatgtaactattgatgttactagatttattattaaacaaactatcataatatacaattctttttatttaaagcatcttatttttatacttattgttggtgaaagtagtatctcgaagactgtgccgaaatctaaaaatgattatattttgggacggatggagtaccacaagatagatatatataaattaatatgcataaagaaaagatagggaagaacatttcaacatcgcaggccaccacacggcataatatataaatgctattcaatttgacaaaagtaaagctaatactgcctagttgacacacttgacagtgataatcaacatcaaggatctaatggactataacctcatcatcctgttgtatgccatctctttcttcagctagatttgacgttaccatcagtccatcactaacgttaacctctcctcgttgagctacaaattacacgcaaacttttgaattatctttccggataaactatttatcggttaatcgtttgtatgaaatgatacttgcatatttagcgactgaaattgatccattgaagatgaaacgtccaattttctccagggagttgattgtctgctatttcttgtttttttttcagctactagcagctagccttttatactcctaaaagatgtactttttataaaaacaaatatataaatttcttagaatactttttaaaatccattttcaactttttaatatttaattcatttattgttgccctcgaaaaagtcattacaaaattagaataatctatagctatcatataattcggaatgggcctataaggctgacgaaaatgcatgctatatatatttttaaaaaaagtaaatattttattaaagaataaaatcatatccaatctttgcacctatcaggatgtatacagccaacgtacatactgtgtgtgaggctagatatatacatgtagatcgtacatgtctaaaatatcgtgtaagatctgtaccattccaataaattgggtatcctgaaagtaccaataagttggatatcctgatcgataaagcatggaacaaaaagagaagccatttcagtggacattttcgaatcttgtccaacgcctacctaaaaattatcttttccaaaaaggaaacgtgcatttcatctgatttttcatctttgtagtgttgtatactattatgtacctatcacatattggacgaataatatcaaagtgaaaaatccagagaaccaatttagtagcgtatttttagagtcgccccttctaaactaaagatacgcgaccaaatgacaaacatgaattttaagacaagtagcttaaaatacatttcttttgcatgcttcttaatcccctaaacagtatgtttcatgtaaagatctcctatatactccctccgtcttaaaatataggggattttgtatggatgagacacttactagtactccctccatcccaaaataaatacagttttacactattcatcttcaacgtttgatcgtttgttttatttgaaaaaattttatgattactatatttattgttattagatgataaaacatgaataatactttatgtgtgactattttttaaaaaaaaattataatttttttaaataagacggacggtcaaacgttggacacggatttccacggttgcacttattttgggacggaggtagtactacaaatctagacagctccccgtctagattcctagtactagaaagtgtcacatccgttcaaaatcccttatatttggggacggatagagtatatttcttttgttggaatacttttgtaaagtagccttttcaatttcgtactatttctttcatttgtttatatacactcaaatagccatcaaaaaatcggattatccaacgatccatcaattccagctctccaaaatggggccaaaatatagtccctatatttaattttaaaaaatgagactatactagtatagaatttcaaaccatgcagccgctcaaacaagcagagaccataatggcaaaacaccaaatatgaaatgccccaaaacacccaatttaagatgaactcacgagcaaactgaccccacaggtgggccgagccgggccgggccgggcgtgagatcgcagccgcacgttcggcaggcagcccatccatccgggccgtccgtttgcgcggacgccgtaatgatggcgatgatgaattgatgatgatccactgatgatggtcccgtaataataaatcgcgatcgcacgagcgcagaagccgttccgtttgcttcttcaatgcaggtagaaccaggaggaggtgggacccacgtaaccaggacgtggggcccacgaacgggacggaacggaattggggggaggggacactgttgaccggatatgctgcgtctagctgcttggacttcgcttttttgtttcaggcggggtgaaaatttaaatgaccgttgatttgtggaaaattcatgtaacctttgtggtgatacttatgcggcttgtttggtaactcgaaggaaggggattatgggagtttacataaggaaatttatgatgagattaagataggaatttgatttttaatcacaatatcttatttggtttgggtgatggaaattgacagagagtttagttggagattaggtcattaataaaaatggatggctcagatttgcttagacaaaataaaggaggaattccctcctaattatctgcccctacccaggtactgaaaaggagggagttccttcctcaattctccatccacatcccaccaaaattcccatctcttccaaccaaacaaaacacttaatagcctcatccctctaaactcccaatccctcctaaaaactccctccaaccaaacgagccgatgtagtattttttttcatgtgttaattgtcttatttttattttttaaagttgattcgattgtgagcacggtttcatttaaaaagaaatataatccacgagcatggtggtcagttgatattgtgcagggaaaggcattataatccgaagaaaagacacgtaatcaaaactacattttaattaacttgaatatctgttaaatcattggccatatattctttacacactttatagtaaaaggactatatatttatcatctattcttattttcaattaatatagtactttttctagcgatttattatactataagtggaattgggactatatgaaaacaagatactgtgaaaatgttaaatacaatagcttctataatagttgttctagttaaatcactatttgttcttttgcatattagcaacatactgcctccttctcaaaataagctcatttttcatccactacacacatatcaatacaaaacaaaaagattagaatacctccactttgtcaaattctaatataattattcatcactttatctattcctaatataattgttccctactttcataaactctgatataatgattactctaaaagtaaatatttttttgggataaatggacgaagctaaaagtaaacttaggctgtgtttgaggaggaggagatagagaagattgggaagatacgcaaaacgaggtgagccattagcgcatgattaattgagtcttaactattttaaattttagaaatggattaatatgattttttaaagcaactttcctatagaaaaattttacaaaaaacacaccatttagtagtttgaaaagcgtgcgtgcggaaaacgagacaatcacccctatctcccctgatagaacgcaaacggaggaaatacataagaatccattccattgtagatgaaggacatcaccagatccattgaggatgaaggacatcacatgttagcacctaataaactcttcatggcaacacttactacaaccacagcttatgaggcctggccactccataagcttcttcattttatttaattgcagctgcgtttgttaacatcacttctttatcgcatcacagctttgtctcaacatgcatgcatgcatccttgtcacactcaccatgccacatgcaaaccaaatgaaaacgatgggttaagctcacagtaaaatcaaagtgctgcttgtacatacacctttaatattgtactatcggccaaaaatatatactctttgtcttaaattaaagctatttttaccacttaagttattttaatataaagctatttctctacctacttactttatttcaaccaatcataacaactcttcatttaatttcttcacgtactttatctccctaagtaattataacatatattctttcaattattttcacctagtttttatttcatgtgaaaattttcatgaatgcttacattttgggacgagagaatattagctagtattgtcttttttaagaggatttatgaaattttcataaaaacattgttccatattttttcaattaaaagggaagaaaatttagatatttccaaaaaggtatacatcagataaatttggtccatgtttcattataaaaattgatatcctactcacatatatttaatttatcacatctactatatgcactataaaaattaaccaattgtagaaaatctcaagtttataaaatagtactcttaaaaatagatccaaccgtacgatgatcatcaatggaattagataaaacatgattacatattcatcgtttctcgccgttcacacgtttagtcacaagcccggacgtgatttaaaatttctcttcactggttagttctttttttactacacttttttagtgattttttatatgttggattagagggagaaaggaaggaaaataactatgctttttaacatatactcacttcggtttcataattcttatcattttggataatgacatggttttcaaaatatatctttgactgtatttttctattgtaatatatctttgactgtatttttctattgtaatacagttatactttaactgtagtactcccttcatctactttttgatagtcatatttcatattggcacacagaccaaggataagtaattcatcatctatttaaacatgctactagtcattcctcgtaaacaagcgattcattaatatttacattttttaatacccatgtagccaatcatgtgtggaagaatggagagtcacacattaaatccgagaaagtcattaagatgataggttgttggattgaaatatgcctatcaaaaataaatttttcagatttggaaatatgactatcaaaaatagatggaggaaatactttgtaagacaagtctatatattgttctagtgactttaaactaaatattttaaaagttattaatagttaaagttataaaagtttgaccttaatctacagtagaaggccacacgcccacacaggccacatccctcctgtggctgctgttcatccgaccacacgggatcccacctcctccaccgatcccgttccgttgactccgttcccgtcccgccccgcccccactcatctccactaatccccttcgctaatcacctctgactccctctaatccaccattttaattaaaccccaataattaacaaacccctcactctcttaatccgcattaattaattgattaaaaaaatctaatcactctcgctatcccgttctaatcctaaccccacccgtgtctcctacctcatcgacggtataaagcgaggcgacgaactgactcgactcaactcaaccccccccaaaaaaaagaagaaaaaaaagaaaaagaaaaaaaagtcgtcgaaaagcgagagaaggggatcgattcgaagagagaggaggtaaagcggcggcgggagaatcttcgccggatcggcggcggtggcggaggaggaggaggaggaggaggaagagggtggtgctgatttggtgtggaggcggggaaatgcgtgatgtgtgagatctagggcgtggggaggcggatcgcggcaatggcggcgcatcggtgggcggtgtgggcggtgctgctgctgcggctgctcgtgccggcggcgcgggtgctcgccaacatggaaggtgggtggggggggaggtttgcgtttgagttgagcttttgcttgggttttggtcgatctggggtgtgttcttgctgggttggagtggattggtgtcgggagcttggggggtggctgcttgcttggcttggtttgagcagttagtacaagttgccgcggctgctggtttttgctgtgtgtgtaagttgctacgagacgtcgcttgattttggtttgatgcgtggccgctttgtacggatcctaccttttttactctccctcgcggaagaatcggagcattttctcgaatttttctccggtcgaatttggacttctctgcgttccaaattcactccgaattcccctagcctgtgaattgcttcaaaaatctgcgcaaagtcgggagctaaatttgcgctttcaaaatgtgaaacccttgtcggaaaaaagttgccatcgcgtttgatttaatttaatttaattttccatgcatttggatcatgtgttctattgaatgaagatttgaactgtgctgcgccgatgctgcacgtttcggagatttcccctttctatcgggtttctgcgtgcgcttgagagagctactgttgcattaaatcgcgttgctacacgttgcttgctagttgttcatggactaatctgctagagctgtgttaatcgattctttcccgtggttgttaggtcttgattaggacgtctaatgacgtggttttgctatttcgggccattgttagattcgagctgtcggtgcctaagttcgtgacataattgggttaccttttcgcgcgcgcgtgcgggttggtggctaggtgatttttcaagccggactttgtgtctaatcatggtacgaaatgggatggatcgtttcgattgcggattttctcgagcatggcttgtttagtcttgagatcccagttgcttaggcctgcctgggattgattaggacgttgatgcgcgtttgacgacgctagactgctaattttgggggtgggattggttgtatgtgtgtagttctagttggggattcggcaaattgtagtgggggcctgtgagctgtgggtcaaattgtattttccaggacaattggtagttgatgtgtgatcttgaagcttcaagcacctgaagcctgatggtgattgcttgtatttgaaaactttggtagtagtaggatataaagaggccaagttggtgttgtaattttcattttagttcgaccctttgatgctgatctcttacttaggtacttactttggagtgattcataagaaaatttaaaagcttattcacgacttacattctcataattgagatgttctcataattgatgatattttgagtttggctcactggttttaagtctagcgtctaagagttatctttcatgtacttatttgcccctttgtcatatactagagtaacaatttaactttttttaaaaacaaatcatactagctatggctgatgaaatggaatttttttgacatacaagtcagatagaattgtgccagatgcaatacaaacaccacatgaatcatgcatgctagttgaccttttggtttcgctccttttctgcatgatgatttggagtgttttcctttggacaaattctattttcaatctacacaacaattattagctactatttatgcacaatcctcattgattgtttggttaaattttattcacctgttgttgatacatgattctattattggcaggtgatgcattgcatagcttgaggactaatttagttgatcctaataatgttctacaaagttgggacccaactctggtcaatccgtgcacttggtttcatgttacttgcaataacgacaacagtgttatcagagtgtacgtgctaccttttgtctactatgcaatccacgcctcatacatttttattgaaattatctccatttttcagtgatcttgggaatgctgcactatcaggcactttggtcccacaacttgggcaactaaaaaacttgcaatacctgtaagttctcttcctgttgttaagtgttgtgcacatcattaaatgccattcctgctgcacatggtgcaatgttttgtcattgttctgatctttgaatttaggttaataccttgtaatgtgatatacgaattcatataataaatgttccattttgtaaataaatgcctattacctttcttatgtgagtatgtgatgaatgtctcacctatatcatcagaatatctacagtcacgtggagaaatattcctagctagtgtgttgtgctcagatcaactcaagccaatcactgagtattgtagagtattaatgttcattgttttctctttatgatgcagggagctctacagtaataacataagcggaacgatacctagtgaacttggaaacctcacaaacttggtcagtttggatttgtacttgaacaacttcactggtccaataccagattcacttggaaacctattgaagctacgattcctgtatgcttctactttactagctaaccgcttctacatatttacgtttagtagagatatacatggtcagccatctcatatttttaggacttggaaactatacttaaatacatatgttttagctggtgagtatttttgagctctcaacctaaggatcttgaattttcagaacacatattctcttagcatagtgcattggaatattggatagagatgaaatgaatctgtggtagtatcggttcatggcaatataaagcctatcgttgagaatcatgctgatgtagccaaccatatagctaaattggttttgtcgaccatttaacctgatatcaatggacagttggacacgcaatgcttacatattttggataacagcacttaacatggtaatgccattgttttaccaacatgcacttataagtgggaaaacattgccatgtgtactacaacaaaatgatttggttcgatttgttttcctggtctgaccttttcattcaacttggttgtgcattagtacattgcaattatatttccagactgctgtttatgagatgatggatagcttttgctactttctcactccttttctgatgttttagggcatctcctatgcctcttgattttcgaagtagttttctagagtctctgcattatatttattctctgtcattttctgtcaatgttactaatttggtgacttattttgtatttctgcgaggataggcgtcttaacaataacagcctttcgggttcaattcctaaatcactaactgctatcactgccctacaagttctgtaagttatccccccccctttattatacacttgtttaatcctttcttttcagtgtagtctttgttttttgttctgtggtttaattagtaaataacccatggtcaatgttttctatttaattaaagagatctttcaaacaacaatttgtctggagaagttccatcaactggttccttttcattattcacccctatcaggtaaaactagatttaataatgattgcagttcactgctcttttccaatacactgctgctatttacacttgcctgtcttttgcagttttgccaacaacccttccttgtgtggtcctgggaccacaaaaccttgccctggtgctccccccttttccccacctcctccatataatcctccaactcctgtgcagtcaccaggtgagatctgttcatattcacagctgtgcaacagccaacactatgatttttttttgttgcactgacgcgtggtacttatgctggtatggactatggaacatattgttgttgttctgacaataataacctcatgttctatagggagttcatctagtactggagcaattgctggtggagtggctgctggagcagccttgctatttgctattcctgctattggttttgcatggtatcggcgcaggaaaccccaagagcatttctttgatgtgcctggtaagcgtccaatagaacaagcgaacttggagaataatattgagccaactttgattgagattcattatttgttacagctgaggaggatccagaggtccatcttggccagcttaaaagattttcactacgagaactacaagttgcaacagataccttcagcaataaaaacattctcggaagaggtgggtttggcaaggtctataaaggaagattagcagatggttctttagtagctgttaagagactaaaggaggagagaacacctggtggggaactacagtttcaaacagaagttgagatgattagcatggctgtacatagaaatctgctgcgtttacgagggttctgtatgacacccacagaaaggttgcttgtgtatccatacatggctaatggaagcgttgcgtcacgtcttagaggtacgttgccttttttttttccaatctgacatccctgtatctttcagataattggagggttgatttgggttttatattatagaacggccaccatcggaacctccacttgattggcgaacaagaagaaggattgcgttgggttccgccagggggctgtcctatttacatgatcattgtgacccaaagattatccatcgtgatgtcaaagctgcaaatattttattagatgaagactttgaagctgtagtaggggactttggtttggccaaactaatggattacaaggatacccatgtaacaactgcagttcgtggaacaattgggcatattgcaccagaatatctttcaacaggaaaatcatctgagaaaactgatgtatttggttatgggattatgcttttggagcttataacaggacaacgtgcctttgaccttgctcgtctagccaatgatgatgatgtcatgctactggactgggtaattgactagcacaatcttcaattcaaattgcagtccatattcatgcccttttgtggcttgatgttgtgttgggagttagataaaattacttttatgtatgtccaaaatcgtatcatataaaaaatagtagttacagtaaggtcttaaaagtagtcctttttttaatcattatggcattagctaagctaagcataggattgaacatcatcgtctgagaaatacactgttatatggtaagccaatattcatgtgctgtgctttgtgcaggtaaaaggattactcaaggagaaaaggctggagatgttggttgatccagatttacagagcaactacattgatgttgaggtagaatcactaatccaggttgctcttctttgcacacaaggctcccccacagaacgccccaagatggcggaggttgtgaggatgcttgaaggtgatggccttgccgagagatgggaggagtggcagaagatagaagtagtacggcaggaggtagagcttggccctcatcggaactcagagtggattgtcgactcgacggacaaccttcatgcggttgagctatcagggccgaggtgatgacagcgcactggtagtttgctgctaattcttgtccgtcggaagagtgatttttatcagccatcctagtcgaatcgccatttgttcataccaaccaattggcccaatgtagccagctacaactatgttttgatgtatattgcttgatttgctccttgatgtgccgccttggatatcggtgacccgaaaacagcaggagcccaaggaactattgtcctgaagcttgcaagttgcaacaagatcccagtatgttaaagctcacaaggtagcagctaggagtgaggttgctgcggctgtttgctggacctgtgaaaattgtactgactggtgacatctaactattttgtaccaaatgtaaggaaaaaccatggtattattactttggcctcctctgggaaaggttcagaactttcagatgatgcagttggcctcactggtatactctatttggacatttgattatgatgtgtttactgtaaatgatacccagttctgaatcaaatgtaccttctgcatacagatgaaatctttggtagaaattgcttatttctttttattgggtcgattgtgcaatcttgtttccttcgccgtgtccatcacgaaagatgacttgaaggctagctatgtactccctccgtctcataatataagggattttgagttttcgcttgtaacgtttgaccactcgtcttatttaatttttttaaaattattatttattttatttgtgacttactttattatccacattacttaagcataacttttcgtttttttatatgttcatccatttagcacttataaatccgtttgaattcaactattttccaatttcttcacttgctccggccatgggtgcagcaactccaaatggctcgtctttttcttgagaacaccaaatggttcgtcttgttcgtatatttttatggtgcatatgttacgtagcttctcgacataaaacgtcctgttcataaacatactttttcacggttggatatctaccatgaaatccgcagaggatgttcagctcttgtcaaattcttactgcctgtttaatacaataaatctagatagttgtttattacactgtgttggtttgtttattttgaggcagagggagcatgtctcaaacgtgttggttttgcatcaattaaaacagtatttctcagtcttaaaatataagcatttctaagtataaatatgaacgactgtatatctaaattcgtagccaaaagttactatattttgggataaatgtagtatgtaagacaatgcagttctcaagctgccgaattctcacgttccaaattatggctttagtttcaaaatgacagcaaatcctctcacggatcaaggaattgagaaacatttgacttacaaaattcaaaaaagcccaacaaaaacccaaaaacccaccagccagagggtttttcactttgggtatgtttagttcccaaaaagtttttttcaaaaacatcacattgaatctttgggcgcttgcatggagtattgtatatagataaaaagaaaaattaatcacacaattatgtgggaaatcgcgagacgaatcttttgagcctaattagtccatgattagccataagtgctacagtaacccatatgtgctaatgacggcttaattaggctcaaaagatttgtctcgcggttttcgggcgagttctaaaattagttttttcattcgtgtccgatcaaacgtctgatgtgacgttcaaaaattttcttttccccaactaaacaagccctttttctccctttcacccttcccctccaggcctccacctggctcaaagccggtggcatactttcccggtgatggcagcggccggcgagctcgcaaacgacggcggagacgcaagtccggtgaccccatgcccgctagaggtagcggcggcaatgcagcttctcttcctcttcctcccccgccggtctcccctatcctccctcgattgtggcgtcgtcccgcggcagctcgcgagtgcatgcgcggcggaggtccaaaggaccggaggcggggacgaagcgagcaccgccccccgccagatccggaggcggagtgccgcgtgcggcgtcgcccgcggcggcccgccggcgggtgcgcgtccaaggggatcaggcaagctgctgcgctcggcatcggcggatcggcctcgctcgcactagtcgcactcatcgtgggactggtcggggagcaacggctttgcgccgacgagcataggcatgcggcgatccttccttcttttgcctcctattccagtgatttcttgcaaattacccccaaattgttgcagatcagatggatttccttgatttcttgtgcaggcgtgccgccgctcaacatggaaactttccaagtgaaggaaagatggagactatgaaaaacgctagctccacaaagtggtgtgctagttggtctaggttcgaaatctcaccccttttatttatttgatattagtttattctccaatattcgtgtttttttaagatggagaatattataactgaaactaataatagcaatactgaggtttaggataataattgtgcggccagaaaacactattcactgaggtttaggataacaattcactaatattcgcggtttaggataacaattgatattagtttattctctaatattcatgtttttttaagatggagaatattataactgaaaataataataacaagagtgaggtttaggataataattgtgtggccagaaaacaaggtttaggataacaattgtgtggccagaaaactctagttgacttgaccgagtggactaggtgcatcatcttccttgcaaataccatataggcatatgaacacaatgcatttcctcagatcctgaacaattacaagtagcttcctactattacgactagtaccatcaaactacttcatccgactgagagctgagctcagacataagagagtaatggcgacgatgcttgtgggtgtttctacaggagtaatgaacaccctcctgtccaagctctccaagattttggaggacaaatacacaaagctcaaaggagtacgccgtcaaatcgcattctttagaaatgagttgagcagcatgaaggctgccttggagatgcttgaaactgtagaggaacttgatcccctccagaaggaatggagggacacagtgcgtgagctggcttatgatatcgaggactgtattgatcccttcttggttcttgttgatcagaagcaagatgaacaatcaacattctttaaggggttctcctacaaactgaagaagatgaaggctcgccatgagatctctaatgagattgaagaactgaagacacgcgtgatagaggcaagcaagaggcacaagagatataattttgttggtctacaatccagccatggcacttctggtattgaccctaggctgcgagcactctacgttgaggttgatgagcttgtgggaatcaaaggaccaaaggagcatgtcatggagtggtttgccaaggggagaggtgatgtagaagtgaaggtgttgtccgttgtgggttctggaggtctgggtaagactactcttgccaaccaaatcttccgtcaattgaagtgccaatttgaatgcacaggttttgtatctgtgtcacgaagtcctgacataaagagtatttaaagacaaatgcatactgaggtagggatcactgatgacacatctgaagatgagcgacaactgatagacaaaataagggaccacctcaaagataaaaggtaaacccagtaatccacttataacaactaatgattttctgcattttgttaagcacagaaaccaaacatggaagcatacaataaacaataattagtggcataactacatgcattttctttgtttataaagtgcatactgcatatacatatgctaaaaacaagaagtctagtcttgactgctataactgtcatgagtaaattgcataaactttctaaaccatttttgtataacaacattaatgaaaaactaacttcttgatggcaaatgacaaagacgtgtgtaaatttgtactgcttgactttttttcaacaaaatccaaatttacaaataggatttcttttctcagagtgcaaaattgtactgcttgatggcaaatggcaacacatatgtgagcatttggaaaggaaggtatttttctccattcctactagaacaaaactaccacctgtggaatatctgcattccaaacaattttttttctcaaaagcgcaggactgcatttcatttcatcaagaagaaaggaaataaatacaaaaagagggggctaaactaacaccagcctacactaacaacacctaagggcaacacacaacctcaacaagcaaacacaaactaattgcccggggtaagcaaacctacagtgaaactcatggagtgcgtaagctccagcaaaactacactcatttattttatagcctgcaaactcccgcgcccccccccccccaaaaaaaaaaaacgtttggattagcactattgaaaacacaatcgttgcgatgcttccaaatctcccaagcaactaggatgatcaacgagttcaatcagttgtgcaactctagataccccttgatggctttgccccaccatgctgagaatcaagtttatgatggttgaggtgcagcaccagccagccgtagcctcaagaggagtggggcaagagaaaacacatgatacgaggatatgctgaaatagtcatcaccactttggtcgcttattgggcaggcaacaaaatgtgacaaccctcgcttagcaagtcgatcagaagtcaacatatgacgttgattgctaaccaaataaaaaacttgcaacataaaggagctcagcttttccaaatccgcttccatggagcaaacttgatagatcccaggaaataagacttgtaggctgatttacttgtgtgggaaccagaccctgtgagcttccaaatatgctggtcctgaactccatgctgcaagaccaccccatcaaccaaatcccagatcagcaaatacttagagagaacatggacagacaagccaccttttataccagccacccaccgcctatttactagtgcttgtgccacagtacgttgcttcgttgatcttttggtgattaaataaaaaagattgggaaagggcatgtagcctagtggttgcagtaatctgagtagcactccaaggtcctaagttcaaatctctataggagcgaatttcggattgggttatttgagggctaagttccctgtttgataggctaagttcataatttaaaaaggctgcatatatccagttggatgtagagatcgggtaaaaaaatacccttctctaaaaaaaaaagattgggagcctattcagttatcgttcttccttgccaccatctatcactccagtacatggtattttccccgttgccaactatagtttccacacccactctgaacacagagcgaacactgcgatgtacttgtataggtaacacgttacaaggcctagtggagtcagtttttttaagtctaagccacctcaagattatgaatgccaagccccccttaaagagaggccaacaaacacgatcccaggagacaaggcagttatcactattggccttctcctgacccttccaaaggaagcccttgcgccttttatcaatagccctggacacccatttgggaagattcattgccatgaccgaatagataagtatagctgtcaagaccacacagaccatcacaagccggccagcctggttcataagggaagctttccacactggtaggccatccgccactttgtcaaccaatggcaacaaatcatccttaatggtttgcgagttgtgacggaagggcaagataagagcaaggaaagctcttcacttcacaagaaagctcagtggagagaacttccaagtcttcctcggaacattggataggggtgcacaaactccttgtcattttggtcttaagacctgaaatacagccaaaaaaatctaggatcacccttgtaggtcagaggaacatcattgttatgtggagggatgaattggggtgctcgacgggagggcaaggttgctgcagcttcgctgccccggagcctaggtgaggccgaacagagaagaggggagactagagataggtttaacttctttcttgattaattccacatgactgtggtgcctctccttatatagagccggctcctaacaaacatcctaacaaccttatcaaataaagcctaacaaacctcctaacaaccttatctaataaagcctaataaccttatctaataatgagaggggctgagttctgcccataacaatcaccacattatctgtgcgtatagagaaatccgatgtgccatctttggaacagcatggggccgacgaagattattgtggatgcatgaaccacgataaattcagcaaattcataactaaaaaaaaacatggggatggaggctccgaagatgaagtgttatttgccccggttccctattaatcaaagctcctgtggaagaagtggagagcggtaggcatagcaagttacaataccaccttccaaaccccaagtattttagtacctcaattaggaaggaccaatcaagcgaatcaaaggcctttgatatgtcaagtttaaacaaaacatggggctctttcttactgtgtaattttcttgccacctgttggacaagcagacaattgtcctgtatacttcttcccttgatgaatgcactttgatttatggaaaccatccccggaagcaaaggtgctaggcgatgtgccaaccaacttagcaaaatttgaataagactaatggaacgataatactttacttgaatcgcatcaattttttttttggcaacaaggcaatgaaagctgttttaagaagtttgaacttagccacatgaccacactgaattgctgagaaggccaaagatcacatcattttttgataatgtcccaagtcccaacacgatgtagaaccgaaagttccaacttccgaacaattgaatgtccacaataaatccatgcattaagatacattgccacatactcccctcaataagtgtatttttagcctaacaatttgtccctaatagagtgtagttttatagtggtccactagacctctttaatactacatccttttcttctcattttagtcattgaacaaatagtactccctcctcctcgttttctccccctccttgttttctctccattttaatgaagggcatattagtcttttgacctcgtccttaatatgtctttgactagctaaaactacagttatttagggacggagggttttatgtgtgcaaaatctgaccatatatatgctttgagaagacatatccatttccctaactaggttcctcattgatatttataaaactgggacctgagctctagagtaagcatgcatactagtatataaccctgattgcagtagggtggtaagcatacttgaatgatatataactaaataaccctgttaaaatcatggaacaggtactttgttgtaattgatgatgtatgggatgttgaagcatgggaagctgtgaaacttgccttgttcaataatagatgtggtagcagaatcgtcatgacaacacgtaatgcagcagttgcatcgcattgctcacgtggtggtgtttgtgtctatcaaatggaaccccttagttttgctgactccaaaatgttgttttgccaaagagcatttcgttcccaggaattatactatccccatttggaagaagtttgtgatgagatactggcaaagtgtggtggattaccattggcaattattactgtatctagcttgttagccggcaagcatgcaaaagatgaatgggacaggatgctaactgctattggccatgcacttgctaagaatcctgatgctgctaacatgacaaagatattatctctcagttactttgatcttccccaccatctaagaacttgtttcttatatttgagtgtatttccagaagattacaagatcagcaagcaacacttgataaatagatggattgccgaaggatttgttcatgaagaacaaggatggaggacctatgaagttggcgggaactattttaatgatctcatcaatagaagtttgatcgaaccagttgatataaatgatggccaggcgaaggcatgtcaagttcatgacatcattcttgatttcatcacatgcaaggctgccgaggaaaatttcgtcacctcagtgaattctgtggagcatgggaacatttc

SEQ ID NO: 42322 - DNA, 2575 bp, Oryza sativa
  unsure (1)..(2575): unsure at all n locations
attggacaataattcgctcctggcttgtcgctctctttcttgagctgtggctctgtgcctgtttccttccaacatttgcaggacgtacctcacctgatgcttttaataagtaaaaaatgtgagattggatcatacaaagcaatcagtagctgccaagaagggattactggaagcgaagttccgctatctgttttctcaataataatcatcctcacattcatttttctttttgtgccatgtgtaacagggtgagacaagtcaagagtttgagggtcagggtccagatgaggcctatcctcgccagcataaaattttttcactacgggaactagaagatgcaacaaattgctttagcgatagcaatgttcttcaacgtggtcgattcgacggcagcatgtacaaaggaagactaggagatggctcattagtagctgttaaaaaggattatataagccgggctttaagcatgggttatccaaacattgattggagaacatggcactttcaaacacaagttgagatgcctgtgcatagaaacctgatgcgtcttcatggattctgcataacgccaacaaaaaggttccttgtctatccatacatgtctaatggaaccgttgcatcacgtcttagagttacgttgccttttttttttctagtctgacatccctgtatctttcagataattagagggttgatttgggttttatattatagaacggccgccatatgaacctccacttgattggcgaacaaggaggaggattgcattgggttccgccaggggactgtcctatttacatgatcattgtgacccaaagattatccatcgtgatgtcaaagctgcaaatatttcattagatgaagactttgaagccttagtggggggttttggtttggccaaactaatggatcacatggataccgatgaaccaaatgcagtacgtggaacaattgggcatatcgcaccagaatatctttcaactggaattatctctgagaaaactgatgtatttggttatgggattatgcttttggagcttattacaggacaacgtgcctttgaccttgctcgtctagccaatgatgatgacgtcatgctactggactgggtaattgactagcacaatcttcaattcgaattgcagtccatattcatgtccttttgtggcttgatgttgtgttgggagttagataaaattacttttatgtatgtccaaaattgtatcatataaaaaatagtagttacagtaaggtcttaaaagtagtcctttttttaatcattatggcattagctaagctaagcataggattgaacatcatcgtctgagaaatacactgttatatggtaagccaatattcatgtgctgtgctttgtgcaggtaaaaggattactcaaggagaaacggctggagatgttggttgatccagatctacagagcaactacattgatgttgaggtagaatcactaatccaggttgctcttctttgcacacaaggctcccccacagaacgccctaagatggcggaggtggtgaggatgcttgaaggtgatggccttgccgagagatgggaggagtggcagaagatagaagtagtacggcaggaggtagagcttgttgggaatagtcacacattgtttatttagagagagttgaactaacttaaaagtggggggagtcactcacctcttgatgtagcttttggggtgtagcaaggctttctcccttttgggatgtagcaagactttcttccggttgagccaacgtctcctgattttgggccctcagagcttggccctcattgaaactcagagtggattgttgacttgaccatcggaactcagagtggattgttgacttgacggacatgattgttgcgcactggtagtttgctgctaattcttgtctggtagttgctagttcttgtccgtcggaagagtgatttttatcataccaaccaattggcccaatgtagccagctacaactatgttttgatgtatattgcttgattggttccttgatgtgctgccttggatatcagtgctccgaaaacggcatgatcccaaggaactagtgtcctgagcagggtttcacaaaccgccgcggccggggttaccgtgccctggcggtaagcacagttaccgcggtaactgtgaaaaaccgtacgaaaccatgcaaaatatattaaaaattcaaattatttttaaaatttatttaaatttaaggaggttaccgtggtttttctattaccataccccgcggtaaggccggtaaccgcggtaaccgcgcggttacagatggtaagtcaaaccctggtcctgagtggctgctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 42323 - DNA, 6989 bp, Oryza sativa
  unsure (1)..(6989): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcagaaaaacgatgagaagaacatcgctttcgcaacgaggcacgcatgcgtgtgacatctgaataacaatgatctctcccattatagaattataccaatcaaatgaaaatctttttcttgaaaagaattagcctgaaaattctttatgcagtgtatcacaatttggtgagaattgctagctcaacgacggcaagttgctgcttattcaggtatccctactcagatagcaccgagacaatgcacatttagcttggcacaagtaagcccagctttgcctctctttttttctgcctaaaaaatataaaaattgtgactgtgagagttggggtttgcaactttaaattggcaattgacgtcttgcagattcagttgaaatgggagagaaaacttaggccaatggcagtgagagttcatgcaggtgagttagatccatggatggagcataacagttagcacggaatcttcaaaggggttgtgatgtcactcaggggtttgatttgggtttggcagataagatgaggtgtcgattctgggatgtagtaaaagccagagttcgatctgtttattgttctgcatgagatgagcatctctaaactctgggaggaagaacaagtgttaggtattgtgatacatattttatcttggtttccattagcagatttttcaaactactaaatggtgtggtttgtgtaaaagctttctatatgaaaattattttaaaatagcaaataaatttattttttaagtttataataatcaaaaattaattaattattctctaattgttttttcatttcatgtgtgttaacttaatattcatttttgtcaacttcaaacgggataaccgttgtggaactggattggttctctttacataacaaaatatcgtttcttccgtttccatatatcccacttcgaatcaggattaattttttctccattgctgggccgacatgggcctgcttcgtttgagagatgggccgtgcgacgatagaagcaaaggacctctcgtcctctccgagccgtgtgtaataagttcatctcaagtcccttaattttacaccgagtccgattttcgttcttagaaccccaaaaccagatacaaccggccctcgaactgtcaaaaccggtgaaaacgaggtccctagcggttttgaagacggttttggctgatgtggcgtctacgtggctggtttgactaggtctccgtcccatgtggtattgatgtggcgatgacgtggcaattatatcttggaaaaataataaaaatcatgggcccacatgtcagccacaaaaaaaatctaaaaatggtggggcccacatgtcatctggttgtcgccgtcgagcttgtcgatgtcctcgacgacttcttttggcttctcagtaatgccacacgagtgctgccattaataacatcaaattcagattcagctacaatgcgattatgctgaaataagcaggcaagcataggtgttcgatcgatcactcaccttggaacgagcagtaagcccagatgtaagcgtgttcacgaccttcttcctggagtacttgtgggctgaaccgccgccgctgccgctgctgccggtgccctccgacttcgaaggcttcttgttctcgttgacgccggcgccggtgctggccttggcggtattatcgggacgaggtacgacctggccgacttcggagctggttccttcctgaccgggttctgcacgacaatctgcgagcaaaatcaaaattggggatcaaaccaaacgctctgaattcgcaagaagaatgaggaacagaaggggtgtctcacccgtaccttgttcaccccaacggcgttctcctgagctttctttagaagctgggcgccgaagctcctggtgatggggcgattgatcccctccggcagctacatcttgctgttgcaagaagaatacgaggtttcagagagggaaacgggaggaagaacgaatcgggaaaggttggctatgatgatgtcatctactatatgattgtgtgcgtgagatcgttgtcttctactccggatcagcgaataggccactagttattcaatacgttatcagcacgagattgctcatacgctaatcccggtaagtgttctagtagatcaattgatttcagtactaatcagattgatatgttatctgtgtactgctcgtcgccggccaacacgaccgcccgctcatgcgcacctgcacgccgcgctcgacgcgtggctgatggtcgccggttacgacgccgcactggagcatgcacggcagcaggacgcatccagccgcgcgtgcccgaggcaaccagccaggcggctctaccacacgcagtacgcaaccctgcggctaggatccaggagcaaaggatcaagcagacaagcatacatgcacatgaatgtacagattggtttatgaaccaatctagtacgtgcacgtattgatcttcaccaagcctataacaacatgggtgtgcaacgacgtgtcgacagtgctgggctatacacagctacaccagcacgcaactcgtcgacgccgcgtcgccgatacgctatgcggacgtgcataagcggatcggctacctttacatcggataaacgagataagtatcggtttcatctattctaatactttgcagtagcgagagtaatatgctagatcatgcctctagtcgttttattttctcgcatgaatagatgtatttgtctggccttagcggcgactcttctcttgttatatcgctgaccacgaagtttggcaccacgcgcccgaacgcgcttaccgtgcacaccagaaggtgcacatacataatccgttgaattgaatgatggagtgctgtcccgaacgacgacacctcacactcggtaacacacgacaccacctagaagttgtcgtctatctggctaacatagtcgtcgatctatgaatatattaacacactcgtcatcaccgatcttatggatcagcgtgcttgggacaatgttggttgtgacttgtatgttaataatccgttatattgctatctatatgaagtagatggtaacaaatctgagtcatcagcacctgcatgcgccgccacctgcacgtagcgacacccagacgccaccacatgacgtcttcccctttgtcaatggttgccgaatcaatccagagaccttccctcgtcgatccgccatctgaaacaccgactcgacggcctttcgaggccatccgcaacgcaattgacggccgtcgcccgtagcgatgccgaggagcttacgcccgcctccccttgccgccgatacgcacggcatgcctcccacgctaccgcacgcggccgggacgagggtcgaagccgccgtgagtgcccgccgccgatagccgtccgccatgccggcatgtatgccgagccgagtttcgtcgacacgtaacatggagctatgattgtcggacgctggtcacggcctgatgccaaagaatgccggtgtcggtgctactagatgttgcaccgccgctccgcctctgaccatggcaacttgccatagtcgtccatctctaccgagggctcactagcacgtttgcaattggttccatccgtcgtctccattgaagaatatcaattagatcatacctcacccacttcttgtaggagaaggtcgtagtagctcattgggcaacatatgagatgggctggccagattttcaagctagccagtataaggaggtgggccaagtagaaattggcctattaaaaggagtcgggcacgaaccgtgattttggtccgaaaacggcattttatttcaaaagtccttggtttccaaggcattatgcagaactcggaaattatacggataagtcctatgggacattagaaactacggggaatatacattcgccatttatactttgaaccttcatgaattgggtttacgccaaatagagaagaactaaggatttataccttagtcccgtatttctaagtatttgctttaactatttagttagtttcttgaataacataatcaatcctagaaacattgtttttaggcaaaagagcttccatgaacttgtgaaacccttgttttagcaccccttttggaagcatcatattttatggtttatttcctggcaattgtttgttttggggtaattgattgttctgtgggttagtagttctgtaaattacacatacctttgaatagcaaaaaatcatgttaattgctaggattgtaataaaaggtgtgtatagaaaaccattctttactattttgtactcgttttgtgcactttatttactagaagtaaaccggtagaaagttgcataaaaggacatcatgtaagtagttgcatgtagcaaatacatttattgggcaaatgagtaatagaattattcatatatcttctctttgtgtaattgtcgccacatttgtagaaggcacaattatatattctccgtatagaataaatgtatacactcatcatgaagaaagtatattattgacttagagatatttcttagtgtatgactatcatagaagataagttacaactaatttatattaattgtgtccaagtagatacaatgtcatcgaatttgtgaatatatagacgagaagtctatatgccaatatgccctacacaaaattatctatcaaaagactatgtacctatgcagtgtctatagttaatttgattgataatgttatgtccattttccacgtataaatgaatttacaaatgaagtattgtttttatgaatgtatgcacatcaattttggcctatatgcaacatgtttagttgttagaattaatacacaagaagttgtattactgtcaacatgtgcatttgcacgcacatatatgacttatactattaatatattcatgaagaacatgcatactcaaaatttgtggaaggaaaggaatttggtgtatttgaatttgatgttcaactcagggggagatgaatagtaatgacagtaatcttgcattcgttcttttgagatcgtattttacaatacatgagttacattacagattagattaagttcaatatgaagaacatggttaagctcatgtagagcttctttatcttttgctttaggcatagaagcttctgcattagattactgaatatttttttatataggtcatctcaccttacctatattgccttttttttacctgtagtaattctttaaccttttgtagaataaaattgtaaattatatgtctaacattgaatgtaaatatttgtcttgcctattatttgaagtatttttggcgaatgtattcttattatccactaagcctcaatcaaccatgtaggttggtagttctaagtgcattgacgccatattggcatacatgtagagctgttcacttatgcacatgaacaattagaatatttatgtttaagcattgaagcttaaatatatccacctgcaaccacattatttctttttagaaaagttgtaccatgaagtcacaacaaatatgtgggtttcacgacaactttttagtaaattttcttatgattggcgtgaaaagggggaggaatatgtgtattttgcaaattaatttcagaatatttataataaagaagcataagaaattgtggatatgtggcaggcaaattggtgtgttataggtcaaatgctagaagcaaaagatagcccaaactattagcgaatcatatttgggataattatgaattattgtcacacaacgaagtgtgttatttattggccattgaaaattgcatattcatcaaggaagtatgaaattgcatatagctatttaaaagctattggtttacttgtagtaaacaatatcctaaaaataattaatgaccttttggattcgaatgattctgaatgatcaaatgacaccacatttactttggcgtaatgaataaaagttagacatgtcacccaatttatttattggcatattcaagaagaataaatattctcgtagaataatgtttgggtgatttgaaaagttccatgatggttaaactatgttcatagattaatgttttagtgctatagttatgttcttgaagacatcatgaagttatataatactaacacatccatcttatgatcatatctatgttgcataaatataaacatgaagtttattgatccaacttaattcaagaattgaatatagtatgagtaattggatcaagtcttgggcaaataaaaaaaagttagaaaatagagtaattttgtcgactagtggatatttgtttgggattcattgtcgcagaataataaccctctatgaattggataacctacagtattagggatgtgcaatttttcatgccattgcattaatttttatgttagctcactgcatataatatctttaccccctttattttgtataagtgtgtgttcaatgaatgaacattttcctcatatatcaccaccataacatacatatatgggcctccacatgaagttggggatacaaatggaccgaattccattaatccagtgcctatgataggggatttttgtgatatgctattagataaagatcgaatatcggcatcagggggagaaaagcccatgtgttaaagatgccttatattttcaagaagaaaaagatctttataagtaagaataacgcacaagccaaactaaactagaaggtttagtttattctcctgtaagccagaagcgggagcttgccagataa

SEQ ID NO: 42324 - DNA, 1682 bp, Oryza sativa
ccatattggttctattgaagaaagcaatgaggttgaaccatagtcgctaaataagtctatgtgaacatggaagtcatacttaataggaaatgaagtggtgaaaagcgacggttcatatggtcatggaaaagactgatattctcctactatgaatgtattaaattccgctatatatatcgctggcaaaaggtatgaattaataaatgatatgcagtttatgggttatgaaaatccatatgaagttttcactagaaagaaaacaatttcgcaacatatatgtaaatctcatactaattagtgtcatgaagcacactatattctcaagaagagaattgcaagactcgtagaagagtttatgatgactcatgaagagtttttctcctagaagtgagaatatttctcatagcagagaaaatgacttccggaagaataagttgatctctgtaggactatgctaatgtatgaattgccggttaatctccatataacaccaataactcgtactcccatgaagtggacagacccgtttaaacgaatgaattggtccactagcatgcaagtggatcggtagttttctacatactatgaaggtgtaagaatttatatatcatgaagatatacttttgatggtatttggcaatcttattaattcccctaatgccaaaatatagaccagtttatgtcactctaagtggtttaagctaattgttgaagattagtgaaacaatcaaactggtaatgattgataaatccactaagagcaagctgcataatatttaacctcttgtattgagctaattattttatacataccgcatatgtgtaacgttgcaacttattttcccatagtcctccgtaaggataaaactttgtttgtattgcacatttgactaagtggttatacatattgctcctatacgttgatttatttctcatgttcatagtaaaacttatgaaataagtaaatgaaagattaaacattgtggtaattttattatcattgttttacacattaataaaaatatggttatgacattggaacatgaaagtttcaacggatgtcttattgagggggagcatatatgctaaacatttattatcatacttaagacttggaagtcttatatttgatttaccaagaattaatcaaattaatctttgttttgataatttaccttgaaggttactaccgctatattgttgtgttaatccaagttgattaatacaataaagcatatagatcattggctatttatgaagaatgtatatcttaaagattatgcgatcaagaagatcgtgtgttgtactctttttcccttagtgagtttttacttgaatatttctcacgcaaggtttttaacgcggcaacaagtgcgatataactagcgtgtacgatgtactcttttctcctatccttttctcccactgggtttttggatggagtttttaatgagacatgtgtatagcgcggtattcgcccaaggtggagtgttataaaactattatctcctgccagagataaatatggactcataccaaatatatggaaacgtatcctaataggactcttcctattataggtatatatattgagagagatggcttgagaggttggttgatgtatccacatatgagaaagcaataaagctgtgatgcctctccctatatccgtgttcattatt

SEQ ID NO: 42325 - DNA, 2951 bp, Oryza sativa
atatatattttgttagaaaatcatgagttgtaattgggagtccaatcaaattaacatgtgaatttttaaagatatttctttacgattcttctgtatttgcaaaagcgaacgaacttaaaaatcgatttaaatataaatttgtattttcaaaaacgaacgaacttaaaaaatgactcatatacagatgacataccaaagtattagtaaaaacatcttcaatttttataataagtaaagatacagatatagatataaggtataagctatccttagaacacctttataataataaaattaaatcacaaaaaaagtaataattacttttttttctgaataagccacggagcatttcgaactttcagtacagacttgacaccatgcgccgagccaccacctaccgtagcgtgtacagtgtatatacaaaacccaggccgtagagccggtcgtcccatagaaatcaggcccacaggaacccagaacgcatctctcgccaaacacactattccaatgaaaagtttgagtatgattcactcgtgccagatttgtgcagaatctgcagcatgttccaactgcagagctgaaattagtttgtttgtactactctgaatgggtttttttttctttttttctctagacattgtttctttgcacggtgattgcaaacgcagtcctgtagccagtcatctgtcctccttgggatcttctgtgagtgttagcaatggcccatgattagaccacttaagtaggcccgtagtattttcagacaaagaagcaggcccgtaattaaggtaccacagcccgcatttgatttgaaagcagagtcctagtttcaaatttggaattctgaaagtttcaatggatctaccgtaaaattcaggtaggattccagcgattttcaatgtttttcgtgaacgcgcaagagattttcaatgtatcttctggaattcctttcttcgtagtaaattcgatcagctcaccttctcttgttctgtgtagtgcacacagagtatttgtcgctctcgtacgagtcaaatgagacgcaggtgtcgttgcaatgcaaccctccagataagccacggagcggagttcagataatgtgccaacgactaaccgtgcattctatctgtttttttatatcattcgccttatttcaaatataaacatatatgaataaaaaagtgtaagctatgcttagaacacctttaatggcaaaattaaatcacaataaagtaagtgttaattaagtcatttttctgaataagccacggagcatttcggaaataggactttccagttcaagcatggtttagttttcaactttttctcaaacttttaacttttccatcacatcaaaatcttcctacacacataaacttccaactttttaatcacatcgttccaatttcaattaattttcaattttagcgtgaaccaaacacaccctcagacttcacacctcactaacacaatgcgccgagccactacctaccgtagcgtgtacagtgtatatacgaaacacaggccgtagatcccgtcgtcccacaggaatcaggcccacagaaaccgagcacgatccatctctcgccaaacataaaaaaccaacacactatgaaaagtttgagtatgattcactcgtgccagattcgtgcagaatctgcagcatgttccaactgcagagctgaaattagtttgttaggagtagtactttgtttcatgtaaaccactaactcatagtagtacaaaacgttctcaaggacccctgaactcgaaattttcgtctatcgtatttcacaacttttttttttgaacgagtcgtatttcacaatttgcgcttcttgaattttgctggtttggaacttttttgagagaaagtaggagtagtagttttggtcaacagtgtttgtgatccaagtccactgcaagcttggaaaccagcagcagcacctggtatcatcggtggttggtgaaactcggtcttcttagaactaagcaagaacagctcactggaacaagctcgcccacttcaaccaagcacttagcagttaacactataagtcactaacacacgaccagcccatgttttatcacagaaaaaaacataattaacattaaattaacctcaaacacactgtttgctctgacaccactaatagtccaccaaatttataatcctcaagaaccaagaggaaagaaaaatagcaaaatgagcttatgtcaaatggttagtttttctgtgctgaaactagttcacattttagacttgatatatgtacggttaattattttcttagtggtaagcgatgtatttgtaaatatcgacagcaagacatctgtgttcacttcatcatatcctgactcaatctttcggggtgcccataagaatagggtttatgcatgtattcataggaattggtgtgcgctcattgtgagcatctgctttagggcaggtataatagcacatactacaagatgtaatatgcgtgtgacatgtaaaaccagatattactagtgtactattccctccgaattaataatacttcgttttggacaaaggcatgatctccaaaaacaactttgaccattattttccattacaatatatattaaagtgttaacaaatatatgattttattaaaatactttgtaaaactaatatatacatgtattctaaagtttgatatcacccttgtctaaaacgacaagtgttattagtccggagagaatacatgtttacaggtaattattgtataaattggctattaagatgattgtagataatttgaaacgggtaattggctttactattaaacttgttcttatatgtttatatataataaaacaagaaaaaaaattgtagtggaaacaagaggggaaagagggggaaaaaatcagtgtggtgtggcccactcacctaccgccaacctccccccaaatccgtagctttccggcga

SEQ ID NO: 42326 - DNA, 15983 bp, Oryza sativa
aggccctccgccccatccgcgaggacgaggtcaccgccatggtcgagtccgtccaccgcgccgtcacccagccaggtaaagcttcaagaattttagtgttctttgtgtaattttgagcaaggagagggtgcttggtgcaaacgtggttggtatgagtttggtggttgtggcgtccttgtgtttggtgacgaattgttatgtcgtgttgactctcatgtgtcagctaaattgtgctgccttagatcagcgattgccgattggtactactagttgttttgcaggcttattggtgctcaatttgcatcgctccttgagggaaatggccaaggcgtggtctgccatttcgtaggcttcgctacgatatgctgtgcggatttggtagtggatcctagaggaaatgctagctattggtttgatctggtgggataataaactaataagaggagttgaactgcctcgagtgagtgggtgcatttctctgagatggatcacatggtgagcacgttgttagagagccaagctaagattttacttgctgaattgaaaatgtaggtaccatgaaactaggtagtgatcatactctgcccagctgtactgctgtagtgtgctgactgctgagagaccttggccctggggattattggttatgagctatggttcatgtcaagcagatatcgtaattggtatagttatagtaaagtgggcttcgtatgacttccagtatacacggggttggtaatcacatgctattttaagcttaagtgaagacagtttggtgctttctgcattattgttcattaaggcacttcacacctctctagtggacaagaattacgctattccctttttggtatataagtttgctctgttgttggcatgctattttagctcctcacatgataagtactctacttgctgtaatgtgacaccttgctagttgaaacaatactatgctgtttaagcttcttactggtatgccaagcattctcttgtgatgttatgttgtaccagtttgacagtcaaaaaaaacatgtttggcaacaaccttgtttgaactggttggaagtcttttttttttcttctaagatgtttgtacattttgatagcattggagtttttacagactaaaattaatgagctgctattatgtactttgcccatctgtctcaactgtgctgacagttgatacagcttatcagcgactcttttcaacttatttctgactttgcaaccaattttatgttccatttgtgttgctgtttcaatgtagtcctcaacattgacctagccttctctctattttccaatttagtttacaagaattaagccaggctgtttagaaaaatgaatgaatttagctttatttatactctgttggaaaaaaattttggcctacaaatgcatcctatgaatacctggtgtcaaactgtcaattgcaaatcgatccactagctgatttgtttacatgtgtacataagttagcaaagcttttttttttgttggcctaaagccatgatgggttacctcaagaaaaaagaaaaagaagtatattgtgcacgacatacaataatggaacaattacctagcacggtaagagtctatttgcattggaatgaagtttttaactaacagtcattttatcgatgtgctgttttcaggtagtgaacataaaccaatcgtagtgaggaatcaccttgctatggtggccttcaacaatataacaaggctagctttcggcaagaggttcatgaatgcaaatggtgacattgatgaacaagggcgtgagtttaagactattgtcaacaatggaatcaagatcggtgcatctctttctgttgctgagtacatttggtatttgaggtggttgtgtccacttaacgaggagctttacaagacccacaacgagagaagggatcggctgaccaagaagatcatagatgagcatgcgaaggccctcaaggagagtggtgccaagcagcactttgtggatgctctgttcactctcagagaacagtatgaccttagtgacgacacagttattgggcttctatgggtatgttggatgttcctttcatacttatcagtatctatcctttttgtcatccaatttcagatatgataccctactggactattaatatcaatgctctcccaattacttttacattatttgcacacatgttaaatatcatctctcaaagtcatggagaattttttccactctagtcagatttggtacatagtttgtgtggcatgtcactatcttagggttggtgaagtatggtggtatttggaaaagtttctgtttactttctagttggaagttaggttgtgttttatggtttcaatcatctacctactaaaaatgcgagaaagttggaaaggttagaccacttagctagtggcaactaccaaaagctttcaatggatgcctctgcatgcatttccctatcttgcatcgcacatggataatttgcatatcaagtttgttcagactaggaaatgaataccataataatggaagataaaaaacaaaatcccgataattgtcatgtgcctgaattttctgtcctgctaactccattacatttgtgagttcttaccatccctgttatgttccttgtgttcaggacatgatcactgctggaatggacaccacagtgatatcagtcgagtgggcaatggcagagctggtcaggaaccccagggtgcagaagaagctgcaggaggagctggaccgcgtcgtcggccgcgaccgcgtcatgtcggagaccgacttccagagcctcccttacctgaacgccgtcgtcaaggagtcgctccggctgcacccgccgacgccgctgatgctcccgcacaaggccagcacgaacgtcaagatcggcgggtacaacatccccaagggcgccaacgtgatggtgaacgtgtgggcgatcgccagggaccccaaggtgtggagcaacccgctggagtacaggccggagcggttcatcgaggagaacatcgacatcaagggcagcgacttcagggtgctccccttcggcgccggccgccgcgtgtgccccggcgcccagctcggcatcaacctcgtcgcctccatgatcgggcacctcctccaccagttcgagtggtctctccccgagggcaccaggccggaggacgtcaacatgatggagtccaacggcgtcgtcacgttcatgagcacgtcgctgcaggtcatcgccaagcccaggctcgacaacccggacctgtacaagaggttccctgtcgagatgtgatcgaacagtttgctttgctgcctgctgctgctggttatacagacagactggagttctgctttcaaagtttcagctattgctcatgatgttgttgttgtaaaatttgaggtgttaattgccttgtgaatgaacgaatcaatcaatctcgtaaagttatcgagagcagatcgacttttgtaatttgtacaatatgactatgtacttaaggtgttttgttcagatagaattttgtaatatgattaacacgacaagcgatgtattttgaggtgtcattaatgaataataataatgtaatgtaatctgcaatttttctttttttttctttctgttctgtttctgttgagaaacaaagaattaagataattatgatgatgataacatgacgtgggggcgaccttatcttgaggcacgtccaaaaacgtctgcggttgttacacctaaacccagataaagcaaagagcccaaaacgagcgaaggacacgagacgcgctcccagccgtcggatccatccggagcccccgaaaacggacggtggatggagacgccagccccctcacgtcacgccacccccccccccccccaccaaactaacgtggggcccacaccatctccgcttcgggggtgtgatggtgtggatggatagaaccaacggctgacgtgtacccgaacgcgcaacgcgggggagtccaagctaacgtgggccccacacccccctttcccctcctcctctctcttcagatccgcgcgctgaggtcactgtagaacacggcggtggacccggtccacgggattaagccggtgtagtgtagacccgtctgggtggggcccacaacattggtggatcggtctatgcaccgggtccacggaacgggtctcgtgtagaggctctctctctctctctctctgggtgggggttgggtttgcttcgctcgcctcgctttgcccgattcggccggggtcagggtcactggccgagcaaattagggtggaaaattttttatttatttatttccgcaaagaaaaaaaagttaaatatccagtaacggaaaccctaatccccaaatcacaaatcgattcgattcgctatttaatgtggtgtggttttcttctccgattcgatgtcctcctccgctccggccccctcatcgatcgagctcgcagccgccgtgttccccgccggggaaggtcgtccttgccgttgggtggtgttcccggcgctggattgacgccatgaggaagaagctggacacccgcttccccgcggtatggttcatatatgcgcggattttttttttcagattagaaattgttgttcaggtgtagatcctgcatgcgtgtatatagattctgcgatcgtgattggtatgtttatttttttcacttttgcctgagatgtgtttgttgcatgcacgcttgttttcggtggttaggttttgctaacaatttgatgcaatgaaattatggtgcatgtcttgcattttatctcccttgttaggcttcgcccatccacatattaggaattattttttgttgtaatttgccggttattttctatgtttgtttgcgagcatgatatatatttttattttgttttaacggtatctttagtgagataagtaatgaaattgcggttttgtgtgggtgtgattctgtatgaaactggcttattcgatacacatatccagaattctggagcctgattggtaattatgatgtgaggtagccagtgagtatttggggattcctaaatccagtactcgtacatttgtcatgtatgaggatgcctgatgtgagaaattttggtttaatttgctgcttatttgcataatttgtaataatagactctgttccatgtggtcccacctccaactgtgatcattaaataaggttatgctcctgagcttcatgggaaaaattagttgcccatatgcattaacattttactaaataatacattatcatgatttgttcaataatacgtcagtctaatcatcactattaatagtaaagaaacgtcaatgtgtgttttacagttctaatgctagtacggaccaccaatcatgtacctcttgatccgaattagatgcttagatccatatatttgatgtaatgtgcatttttccttgcatggatgttccctcattttgttaaagacacatggagtccttaaatagaataaaagtgcactatttatccttttggcctctgcactgtagcaaaatggtatcatgtagaattctactacttgctgcgggtctgctgtacaacaagttgtagctaaatccttatatgcttaaagccatgcattctgaggagatgctttcttaattaacctttgctcttacaaggacatgcagaatcatttctttatatatgttagggctaatgcttataatctcatttaacatgcccttaaggttgacatggtcggagctctttagtatatgttagttgtaattataaaaattgcatgaatcagattcttttattgttaccagtgctctttcagacaatattcttattttgtttgatgtctgtcatgtgttgcagcctcggattaagaaaatcatgcaagcagatgaagatgttggcaagattgctttagctgtacctgttctagtgtgtgagttttccactctgtttaatcttccttttattttattatatagctatttaactctcagtaacttattagtattcggtttagaggctcataattattttcgctacaaactgcactcctttctgccactaagagttaagtagcttatattttagaggccaaaacatatgagccttggagtctatgtaacaggaaatcatgttctgaatgataatcgatcttttcggtttctagattacaaatcatactgcctgcaaagcattattgattgtattagggaagacatagatcaaagctggcaattattgttgattaagggggaggggggcaggcttactaccaaagtatgttaggtcttactttgggctgttgtaatattgaaatcaagtgcatttgtacatgtactgtagacttactccctgtgtcattcacaccatccttaatcatgtaagcccattctccttcaaatttcacattgcatgtcaggtgcactatcaccaccacatctttattttggattcatctctagcgacctagtctacatctctgccatattagaatcaaccgatcctgtatgagcctgcatggccatgttttctttattcccctgatatccacctcgcttttttttttttgcgtgagtcatggtggcagaagttggggagcaatggggttggcattgttggttggataggaagagcagtcagatatgatgggggttgaatttggtgagggtgaggggaactagagaagggagattttggagaagagtgtaggagcgggagaaccggtgtccacatggtgcagcactaaagaacattgaatcaagtggatatattacagacaatttggctttatggcacggtatggattaagtaaaaacatttggatgtgagcccatatttagctttcctggaggaagataaaaaggtaaatgagtgaatgtaaaaaaggataaaatagctccatgcaaaataatatcattgcaaggtatagatttaatttatttgtttgcacttgggtgctttcttttctcttctgctagcatgcttctttgttttcttcgattgatatatctctaacgttggcataagattggcaccatccatagctaagcatattctgcactttgacacgttggcaagcatattttccgtttccatctgatttgatttaacttattatgatttgttttattaatgtatgatgtgatctttcaggctttcactttacatatatttcattattgtccattgttgcagcaaaagcattggaattatttctgcaagacttgtgtaataggacatatgacattacagtgcaaagaggggtcaagactctgagttcttcccatttgtaagttttgttgacctttccatgttttttttttctgagtcaatggagctataggtggaatctaacgactctttattaggatgcctgagaacctttttttccttgtcattaggtttttgttaatcataggttgttctttcaagctatctactcgtcatgctcttttgcaagtttctgagttgtgtgctgttgtcataatctgttcctgtaccttgatcctagaatgcatttttaagcatgtgttgttgtcagatcatgaaatccagtattttgcctcctttttttcaggaaacagtgcatacatagttataatgtttacgatttcttgagggatgtcgtcagtaaagttccagacatgggtacatctgatgctggtgttgatgataaacttggcaaaaggaggtaaaaaccttttcatttaatagtgtctgatgttcaaatcaatttttattcagcaagctttaatgagtgctgaaattcatcaggaaaactgctgaagatgacagtgaagaggaatcaaagcggacaagaaatgttagtttctccattatctttacctttatgtggatgttgcacatttcacaatttctgtcccttttgcattcttagtattagtatttgtatcagcacttgaaagaattctttactccagtcattccgttcatacataattaaaacgttcacctttgattttcatctcatttgctaataaggttgtatgcatgcaggaggcagcaagccagacaagcactggtagagggcgtgggaggggtcggggaagaggccgacgtggtgggcgtgtgtctgagagggagattatttccgcttacgaaaaatttgagagaaccatgagtttcctccaggtcaatttagcaagccttctcagctgaaggtagatgtttcagttgatggtacagatgcaattgaaacaaaggaggctaccccattaagcaacgcaagagcttctctaaggaacattgacttaaacatagagcttactgactatgatgatgagggttcagctccactggaggtccagcctccagctccggcagcaggtgtggttacaacctcttcaggaccacttgtttcggaggtgaacgaagaggcgaagaccaaagactttctaggatggcaattgcctgagctgaccaagatggccatggaccctgttcagtttgccttgtcttcaaaccataggttagaggaggatgaggattatgacaacgaagaatgataacttgccccttttaggttaagaagctgatagatagacatgacttttgtctattgtacatccttgtagcccagcttaactctgtagctgatcttgtataatatgtgtacctgctgaagctgcagtagtttaggatgttacagaggtttatcgatcgatagctagcaactatgttgacagacagattcatcagttgtacatcctatctgatctccagtttatgatagtttgcaatgttcctgtctgtttgtccattgctgtattccctgtgcctactttctcagggtgctgaattttactgaaacagtgagctgcagggctgttgcagccaagactgtttccttctcccaaaggagagtgatacaggtatgatgaaattgtgaaaagtgaaagtgaaaacttattacaatttacaagcaaagcttggccatggccaagaacacaaggagactgcgaaaatgttgtgtattgcactaggaaatacagaagtgatatgtctattatgacccggcaaagcagcaggttttattcatcatattacaccttccagcaagaccagtaacatgttctagtagcagataattggatcactggatggctctgctttaagccgatgattcagcagccggacgatgatctatgtacctgaaattatcagcacctaaattatcagcctcctgccaatgatgacgaaccatttgcaattcgcaaagcacaaagcgcggcgattcattcaagaaacgatcaacgaaagagaggtttgaatttgatgttttacgtttaggcggtggcgtcgtcgaggggcttgaaatcctggagctgcttgaagttctcccacgccctctcccacaccttggcctcgtacagcttattggcgccgccgggttccttcacctcgacggtgaggtagtgcatgaacccgcccaccacctgctgcctcaccttcaccaccctctccaactccaacatcgcgttctgcaattagcttagggggtgcttaggttaagggtgtaaaattttagcatatcacatcaagtattatgtaaggtatcgcatgaggtgttcgggcactaaaaaaaactaattataaaatacgtcagtaaaccagaatttattaagcctaattaatcagtcattagtagatatttacggtcacatggacgaatcatgaagcaattagacttaaaagattcgtctcataaattaatcgcaatctatataattaattattcttttagcctatatttaatactttatatttaatactttattgtaaaatttttacgtggaaactaaacatgcccttattgtattttatatttttaccacaatccacacggcgatccacgcaattaacaaggggaaaaaagaaaggggggcgggtgttcttaaatcttacggccttgctgttgtgctcggcgacggcgaaccgggcgagctcgacggtggtgaggtcgttctcgcgcccggccggcgcgtcgtggatgccgcccaccttcacgccgcgtggctgctgcgcctcctcggccatcgccggcgagccgcgaccggtggagaagaagagggtaacgggaacggcggcgagacgaggacaacgacgacgaccagcagcagcagatgtagtgaacaccgattccgcgaagagagatgatgcccgcatagattgaagcggacgacgggggaagcgggcgatttttatagcgaagcgggaggatttcttttcttttcttcttcgcgttgatttgctcgtgtcgtttcggcgacgatgcgattgcgatcagcgatcgcgacagccacgggaggcaagtgtgatgcgtttctatgcttagcatggaaggcagcgatgaagacgaagtaatgacgcggggcgctatcggtacgtggaagacgggaaggagagtcccgcttcctctatgggcctgcggccctgcgccaatacgcccataaaccattattgctaaaaaaaaagtctacttgcctccctcaaatctgattcatatcctttgatcacaaatgggtataacaacccatccaacggttaaaatgggtataaaatgacgactaggcaaaggtgatattggctgacatggcagtccagtcatcacatttttcctcctccctcccccctcctctctcctccatatttcctctcggttatgacatctcagtagggcagtggcagggaagcagcagggtgacgactggacagcgagcttcggcggtgaacatggccaagttagcatgtcaaaatgcattccaagaggaggggaacttgttgatagaggtagagtaggagtggctggtagtgttggccatgacggctaatcatagcggcgtggaggaagaacaagatggggggaaaaccttctggagcgtggcagtgcatggcgacagttcaaacgacatcaacggtcgccctatcccctccttcacaaatgtggggtggccgccggcgagctgcagttccatcgacccgtcatcgtcgtcgcttctagatctcgcctttattagttgtggaggagggatcatggagtatacatgggtcggtgtggtacgcccctctcctctatgtgctcgtaccccctggccgtcgagccacttcctcgcaacagtggcggccttggcgacaggcaccccaatgcctccatgccgagagcttgggggtgaggccctgcaggctggttcacatgacagcggtgaagattcgtccatcgccagcgaccggagggccttaaggaggcaatagtaggggcgtgtcgttgctgctctgcctcaaggccacgctagttgcccactcgttgagctctcggcatctaccacatggccaccaccgatggaggctactatcccttgcctccaccggcggaggtctgctcgtcgtcatgcgtgctcatgtggggaaaggagaggggcaaaaatgaagagtaaggtaataggatagaagaaggaagagagcatgctgacatgtgggttctacgtgctgattcagctggttgaactaagtcaatgagtcacgttagcgaaaaccacctttaaaacaaactagtgagttattttgtatcttttttaatagttcggaggttaaagatttctctggcattgtggttgagggatataaataagatatacctatatttagggagtcaaagtggacttattctttaccgctataatctatatgcgggacattcagcccactaagaatctattaggccacgccctacggcttcgagcccgcgagcgagcgcttaggccaaattccaacgccgattcgtggacccaaacacgggccccagtgaccaccaacaacaaacccacaagaagcaacgcacgcatggcgtcatctctcgtgctgcggttggactttcacccatccatcaagcgagtcaaggagccaagtggatgcccacgacgacgtcgtcacgtcggtgtctcctcctcctcctcctccatccggcgcgcgcgacgctgtccctacttggctaggagagtatacaacccaacaactcgcccggcggccactcacccccactcaccaaccactcccggcgtcgcgttgagaggcggacgacgacgacgacgactgcgtgcgtacttcgtagccatcgcccatcgcgcggggaagtcgcgatcacgcgcgcccggccactgcaccactactgctactaccgggtctcgacctggccatcccaccgaaccattgtcttctactagtattcaattcttttttctctctcacgcggtcacgcgctcgtgagccgtcacagcttgcttggttttgtgcaggtgcagcctcttcagctttgggttgcagagttgggcacggtagtgtacgtggtgtagctggatggatgggagaagggaatcgttttgagtcggtattatagcgtgacacgcacttccgtggactggactttgtttccgtttcacctttgggggagaaactctcttccttgtagccattggattctgaagagctacggattacggaaggataagatttggaagctaggctgtgttctccagtacactgtacttttctaactcccacagtctctttttccaagtacgcgtttttcaaactgtcgtgtattttttgcagaaacaaagttggtttcaaaaatcatattaattttgttaaagatttttcattgttcatgcagtgaccaagcggtgctgtaacccttaaaaccagtaaggtaatcctaaacggttccatgttagctcaaaatcataggtcacaccattggttcaccgcttttcattttaaaaaagaaaactcaacataaccggtatggcaaaccttgaatggttacattggggatggaaaaacagaacatttatggcatcatgtaatacaaataacggaccgacacaagccacgcaaaacgaaataggctgtgtttagttcagcgcaaagtttggatttttgttgaaattgaagatgatgtgactgaaaagttgtgtgtgcatgacaggttgatgtgatgaaaaatgactgaagtttggatctaaactttagatctaagcacagctatagagagagaatatcagcatcatatgaaagaatcggaacgatcatcatatagctcttaaaaaaattcacaggagaggtagctagtccctctctagacactgtagaaatcttaacatttgctggatgggcaggtgcaggtgtggcaatggcaataccgctctgccccggaaaccatcatgtcagtgtcaaaagtgtcagctaggctggctctcccggaaacgcgtcaaagtgcagcacttttgccccggatggcccgggagaaaccccacaaaaaccgccccgactccaagcaagggatcgatcatccgccgaaccgctaccaaaacgagtcggtgcctgcatcccccccccccccccccccggggggataatttgtcttttctctcggcggctatcttagcaatagcttggcaattatcaacggggttagtacaaaattaagctgcattatagaagctaacaattaattttgtttatcgatcagagtgttgttgatcattgatgcaggtctcatttcggtcgttctcctgacaaagaaagagttgtccttgctgcttatacttgcttagtgcttgatcgcatgaaagagagttttattagagaggtagatgaaaccaagctgtagaccagaaagttggttggcacttcattggtttgacacttgacagagttaggcctaacagtgcagtagagtacatgggaatatttttctttttttgctccaattattgatagagcagtgtgtcaataacattgaagtaatcaagtggcctaatacaaccaaggctttgcgtttctgaacctttgacatgttctacagttaatcacagcagaattgacacttaaatatataactatagatccaccgactgactgaccgattcgttgtgcatcgactgctgcttcctgagagttctcaaaactgatgttattttgacttcgtcacgaattactatgcataagtaagtatttgtaagattgaccttgcagttgcaggtggtgaaagaatcgtagattcgtagtgttgaaatcttcagacatggtagcagtacttgttcagtcttcctcaacgtcgaactttttggaactctacaacataagattctcctgaaaaatacgaataaaaccataccaaaagcgctttatttatcgacccataatggttttcacattacttgatgttcatatgaatgtaaaaatattagtactcctatgcgttactcaactcagttttagccctgcgtaattaacctacatgtcttttttttaagaacaaacctaacatgtcagttcctcttatctctcccgttacatagaaatggaaaaacgattacttgcctaccactctacttttcttccttaagactgtcccatttattttcgaagggcttctgatttcacagcataatgctatgatatatatagcttaacagaaattggcatatgcggaaaatgccgtaatgttaagagagaggagtcatttttaagctgaagtgatgcttgcaaacgttcttatattaagttcttaaccaaaacacgaaactgcgtggttttacaaagtgcatgtttaattatcagcattgactacattggcaaattaactgtatctaattaatactactatctaatattatggttgaagcacaaaaataacaatgtttttaacaaactcagggatgaggcaaaacgaactgcttttttaagaagcatttttctttggaaataggcatgtgcatatataacacagtatgccatcaaacaaaaatggtaagatatattcaaattgactatgtggtatttttcttgagggcttgaccaacaaccgaattctgctggtttaaccaaagtaggaaattattttgtaccacttggattgttgccaatttttctgatgatctgttgggaacaatttggcaccaccaacccagcttgtctgcatgctgcggcctaagcatgcttattggttagtacttagcacatatttatttataacctattatgagctgttcatgtgcaacagtacatgcaaaagtcatcctgcatgtacaatgccaagtttacaacgcagataaatattgctattcctgtgagaattaaagtgcttcatgtaaatttactacaacaatcatatacaaaatcctattattaaaacgaagttcttaattaagatccattcagccttctcaaagacttgcatacaaatctttcccaaaaaaaaaactaccatatgcaggcaataccttttgcaattaatattctttcttcaaatgataagagcacccgcaatggtaaagtaaggtgctatctgttttatacatctcagcaatagactagattaatagtaaatcacttcaatggtatgtctacatgggtatctatagctctctaattcattgcatcgtttttctctatagactatctccaggttagtagatagttttgctccatctcttcatttaatctcttccaagtagaaaaatatgttgacatggatctcttgtagagaacctatagataaccattgtgggtgccctaatatacacgccatattgcacaaaaatatagtatggctttacccttaaaaaaagtataacttctttactccttactccttttaacgtttctggtgatggtgatgatgagtctgcctgatatttggacctcacaaagtggatcgatcccacatagctagtaaaatcaaaatccttcatataaatcactgcaaataacagttcgtatctcgatatactcctagataacagctcaatttgctagcacaacaagaagttaaaagagattcataaaaaaaaatacaaaaaagaaagaacaaaagacaagtcaaagcgtcccgtcaagcccaaattaaataaaaaaaatccccaaccaaagccagtcgattttccacgtggccaacgcgaccagtccaagctccccctccttcacctaaacccc

SEQ ID NO: 42327 - DNA, 18749 bp, Oryza sativa
gggcccctgccgccccaccagagagcggcaagggttttcctgcaaaaaaccctccctccgtcaccgcccgttcctcccccgtttgccacgtcagcttgccgccccagaggtgggcggcagggtctatttttgtaatttttttggccgacagattatttctgtaaatatttttttaaaaaaatctaaaaccgaaaaaattcggctgtggcataggcacccccaccccttccccacctcctcctccccccccaaaatcatcagatccgcgtccgcctcctcctcctccacctcctcccaccccctcgccgatccagatccatcgccggggaggcgccagccatggccggcggcgggggcgccggcggcatgtcggagtcggtgctccgcaaggtgctcctctcctactgctacgtcggcgtctggatcttcctctccttcgccgtcatcgtctacaacaagtacatcctcgaccccaagatgtacaactggcccttcccgatctccctcaccatggtccacatggccttctgctcctccctcgccgtcgccctcgtccgcctcctccgcgtcgtcgagccgccctcgtcgcccgccatgaccccgcagctctacacctcctccgttgttcccatcggcgcgctctacgccatgtcgctgtggttctccaactcggcctacatctacctctccgtgtccttcatccagatgctcaaggcgctcatgcccgtcgccgtgtactccatcggggtgctcttcaagaaggagaccttcaggtcgtcctccatgctcaacatgctctccatctcgttcggcgtcgccatcgccgcatacggcgaggcgcgcttcgatgttcggggtgtcgcgctgcagctcgccgcggtggcgttcgaggccacgcggctcgtgctcatccagatcctgctcacctccaagggcatctcgctcaacccaatcacctctctgtactacgtcgcgccgtgctgcctcggcttcctgctcgtgccgtgggtgttcgtcgagctgcccaggctgcgcgccgtcggcacgttccgcccggacttcttcgtgttcgggaccaactcgctctgcgccttcgcgctgaatctggcggtgttcttgctcgtcggcaagacctccgcgctcaccatgaacgtcgccggggtggtcaaggactggctgctgatcgccttctcgtggtccgtgatccgggacacggtcacgccgatcaacctgttcggctacgggatcgccttcttgggggtggcatactacaaccacgtcaagctgcaggcgctcaaggcgaaggaggcgcagaagaagatcagccaggctgatgaggaggctggctcgctgttgcaggagcgcgatgggcacagtgatcgcaagagcgataaccaggcatagagccaccaccagatctgatcctggcacacacaaattggttgttctaaatccggctgtgttatctcttttggttgcactctcaatgtgtttgttctttaccttgatccgttgtaggagagcaataaattatggagtaaaatgtgatcttttacatttaatagatggaaaaatgtgcgatcttttatagtttacacacctgtatttttttatttattactgagatgctacatatgtttactggagtactagagaagtgtaaacatatactatctgaaatgctttgttgcaacagcctttgtagtctatataatcactatatccacttagttgcaactaagaaagcttgggccctatgtaatgttgcgtgaggcattgctaaagtactcttgaatgttgttcacttccttggtatgtatccctttgttctaattatgttggatgttgtgcagggtatctggtgcaaagtgcaaaagactgtagtttggttggtctacggttgctttcaaggaggtggacaccagtttgttctttcacttatttaactttagttggatctggagggcaaatcaagggaatttattggtttaggaaaatacttgcacttgcacctactttctggaggactagagtaaactttcatgttaccctgttatttattcagctatttttgttccagagaaagacagcctcgttgcctctctcgctcattgcctaaaatttatttgttctactagtagcctaggtactaaaaatgtacttctacatattggtattttggtggttatcttctatatataatgagcttactgtaatattataatctactgctgtgtatttctaccttttcaatttgaatggtttatcaacttgatgcatccatccgtcaactgtttcttggtcatttcatagatggcgctttttgttagtaacttgtatgctgttagtgctttcatagtgcactgtactgagtagtgaacacacacataattctgtttttcactagatgattggtggtcttattgattagtcttcagcatcacttgcgttgtactgaaattcagaaccatagcattggaaaaatagggttgcattggcatatgcctgttcaattgagcgctgaatcagctgtataagctgttttgctctttatatatgaataatttcactgattaattgtcattcagaaccacctcaatagctttggaataatgatagtagtacatttttgtaccttttagtagatttgatccaccaacatagctaggttggtggacatattaagcttagttgcattgattgtgtgctgtgcaatggtttcaatcacttcttagctatcaatcatagcagcaattaggtgtgatgatgggttctcttgtcttcataaatgaagtcgtagtatgaaatttcagttgtttgatcttgttcgtactggagggaagctcactgaagtcgacatattgataaattttggtttggtttagaatagcaatcaaatgtgttaaggctgagactttcaagaatgctgggatcctggcacgtgttcgtcctggacattgaccttgatttggtgcatcaactacgcaagaatgtttgggtgttgttgctcactcaatgcttgtatatacagccatggggatctgtatgtcgtttacttggttgttaattccttagtttaggagttgtatcttgttaaacatggttacctgatgcaacacgaccattgataattgggttgcttcagacagcgagaaggaacggtgaattgctggcctcttgtttgatccttgtttgttgtttccgaagcacacgagattgtttagcagcaaatctcttgtattcttgtttggacgctacgcaagtgccgcgatttttgtcatgcttgtgaacgggaccatatggaatggcatgtgcagtgaggctagtttgggctagtctatgctctatcccttcgaacacaaggcaaatcctgtgaagtatagtactactatgtttttttactgttaaattgttacaggagtgaaatccttgttacatgctgatgagatgagcgagacttgaccctagagcattgttcagtgtagtagtaatgctaatcatttacagtcaagtagtcaaactaatcccttcaaacataaggcaaacgaccgatgtgtattcactcagtgtcagtgaactacttgtactgttgaaattgctgtgcgactcaaattcttctcatgctaatgagaccgatgtgtttattcactcagtgtcagtgaactacttgtactgtagaaattgttgtgcgactcaaattcttgtctcatgctaacgagtgagccaattcttgtctcatgctaacgagtgagatagccttgacccatcttttctgcatgccttggtgtagtagcagcacatatcatttccagtcagccataattggcagtggtgttcgttgttaagagacatgttagatggtcgggcgcctatgcacctcttgtctgttgtctgtacagcattgtactgtacaaatcaacaactactttagtactgtatcatcatcatgtactactgcaatggagtagtacttctacctctgttacaggattcaagtcgttttacccctctgcgacttacagggagcagtatctaacatacaaatgactctccctgtttataactccctagtaatccattaccgtgatctaacagacaaatctcgagctaaattgctgtgcagtgctgactcgagcaatgttaacacaactgtacacaatacatcagagaaaaatacatctatgctatgcagctgccagtcagaaaccgctcgatcgagaaggatctcatcccgaattgcaagtattgtgcaggcacctcgtcatctgaaatgcgccgtgccaaacatcacgcgggaatcagatcgtcccgagcaaaagtggagcgatgccatatgctctcgcacgccgcgcccactacgcgattaggaactaatcaacgtacaactacatgtgaagtgaaaggcacaattcacaaaaggcgcaaagcacagtgcaatcctcctgatctgcttctgatccggtaaaaacagctgacctgagctgcgtaaacagtgaaaaaatggaggtaaaaaaaaaaactaccggtattgcttcacatggcgggcctgcctcggaggcgccgggctggcacgcggccggctggaggaagtgggaggctcacgtcggcggcggcgaatgtctcgtcgtcgctgtggttggagtcggagtcggcgctgcgctcgccgtcgctggaggaggaggaggaggagaggcgggcgagccagcagctgccgtggaggtggccgctgacgcagacgaagtactcgagacggccctcgttggcgccgagccagcggcacgcgctgcgcggcgcgagccccgcggcggtcatgctccacacgcgggcgccgcagtaggggcagcggacgcgcggttccagcggggcgcggtggccaacaaggaaggcgcgcgtccgcgaccgcatgaacccgcggtacacgccgcggtacgcgcccacgacgtcgtcgtcggacgcggcgccggcggcgtgctcgcacgggtccgacacgaacagcaggtcccccgcgcaccgccgcgacaggaagctccggcccgacgtcttggagaaccgcgacacgggcgcgaagtggcccggcacggcggcgcccgccgcgccgcagcagaagaagagcagcttcgccatcgccggccagcctcccccgatgcgccccgccgccgccgccaccgccgcggtcgggcccgacagcgccgacaccatccgcggcgccctcgacacgcagagctcccgccacagcacccgctccgccaccgcccgcagccgccggctcaccctcgccaccacgcacagctccctcgggtcccagttcagcgcccggaacaccagctccagcaccttctcgtccatgatccccgcgttcacccccctcatcctccccgcaatgccaccaccatcccactctccggccactgccgcgccgccgccggcattgccgctgcccaaccgcctcatactcatacgcgtgcgccgccgccgtgacacgctctctcgctctcgtcggcgactgcctcgccacgacacggtcgccttactcctatccaaagacgaaccggttatatcctcgtgcggtgtcaggtcggcccggaccggacgcacccgatcccgaccgcgccctccaccacgcgacaaatggaccactcctcgttaacccccaataattagcggctcgccgaagcgactaaacccgcgattacacgctaaacacctcgctaatcactcgcttaatcctgcctgcctaggaggaatcacacgctcgccgccgccgctgttgcagaggcgagtacactggacaaaaatatcttctcatttttgcgaagtccaatccgtgttgcgtcacgcggggctttgcttgacgcttctgtaaaaccgaaaccgccttcgacgacggagcgggaggacacgtgtcccccgcgcggtgcggtagcgcgccacgtggctcgtttcttggggacacgtgtcgggcatcggggtgatttccgtcgtctcggatttaaatccgttccggatttctttgatcccttcttccggtggtggtccggtgccggcgaggccgacacgtggactccggcgagaagcggtggggcccaccccggtggaaatatctcgggggaacgtggcggggcaagtgtttggtttgtgggacacgtggcgcgctgaaagggtggagagagatttgggggcccctgatgggccgtggtgacgggacatggggagatccgggccgaacacgtggtgcggttgttagcattagcttattgtgcgttttgcttttcttttcagctaatcacatcctgcgctttggagcagccgtcactttgatgggcgtgtttcaagaaaaaaaaagagtttcaatgcttattttaagaaaaataatttcttcgatattttgacataaccatttctgaaaaattgaagaaaactttggtcaaacgtcatggttagcattcctctgtcccataataaatttacttttagcttcttctttatttaaaaaataagtttgtttttaaagtaattattgaattagagttttgtaaaagtcataagtaattgtattagaatagataaaataaaaaaaattgtattgaggtttgataaaatagttgtattttagtttttttattggatatatatgggaaaattttattttaagacggaggtaacagcaacctctagcccgtgcttgttccagctgataatctgaaactttcttttttgttaatttcgtgtcataatcccttcgtttttggtgaaggccgagagctggggaggggtaatcatttgctcgtggttttactctcccgaagaagacaaatttggctgtgtttggaggtgagtgttgggaacccatctctcatacacagaaaacggagcggttcattaacacgtgattaattaagtattagctaaagtttttttaaaaatagatcaatatgatttttttaaacaatttttgtatagaaacttttttaaaaaaacgtaccatttagcagtttgaaaagtgtgtacgcagaaaacgagagggggtgttgggaacttggtcttgcaaaaacaccctacacgttgctttggtcgattggcaagttgggaaaggaacctgaaagtgtcgctggtgtccggacaggcacaacgacgcgcacgcttcctgaaatggtaatgccatgtggtggactggtggtgccggaagctacagcgtgcaggaagcatctagcggtgcgctgtacaggttgccgttgccgttgccgtcaggtggtgcacacagaactcgggattgggtaccgaggtagtaaaaataaattttttagatgtcatatcgaatgtttgaccatatattagaagggtttttcagacacggataaaagaaaataattttataactcgcctaaaaaccgcgagacgaatctttaaagaaaataattaatccgtcattagcatatgtggattactgtagcacttatggctaatcatggataattagactcaaaagattcgtctcgcgattacccccaaccgtgcaattagtttttttatttatctatatattaatactttatgtatgtatccaaagattcgatgtgatgtttttgggaaaaaaatttgagaactaaacggggcctaagtgatgcccggcatggttgctgggtgagtttaatatgataataatatataaagtagataaatgatataagcttacatacgtttgattatttagatgtatatacaataatgatcaaatgtcaaactaaggtgatgcgtttttatgagaaataaaagaaatttggataataattaattatttaagagctataaacaattcattatggtatgacttaatgagagaagatagaaataatattataaaaagtgatggagagatgtaattaaatattatatgaattatgtaggattacaatttaacatgtttgcattttaaagctcgaaattttaataatctatataactatagatgatatattatgcttgcatgatgtttaagatataatagtcgtttgtggatgatgatgtgtcatatttgcatgcatagctgtagaatttagtaggttacaactttatagcaagatagcatagagcttgttcaaattgatatcatttcaatggtaataaaattaaatatgttgatgcgtttagtttgttattaaactttgatagtgcgtaaggaattttggtaacatcacatttagtttatgttatcaaaacttgataatcctgctaagttttcaaaattttggtattgccaaattttggaaagattcattttgacagtaatccgaacaagctcctagttgttttgatttgaagtcaaattatggcattgttaatgaacaatttggtatttttaggttccagtgaaagtttttgctttttcattggtatcgagtcaaatacatctttatcttgccataattaatggtgtgaaattttattttagattttagcactatcgatatttttcgatattttggtatggcactaaacaaaatagatcgagaatttgatgagatggtatagttgtgctgccacttttgcagggaagtgcaggcgtagctttcaagcacaaaccaacagtggtggtagactgagtgatcgtcggctcgtcgcttggttatgacgtgcactagtacttttctttttggtttttgctgtgctgaattggtctcgtatctcgcgtgcttcgcagtatcgcatattcgcatagaataaagatggaaattttcaagttctcaagatgctacgaacgaaagtagttaagtagaacctgtgatggatccaacacctcaaggcatacttgccgtgcacagcttcattgttccggcccggaagtagtgacaaaccccacggtccagtccattctggctaagccggtacatccaaaagttggcccaagaatacccactagaccactagattctgaagaattgcactaaatacggcccagcaaaaggtggagaaaaaaaacttgttcagcgagcttggtaggttagctccgctcttaaataaagtaaaaatagtctttcgaatggtagaggaaaatataacatacgatagaaaattgatttcgaagaaaacttgataaaaacttttctagccgccaaaccaatgcgtcaaacttggccggtgaggtaaccatcgaatgtttttcacaaaatacaccgtttagtacattctctatcttagaataaataaatatgaacctgcctcaatctttattaggtaaatctggatctgtctctcgcatttcatattaggtttatttattttggaatggagcgagtagattgaaaaaacatattaataaaggctaagataaaatatgtatcttacctaaaataagagtggaattgaataaggccctgtttagatcccatcataaaaattttcatcctgtcacatcgaacgttagaacatatgtgtcgttcgaacatatgtgtctaggttatggataccacatacctaatagtaatcaactaagctcggcagggcccaccacatatcatgtcttatacgaaaacaaatctcgtatatataaggagttccggataaggaagaatgagtagagttctatatggaaacgacaaggactactcggattgtatccatatttatctctctagttctacttaaataaggggttatctatgggtagaaatacaaaccccctaggaggagagaggggacacccaccatagacgccacaaagccacaagccaacacacgttgccagatcttgacatcagagattagcctagccataccccatccgatgtctacggaagccggcaagagggatctagtgccatctctgatctcgacgggttcatactcgaggaggaaggctaccctgtcgtcgattatgagttggttatctagccgctaagtcgacgacgattagataagttatcccaattgttgtacttcgtggttttctatataaatcccatataaacaggatgtaggactattatctgtaagataaggggcccaaacctgtataaaaatcactgtctccatcttttttacctcaatctcacatataccctggtaccaacgatccccatactatccaccaacgatcttcataccattcaaataccatagtcgcgatatcaaacgtcgacaacatgcatgaagtattattaaatataggcttaaaaaataactaattgtacatattgcgactaatttgcgagacaaatctttcaagcctaattgctccattatttaacatcgtggtgctacagtaaatatttgctaataatggattaattagacttaataaattcgttttgtggtttactgacggattctgtaatttattttattattaattgtttttattattagactgcgtttaatactttaaatatgtgtccgtatatccgatatgacacggtaaacacagactaaagtgctcttccggaaaatattaaccaggctgtgtttagatccaaagtttagatctaaacttcagtccttttccatcacatcaacctgtcatacacacaactagtcacatcatgtccaatttcaaccaaaatccaaaatttggatccaactaaacacagcccaagaggcaggggcaccagtgcgcgcggcaccatccttcattccttcttgcggcgcggccgtgcgggtgttgacggcaacgcgacgcaaccaacacccccaccccggtagcgcgcggctgcgcacgcacggcgactactactactactcggcgagctcgtgacgtgacgtcgtgagccacgaccacgagggacgaagagacggccatgtgagcttgtgttgtgtgttggcccccactaggagcaagcaaagcgaggcacagatcggagggaaagagggggaaaaaaatctccgagctctcttggaagctatagcccccccgatccgcgggggagagggcccgatcggatccttgggaatggcgacgtcggcggcggaggaggaggcggtgcctgtggcggaggcgcgggcgcaggccgagaagcgcgctgcggcggaggatggcgagggggcggaggcggaggaggaggggaacgagatgcccgagccgaagcggcggcgcgcgtgcgtggcggcgctcgagggcgtgcgacgcgccgcggcggacgcggccgaagagaacggcgacggcggcggcggcggcgcgggcgggcctgcggcggacggggggtcgtcgttctcgttccacgcgcgcagcttctccggggtggagacgacgcccaaattcgggtccttcaaccccgccgacgacctcctcgtcgccttccagctcaagcctccgcctcccccgatggatgcgccggcgaaggaggagccccccgccgccgccgccggcgacgacgacgacgaggaggagcacgaagcaacagctgaggagggcaatgacgggatttcacaacagcttggggtagtagaccagtgaagtgctcaagtgagcgacggttttgacttggtgcgacttcgcttctccgttaggcactgtactcctactttgataacggtagcttttgatttgtgtagtagtaatcttgtactactatctcatcgtgtcaatgcctcagtggttctgtgttgtgttgtacaatccgattcctaatgataagattagcgaataataaaaatgatttttgctggtgtaatcaaggtgtttaactgccgccaaatgattcttatatctgcttaacaagtactgtactgtactaacaaccctgctgccccactgtgcagttgctccataccatcaccaattcagctcatagttttgaaccaaatgttcatcttctcactctctcacagtactctcttctcacggtactcccccggaaggtctcttgaagacagattataacagggctgatatgttcctcgaaaaatactggatgatgttgtcctaaaccaactaatgtgtgatggcatcaatcacgtactgagagcatccgcaatgtctaagatgcatagagactacaaggtggaagtaactgacatttttctaatagtaaagctacaatggttatggtctcctcttgactttaaggtaggatccacatgaaaaaaaaaactattcaccctttgatgtacaagatttaaagacccacatgcatactacaaaggtacaaaatgattttcttttcttatggtttagttttaagcttaaggtgaatcatagcaacattattcattttctcatcttctaatgcataaagcaacaacacaaatactactttattttttaaggtcatctttacatgcacactgttgttatcctggcgcaagatactccctccgcaacaactaaatcgttttctggctacaacttacacataacctatgtttgtgagcgaatgacaatcattatcactaagtttataatcactaagtttctgacttttttataatggtttttgttctgacctttgtttaaataaactaaaatcaatcataacaacaattgcagatcgaaagacttaatacatctccattcgtcccataatatagcaatttagtaccggacgagacacttcatagaagtgtactgtgaagtatcttatccggtcataggtagctatattatgagacggagggagtattagttgttttgccaatccatgaagggtcgaactactagctgaaaccgaatgatcgggacaataattaggccttatttgtttaggcttataagctaacttataagccaaaaaatctaagtctaaacaaacaagcaacttatttgtttgatttttttgaagccataagccactctaatactattaagccaaaagctaggttggagaaacttttttggcttatgtgaggttgatgtatgacttcactactaaacttaggacattaaatccaccggtttatacatcatataagctaacaagttgacttaaaagtctaagccagtaagcttaaagcctaaacaaagagggccttagagcaggtacaataacatgctataagccagctgcaaacatattttaaggagataaatcaggagagagaagagcagcgggctacagatttatagctagctgtagtacggactccaagacgcagtgtgtctatgacaggtgggactaggtattaatagtgtagcatataactattgtatgaataagctattagattggctataaatgaattggagccagtagttggctatactattgaacttactcttagaagataagaggaggaaaagaggaataactagtgattttttttcatggatgcgtgctgtaccttcttcacggttgtgtgaggaattactagctggcaacggtgttgtgtttatttttttataatatccatgattgtaatcctgtatttttctctgtctattgatataaaaattcacactgtatggtgcggtcgttatgaaaaaaaaacatttgttgatttgtacgattgaatatttatcgcaattcatttatctagtcatcattccattaaattctgcaggcacacttcacctgatgtttgtgcggtcacaatcagtgtctaaaccctaaaaaaataaattactactccctccgtcccataatataagggattttgagtttttgcttgtaacgtttgaccactcgtcttattcaaagttttttgaaattattatttattttattggtgacttactttattatctacagtattttaaatacaacttttcgttttttaagtactttaagttcaactttattatctacagtgtgatcatctttgtttaggctaaaacttactggcttaagcccacagttaaatgctctaatatcatttttcttagaaatcggcatacaattttcaaaaactatatattcctccttggtggaacgcgaaatgttatactgacccttgattgcataccatttaaaagggaaacttcttctaacactaaaatatgcaacaattgcaggggcctaaacgaaagaaaccaccaaaatctctccttacttaacaaatccccttcccgttcccactgcacactcctcgccgccatccccaaacctcccgacgatcccaccgcctcgaacgtgccgccgttccagcctagggttcgcgggctctccggctgccggattcgcctcctcgccggcgggtaaggcggctgagggggagtgccggggcgctccgcatcgctccctccctccctcccgtcgtcgtcgccggcggcgtcgggtcgggcccggcggtatcgtcccgcggaaaccctagatttcgccgccgcacgcgtggagcaatcgtgcggctcctggtgtccctctatggctatgtaaggaggggattccacctccccccttgtgaggctctctcggcataaccgctctcgcgttctagggtttgcgccgcctcgactgcaatgggtggtcgcacggtgctctccgacgaggaaggtacgcggtttcttcgcctgttttgtgcggtttcgtgctgattggttattccagcggaggggtttcgtgcgcgtttgctgatggagagattgttcgtctgttcgaactctgtcagatgaaatcgaggaggaagaggaggaggagaatccgcggccttcgcggagaggaagggacaatatggatcgggacgatgatgatgacgaggaggacgaagaaggttagagattttttctacgtttcttttccaaattgcgctagtttcctccccccatctgtgaacaccaccgattcggatgtttatatcgtgctatgcttagttgtttttttttctgtctgatttggataactccttttcgtgtattgaatgttatgacacgttctaccaatttcattgagtttatagaaatggccctatttcaatatattatttgtatgcccgagtagtgggttataattgttcatgtgcattcatgtgacaactgacaaggcaatttagttttttaaaattcttttatatgtttgaatcccctgtgatactcgagttagctttggtaatgggatgtaactgctttggtacagacgagggtcaggacgaatatgagaaggatggcttcatagtagatgatgcagatgaggaagaggaggaggaggatgagagggaaagtgatgatgagaggcggaagaagaagaggaaaaagaagaagaaaaggttgcttttgatccctcaacgagatagaaatatcaaataccgtattctcttctttagaagttactgaaacacatatttgtgcacagggaatcagaagggttcatgctggatgaggatgactatgagttgcttcaggataataacatcactggcattcaacgtcctaagcctgtatgcttaaagatactttggtgctgtcattaacttttttagcatgtttttgaattatggctcttctaatttactgcagggaaacaaatttaagcgcttgaagaaggccggaagggaatctgaaatggatgagcgctctggcttttcagatgatgatgggtcaggaaaaaggcgtactgctgaggaaagagtccagtactccttatttggcgaccatcaaggtagctgcatccaaaaatacttctctttagcttgtgtgatacagcaggaagtagtttatctaattttcttatttgctgcaatgcaatttcctcagatgcgtctattgaggaggacattgttgaggaggatcagcaggcagatgaagatgaggatggtgatcctgaagatgaaatggcaggtttcattgtcgatgaagatgaaattgatgcaaatggtcaagttgtaaagtatggccttatttttcacatttgtgccaacttcttttatacaactttactggatcttgtttgctagagttacatacaagtactgtttgcaattgcagaaggaagaagggtaaagcaagaccacgccgaccggctgcaggggtatcatcatctgccttgcaagaggcccacgatatatttggtgatgttgatgaactattagcactgagaaagcaagagcttgagagggatgctgctaattctggtgagttgagaggaaacagacttgaagatgagtttgagccatttattctggctgagaagtatatgacaccgaaagatgaacaaataagagagaatgatgtacctgagaggatacaggtaaaagtttgacactcttcttaggcatttttgttttagttatcgtgcatgtctgatttgtagctccttttgccagctgtctgaagaactaactgggtatcctccaacggacaccacaatgatagaggaagaaagtgtatggatacatagccaactgacgggtgatgggtttctgtcattctttaacaatgagcatgtgaacaaggacattgaccagaaggacattgcaagtgtattgaccatgttacatgtcaacaaatttgaagtaagtaaatgcagacaagctctgtgcatgtttcttttatgcttatttttcttacataacttctattacctgccagattcccttcattgctatgtataggaaggagaattgcccgagtctgttaaaagatcttgatgccaatgaacagaccaatgaagaacatagtgatgaagaagatcaacgcaagatgatgtggcacaaggtgacctatcactatgcatatgttgttcctcagagccaatttatcaatgttattcagttattgactccattgatgtcttccttttagatgctttgggctgttcagacattggacaaaaagtggctgcttcttcagaagcgcaaggttgctttggagatgtactatgataaaagatttgatgatgagaatcgaagaatagatgatgtcacacgccaggcattaaaccgtcagctttatagctccattattgaagcactgaaggatgcaaaatctgagaaagaggtggaggatgttgatgcaaagttcaatctgcatttccctcctggagaagttgaagaagaaggacaatttaagcggccaaaaaggaaatcattgtacagtatttgtcacaaggcagggttatggcaggttgcaaaccaatttggtcggagtgctgagcagttaggtcaccatctcacattgacgaagatacccgtacgtgcactaagccgacaccttgtgttacctttctttaaacaatattactaggacattgcaagcaatccatttacatttgtatatttcaggaagcaggagaacttgatagtgggaaagattctcctgaagaggttgctgcaaatttcacatgtgcaatgtttgaaacaccacaagatgttcttcggggcgccagacacatggtactacttagtatatttcacaatgctactctacccctaataaattatcaggccttgttcggttaatccccagaagggagggatttgaggggattgagggggtggaataaatcccctcaatccccttgtgggagggattacccgaacaaggcctcagggtagaaaccacacttagttaggttcatctcatctcactgatatgaaccgttctacctttatcatcttaccaggcggcagttgagattgggtgtgagcctattgtaagaaagcatatccgtagcatcttcatgaataaagctgtggtctcaacatgcccgactgctgaaggaaatttaatcatagatccctatcatcaactatcaggtgttaagtggctgcgtgacaaaccattaaacaagtttgttgatgcacaatggctgcttattcagaaagcagaagaagaaaagctcctcaaggttactataaaactgccagaagatgcaaagaaagagctcatgtctgaggctcgtgaaaattacttaagtgactgtgtcagcaaatctgcacaactgtgggatgagcaacggaagatgattctggatgatgccttcttcaatttccttcttccatcaatggaaaaggaagctcgatctctgttgacagcgaaagccaaaaattggcttaatatggaatacgggaagcaattgtggaacaaggtatctgtggctccttggaagaagaaggatgcagacaagaaggattctgatattgatctcgatgatgaatccgagttgagggttatggcctgttgctggggacctgggaagccagcaaccacttttgtaatgcttgactcatctggagaattggttgatgttctatatgcgggttctatcagtattagatctcaaggtgttgctgagcagcagcggaagaagaatgaccagcagcgagttttgaagtttatgactgaccatcagcctcatgttgtatgtgtaggagcatcaaactataattgcagacaactcaaggatgacatttatgaggtatttttcgattctattcatttgcaacttctttcttcacataaggttacatgttcagttaacctgtacaaagttatatcctccagcagcatggcttgtttagttgctagtagtatgtcaccagaagcagcattcatgagggaccatctgcagagaatttcttgcagcctgtgctataatgaacaccaattaagctcaccttgctgttggatgcttgtgattggttgagtcttttctttatacctgctggtcatttgtgaaggcaattgtactttgtttaaggcccggtttagttggcaaaaatttttattttagggtgtcgcatcggatatacggacacacatttgaagtattaaacgttgtctaataacaaaacaaattatagattccgccatggaaactgcgagacgaatttattaagcctaattaatccatcattagcaaatgtttactgtagcaccacactgtcaaatc

SEQ ID NO: 42328 - DNA, 13430 bp, Oryza sativa
tgcaacactctgcggacctggaaaagagatactttcatggaaactgcacccccttgagcagttccttactcctgatgagaaatatgaagttgttgagcaaattatggttgatgcaacaaatcaaataggtttcgacgttaatcttgctgctagccatgagtggcatttttcaactctacaattcgttgctggtttggggccacgtaaagcttcagctctacagaaagaattgttacgagagggatccatttttagtcgcaaagatcttgtaaaacctctaggcaggaaagtattcatgaatgcatctggctttttacgtgttcgccgtagtggtggagctgccgcgagtgctcaaatcattgatttacttgaggatacaaggatacatcctgagtcatatgcattagcaaaaactttggcaaaggatgtatttgctgaggaagcaccacatgaagcaaatgaaatggacgatgatgagcaagagatggcaattgagcatgtcagagaaaagccacgttatctgaaatcgctcgacattcgtgagtacatgaagagtatgccagaagagttccataataaagagcaaacactgaaagatataaaatgggaactgttgtgcggtttccctgattggaggaccccctatgctgagccaactccagatgaggaattctggatgctttctggggaaactgaggacaccatatcagatggaaggattgttcaagttactgttcgtagtatacaagataaccgaatcatttgcaccttcgattctggtctgaaagccatagttatggctgataactattctgatgagggctttgatctagaaactctgcagttacatgaaggtgatgtattaacgggcaaaattaagaatgtgaataaaaacaggttcatggtttacttaacatgcaaggcaagtgaattgaggagaagaccattgtccagaggtaatcatgatccgtacaatcatgaacaagacatgacttctcagaatgaacaagataagcttcggaaacagaaagaactggcaaagaaacatttcaaaccccggatgattgtccatcctcactttcagaacttgacagctgaagaagctatgcaggttagtcaagctcttatcgatcagatattccccactctgtttatttagtttctcctgtcgtaaaatctaatatgaaccctcctgaaacagttcttatctgacaaagaacctggtgagaaggtcattcggcctagttctaggggaccatcatttctgacacttactctgaaaatttttgatggtgtccttgcacacaaggagataactgaaggtggaaaggatcataaagatattacaagcttgcttcgccttggaaaaacattgacaattgataatgaaacttttgaagatcttgatgaggttggtacacatgatctctttttgttaccattgttactctagttcagtatcagtaagtggtgactcttttctgtgtttgttttgcacgccagcatggttctgtgtttctttttgcttgctgttatcacttagcagtagattgtcattctgttatttttggctaactactggtgctttattttggcaaataggttatagacaggtacgtggatccattggtaggccacctgaagagcatgcttttgtaccgcaaattcaagaaaggatcaaaaagtgaggttgatgagatgttaagggctgagaaatcagagaatcctatgagaatagtgtattgtttcggcatatctcatgagcatccaggcacatttattttatcttacattaggagtacaaatccacatcacgagtatattgggttatacccaaagggctttagatttcgtaagagggactttgacaatattgatcgcctagtgtcctatttccagaagcatattgacaaaccaccacctgatgctggtccatcaatgcgaaatgttgctgcaatggtgcctatgaaaagttcaggttggggtaatggtggtggcactggtggtggaaatgatggatggagaggagatggtaacaacgacagggatagacctttctctggaagatcaggttagtttttaacgcacttgcacaatgttatcatccagtttatttgcatggtattggcaggccagctttattatgactcaaagatgtttgcatacttaatatttgcatggaggactttaaattctatgggcctttagttcttcagttagcagaactatagatatgcttgtgtcagtttcagttggctgtagcattctttagggtgattcacgctctgtttgcaggcgccagtatcatgagaaccatttacttcaaaaaaaaattaaaaaatattgccctctgtatttgggattcctgattgtttatgtggttcaggtcaatttatttcatatttcaattttctacttcccattgcactttctttatcttgtgcttctccaatcattgatatcaccgatgaggttcccactaaacatgtgaaaagctaatcttgaggcaactataaaaccggccaagctactatttttggatagtaatatgatttgttacatttattgaattgttgatggatccttaagtagtcacgaactcccttttggtatcttttgtctaaagcaggaggcaggtttgattcaaggaacagctctggtggtcgtggacgtgggcgcgggcgtggtagaggtaactttggcagtgatgatggtggcggcggaggttggagtggtggcggtggcggtggcggcaacagtgggggatggactgacaatattggaagtggcggaggtggatggggcacaggtggtggttcctcgtgggctggtggtggcgacggaggttctggaggtggtgatagtaaccgtggtggtggtggaggctggggaacacccgctggtggttctgatggcggcggcggtggctggggagcagcacccggtggatccaacgatgccccaggatggggcagcggcaaaaaggcggtcccagcacaggatggtggtagcgggtggggagcttccgccggcggcggcagcggtggctggaactagtcaaagaactgctagatgaaatatttttttttttgttttctggaccctcttctatatctggtaattgcgctccacgggagaaaaattgtcactgttcggggaccctagtaatctgctactgaatgccgctggttttatacattttggacggccttattttgaatgcatgtacagcttaagcaccacattttgttttttagttttcattacaaatgcacgaacccatagcccactcagattggaattgtctcaatggttgtaatgccatcgaatatatctaactttaccaggatcttcgtaaaccgtcgtgtcgctcgagccatcctcacactcgtgagagtgagatgtggagctagtcggcccaaacggccagaggaacgagcgcgagcctcgcctgacttgcctctcgccgccgctagctcctccaccggaagcggtggtcgccggcggcggcagcgagtggcggcagacgggacaggagttgtgatggaccagccacggcacgatgcagtcggcgtggtacaggtgggcgcacggcatctcccgcgcctcggcgccgagctggaactcgtcctggcaaaccgggcaccgcggctcggcgcggaggtgccggcggctgatcgtcaccacgggcatcgcgtcgatcgccgacggcggcgccggtggagggccctgcctgctgctccccagctggttctgcagctgctcgaagagcgcctccagaccggcacggtagtatccgccgcggcgctcgacgccgacacggggccctcccctgaagaggacgccgagtctcgcgtgcgcaggcacgccatcgccgccgccatgctcgtcgtggacgtcgacctcgcgctcgtcgccgcccaccgttgccgcgtgccgcatgagggtggacatcgcctccatcaccggggatcgccggagcaagaactcgtcgccggcgtctggcccgacgaaaccgagcgtgctgctcgccgtcctccgtcccatctcgctcatctcctggacgaagccgtcgtcgcagcttgggcaggtgacgtcttggctgccgccgcggatgcgaaccggccgccggcacacgtagcaccagtgcgtggctctgtttgacatcttttgcttgattcctgtgacaatctgagaattcagtagtagcaggcagcagcacaaatttcacgattcaccatcgaactgtcacgacaaatattacatgagcaaacttgaattggacatccaagacatgataacagccccaaaaaaatattgaaagaaagtaaaaagaagagaaattgatccgaaccagagataattcccacccaagaattcagttgacaggaagcagtcaagcagttgtgtgcatatgccacaacaaatcaagctaaacaaacactaaaagaaacagaattaatccaagcataccttgggataagctgatggtttgggaggaggagaatgaattggcggaatgaattgaatgatggggagcggactgatgatagataggcggtcgcgagctggaagagtactgaaagcggctgctgtcggagtatctgctacgatttgtccgttcttttttcttttggaggtctttgtccgatgagagcattctaggcctcgcgttgctgcttgtgcagttaacttgtcaccggcgggcagcgctcgctgtcgctggccatgcttgttaaagcgacgtgttggctcccggtccaaaatacacgagaaatggaagtttgttagtttaacgtctcaacctttgatcgtgaaactttacttgataatcaaagttgatcgagtatgtattatcataatagcgtttgttacgatttacgacagtcttgattgtaacagtagaacagaatgcgacaagctaagccacaagcccacaactgtagcagtaagcggaacatccgtctaaagccgtgttcgactgttcgtcacagcttacttaactagcactatttataaactactaaacgacaagcaatgtattttgtgcaaaagttttatacgtataaatttattaagaatcaaataaatatatatttttatttataatatttaatatttagttaatcctacctgcaccttttttaaattttttttgcaccaataatctcagccaaacagttgaatcgaacgcaacgaggaaccatggtatgcccagtgtttggtaaccaacaaaacacgtctagcttaagaaaacttaaacaataggataatataatttttgaaataacctttatatagaaaattttggcgaaaaatataacgtttagcaactcgtgaagcatgcgcatgagtaatgagaaagaaaattgaaaaggtgcagaaaaaaacatgccttcttttacacaagaatatacccttagagcattatttggagtgaagattttggagaaacatctatactacggtaaatattggcaatgatgatagtagtcaatctgccaccataaccccttatcacttacgtgtgggcctctcaacgttggtaaaaaaattatacttcctatttcaaatgctccttatccctaatccctgaattgtgctttcattcgatagtaacatgtgaaaatatgttgcgtaaactaaatacagtgaaaacctaaaaactataatgtaaaaatggatgtacgagattagttcacgtcatctaaaatactaaaagctttactcatagattcaatcatgactaaaatttttactcttggcggcgtgaaaaatctcagacatcctttttttaaatcaacgggactccagtttttatattttcagtatacgtaacttccagcgacatatttttaattgcaacgcacgactagggtgcaagcgggccaacccgcaaacccgcttataggcaaaatgagtggataacccgcggtttgactcgcgggttaccaactaatttgatatataaatgagttttggggttgatccacttgcttctctatgacacggcaagccgagccatgacgcgaaaacccgtggattaccttctatttacatccctagtcctataaaaaaaaaaatctccgcagccgactttccattcagcccaccctgaggtctcggcgacattgcctgggccgtggcgctctcgggctgggctttttctccccacggagaacacgctcgcggccatcacgttagcagcccactcgctcgctcgctcgcggccgcgtctcccgtcgtagctcggaggaaggttctagacgaggaggagaagacgccgccgccatcttcgcggccgccggagagcagccagcagcggggtgcgggcgggcgcgggcgcgacgcgcgtggcgcgggtggagctcggaagcaggcgcagcctccacgggcgcaggcggggttgccgggacgcgcctgggcgggcgggcgggctcgaggttgtggtggggcgtgtggcaggatcctcctcgcgccgccatggatcagaggaaggcgttgttccgggcgaagctccgggagcgcgaggccaaggagaagcaggagaggcgcatcgacccctccctcgtcaggtatatatctcctctactctccctcttcccccatgtatctgtgtgcctctgctcttcttctctcgcggattcgtatgctactagtagttttgtctccggatcctaccgataagctcgtgctgtggctgctcgcgcgtttgcttgatgtaaccctaggcaattttgaatgttttgttacaaccaggctgggattttaagggcttgaaccggtttgcgtaccctccagtagattggaagaatattacaagtataacatagctaatgggttccagtttcctgtcaatttggtgtaatttgcagcgagccatgaaaaacctacaacattgatcacaatttatataatacctttgcatcttgttcagccggaatggttgctgacagaattgttgctatgttttatccagttttgaatatcatgagcgttgatgaccaagggtagtattagatggcaacatactggacgtggattgtttttaagcaatacaccattctaacagataggtgcatcattccttcaggtacaatgaatttgatcagcccatctgcagaatctgcaatgttactctgaaatctgaagcactttggcctgcacatcaagtttcacgaaaacatcatgaggtacacagagaaaatgaatcatagtcattctggatgatctatgcttggattgacattcgaaggatgtacacataacacatcattttactatctcatgtggtatgaatatgttgatggaaacacaaatacatatagaaattcaacagtgtaactgcaaatacatttctgctgagcatgctagcttatcaatttggataaaattttgtattagcatcgaagatggttgaaatttcatacatgctgtggtctgtgggttgttttggcagtatggtaccattctggttatgttcacttccactaattatctttttttttgttagtatctaaaaggaaaaaatattatgcggttcatattgctgataaccatggtgtttctattcttttccctttagaagttagttgctgccttaaatagcatgcattacatcccatagaatttgtttgttcaaattgcagagatgtgagtctagtttaactgctccaaggataattgattgttctataacttcacatacatatattcagatctatggctgttactaggatttgaagtatatttgttatttaaagtgctcatgtacattactgacccatcttgtcatttttatgatacaggcaaaagccgctgcagctgcatctgctaaagctccatcaggtgcagggtctcgtggcaataaggccaatcatgaacaacctgcagagtctcagaaaccaaaatcttccacattgcctgccaacttttttgaaaaccagggaatgaagaggcatagtgatggtgagagtaacaaacacgccctcccatctgtctgcgctaaatttaaagatagagtgagaaagcaactggaacagccttggttatactttgtagtcatttgcttatatccttttatttgtgagatctctgtaaatattgatttttcgttgagttctcagttgataggctctagaattgtattaatcatgcatctaatttcacattttggtccacacatggtacaatgctcatatgccatgtgtctgtatagatcttcaatgaaattgattatcttattcttaaaataagcaggatagcattatcatgtagtgctttgatttttataggctaattgtaaacagatttaactttaccataaaatcgccataaactactgaaatttcagtcagctaagattgcatcttagactttacattccttagtacatctgataatagctaaacctgcgaaatgttactatttgtgtgagaaatggtgttaggatttgaaattttctttgaacatttttgtttgagacaacattttgtattttctgaagaagaaagaaacaaatatccatgttatgctatcctctgtagagtgatcacctgcatgtacagaacatatattaattcctattttatcaagcttcctgctagtagtattatttatatatgctatagaaagaactgaagtgtccatttagcagtccaaaaaatatgtttcatgctcatgaaccctaatataacaacttatatgactaggcgctggttctgaaggaaggtctgtgcgtcgggaggtagctgatgttcagcaaaaaaccaaagaagcaagcaaaactaagccatctgtcaattttgagaaaataccaaagaaagaaagtcaagccaataccaatgtcaaaggtgttcttccagggaacttttttgactataatgatgaagatgaagatccagctcctactgaggcgaatagtgcacctggaaatcctccaatttcaaatcgcatgcaggtgaaaggtgtacctgatggcttctttgatggcaacaaaaacagcaatggcatgcaacccagtgaaccaagtcaatcgtctaaagccgtaaagagttcagaaacttctgaagtaaaaggatcgctaccagaaggtttctttgataacaaagatgcagatctccgtgctcgtggtatccaacctccgaaaatcgatatcaagtaaggttttcatcgacttgcatatgcattgcatttattaagtatatgcttggacctcttgcagctacacttgttattctcacataatatacccttgtggaagaatgaatataccttttgaaatggcaagtttgaacatcattcatgataaaaatttcaggcttttccttttcatggaagatgtcagcagaatttaacaatataattaaggctgattattaaccttactactgttacttccacaccctttttgcacttgtgcacttgtcaagttcatacctgcatgagggtcagagggttaataatcgtgtttatgttttttctgtgaactatgacatttgttctcttctttttagatcatattcttcctgcaaaaaaagaactgtattcagtttgtattgattgatagttgaagttttaacatgaaatatattattaaaaaatatttttcagtgatgcttacaaagaatttgagaaggaaattcaggaggacttgcaggaagttgatgatcgccttgaagaagaggaggttaggcttctctattacctagttacacaatataaagaataccttcgcttgtctggtgcaaatgctagtttgaactgctatattagcttttttttatgtgaactgtagattgatgctgctgctgagagagaagagtacttgacattagagcaagagtatgttccttagccacaacttgctatttttgagccttcatgcttagcgaagcgaaggttttttattttcatcgtccatttattttgtacacagggagtataggcagcgggtggatatgctgaagaaacagcttaccgagtcaaaagccgcccgtaccactaaagcaaacagcaaacctgttggtatggacatgttgtcaagcagcgactcatctagtgacgaggaagatgacagcacggattttgctgttgattggagagcacaacatttgaaatgatgtggagatttttgtgattggctacccaccgacgatgacaacatagatctgttagcatccaccattgtgcatccgtgacaatcagatcccagcacctctaggtttctgcttgaggagaagatgatctcttttttttttctgttgcatcttgtcttttatcggaaaaatgttcgagctaatcatgaattaacacgatgagaatagttttggagaactggtgaatgtgtataatccttgctcctaaacctatgccacaatcttatctgaaggtgtatgcctatgatgggcaacatctttgtcggattgcaacttcaagatgaaagttggaagggacgcctttacctgtgcagattgactgcctttcatcctgcttcaactccaacgcttatctacagggtttcttaccttttttttctcctctgcttatccggcaccggcaactccgacggtgtatctttctgtgatggtgaaggacgaggccgacgttgctacgcgctggcctgccgggtacctaactttccaaaagtttgaaacctctcatcttttgcttgttggctgacaatgcttgtttgtttatcggatatagccaaaaattgtattttgaagcttgattttagagttgatttagagcttcttcatcgcggtttatttttttctaaggtttttaaaacattaagaacagaaatatagaagttctatccatatattttttcctcgttcattttttcatgtgttattgaggcctggtcactgatctggactagtgtgccgacgttcaatggatcgtctggtgctttgccttacagaaactcaaaactagaattgttcgtagacatcttctgtcttgtgtgctgcagtatccaactttcgcagctctactgtctaaaaatgaaataaacttgtacctctgccatattggatagtgtggtactattgtagtgtaagcaatgttttgcattcgctagaaatactgtgtttcgatggtgccgcttccaaccttgtagatcaacactgaaaacaactagatgaacaagaacaatattaacatagctttctgtctctgctttattgataatgagatatgagaatgatgcgcacagtttcactgccataggtcaaccagactcgtagatcatcacagttttggttcaggcatctgcctctatacccaactgttcgcatttcacaagaagaacactgtgtaacccactcagcggaactcccaagctgaactcactcagcaaagcgtatgacatggtgagctctgcaaccactcattgtgaggttgatcattatgatttcatcttccattataatgctgctcacagccacacgccagccaaaataaacagttggggatgtctggacatgatcttttagaattttactccctcggcccataaatttaagcatttcaagcatttagaatttatctgcaaatataaggattccatcaactaccactcatttgattttttttcatgttatttatggccaccctcccaccccaactatccctcattttgttgagggttatttatttttttcttttgtccaattaaaaaaaatcagttgttcttatagaaggatttataggttatttagcaaataataagattaagtcgaaagattactttttactcatttcagttgtcaatttttaaattttgaattgattatattctatttcaagcatatggttggctttggaataaatgatggaaatcacatgaatctatgcagggatgttatattatggtaaaaaaattaaatattagaaattcttatattttataattgatagattaacaaacagtttaattactgtaggaacagagatcccaatagggaccaggatgacgctcctgacgcctcatgctcacctctaggcgatagaaacgtggccaaatggtaagatgccaagctcatttccgaaacataatcattggaattttcaagtcaatgacgtaggcgatgttcacgtttcttgttagatttggtacatgattatttcatttgaactcctgttaattggtcagtaacttagtacatatgcaatcttgtacggacacatagagatgttgatttacctttctttttttcaccttgagataaaatgcatcattgattcattgcatcataacttgctcaattgctgttggttccccctgatcttgcttggagtaaagggacacatttcaacttggattttatttggactgtttattggagacaccttgcttggatatggtgtaaagaaacacatctcaatttggaatttatttggaccgtttattggagacgtgcattcatgcataattacgtcaggagatgcccaattgcccgaataacccatagatttcttttctcaggtataaaaaaataaatcatgattggagctgaaaatggtatatgcaattttttcaatcagcaaaataatagtcgcaagtgaaaatgaaaggacttctgcaatgataaaataaaaaatcaagggtaaaaccggagcacgtttcttcttctcctttttttttttggtgtctctgtgtacgtggtcaaggagagtgggtaaccaacaaatcaacctacaatttctggaaccgtcaatgacggagatgacaattaacataatatttgaggcaatcacgatacaatgctaaaacaactaaacaagtgtccaattcagactttgctttcacggaaacgattcctttattaaattgtgttttgatggtgatctgaaataaaaattcatacaacagaaatacgctactgctgaaaaaagaatatttctgatgtaatgacaactgacaacagcaaaacatatagatgtttttttctgttttttgaaacgaacatatagatgtttttgcgacgtaagagtacttcatatgaaatagtagcatttactgaaagcatattatgcatataagggaataattagtgtcaataattttagatgatgagatcattatcttatactactagcaattgttggtataatcattattatcttgcactagcaactattgatataacatcattcaataaagtactacagtgccaattctcaggtcaaatcattcactcttgcttttgatattggcttctgctagggaaagaatgaaagatgaccaatcaaaatgcattccctgtcctaacttagaatagtgcccctcccagatgatccattgcaccacaattcacaatcagaatagcatgtaaagctataaagcttcagatgctagcttcccagtctctttcctgtttctagaaaaaaagaagttttattcttccaaattttaatatcag

SEQ ID NO: 42329 - DNA, 3567 bp, Oryza sativa
ctccaatctcagaattgccattgaagcacatacctggatcagtgcatgccacagagccaacactgcacggcttctggtaagggaatgtgccgatctccatatcaatcttgccccggacatcgagtaggatgctccttaacctgatcacctcagcctcgagcgcagcatggccctgcaatcgcttcagcagctgctgattggcggcgcggagcttcttgacctcctcctccaagaaagccgcatgcgccttcttcttctcccgatacttgcgcacggcttccctgttccccagcggcctccgggtcttcgtcaggtcctccttgatgtcatcttcgccactgccggaggcgaagacctgggtgtgcgtgtgcaagcatgtgtgggtgtgcatggttgccgacggaccaggaggattgcaggtgtgggtgtgggtgcaggttgtgatgttgttcaagaaatcatcgaagctatcaggcacctccggatgggagaagagcaattgacttgggacatcgtccattgccgcagaatgcgccaagaacaatctcctttgtatgggtcaatggacaatttgcacaacaaagttgcaattgcaattgcaacaaaaggaatcaagaacctctgaacttgtttattcaatgaggtttctagattaactgaccagggattgagcaggcagactacatgatctgccaaaacccctgcaaaaactggtgagctaccaactaataatcaagaaaggagtgagcaacaaacatggcacaagtgaggaagccctgattggggagctctacgacagagggcatcacaagagccaaaaaaaatcgatgaggtgctgaaatagacagagaaaaggccggattcgggcatcaaaacctcatcctgaggacggcgagcgacatggatggaattcgcagcaacgccgagctgcctcttgcagggagaaaagaaaaacaaaagaaaattgaaaagactctctctctctctccttttgctcccctcgctttccttcgctttccgccttctctcgccaccgatctttttcctggcgatgttcccccttctttgctctggcgattgggggtttggggatcggagaatcttggaaaggagccgcgccgcgagaggaggaggggagcgacgttgatttgatggatgagtagtagtggtgggagagatcaaagttgggggaggatcctagttcttgccactgtgggtggggatggttttgttttgtttgggtttctttcttttagagcttcctttttgcatatttaagtactgcactagttgtttgtccgaactgccacttggacatttttgccccttttaatattgttgcctagttgaccatgacacatacggatgtgcactgttttagtaaaattgctgcttatttttatgctgatatatcccactacatccattctaaatccctatatttttttgtagatggggatagtattaacgcgaagggccttgaacgcaggatgtaaaaatatacacagaaatcgaaagattataggaacacaagacgaagtatggtgtttccgtgtttggaacactaagaatagagtaaatcaatggattcttgatatataaaatatagtttctatttgcttgttgattgtctcaattgtgatcactcgaagtcacatgaattgatttgttttggtcgtctcaaaggcaaataaaattgatttgctttggtcgtctcaaaggcaaataaaagtcaaattcctatggacatgggcaaagggaaaattctcttgtactccaatgcccttcttcaaatctccaatccaaaggtgtgaatagtactacccaaatccctcaaatccttaagaattacccaattttcctcaaatcccaaaaaaccaaaggcagccgaaacgttcagtatactaatagccaatgaagatatgcttgactgaactaagccgaaactgatttcaaattgtagagttgactaatttctcaatttgacaacgcaataggccaaacctttgtattttggatgcttacgagtgtacagagaggaaagaaatggagggatatgtagccgctttttacaatttagatgacagaatcaaagaatcagagggtgcacggcaacacccacgatgcagatatctggattttaagatgcagatatctggattttaatctatctcgtggcgtactggcgtcgtatcacaatatcaatactatcatatcagtgcagtcccttcaaaaatactatcagtgcacaaggccactattgtttcatcctgctgcccacaaactttgctcgtcccttgccgcacaggatcaccgttgcctgctagccgcgccaacactgcatctgaattctgaacgagtaggaaaattagagtgcagtctagctgctcaacagacacgagagttttccattgccagtgtcttcagatttgtcagctgacgctttgtccctgaaatgtagtcaatcgtggaacaactgaagggatgcgaattttttacccccaaaaaaagggttaaaaaaaaacatagtcccgcggcaataatattggaggccacacttttaactgaaaatactggctttcttgtcaaaccatacctgtcttactctgcactgccgctgccaacactttggcctggctccggaaacaacagtgtaacctgcaaaaaaatgctctgataatgcaacaccattgcaagatcgaaatcccatcaccaacaaagggtgattacttctactttgatgacaaaagtcagtttgtggttttgcagtcattgattccactgcggttccgtcagaaactcaaatccagaatttacaacacaaatcatattaacaagctacttgcagttccctccacattttttcatccgggcttgggaccggcaaaggcagtgttaaacggcaaaaaaaaaaagagagagagaaaagaagaagaaagaaaaaaaagagagagaaaagacaacacaaaacagaagatcaaattgaaaaacaacgaaaatatccatcatgaaacgcaggttactcaacaacctaaaattattgtggtcagtctggaaatgcaggttaataatcactaatttcatcaaaataaagtttagacccaatatgtaactgattagtgccttaaaaaaaatccaggatgttgagatatgatgtgaaaaccagtgattcaagacagcagaaacaagaaaatgccatatcttaatttggcacaggtaagttaaaaatgtgtgagaacataaagttttgtgctcattttagtatcttctgctccaactccaaatcatagtcaagtaaatcaactttgaaccgttgtaagcaacataaacaccaactgactggatataatattgggaagaattggtcattaaattagtcatctgaacaaagaatccttataatcatcaaggttattgaaacaatccaacataaacaccaacttactggataatattggtctattgggaagaattggcaagaataaagtgttgtgcagttagcaacagattgttacacattctttttctatagaactcatataatgaaacctgcaccaactgtgatac

SEQ ID NO: 42330 - DNA, 5251 bp, Oryza sativa
aactgctggaaagtgaaaaccaaccaaacagccattggttaaaattgtggtcatagaacaggtaaaagatagtgacgattcaagtaatcgggagtcagaacagtatatatttgtctaaagtttaggaaaagtgagctcttgcagctatggactgtctggttcatctacttcaagtcctgaacggccttggtatgctggatctctgcagatgaaatccaagttcaaatttcaacagtataaaagattctgttggtctttctgaataatgatttgagatgacagaattaacaaatctgcaaacaggtttctgctccacagaatgtcttgcaaggttaacaaagaaaggaagagggaccaaactatgtgtttattttggcagaaagatacacttaatatcacaaacatgcattgaaagatgtcacaatgagagaggaataagcctgggttaaagaattcagcaactgagcacgcgtccaaacaaatattgattacactttgtatcttcaaatgccatgtctgcattgaatcaacaagggacatatataaaaccaatgtctgaaaagcattaactaacaaagactaacaaaagaagtcagggaaggaactccaagcatggttccgaaattagctactccacaagccatatatatacttctaattgttggagaagaagcagataagtattgttggacagatgaagtgtgcacatgaagaaatccaaacaaaaggttaattttttccaatgcatgatctttggtccagtcgagcttcaactccaaaccttaacttgtagatattgaatgacagcaaatccaatgagggaaccactattgataaataacacggacttcccatgaactaaccaaacatagatcccttttcaactccaacatccaccctttggcgtgtcatctaaagcacagaaacacatacgctaaacaagattagcttttaaaataatttataccaagggtacggaacacaccttatataaaaggataatgtctgatagctggccattaggtaaaattcctcaaagtgccgagacaaagaacagcatagagacagacaatccaaatcaagataaatctatgaaacgaccagaccttatctaataacttactgcccttcctcaatttccaggtactagctttctcacagggagctcatttccaaccaaccctgtaatcaatatgcgaacaagaaaacacatgcaccgaatctagaaacaatcgatcaaaccacaaaatggtaatcaatatgcgaacaagaaaacacatgcaccgaatctagaaacaatcaatcaaaccacaaaatggtaaaccacaaaccaggcaatttaatttcctcgagaaaatttcctcgtcacatggacaaaaggagaatctgcatgcagaggaaggcacaaatgacgccaaatcaaatatgggcataagaagctacattatcaaccaaaacagaaatagaaacataagaatgcaaggagagcactaaatcgtatatagttgtaggttgtacgatctcccatggtctcatctagcttgaagctccaaaacacaccctcgaaccctccccatccctgatgatcgaaattaagagtattcaaattctgtccttgtggggcatttaactttttaataaggagttgaagggaaaatcctggttgttcagaagatttcaatcggaattggatttgccttgcaaaatgaccaaaaatagacctgaaacaggcaaaagactatcttctatgaatctgtataggcggaagcagcttagacatcaaaaacaaattgtcatggtggaaaggagggataagcctgtttagagaggtcagaacatccaaatctgtattgattttgcagctccaaatctgtactgaatctgtatgtctgcatttgaattgatggcaggcacataaaaaccatgtctgaagagtaataactaaagaagtagaaagattgttaatcacagaagaaaccagtgccctgattagctccaaaatagcaactccaacaaagctagtacttccaattgctggagaaaaaacgaaaatccacataagcatcgctgagaagatgctaaaccggatggtaagtactaaaataatgagtgggtgaatttggcttaatgatctttttccagttatatgatagttgctccagtccaccgtaatatcaaaagatccatcctctactcttggatttaatctcccgatagccacccttctgcatcatctaaaacaaggacaaacacacaaaccacaaaaaaaaaactaactcaggtctcaagtctagaatccactaaaattacgagatactgcaactgatggctggccatcagggaagaccccacacagaaacgccaagccaaacgatccatatgctgaaataatccaggtaacaataatctgcgaaatcaatcagaccttgtgtgcattcagagctccaacccccagaccaacccagagactatcggataaacataggtaacaattgaaggtgataaaacacaaaccgaacaagccaacagcctccaatcaataaccttgtcaacttgggagaaaattaaggaatctgcgaccaacaaagaaagacaaaggcacaccaaaatctaagctacatgtatgaagcaattctgatgaccgaaatagaaactaaacaggaagttaagtattaggcaaactaggaaaagtatgttttggttgtagaattctccagtagtcacatctatcttgaagctccaaaattcctacgcaattccatttctgcagataaatccaagcacttaaattctacccttggtgagtacttctaatgatgaattgaataaggggatttaaagatttcactcagtgaaggctggccatgcaaaattatgaactaggacctgcagtgagcaagagaccacttattcgagaagaaattcaactttgcaagcaattaacttctgatggtaaattgaagagaaaggggtgatgatttaaaggattcactcagattggccatagaaattatgtagaaacctgcagattggccatagaaattatgcagaaacctgcagtgagcaatagattggacttaaatatatctttgtgaggtatataacttctaatgatgaattgaagagaagggtggtgatttaaagatttcactcggtgaaggttggccttgcaaaattatgagataggcctgcagcaagcaagagaacatttatttgggaagaaattcaactttgtaaatttttaacttctaacgatgaattgaagagaaaaagggtagtgagcttcactgagacgagccataacaattactcttatttagagacctacagtgagcaagagtattattttggaggaaagcagcttaagcatagaaaacatgcactaaagactgagtggcataggtataaagcctgtcttgagctcgcagaccgaggcaggtttggattgcaaattccatcttagttgtgtgctatctgcaagaactaagaattactgatgaagaacatggaaaatttgattaaggggaagattgtcgatcacagaaaaagaactgccagcggcctgtatgtatggtgattccaattcatgcagcaaataggactcgccgtgagatgcaactcccaataattctgaagaacaaccaacggcccaaatcagacttttcaaggcattaatcaaattatgctgacaacaactaaatcaaatcaaggggggttcagaatccaaacgaagcattgctattccatctgacaatctcccgtaaatctatctccaaatcacttagaaatctgcacatcttgaggatctgaccaaaggaaatccagtgaacgttgtcacgacaccacaaactttcgtgtcagaataatttcagaaccaccatgaactaatcaaaaagccatgaaccataacaatcaaacctccacctccccgattcatcataataatcaaagcaaccatgaacctggaccataataatcaaacctccaccaattcggttcatctcaacagcctccctccctcctgcatcatctagagcagcacaaacacataccacaagccagatcagcggttacaaataactatcaacccagggtctcgaatcacctcgcgtaaggacagataagaacccgatgatcatccatccatcgattgaaggtaatcaaccactcaaatctgaaatcaatcaccgaacccaagtgactaaatcaaacgaccgtagacgggaaactgacctcttcctcgaaacctcgacttcccccttcgccacacgacgccacgggaacctccaaaatcccggatcaaatccgctcctgcaacaaccgaacacgccgagaggacgaacacggggaacaacacaaaacagaaatcgagaccagagaaggggtcggataggatcggatcgaatcgaatcaccggggaggaaaaaaatcaaacacgtcgcaagcaaaccgaacaatcaatcaatcaagtcgaacgaatccagatagaggaggctcccgggcagcgtcgcacggagatctgcggacagaaaaggcgaagaacacgacgacaatccaaatcaacacgaagattattaagaggggaaaaaaacgaagaaactcgaatcgaatcgagaggcagagggaggaagggatcgggaacgggaagacgcaaacgcgacgacgcgaccacgccgaagagaagaagaaaaaataaaaccgagggggccgcgaggtggggagaaaccgtggcggggcgtcgcctaatataggagaggggtggacgagaggcggtgccaagccaactcggcttcggctttccttaacggacacggcgccgcctcggcctcgcgtttggtttggccccatgtggggcccaggcgccagcgagacaggtggggtggacaggctggtggaagtggtattccgtgttcgggttggctacgggggtgcgtggacggttggcgcgtcggcaacggcaacgcggaagatattcggtcgcgtggaccgagaaacttctcgggttcacgggagcttcgcgaggagagggggggggggggggggggtgtgggtgtggggcccggtcgtctgtggctgcggttgattgctgaccgttggccacccgtgtatcatatggtccgcacgtatttttggggttaaaaaaaggcttttgcaggatttgcggggggcatcgtggaccgggtccacccggaccggttcctaggcggtggaagaatttttttcgtttttagattttttgggctgcaggaat

SEQ ID NO: 42331 - DNA, 2341 bp, Oryza sativa
cgcaattttggccgcccataaagagcttgcagccgtacttttttcatctgggtcccttgccgccgacccagatgaaaaaagtacggacaaaagatttttctatgttatgttaataataaataaagaagtatttattggtaaaatttgttaatattgttataaaaatgtattgaagttggttgtcgcgcaatttcatatgttaagtgaggtattattttgtaccttattcgacgtattagtactcggataatttatataggcctatcgcagtctgggtcgtagaaacattatatggacttaaacaaggagaattatgtaacatgaagaaatagtagtacaatttgaacatgatacaactatttgcattgcggttacatagatgatattagattcgaactaggagggaggtaatgcaatagttgaacacaacgacgatgtagtaatgggacaaggaagcatgacagtagaaatttcaatatgctaagttgtccgataatagctaacccctacgtgaggatccctctcctctctcaaaccgcgctttagtaaccctgtattgctctggtagttcaagctgcacaacacggctaggtggagttagaatccttctggtgtctatccattctctgtattgttatctccttggtggttcctgggaggaaagaatagatgtaaagcaagcaaagttagtaaatgttgtgagaaaataaggattcatgtaatcaaaatattcttaccatgaaatcatcgtcaagaatatttggacaaacaaagaaccttcgacccaatgttgtaggatttatggaacgaagaagctgacaacgatcaccacacctgcatcttagacaggcttcccatggagggagtgccgtagttagcacccgccagtcgctctgttgttcacgacattgtcgttcataagccgcttttctctgtaagtattgctcagtactttcggatgcgaaataccagcgaccttcttataaacaagtggttaggtcgagaacgggattttctgtatcgacccactcgatgtatgcgcaagccgtagtgcgggtctgccgaatagagtagtgttacgaagaataaagcgattgcccatacggaatgaataagcatatgcagataataaaatacctcacggtcatagttagggcacctaaaaaagcgccttcctcgaatatcaggattcctcgaagccattagttggcatcgatcaccgcataggcagagaggacgctggcaccaaggtggtagtaggtatacacaaggatcgttacgccagtttggatcctcaacaccccggcgtctagccattgatgaaagccggtcggatttgtaatgaagcaagtggggaagagagtactgaatgtgactgagttctgaaagattgtgagacctcactcgttaaggcgacttatataggcgcaaaaaatcgagtgatacccctgacatgtgaacgtggtggggtatggtgggtacgcctgattggcgccgaaagttacatgcatgattggcgccgaaagttacatgcatgatcggcgccgaaagttacattggtcgtatgcgccaaatggcgggcaaatactcgtatcgcacgcgaataaaggaggctgcatcggtgcggcagaaagtagtcgtgcatgcgccgaaaggtatcgtgtatgcgccgaaaggtatcgtgcacatataacaacaacgtagtcattacacaagcatacagtattggaaagtgaagcaaataaacaaagagaagattgctctactggccctgccccgcgccgcaaccacgcttggtcctccgggcctgtgctcacacgtggtcctgggagtaggtgaaacgatccggtggcacagcacgggtagcacgagtgtcctacggaggagtggcctgcgcctggtcctgcgtctgcaccggcggtgcgcctcccagctgtgaggggccgatgacgtcctctgtcgagcctgaagcgaagtcaaagtcagtgatgtcgaagagcaaggtggaaggcagcaagcggtccgacgaggtcccagcatggtccagtggtggaccctgactcgacgtgccggctgcctgtgacgaagtcccggtgtactgccagaactgcgctgagtgcgaggtcgacgcagttgcctgagacgctgaccctgcagcctgggagaagtgggcggcctgcgtcatagcgaactgggcgaaacctacacatcgacaacaggacccttgtaagctaagacataaaatgcatgtaaattgattgtcgaagtaatgttgtttttttaagtacttgtggggggcacaacagaaggcctagccgaggaaggcggggtgctgaacggt

SEQ ID NO: 42332 - DNA, 3664 bp, Oryza sativa
acaaaagtcgccaacttggcgggccagtcgccagctgactgctgacccttgcgcgagtacctgcgaattaatgtgtaatattagtgtgaaacgacagatgttacaaattattgtgaacatgtagattttaatgcaacaacggaaagcgtagtgaaagatcttaccggtgaacagcagctgggacggtggtcggaaacggtactggaaagggctgacggaggccgaactgtcgcatcacgcggaaaggggcgtgaggctcaacgcagatgtcgaagaccatcggaaccgtagtcatctagtacgcctggtccctggtagagagtgtggacagacccaacggcgcacgagcctgggtagccgcggcactgtagggctcccacacgacgtcagtcggcagaaggcggtcgaactccataacaaactcaggatacgaccgcctaacctggacgtgagcccatcggcgctgcaatacgagacgatcgatgtgatgtataatgaacttagcaattaacttaacaatacgataagatcgatgcaacgtacctgacgacgtgtcacgcccagaaattcccgaatagaattccaagcagaatgtgcattaaaatccccgtccaggaccggccggggtacacaaatgacaatgttgacattcagatccacgtcttacaaacatcataaaagtcttacataaatgcagcggaaaaaacgaaagacaacaggagctaagccttgactagaactgcagcgggaacaccactccacatgcatcctcgacggcacggacgaagcctactcctcggagaaaccttcatctgacacatactcgtgctctggggttgggaaaaatagagcaagactgagtactacccactgtactcagcaagtcataccggaatagggatatgatgcagggaattatcaaagaagagctagagtggttcatttgcataaagcgagcatttataaacagaagttgaaagttttaaacggttgtaataattaattaatattaactatccactgtccaacgctatcccacgttgcaacaggcccaaccaggcacctaaactatccaaaaacaaaagattacactagggtgagactaatcacggtgaatctggttgaccgcccataactgcgggcacggctattcgaatagttttactctgatcagaggtgtacaactgtacccacaagacacagccccacgacacgtttccgtgcgccgacatgtcaccacgacataccggaaagaggccgtgataggacccttcgcataaccccctctaaccaagcacaccacacctcaggtttcacccccactcctcgcaaggcagcgggcagtcccctctcgtgcctaggtgaatccggaagcgacagaggccgtcgcaggacccgccccgctccatcacgcccacccttgcctggatgcgttgactagaggaaagctatactacaagcccagccattgcccacgctggcttgtggtaagtacgataagttcttccagggcatcccgcgaaccggtccttaactgccatgggtgcgaccagcaaaaccatgcacccacagcccaccatgtgatttattttaattaactaacaccaaagcggtggcactaatccaacaagaccattagagccaacagtctaaacattaataagatcttccccattgtgcactagttgaactaagcatggctaagcaatccctagtccaatctctagtcatgttataaccccaagctgacaaagaaacatggtacaacaatagcatggctatgacaataggtaaacaccccatagaaacattataaaacaatgcaatatttgaaagaaaacaatagagcatttgcaatataggatcaacatgttcaagtgacaagcatgacttgccttgctctgttgctggaggaacctcggcgactatttcgaagtacaccggagcgttagaggaaccagaatctagcgacatacaaggcaaacattgcaaacaggctataagactactgaaacagggaacaaaaccatttttaatggattctacacatttttcttgatttactgagacttgaatgggcttaaacggagctcggatgaattagttatgagttttagaagattcactgtgtttattactataaaagaaaaaccttaaatcatttattgcgcaataaatcccagggctgacgtcagcacggagggggagcggcgccgacatgcggggcccaccggtcagcggctcgggagagggaggaaggggcgccggcacgcggggcccactggtcagcggctcgggggggggggaaggaaggggcggcggcgacccggctcggcttggctcaaggccggccgaccggccgcggcgacggcgacggcacgcgcacacgcgaacgcgttgccggcgacggcaaccggcggcggaggcgacggcgcaaaggcgacgcgaaggcggctgcgctaagcgacggctaggaaggagagggaggggaatagatgggagaggatgcctcaccgagggtggccggcgcggaggaagacgatggcgaacggcaacgacaagccacgggaggacgacggcaaccggcggacgggcttcggggtgccctaaggaaggaagagagagattagagagagggagatgaaccacggcgaccggcattcatggccgaaagcggcggtagcggttgaactcaccggagcgcgaggggatgctaattccggcgacgaaactcgacggggaaggggcagccggggtggagcttagcctcgtgaacccgacggcggcgacggcgcggtgcggcggcgaccctagcggcggctagcggcggccggagtagcggaagcggcgtcggcgggtggttgccggcgcgggagcgatggggagcttgggagagttcggcgaaatggggaaaaagcgacagggggcgacggggaagcctaaataggggaggagagccccggacgtggccggtaggggcgaaatttcgccggccaacgtggggagtgggggaggagagagaggcgggattcgaaaatcgaatcccggccatctcgggcgcgggcgcgggcgggagagagaggggagtgggcgcgggagatgcggcgcacgcgcggacgtggctgacgtggcccggagaaggcggaggcgtgggcgcggcggcggttgcgggcgcggcggcgccggctggaggaaggggacgtgtccgacaagtggggcccacctgtcggcgtcccggggagagagggaggggcgacttggctgggcctcggcctgcggccggcccagcagggaggagggagagagaaggagagaatgggccagcggcccattcgaaaaagggagggaaaaagaaaaagaaaaaggagaaaaggattttcctggaattaaaatattgcttgctcaattttagttggttaaaattatttgtagggctctgaaaattccacgaaaaatcctgttagtggatttcgacatgtagaactcaagaaaaattccacatgccacttccgattattatttgcattgatttaaaagggtttactcttgctttgcaccggtattttcttagggtcgcttataaattaaatttttggcttgggaggagaacttcggggtgtgacacgacggcaccacagagtacccatcgtagggtagtcgacct

SEQ ID NO: 42333 - DNA, 3051 bp, Oryza sativa
aaagataacttgcaaaattatgaaatagtaataaaatcatgagaataattatgtacaacaagagtacaggctatttaaatatagcaaacgttactaatggtacactccgatgacgtgcaatttaacatatatgtagagctcgataatataacataacattacgtgtcgaagtccgacatacatcagcatacctaaagacgttaggcgccttagtccgacgttacatcacgagaccaaaagacatgacatgccgaagtctgacattacacgacgaaacatagaacataagaactacaccacgtagccagacgtggcacgacgacgcctaggacgtggtcgagtggaggtagtgccttcacccgtagggcgagctccgtctgctgctgatcctgatagtcctgcctccgccgcacttggtttctccttgtctttaggacaatgcttgtaggtgtgcccttgttcatcgcatttgctgcaacgcttcaccctgccagcctccgactcgtccatatcgttgcggatgcgacgagtcctcctccttccagccttgcctcggagctacgatgggtcaggaatattgagtacttcatcgttagtctctgtgaactccccagctatgcgaacccataaatctcgccgctccatgtatgatatattgcttgcttactgaagtactgtgacacatatactgcatatggtatgccacactccgctgcggcagcaatgacatgggtgcatggcctgtggagcagcttcggctttgcacaagagcaatgacatgtgccgtcggctttgagaacacactcctgcttcactctcttgcggtagatacccctgcctgccttatcttgacatagtatctcaaacctgtgctgttgggtaccttgcactagagctcgatgtttcatggcctttttacgcaactcctctagctttttctgcatgaaagctccaaacaaaatgctgttgttcagcatagagggaagaactgccgggaaccgatccctacaatacctgcatgtcccatgtaaaatgaactccactatgccaactagtggcagtccacggacaccgcgcatcacccagttgtaaacttctgccaaatttgttgtcattattccatatctagcaccacttgtgtcatacgccttggcccatttctcttttggttcatgcagaatccactgaaaaaatttccgaatctccaatccagttcttctaaccaatgttggactatccgttgggagaggtccaagagcttgaggagggtcagcaacggcggtcgatggagccgctgcacgctgatcactgcatttggctgtcaactcatctaatctcttccaaagctcattaaattttttctcctggttctgattgcacagcctcttgaacatgttcatgagctccttgttcttgaattgcttgaagaaattagctcccatatgacgcatgcaccacctactctgtacatcttcccaaacaccggggtatcctcgttccatactcccaaactgcaactcttctatcgctcgcagaatgccagcgtgcctatcatgtatcaggcacacatttggcctcataccaacaacttttattttaaccaatttcaggaaccagtaccagctgtcggtattttcactctcaacaaaagcaaatgccaagggcaatacctgattgttcccatctacccctattgctgttagtatctggccctgatactttcctgtcaagaatgtcccatcaatgcagagaacaggacgacagttcacgaatgccatcttgcatgcatgtagaactaagaacgccctttgcagcacactcttgctaggatgatcaattgaggggaatttcttcacttcgtaagagctcccagggtttctttcctcgataacaccaagcaggcgtggcaaattgtcatacgaggcttcgtaagttccaaatctcatctctattattttctgtttggccctccaggctttggcatagctaatagtatacttgtatgtctcttcgatgtgtcggattattgaccttggttcatatgtgagattatcgataacatgcgcatacatctcagatgcaacaaatgcacatgtaatgttcctgtggtatttctgaacaccaggtagaaaacatgtatgcttggtaacgactgatactgtccaataatccttccatttccccttatacgcgtgcactctccagggacaaccatctttttccttaaaacaccgaactttatattgcgaccggttcgacttggcaatccaaaactctctatgaagtgacactgcaaaatgttttactgcctcctttatatcttctgctctactataaatcgctccctgaataacctcattttctttgtactcccatctcacactatcctcttcagagacgatcagcccagaaaaatcctcactagcccattctgctggattaatatccgtctcatcatctgacgaatcaccttcctctacacgctcgttgtcagaatcctccctctccatttcatccacaatggcaccgacagtctccccctcgtcggccactccacctggttgaatgccactggagctactacgcccccgtcctctcgtgcgttgacctcctccacagaagtctcatttacttcagcacttggtccctcgccatcatccatgttcatctgcacacctggatccttcgggtgaacaaacggaaccaaagctagaggccacccgcgttgcaatgcattttccaaataccatctccacactcgagagttttgaactggcattagttcccaataaaaaccctcagttgcccgacttactataacattgattgttatgtcacttgtctgtggatcaactctgaagcccctcattaaccatccttttatagaaggtacactcctctcagccggtctatcaattcccctttctgatacaataaaatctgacagatctaccctagttggcccgtaacggacgtttcctggtccatggtaaacttggaatatttgtttgttcgacatatctgtcaacgaaataactagatcatattact

SEQ ID NO: 42334 - DNA, 797 bp, Oryza sativa
gacgaatcttttgagtctaattaattcgccattagcacatgtgggttactgtagcacttatagctaatcatagactaattaggctcaaaaatcgcgatttctccctaactgtgcaattagtttttcttttaatctacatttaatgcttcatgcatgtgttcaaagattcgatgtgatgtttttgggaaaaacttttttttaactaaacgaggccttatgggggcattttgtaattacgaaagattaggggggaacttttgtaatttgctcgtactatatataatcagctaaggcgaaataactttctgaaatctccgatagccagcaaacaaagcagggcgggaagcaggaggagagggagagaggaagcggcggccatggagggcgggagaagctggagcatcgagagctacctcaacgagtacttcgacatccccgccaagaaccctcccggcgaggcgcgccgccgatggcgccgcgccgtcggcctcatcgtccgcaaccgccgccgccgcttcggcaggttctccgacgtcgacgccatcgacgaagcccagcgccgcaagatcctggttcgtacgcagccccctctccccctcccccggcgggatcgccattcccccccccatccccgccgccgcggttgccccggcggccggcgagcgtggtagactgcaagtagagtcgtacggctcgtacgactgactgttcgtagcatatcgtgcgggtcgctttcgttgaagcgaggtacaaatttacctattctttctcgaattttgtaagtaattttttgggag

SEQ ID NO: 42335 - DNA, 21591 bp, Oryza sativa
agtatacagcaagataggatcttctaccctttttaacttaaagaagtcaagggggccccttaattgtccaaccatctcggatcatcggggcatctgacctgtaaaagtatcaactagggtattatcgtttatcgggatcaatgatccaccttcagtaggaatgtgacaggaacctttcttgggaggggcaaaatatttatgggtgaaatctttgccttcgggccggcaacgatgcctgtgggtgccgttttcctcttggggcgttgctgcataatctcatctctcccagttactttcttcaggtgaaaacgatgtcctgactccctggggcaggcggtggtaacgctttcggtgttgttcccttcttggaggcgtcgcttcgaagatctttcattcttgtttccgctatcgcggcatgtgttgtcatagacgcgcggtgtggttgttttttttctttccttactatagtttttcaggactatagacttgtatatttctcatgctttatcaatacatgaaactcacactgtcttgtgcaattcgttttaaaaaaatgatccaccttaattgtctggccaacttgaccatcgatttattaatccatccatcacatatttctcaagactaaccatccagcctattgtctaacatggacaaatcatcctgacaatgcaaattttagtatacatctcaattaaatcatacttcgatttatttttacttgaactcttattttggggaaacggattgtttacttcaacctgttattgggcttcaactgactagaattgagctagacaagtctaccgtgaatcattactagataaaggaaaaacaagcctaactgactattgctgcttctgcttttattactttttttggggggaatacgcaaggagcgcatctttgtattaaggagtaataaaagttatttacaggaaaaatacaaatgtggtgaaggggacaagatacaggaagggaaaaaacgaaggaaaataaaatctaatctcgcaaaaaacttctgcttttattactgaaatttatttttgaagtctcgtcaaattacatccacgagtgaaggccaaaaaaacaaggagtgtagttgtgtagatgatagtagtaattccttttgccatcaacggtccccttgagaacataaaattcatgtaggttattttattatttgatagcacaagtagattgtttttgttcttttcttagagatgcttctttttcttgtccagggaaaagttcaggttgtaattaacgtgcacaaggcagcgctgcaatttattgatggtgtggtctcaactaattatttctggtttctgctcttatcataatcacaatatgtcatttcaccttatatctaatgatgtaggtgtaaaacaatatcatctacctcctgaacttattgaagaaggattctgtatcagcccagatgaactagcagcaattgctaacatgcgtgaagattatacaatgctcaggatgcatggtggaatcaatggaatatctagaaaaatcaaagcatcattggaagatggtgccaaggaaacagatatagcaaccagacagatgctgtatggagctaacaggcacgctgagaagccccctagaagcttctggatgtttgtgtgggatgcattgcatgacttgacactgattattctagtggtatgtgctctggtttctatagtggtcggccttgccaccaagggatggccgatgggtatttatgatggttttggcataatactcagcattttgttggtggtactagttactgcaaccagtgattaccaacaagctcggaagtttatggaactggaccgtgagaagcaaaaaatatatatccgtgtaactagagataagaaaacaaaggaggttttagttcatgacttggttgtcggagacatcttgcatctttctataggcgatgtggttcctgcagatggtctgtttatatctggtgactgcctaatgatagatgaatcaagtttgtctggtgagagtgagccagttaatatttctgaagagaggccttttcttcatgctgggaataaagtagtagatggggcagctaagatgcttgttactgccgttggtacgcgtactgagtggggcaaaatcatgggtactctgaatggagatggtgtggatgaaactcctttgcaagttaagcttaatggtgtggctacaataattggccagattggattggtgtttgctgtgctaacatttttggtacttctagcgaggttcttggctgacaagggaatgcatgttggtttgttaaattggtctgcaaatgatgcattgacaatagtcaactacttcgctattgcagtcacaatcattgttgtcgcagtccctgagggtctaccattggctgtgactcttagtctggcatttgctatgaagaagttgatgcatgacaaagcactagttaggcatctcgccgcatgtgaaaccatgggttcagcaagttgcatttgcactgataagacagggactttgaccacgaaccacatgattgttgataaggtttggattggtgatgtcaagtttgttggggacaaaaaaaattctgagctaaaaagcacgatttcagaaagagttatggcgatccttatacaaggcatatttgtgaatactgcgtctgaagtggtgaagggagacgatggaaaaaataccatcttaggcttggctactgaaacggcattattggagtttggcttgagcttggaagaacatttatatgatgactacaataagttgactagaataaaagtagatccttttaattcagttaagaaaaagatgtctgtgacaatacaattacctaatggaggcatcaggaccttctgcaaaggtgcgtcagaaattattctggaacagtgcaataccatccacaatactgatggaaatatagtaccgctgtcagaaatgcagaagcataatgtattaaatataatcaattcgtttgcttctgaggcattgagaacactttgcatcgcatttaaggatatggatgaatttcccaatgatcaacctatatcagatgatggttacacactaatagcagtttttggtataaaggatccagtccgtcctggtgtcaaggatgcagtaaggacctgcatggctgctggtattagagtaagaatggtgacgggagacaacatcaacactgctaaagctattgccaaggaatgtggaatattaacggaggatggaatagcaatagaaggacaacagcttaacaataagagctcagatgaactgaaggaactcctaccaaaaattcaggtttagttgtactctcttgttttcttttcattaattaaatgcgaatataagctaaatctatgtcccaagctcaggtaatagctcgctccttgcctatggacaaatacaaattggtgacaagcctgaaaagtatgtatcaagaggttgttgcggtgactggtgatggaaccaatgatgccccagcactgcacgagtcagatattggactagcaatgggtatcactggaactgaggtatctatgaatgtttttcggtaatttatgttgttttattcctctatgaccttaatatgttcggtttgagcgtgtcttgaagtgagaactgggaaatgccctttagtctaaaccaattttctacaagggcttatctatatcctgacttaataataatattagctgtattttttaaaaacatattcctagatgtttaatattgtcagtgctaaaaaaaggagcaaacggtacaaaaatacaatttaattattttgcataaggtcgatttccttggctgtaacagtattcatcattgtttagtgacatttgattttccgtgtatgatatatctgtggacaagttgtgatgcaagttttatctgtttgcaggttgcaaaagagagcgctgatgttataataatggatgacaatttcgaaaccattgtaaatgttgctagatggggccgtgcagtttacttaaacatccagaagtttgtgcagttccagcttacagttaatattgtggctctgattgtgaattttgtctcagcgtgcatcataggtattagcacacttgctaccactctaatattattgatctaatgatgactgtttgaaatgaatgtgtattgttttctagaataaattcgtatgcattttatttggaatgcatatgcaacttatgatataatatttcctttttgctacacattttaataataaagtcatatatattgttattatggctggaaatagaggattgatagggtagatcgccctcaagtcgctggcttctccggaagaccgaggctttgatctgtttgacttggtgggcaaaatccttaatttctttattgcttaagtccctaatacaatagcaggccccctttatatactaggtgccagtctaatatttaggaaatctaagacaaactaggaataggaaacagaatcctaaaccaactagaattagatatatctactgattattcctattcctattcctatggtatttgattccataacgccggtctataataattgtcctctcttcttccctttacttgaagggagtgcaccacttactgctgttcagttgctatgggtgaacatgattatggatacgttgggagccttggccttagccacagaaccaccaaatgacgaaatgatgaagaggccccctgttaggcgaggagataattttatcactcggattatgtggagaaatattcttggccaaggtttgtatcagctccttgtgctggctactctaatggttattggaaagaaactccttagtattgaaggtcctcaatctgataaaaccatcaatactctcatattcaactctttcgtcttttgccaggtatgtgaactacaagtcccttttacatgcaaatgagtcaattttgttgtttttgtctatggattttatttatgtttgatatttcaagttctcatattataattgacaggctatcatttacattattctcggccatttcagatgtcatgttcactttgtagaggctaagacatttaattctgtgcaaagctcattgacatgtgatatctgataataattttcaatatgccatggactctctgatgacttcagcaaaccatagaaaataatcatgtagtaatcagtatatgtttttccattttcgttagaaaaacgatccagacaaatttaataattttcagaacaaaacaaagctttttccgtgcgcatttcacatatcctgatgctatgattctataaaatgcaagtgcaaagtaaaggcaatattcattaaacaagtgatctattgtggaaattaggaatcagtgctttattttaatggtaattttaccatccttgagaaggtatcgggaggtaacacattttctagtgtaaaatttggtacattcaggtactaaaataccttgagtataaaaaacttttgtgtaaaatttaggtaccttgaggtactttctcaaggaaggtaaaatttctcttattttaacggtaagtttcatctgacatgttaccatgcttccaggttttcaatgaaataaattgtagggagatggaaaagatcaatgtcctccaaggtatcttcagaaactggatctttgttggtatattgacagctactgtcatattccaagtgatcatagtagaatttcttggcacttttgcaaacactgtaccattgagcggggagctgtggctgctcagcgtcgtcattggctcaattagcatgatcatctctgttatcctcaagtgcattccagttgaatttaataagacaaatactaaaccccatggttatgagttgattcctgaaggcccagagattctatagcagtttcacgggaggtgcggaaattccgctcaaactgcggtttctgcggtcagcaacccaatcaatcataatggaaaaggatgcactgtaaggatttctctactgatgtaattttgttgaatatgatcatgtgtttctgaacatgatatactgaagagttgaagtagatgttataaccagcagatatgtgatgaagtatacggaataggaccaatcatgctgcaagatcagacagcctacgggatttatggtgttgattcaagatttcaagtagatatggctgctacatgagaatgtcgcagcaaatgtggactgcttggaggcttcgttgcaaagcgtacagtttgagctggttctgcagagttcagcttgagatttgagcgtacagttttgtaaaattgaactctaggtactaacaactgtcgaaatggtatcatattattacccttcgtgcttttctcttcagcggtgaactgtgtataacgtgtaattattcttttttatgtataataaagcaaattgtgtgtaactattctttttatgtataataaagcaaattgtgcgtaactattctttatgtattctttgtgcataagaatggatgtcctacatgtgaataatgttgtgttctaaggtgaagttgggaaccttcccttccctccccgcacggcaaacgtggtatcattaacacgtgattaattaagtattagttaataaagcttaaaaatgagttatgagcttttaaaataattttcttatatgtatattttttaaaacgtatcgtttagcagttcgagaaaacatacgcaagaaaaaagagggagaagttgggaatatggacaatcgaacatagggatgaaaacggacggaaaccacctttatcattttcgtttttgtcgacgtttgatgtctcgactacggtatttggacagtatggggatcgtcggtgctaggatatatgcgagactaaggtaaaagagatggagacagggatttttatacaggttcgggcccctgagttgtcaggtaataaccctacatcctgttggccgaagccggtattgctcttattcaccataatcacaccagtacaatatgtgggtagcctatctaactgttgtcgacatggcggtctgaaggtctgactcgtagtcgacaacagggtagccttcctcctcgagctcgcgcccgatggaatcaaagacagtgctagatccctacggccggcctctgaaggtaccggatagggtcgatccaggcgtatctctgatgtcgatatccggcggcttgtcttggtgtatgtaggcttctatgttgattgtgttgggagttgattgtctcgtggtgggtgttgatcgtctcatggtgggggttgatcgtgttgatagttttgatcctccatggtgggtgtgtgtccctctgtcctcctaggggggcttgtatttatacccatagatgtccccttgtccaagtagaactagggaaaccaatatggatacaatccgagtagtccttgtcgtttccatgtagaactctgattgtctttccttatccggaactcctcctatatccgaaggttgcttccgtataggacatggtatgtggtgtatcttgccgagatttagtcaactactattaggtatgtagtatccataaccctgacagttttcatattttttttcggaatcagaaatcgtagatataaaaacggaatcgaatattatcgaaactgaaaacggaacgaaaacaaacaggtgcgaatatggtaacaaaattttatcaaaatacaaaacccctcaaactgagcttcaaactttgtcaagttcaattctcaaatctcaatagtaaacaattcatcataaaacacaatcatatcaagtccaattgttaagtctcaacagtacatcataaaacacaatctatgaaataaatgatctatgtctaagagagaaatattgtcgataaatcccaatgcaagaatttaggaattgggccaggctattattgtgttgtatgggctgtgctacaggtatggagggtatggaaattccgagaaaatttttagaaagtttcaactgattccgagttcctacgaaaactgccctaatcatatttgattctgtttccgagaaaatatttcccaattcgtttactttttcgaaaaattctgaccgatagattctgtttttgaaaatagctttggaattcaaaaagtttccgtaccgttttcactcctaatcgaacatggctaaagggttagcgacaacaaaaacaagcgggaaaaactccatagcacaaaaactcgcaggtcatcgactcaccgtgctaagataaaaacaaaactaccaaagaaaattgccaaaaatccatggcgatgagaaatctaaaataacctgaaatagtgaaatgtgatgggagtcaacatggtctgaacagtgcaggagacaagaaagcaagtgtaaactaaaatcttggaccagaaaatgatcaaatcaactcatctaaatttcatcctccatacttctatttggatggccatccaaaaagattcacattctatataacttttcactccaacagattatccatattatatcctacatataccaacatcctatattttactaataattttcaactactacacatttttactcctacttctctcacctttcaccacttaaaaaaatcttggtaagtgggtagttgaggatggagtgaggagagagaaactctatatttggcttgggaagggctagatttggaggacctccaacaatggagtatgtatgtgatggagactctactggagcattgtttttcttctccatactctaaatatcagatggatgactagatagagaagctgctgggatgctctaacaacccaccacaatcaagcttaacctcgctttagaaaacgcttttggatagcatgctgccgctaaacgcaatcacaatcaaaagccaacccttgcacgcccgaattaaatcacccggttggtcacctgtgcagcagctgcaccgccccggctcggaccagccccacctactccaccgccccgccggttcattcatccacgctgacgctgacgcggcgagaaaccacggcggaatccgcgccggctccacctgtcagaaacgtggcgtgggtaagcccaagtttagttccaaaatttttcttgaaacttttaatttttccatcacatcaaaactttcctatacacataaacttccaacttttccgtcacatcgttctaatttgaaccaaacttctaattttggcgtgaacaagggaagaaaacggataatatgcgacttgattcgcgcgatttggataaaataccacccctgtatttgtacatgataaaatatcacttaatatattgtcttccaccttccagtgaaaagctttcgaagaattttagcccaaaaacatccttggttgtggagagagaaggaaaggggagggtcgagccggacgaccgtcgtccccggcggtggcgccgctcgtccgctcgcttctcaccgtcgatctccagcgccgctcgggcgctcacgacttgtcacccattgactaacgcgcgccacccgaccactcactgaacgtcgcctccagccgtctctgtgagtaggactaggtccagcaatatggcacggtcattgtccgaccctccagcgctcctcttttccctctttcttttcacaaaagagagcattttgatctaaaattctttagcgttattttaatcgggaaaaatgtattaagtgatattttatatgatgtattttattatctgtatctacattttatcgaaaccacccatattatccgttttctctacccaacaaggcgggtttacggggtccacctgtcggatgcctgcatccgtcagtccaccggtcacccgctcgtcagaggtaggtcgccgtcgccgcgtccccctccgccgccggctcccgtcgctctccggtctcacgcgccgcgcggccgcagcagcaacaacaacaacaacccgttttgaccgcgccttcctcctccgccggcccgcgcgctcgccgcgcgcggccgccacgggtttctctctagaagccccgcacgaattttatccgttttttcgcattctccccgcctcatctcctccttgacaccgacctctcctcctcggctcggggaattcaaacgcgcggcctcgccgggtggcctcgcctcgcctcgccgcgttccgacagcgagtgccccgctggtgccactatttcttgccgccccaacccctcgcatcgatcccccacacccacatctcgcctcctcttcctcgatcctttgtcttcttgcttagctagctctgccatggtggggagctacgcggcgggagggggacggggagcggcagtggcggcggtggcggaggggaagctggacgagctgcggcggaggatggggaaggcggacggcgacctgctgaggatcgtcggggtggggggcggggcgtgggggagcgccttctgcgcgctgctgcaggacgcgtacgggcggcaccgcgacaaggcgcaggtgcgggtgtggcggaggcccgggcgcgccgtcgaccgcgccaccgccgagcacctcttcgaggtcatcaactcccgggaggacgtcctccgcaggctcatccgccgctgcgcctacctcaagtacgtcgaggcccgcctcggcgaccgcacgctctacgccgacgagatcctccgcgacggcttctgcctcaacatggtcgacacgccgctctgcccgctcaaggtcgtcaccaacctgcaggaggcggtctgggacgccgacatagtcatcaacggcttgccctccaccgagaccagggaggtgttcggggagatcgggaggtattggaaggagaggatcagaccccccgtgatcatctcgctggccaaggggatcgaggcgtcgattgaccccgtgccccggatcattaccccgacacagatgatcagcaatgcaagtaagttctttgctctcgagtgagtttgattatcatatccatttttactaattagtttcaattacagtatcaaatcgattattcggttgctattttactactattttcgttgatcgttgtacttgtgtccttgtgggaataatggacacataaagaaaaggtagttgctgctgaactgggaccaagatacatacctccagaatattcttgataaaatgtgcaggctattcttgatatgcacctaatgtgatgtccttcatgtttattgcaattattatacccaacacaatgtctattgttgaatgttatgagagctagttaaggccttcagtatgtgcccatgtgctatgtttctttgcaattcctttaggggtaatgcatcttatttttagcagagtttatccaaattagtacccagtactgcacgttccgtgtcacgtttctacccagtattaacttctgatatgctcctaagtttttgtttcactgtataattgattttaccatccactggtcttcatctttcctaccatgttgtagcctttaatgttttttgtttcttatgatgggcctattgcagctggagttccattggagaatattctatatcttggaggtcctaacattgcatctgagatatataacaaagaatatgcaaatgctcgcatatgtggagctgacaagtggagaaaacctctagctaaatttctgaggcagcctcattttattgtgtgggataatagtgatctcatcactcatgaagtaatgggcggcttaaagaacatatatgccattggtgctggtaagttccatggtctcatatctgacgttttatgtccatatcaccttgaaaatttttaactgggaaaataaaaccatcatgtggcttttcttgttgaagctcacacacaatgcttggcaaaagtatgaccagttcaaacaacgaagccataaaattgttatgtttgcataatgctgaatgctatctgtcctgtaggaattgtattcagtatacgttgaattgctattatctcttatgtcaaacgcaatgctgctttgacatttcatcaaacctatcatagattagaaagagtaaatcaggtcatcttgggtaatgaggttcccctatgcatacatattcgttataaccttctgcattaatatagaggatcttgatttaagtcatgttgttaaataccttgttatcttgtaggtatggtggctgcactaaccaatgagagtgcaaccagcaaatcggtttacttttcactttgcacgtctgaaatgatatacatcacccatctcctagccgaagaccctgagaaacttgccgggcctttattagccgatacctatgtaacactgctgaaaggtcgtaatgcatggtatgggcagaaattagctaagggtgaactgactcttgaaatgggggacagtatcaagggcaaagggactatccaggttggtgctaccttcttaatgatgtaaatctttccatacttctgggtgtgtttttggtgccgaatagccatgtgctaagatttgctgtgattttatctttagggtgtctctgcagtccatgcattttatgagctcttgagccagagtagcttaagcgtgacacatccagaagtgaagaagcttgttgctccggtcgagctgtgcccaatactaaaaacactttataaaatcctaatcaagaggttggtcagattacctttgttgctgttcctgctagtactaatatatgtgtacaggcttaagttctttgcacatttcacctgcagggagcttgccactgactccattctccaggcaatacgagatgaatcaatgtatgatccacgggagaggattgagatgtctcagcgccagtgtctttaccgaccatctcttcttggcctacctaaagtagatattacccaggcttagatctattcttttttttttctgcagatttgttttgagatttgcaggattctttgatgtattctttgcatagtggtcctcaagatccttccttgtgtgccaagtgcatctcgtgttcgaacactgattccattctctactagagaatttgataatgaggtgttttggttttttattgtcagagttccaaatagtttcacgggctgatgccccccacatgtgtatataaagtacaaccactgttgattcaattgtattgttgctcctttagagcctgttcactttgatgccaaaaaaaaaccttaccaaattttggcattgccgaaattttagcgtagttgccaaaattttagcaacttgccaaaattttggcaagatttcttatatagtcaccaaaatttagtagcaaactaaatataatcactttttttagcaactttaccaaaatttagtaaggtttaaaatggcatcaaagtgaacaggcccttaatatatttcttaccattgcagggaacggatacctgctttcttttcttattacttatatagatacacagaagatgcatacgttcccagttcacctacgcggtggttcatgcgtcttccctgtaatcgaaaggaaaaaaaagggaccatctacaaaaccgctgcaagttttttaaaggaaaaatttttaaatctaactataatatataattgtaatatacttctactataactataatataagtattaaaataatatatgcaacttgatggcctgttctgattgtaaccaaaataaaccttaccaaattttagcaatgctaaaattttggcaagttggcaatattaacaaaattttggcagaatttattatgtatttactaaagtttggtaacaaactaaacgtagacacatttttagcaactatacaaaaaaaaatggtatggttgaaaataacatcaatctgaacagcctctatatctaacttatatagagattataatatagttacaatataactatagtgtaactatagttgcatttgatttttttttcaaaaaaaaaaacttgtgacagttttttagccattctgataaataactactgttcatggtttccttggcccatttacggactgtgaaagcaaaaggaaatgagaacatgaggcccgtttatcggtctatggctagctaatccatccgtaaacaacgttagccggctagcccaactaatggcccattgcgccccgtcaaagacaactttaagtgttttttttctctttttcatctactatctttgtgattaataaataatatcgttgacttttaaataacatttgagtattcattttacttaaaaattttacgtaaatatgctaaagtgtaagttgtacttaagttttatttaatggtaaaacatgtcacaataaattaaatgatatttatataatttttttaatagaacggatgaccatatgttatgtaaaaaatcaatgacgttacctattaaaacccagagggagtattagaagtgagcatgcatagtttcagcagtgcagaaagtaacaaggaaaacaaattaaaacaccatacgactactgaagcctgatttcctaataaccatctgatcatctcctcaggctttacatccaggtgccatcatatcccgtcttagcagctaaaacctgggaggaaaatccacatgagggacataattaaaaagtgatgagcaatgctccggtgctttctacttggagtattatactacaagtaaaattaatctcgaccgttcattttaaagggtagattagtaatctcctaatatatattaggggcaattttggcaggatctattttctctgtctcggtcggtcttggcttgatcgcatcaggtccgacgaaaagcaccgcatctcgcccgacgcacgttgcttatcgctactcctcccggcacgccgtggcgcggtgcggcgaaaccctcaggcgtcccctcctcccacctctcacctgtctatccgttcctcctcctctcctgtattccacgtcggcatcctggttcgccatcgtggccttctgtccgctgcgagtggccttccgcgcgcgtccgattccgccggagcccctgcgcaagacctgagattcttggcagcgcccactttggaggattcaatccattccgccggcgggtagtgatctccattccgtgttgctccgattgtgtgggctgcggccacttgggaggcagctgcgatacattccagcgccgtatccccggtccccctccgtgcgtgcccgagtcttgtggcttgcatcggcgagcacctcctcgaccgcgagcacggcatgagatgcagaatatgcaacagtgtcgctcgctgcgtgttgccgtggaaggcgtcgccggcgaacctgatagaccgcagtgctcagaggtttcagcacatccgtgctcgcggcggcgtcaggacactggatcggacgctgaacgatgcatgtggcatgcccgatctgctagctcaggatggtggccggcgactgtccgcacgctctcctgcgggcatgacttccacgaggattgcaacatcgcgaagtggctccgtgacaacaagaaggcctgcccagttcattctgcttgtaatattcagttgtatggtgtgtcgaatacttcattgactaattgacgagctttgagatactgatgtttattggatcttgtgactgtcccaatatattcattgttcagtaatggtttaagtaaaaaagaaaaggtgaatagtgatggactactagtaatgtcaatgtgttgaccatgtcagtgtgttgtgcattttttttgtgtgcaactgtgatggggtgagatgaatccaagcaatttgaactgaaatatgtcatcctgctcctggatcagtaaacaagttgttttgctcctgaaagagtgagactgaaaaaatctgataaactgcttaaatgagatttttcactatcagagttttgcccatatgtaaattgcatttcagtcagagctgtaattcaggatttgttttatatttcataccatcgaaacatctaactgcattctgtcatattctggcgctctgaatcatcgctacatgattcctttcttgtgctcatatgggggtagctaagccctcaattgccactaaattgattttttttcagtcataggacaatgtctactaatgggggcttagaacatcttgattcactctttgctgcaaactccctggtctactgtcgtgtttatgcaaaagcatttgcattagctccgcggcagcttgtgaagtcatgcacagtccctattcatgtagcatccaaacacctcattcccaagtcccttagccgctcgtacggtcgccggcggcgaccaaatgccaccgcctcactcgagctccgccaccgcacgtcgccggctgccatagctcatttcttggccaatccgagccgtccaccacatccccatactacactcgttcattcccagttgcccattcctcctacctcgccgccgttcgccggaacccgttgaatttcgtccgccgtccaattgcccggcgatctcctgtcttggtcaaagctacatggcaggactagtcgtccgccgtgggcaaggaccttcagcggcttggcgaagaggagaagggccacccttggtcgctggagggggaggagatgtcgatcgcgctggaaatgatggaggcggagagggagatggacaagcgacgaagtcaacgatggatggggtcaggcgcttgagaatggcgaaggtttagagttactgaataataatttacgataatacccttatatgaattattatctatggacaaatatacccctccacgtttctactaccactatgagtggtggtagtagaattagatctcaaccctacgattatatacgatcaacggctcggattattttctactataagtagaaagcaccggagtgaggcacaaaagtgattacacgttcgtcccatataatttcttcacacacaagctaaactagctaattattaaatgcgcgtgatcatcctataattgcacgacaaaattatctatattatcagatcggatggaaaatgaccggatggaaacggacgtgtccatgatgatcagtccatcaaactagctgtttcaatttgcatcgttttcacgtactcacgctcacgctcacgggccctcgcctttttcacagggagaaaactgaaaagaagagctcctggatgtgctcatgtgacgaaccctaatttaatccgacgcgttaaccccaaccaacaagacaaatgcacgcagagtcaatcgcccgatcgaaaacagcttcccgccaagcgcctgaccgatctctgaagcgaaagttgcaccagcagctagctatagctcatttaatcgtttctgcaagaatttgacatttttggggatcgagcagatgaaccttttttttttcctgatgttgtgtgttcacgtgggggaaaaaaacatttggtggggttgatgatcatgtagtgtagtgtttggagagccacagctgtcggatctaattctctcgtaatgtcggtcgcttgtgcctcgagattcatgatacgccctctgttcctttcgtttgtaacttgacatagttggccagtgtgatttttctttttttttttgcaaataaaacttttgaattatgttgtttttatattttcaccttattaggcaccagctgaccagcaacatgagatgatttgcctgccaatctgccatgtatatgttgctgacctgcctagtactccattcgtcccaaaacaagtcaacatcgtactacgatgtgacacatactaatacaaatatagagtatatccagatttattgtactataatatattataacttaatatgatattggtttattttgagacgaataatgtagttgttacgaagagcatttatcatgtctggaattgaattcctgttgcgattttacaactagttagcacacgcaaagttttatatgttcttatgaaaaatcaaatcactcgcagcaatccaaagctttacactgaaactactcctaaaaatctatgaatcgatacgccgcgtctgaatccgaacagctgccgtcttacatatgtcgggctgtcggctggattatctttggatgcaaatatataagttatctctgctgtatcagagagcaagccaagctatctatgttgtccttgcgtgattgtacaatctaactagattagattaaccaagaggaaaattgtccttcgacaagctagctcaccagcagcttaattagctagctccatctgcatcatgggcaatggatgcgttgcgtgcagatattctcaacgacagatcaaaacgaattcgatcgtgtggtagccaaaaagaaatatcggttttacactgccggaatatctagctataggacatttcttctgcaagtgaagttaatcaggttgtccaaaaaaaaaaggctatcgtggtcacgggaacagacgcctgtatctcgctgtctgaatttttcttttctgacgaagaacaaagagagagaaaaaaaacgcgagcagagtatgtggttttgtgaattgaggcgccgattttccgtgaaccatctactgtttactcaagaaaaaaacgcaagaagaacatgtttactctcactttcacctaacgccattccagagcaaaagcgtaattaagatatgtttatgtccttaaaataacagagagtgagaccagccgacaggccatcagttttattcttgtttaaccattcatgcagttagaaccagctggatgaatattcagatacatgttgttaccgtaccttgtaaaaaaattgggtttgtgttactatttttcttacatcgggttgctttcaagaagtgcttttctgaattctgggcctcgtatgtaaacgcgttgggggatagtatgtgggtgttcgttttcgtcttctcatggtgaatgggatatattacatttatttatttttgagattacatgtttgtcttttccaataccatatcatagaacttgataagcctaggatacaattggaaccaaggaatttttttttcccgatcgcctctctatacctcctcaaaaaccataaatcgccattataactcctttgattggtaccactcgtccactgtgacgtgatacctactgcatgtgtataagatatcttcgaggtattatatctgaagggcctaaataaccttgtttttgctttaatcttaatctagcagattttcttgtgcaactttatgtggagttagatttctaaagttgaattggatatacaactctaatgtcctatttcatcatagatataattgtattttatatacaacatattttaaaagcataattggatttatcctacaaccccttctatttttattggtacaattttgtattttatttacaaacatcaatcaatatcaatgttataatttgaacccactatgatctataacaatgtaaggctgttgtggttggaaacaaatccctcccgcacgtaaaatggagcgatccattagcgcgttattaattaagtattagttttttttaaaaaaaattgatcaatatgactttttaaagcaactttactttagaacatttttgcaaaaaacacacacacaatttagcaatttgaaaagcgtgcgcgtggaaaacaagttgagtgagtcggaaaaactcaagtgttgaactcaacctagatctttctctttttttccccgattaagatactcccttagttccaaaataagcgtagttatgagtttccgtgtttaactttaatcgtccgtcttattttgagatggagaaagtagtaatttctaggtctccaagccaacatgatgctcttttatatctttcaagataatacaaatgtaatatagtccatccgttaaaaaaaaacgaatataggactggatgtgacgtatcctattacaacaaatctggacagagacatgtccagattcattatattaggatgtgtcacatccagtattaggttagttttttatgggactgagggagtagtagttactccctccattccattctaaattgatctacatatttcataggtacaccaagatcaaaaaaactaataactctctcatactatatttactctagcaacaaactcaatgcatgcagcatccccattatttcttaaccaatagcaaatctaaatattgtatgtgggtaataaatacttgtgtacatggatgcatgtatcaatgtccatctactctaatccacaaataacgaatagacttaatgaatgaacacaaatatgtagatcatttaggaataacctcaaaaaaaatatatatgtagatcaatttagaatagtgggagtagtagataaattttttaagttaactttatctgaaaaaagtttgatcagagttgctagacatacgagggtagcgagagtgtcaactgctacaatacatgcacggcgaacaaaaatcaatgcaattagccacaaagcgagaatcgagaagctttctctgctgcggcgaggttaatttaccgtgaagcaaatggcgatcgatctgcaggttggtgcgttgcgttgcacctaatcagattagcccaggccaaatagtaatacgtggtacggttgatgaggatggcctctaattaatagtgtgtgttgacctcttgactatattatgtatcgttggaacttgggaaccgctgatgtgatctgtttttgcagtacaggcaccggctttggtgacctaatatttgtggtcgacgattcttaattatgtatggtagtacatacagatatctgcattaatactctttattagtactgtatcacaaaatttttagattatattcagcacattcaagtaccagcgaatatcaaatatagttagaaaaaggaaatttggaaaaggagaacgataatctatcttcaccttgtgtatagcagatttattcttttgggggggttggccgaagacaaggttgatcaaatttcataaagacaagaccggatgggatgagatttgattaaaaaaactgcctgtaaaaagaagtacatatgctactagtgctgaaatttagccattagcttcttttttttaaaaaaaaagaaaccttcttgcttccacatatttaattttagagaactgcaacatgatatagcatagacctcttttgaaatgcagaaaaaaaattacataacttttacaggaactaaacaatttttcacaaaacaaagacctttgaaaacctccattgcgaaaaaaaaatcatagtataattttcaatgtttgtttgcaccgtgttttggagggagctgagtgtccagtttgtccacggatgtaccaccaaacgtgtaatactgtgcaccgaaatgaatgtttgcatacgacacacatgacgtctgagatgtacgtgtcaaacaactcggtaaatggacgaatgaaacgtgtgcgcggtgtgccagacaggtcaaccacatgaaacttgactcggtgaatacgtgcacgtgtgaggtcacgtttttgtgtgtcccaaaatccacaaaaaagtaagaacagaactacggtctgctagtaaatgctgaccttatatgcatacatgcaaacatggtaggagtacacagcaacaagagacttgttagcaaggttagccataaaagtgataatgtgtgccagctcgattattttgcgactacgtggaagacgcacaggccaggaaacgccgatgcttctaaaatcggccatatctgatgttaggtttttgggct

SEQ ID NO: 42336 - DNA, 10687 bp, Oryza sativa
  unsure (1)..(10687): unsure at all n locations
ttgtcaattttaatagtgtttattgtttatttggtttggagccaaattttggcatgcctaagaaaataggccacttcaacatttaatttaggctattttggcttcaatccaaacacaattttacctttatcaaaattagtcatgccaaaagttgtcaaaatttgacattgacaaaaattggtaaggccaatttatgccacaaaccaaaccagccctttattcatctaaattttttttcctagtgcagctcacaatacacaagaagttagaatgaacctgtttataaacttaagttaaatgagtctacatttagcatatatgggcgagtcatatactatgatcacattgtatataagattaattccaatataattatgtgggccaataacttacaaagtcgatcatgtaaataaacccaactattccaccatgtgcttgatcggcgcaaaaaatgcatatacatataaatataaattctagtatatctcaataacttacaaagtcgatcatgtaaataaacccaactattccaccatgtgcttgatcggcgcaaaaaatgcatatacatataaatataaattctagtatatctcaattaatttctctattgtgtttcatcatagttatccttggcaccatttcacatcagtaattccccatcacacgcagcataaatacttttcacattaaattaaagaaataccataatataatatataaatattgtatgatgtcctccctactgataatacttctcattttaagcaaggatgaggtcaaactttagaatatttaattatgaatcatttttaaaatatttgtcttttaaatatggtggccacatatatagattagtcttaaaaaatattttaataaaatcacatatttgttaatacttttatatattttataataaaaaataatggttaaagttattttttttgagaccgtgtccttatttaaaatgacaagtattatcaatccgaagggagtataaaaataagtcctacatcaatacgctcagataccctcccttaatcccggagatacttaccacggattcctccacgacactaatcccaaccagaatcacctctgccccctaatttgccactaatgacaagcttatacaatatgtggtcaaagccgcgaccggtctgaccacgtcccttcgccgttgatcgagtcgacgtggctttcctgacgccgtcgacgatcgatcgagcaggccatcgatctggtcgtccgtaattcatctactaaccgcttgcggctgcaggttcgcgcgcacgcacgcacgcgttgcatttgcctagtccttcgggttggtgtggcttctgaaaccgactcctcccccactcttctcccacgcaaatctgaaattgtgaagtgagcggtttgcctttaggcttatatatacggagaccttaacaccacgcagagagagagggaggagacgcgcgcgcgcaggttcagatagtttcaggcttgggaggaaggaaggagaggcagagagagaatttttgtctgagagaattcagatttcagagagataattttcgtctgaagaattgtgtatcgatcgatgtctggtggtgtgatcagcatggtggtcgcgccatggattctcgcttgcgggttcttgctctgctcatcctccttcctcggtgagaacagttctcagttcattggttcatctttctgttttttttttcaggttttttaccttgcttgcaatttcttctgttttctttacctcaagggtgatcggttagcttcaatctatacatgagttcatctgaggtttagaattacgtttaatctcttatagtagattatagtgtatgaatggttacagcatgtttctcatagctagagtcgcagtttcttcaatctgttcttgacgtctagctagctactttcatcgcgttctgttcatagcagtttttttttctttttttgaagaacgttcatagctaggttggttttgtctcccatcacgtcttgttttgtttcttgatttgagcttatactgccattagggtaaaggattttcttttaactttgagggatcctttgggataaagatggcgccaaatgtctgcttcgataattaattatcgattgcaggtagagccgtataggtggttgccaggcttattctttgtgttcttggttaggtttcttaaagaaagaaatccatcctgctgaggaaacactgcatgattggtttcaggaggaatgctgcgactgtagctatatttattttgtgggttttcaattttttaattacccatttatcgtactggacaaaacttcggtaatactccagtatttaggagaaggaaaaggataacaacaatattgacatcagcatcctgattggacagatttcgattacagtacaaatatatttcgtatggttcagaaaaataactgtatctagtccactgggcctatgatgcgttcttacttccttagaccagttctgttctttcagtaaaagtttggctaaacctacctaaataatttaaataggtcatatctgccattatttattagatgttacatctcaaccaaaatatatatcttattctgccaatagtttttctgattgacgaaatgaaaaagggtaacacttttgcattgatgtttaaatcaaactaaactgatgttgatatcgttgtcatctcaatatgacataacacaccgtcactggataggattatgtcttttcttaatcttgtagttttttttttcaacatcagacaacctaaaccaccatttttgctgttatctttgattccagtgcatctttgactctttgtatatcttatccagtgtgctttgatgaaacaactataattaggcagacctagatgatgctgtaaacctagataagatataatccattaccatatgaacgtatctaaacagcatcacattgtctacaattacaacaaaaaagacattgctgcggttttaatatctttgtttatttctggttgaaagcgatgtacttggatatatttgactccatggacattgacgtttactgtttgctccttgacgccaagtagaaaatggtttgtgcattttgcatcttattttttgtagtgtgaatgacggaattggacctgtgtagtacgttctataagtccttaggttggaaacttggaatagccagcagaaaagacgtatagtgatgtggagttgtgcacgggcttcacttggaaaattttatctggtcccaactcttctcctgggtttgttggctaaccactcgcctaatctagctaggagttcagtttctgcaagtcaggttacacacctaattcattgttcttcatttcataatgttaacctaaacatgataggtttggcattgcggatgtgaacaaggctaatgattgcaacttctcacaagtccacttaattttctcatctcaaatatatatatatatatatatatatatatatatatatatatatatatatatatatatttgctccaaagttgaaacaaatataaattgatcatttgactaatgtaaattgtatcatacaccctccatcccacaaaatatggcatcttctagtacaacgaatctgaataaagatatttagattcgttgtacttgtgtgatctcttctaggttgatttttttttatagatggagtagctgtataatgaatgaaaattactgaaaaaaaaagttgtaagttgtaactcatccgtgtggcaaaatgatgcaggagctgaaggcgccattggtgtgaactacggcatgctggggaacaacctgccgtcgccggcgcaggtgatctccatgtacaaggccaagaacatcaactacgtccgcctcttccacccggacaccgccgtcctcgccgcgctccgcaactccggcatcggcgtcgtcctcggcacgtacaacgaggacctcgcccgcctcgcctccgacccctcgtttgccgcctcctgggtcagctcctacgtccagcccttcgccggcgccgtcagcttccgctacatcaacgccggcaacgaggtcatccccggcgaccccgccgccaacgtcctcccggccatgcgcaacctcgacgccgcgctcaaggccgccgggatcagcggcatcccggtcaccaccgccgtcgccacgtccgtgctcggcgtctcgtacccgccgtcgcagggcgcgttctcggaggcggcgtcgccgtacatggcgccgatcgtcgcctacctcgcgtccaggggcgcgccgctgctggtgaacgtgtacccctacttcgcgtacgccgcggacgcggagcgcgtgcagctcgggtacgcgctgctgtcggcgtcgcagtcggcgtcggtgaccgacggcggcgtgacatacaccaacatgttcgacgcgatcgtggacgcggcgcacgcggcggtggagaaggcgacgggcgggcaggcggtggagctggtggtgtcggagaccggctggccgtccggtggcggcggcgtgggcgccaccgtggagaacgcggcggcgtacaacaacaacctgatccgccacgtctccggcggcgccgggacgccgcggcggccggggaagccggtggagacgtacctgttcgccatgttcaacgagaaccagaagcccgagggcgtggagcagcatttcggcctcttccagcccgacatgaccgaagtctaccatgtcgacttcgcggcctccagctagattaggcccggcccatttcacatttctttctttcagctgctgctactattttattatttgtcggatacagtattttcgtagtttcggttcgatctcatgtcaccggtgctctgatttggattcattgttcatttgttgtcgatgcacattggagtatgatttattcaaacgcacgaattttacgagaagatatgcagacaatttccactagatgaatgctgatctggatttaaaaacaaacaccatgtcaaaaactgagtgaaatttaatcgttgcgaagaaactaattctgcgccgattgcttttgcggaactatggtggaccggaaatgcgatacttacgggccgtttacccgtagactcggtcaaagccttttggacgcttatgggccggacgtgggcccacgaaggtaccagcgatgatgccacgtgccactttttgtggcacacgtggcgatccaatccgagaggactagccgctggtgtgtagtagtactagcgagttcttcctcggcgagttggcggcgtagagggaacgagaagaggcgagttcttgacccttccaccgttgcgcgcttcgtctgagttttgcgcctctcctcgagaccggtgagtgcgatcacgcgatttgttttaacatctgttccgtagtttggttgagtccgatgcttagggttacttcgtgttggctatggttcttgggtggaatctttgatcgatcgcgttagggtttgctttcagcaaaatgggtttattttctagcgaattagcgtgctttggttggtaccatgtaatcaggaatcaggcaaaggaggagggtaggaaactagggattcaggtacgagttattttgtgcgtgttccccatgtggccatgtgcgaggctgaaggggagattaggattactctgtttgatagaagtaggaagttttggtggttcatcaagtggaaatgcaattgagtctctagcagattcctctcggtgattgtaacaatcttatagttgtagtgagctagaaatgattcacaagtcgattagcctgattttgagattccacgcaaaaaccgagtaaatttgagacccactggcagatcctttccaacttatgttattgtactccaataaagtggctaaggtgatgcccttttgtgtagatttgtttcgaagttgctaaagccaactttaactcattcgctctagtaccacttgatgcctggtaaatgtgaagattgtaggagcagactagttaaatccaggagcaatgcttctacaagaacagcttagttatgcctttttccctttttttttcccctggaagcatcttcagttgtattttgctgatgcttagtgtattgggtccaaaaatggattgtatgggaaagatgtgacagttttctatggcattctttatctatttttagataattgatagaaatatggcctcctatatccacaagtggatatacacagctaaaagatacatgatacatgagttcttaggctccaagtctcaaaactgaggacaaaataaaaaggaaaaaagctagacaactacgaaagagaactagaagactttgtttggaacttcctaaagatttcgtaatagtatgactaatctttgtcaatacattctgttagcatattgctgtgtatgctgtgtggttcttctcttggagtcttacatctagtaattcataccaggcatggatgcaaagaacttaggcaacagacgacaaaatcatgagaagagtacaatgacagaagatgcacggagccgagatcaggagaccttgcagcggtttgcagattcagatattactgtgagtccagtcaacagtcatgaatctggagatgtgaacatggaagctgccatctctgctgaggatgtcttgcgagctggtggtttcggagcaaaagatgacatcggcagcctccttcccacagccgtagattcgactgatttcgaggcctcgctacgggatgctcgcgactttgaaggcgagagtgaaaaaccatcgcatcctggactaggatacaaagcaaatgaaactgacagtggaggcaaaccatcagatgtgcagcagcagcagcagcagcagtgatccttagtgttctcttctcctccatgcaattttagctttggataacatgacattcgccgcgttcctctagtgctccgaagacctatcctgttctgactttgtgctaaggtatgtggcatttctgttgtttccctgatgtaccatgtatgaacgtgaccatgatgattctgctgtatgaaccagatcgtttcaccttgtatacctaagtattagtggtagtagtttgtgccagttttttcatcatgagttgattatctgctggtgattgtggtcacaggatgcagaggagagctgatatattttggaacgaaacgcatgcaaattttgcatggtaggtacttgataggaggcataaaggatcatctgaacacttatgtatgatcagaaatcaaacattaaaacaatagaaatcaactaagttgacattaaaaccaacagaaatcaactaagtctggatctcgacacaagaacagaacaacagagcaggtctgtcattcactgtgaggctctttgtgagttaagatgatagacaatcgtcgtcgtcgtcgtcgtcagcatcacgaaacttttgcccttcggccttgttgacgtgaagcctcttcttcttctgccctggcttcttcttgccggcgtcggccgccttctcggccttgagcttctcgttggccaccgtcgtcatggacgacacgatctccttcacgctcgtcgacgtcagcgacgccacggcgagcttgttcatcgccttcataagaccaatgtaatggtagcttttctgaaacgaagaaagaaacaaccaaacattagaccccaaattctccttgcaattatttcacggacaagaatatgagacgagaatgcaaatacctcgtaaggtctaagaagatctttcgcgatgcgctcggcgtactcggcgaattccttctccgattttgggacgaacttctcgatgggttcgtcgtcgtcaggctgcttctgagctatctcagcagcggcattcgaggtagaggtttcactcggtgttgcgtctgctgcttctgccttcgccttcgcgttggcctggctcttcttccctttggttgcaggaggtttcgtgctcgccgccgtggcggccgtctccttcccaggtttaacgtcgtcgtcgtcgtcccacgtgtccttcaccgcggcgaagtcgtcgccggcgtcttcgtcctcccaaagcctttttcccatagactgttcttcctcatcggaaaattcatcgtcatctgcagcgagaaacgcacgggcaatgtcagaacaaaaaatggatcaaaattacagtttgataaaaaaaagtgatatcgagaaggaaaaggggagttttactatggaccatcgacggcaacttaccccaactcgccatctttgatgccgtacttgatgatccgtgcaagaacatcaacaaattaactatcaaaagcagggatttatagcctttttctccaaaacccaagaaaacaccaagagggcttcgattgtcgagtgaaattcgagggctgcaaaatcgagccggtgcacgagaatttttgaagtttttcttgcgaccgagaagtgctcgccaaattgcgatggctatccgtggatgcacgggacaatccaggtatatagaggaaacggagggccgtcttcttgtcagagtcggacgaggaagagcatactagagtactggattcctagtccgattcatgatccgagtttctgctgccgtggggcgcagcagccaattgctgatacaggcattgatgaactggaatcggcttaaatatgccacgttttattaagagagttttgagcgttcgacaccacaaaatctgcgatccaaactaatgaactcatggctcgacaaccagaagaaaaatgtagtgatgaggtttgtctgaattctgatgcggcaggatgaacattgattggatcattggaagcactgcacgtccagatccgatgcggagtttgttgaagtatatagatgtgacaggagtttatacatgaatgctcaaatgtccatggttaatgcaaatatcttgaagaaatttcatgggcataaaatgtgatgatgtttcactttcagtgatcagtttctggttgcacacccttcatctgaattttgagctgaatccagtgtgcgcatccagcatgcaaatacatgatcaaatgctcacaatggattatgaaaatctccaaggtgtctgtttgttccggaatccagcatgaactcctgccatgccatgattcactaattttcaatggatacatctactttcaacagtcgactgcccaggcaccctaaagtttgcttctctgccaaagaaaaaaaaacgcaaataaaacatacttacccagcaaattagcaaaagaaaaaaaaaagatgatgagagaaagttctgggggaaacaacgtaaggtattgataattatgtttcctgaggtaaggtatatccaacaaacacaaaatgctgggaagttattcaaacgatttccagcatctctataaaacattggtctcttacatttcgagtggttgaagaggtgcgagaaaggagtagaatatagcaagtttagaatggtacatgaagaagatgcaacaaaatgaaacttagcctcatacggccacagtgacagcttcatcaagtgcaatgactccaggaagttcctttccttccaacagctccaagctagcaccacctcccgttgaaatgtggctcataacatctgcaactcccaccttctcaacagcggcaacagaatcacctcctccaataatggttgtaacacccttgccgctaaggtctgccaacttctttgcaatagcctgcaaaagagagctcacagttaagcttgttttcgcaattccgttaagtttgttttggcaattccatctgtaatcaaaccgaatgagagcattggcacaggccatcacctcagttcctactgcaaacttgtcaaattcgaagacacccataggtccattccaaatgactgtctgtgttgtttccagggtagagctgaatgacgcgactgaatctggaccaatatccagacccatccaaccatcaggaatagcagatgctggaacaacctgtagaacaattcaaagtcaaggtcaggtccagtatatcacttcaccaaactttgagctgctctatatcaagttatcgactagacaatatctatgataatcatcatcagtgattacaaaagaataaaacataacagacctggctgttagcatcaggagcaaacttatcagcaatgataacgtcagatggcaacagaagggagacacccttttcttttgcctttgcaaggagagatgttgcaagctcaagtttgtcttcctcaaccaaggaagaaccaacagagagtccttgtgccttgtaaaatgtgaagatcataccaccacctagaagaaggatatcacatttctccaaaagggattcgataaccccaatcttggatgacacctttgaaccacccacgatggcagcaaatgggcgtttagggcttgaaacagctccaacaaggtagtcaagctcctgtgatttaaattaatgataaacattgaggctcagaactttatattgtttttgaaagaaaagaaagggtactctaaaatttctggtctaggtatagctttcaaaaatttcaagcatcagacttgaaaatgtaaggtgaaacggtagtaaccttctgcaaaaggaatcctgcgacagaaggctttaaaaacttggtaactccctcagttgatgcatgtgctctgtgggctgttccgaatgcatcattgacatagagatctgctaaggagnnnnnnnnnnnnnnnnnnnnnnnnnnnnnnnnnnnnn

SEQ ID NO: 42337 - DNA, 5833 bp, Oryza sativa
accatatgccttctcatttttctccatgtcttccatcatgatatcatgcatgtcatgtactgatgtgcatattttcccccaaataaaacatgaacatttcaaagtttacacaaggttttgctagcttccacttatgtttagtaattagtacaatttgaaagtttccttggcgcagcataagtcaattgaagttcgctgtcagcaagcttttactccatatcgatttcagtcaatttatatcttccatgtattatggtagagaagaatagtatccatataacttgctcctgtaagttcataaccaataactcttgctaatgacattttgaaaggttgtttttaactgtatatgcaaaattttgcggtcacagtttgttgtcacctatatgggtatatgatagcagaccacatattcggaaatatagctggctactctcaaaagtaaaactcaatgtgcatctttcgttttgccattccgcaccttttaacactataatcctttgttgtcgctataatatcaaatggaactttaccagtggcctgcaaatgagattattataagatactccctccgtttcgcaatgtaagtcattctagtatttctcacatttatattgatgttaatgaatctagacatatatattcattaacatcaatataaatgtggaaaatgctagaatgacttaacattgcgaaacggaggaagtatatatttattatttatcgttttattattcttttatttttgacaggtaacaagccttttaacttcttcagttaatcaggaccaagtgcagctttggtagtttctttggattggccatcaagaatcacatgcacattcgcgtatgcatgtggagttccaaaaccaatgttgcatgattacgtaccgatctctgtaaatcaaaatgatggcataccgagtttggtgttatgtatacattgtcgtgcatgatcgtatacagatttttgccgtatcaaagagatatttttttcttgcattgtcggtacgcacgcgtttcttgctagtttcgctcacccactgacggcgtttgtttggatgaaaaatacccctcttggggctgcctacctcgaatttttttatttataattttttttattaaaagttttacaaaaataattttccattttaaaaattgacggaagtagtcgcctaccgccctctgggagggcgagagggcggcgaaaatgacgtggcagccggccgttcgctctcgggcgacggccgtcaacgaaatttgcaggcggcccccttgccgccctccgctagggcgattttatactgtgcggggggccgcctgcaaatgggcggcgaggggggcatggaattttgcaggcggcccccttgccgccctccgggagagcgattttatactgtgctctaaatttttttataaatatcaatagttatcaaatctttttatattgaaaactatacaagattaaaatctccaagactggtaaaatacaattttattattttttagggcatatttggattgttaccgtacaaatattttgttagtgccaaaatataagcaagttttggcactaccaaatatttggtaaggtaaaattgcatttgatcatatttggtttgctgccaaaatgtaaaattgtagtgaagaatgttctacataatctcaaatctagattacgtattaccaatgaataggcttctattttcgtgtgtggtgtgctagtgggaaagaagatatgaagaggttgccttcagattgtcaattatatagcgtcgttttcactgcaatatatgtgaactcaatgagatacattattcattagatgtgacaagacgatcacgcgtgggcgtgaatcactttatgtcaacaggcagcgccgaaagttgatagtgataactcgagctgccgcttttcatgtgtgctgttgtggactgtgcgcgctactggatctgacactaccgtgaagcgccgaaagtgtgttgtcgtgagcataagttgttctagcaccatatgaatgaaaagaactatgtagacgagacaaacacaagtagtactgcagtagtaatagcaaaagtagtactgctttacaattttgtaagccaaaagaaacggtcacataaggactgaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcgtggtggtgtgcaccgtgcaagtcgtcatcgtagaactggctagtaggaccagtcctaccggcgtgagacgaagaggccccagtaccgaagatcccggctgcaaatcctgctggacaaggaccatcagtttcgtacaagtatttaacagtggtaataaaaagtaaagtaccgtgtgggcgagggatcgacgctccgtgagaggaagagctggcgaacgcgcccgaagaggtggcgaacgcccctgcggagctcgcggaagcgccggtcgtgcctgcgaacgtgctcgaaggcagacgaggtcctgcgatgaggaaacgtgcagttaaaacatagtgacatattcgtgcaaaagctgaaacaaaaatgaactaatatctgggctgaactgtaccgtgcgaaaccggtgttgtaggtcgcactgctccgaagctaggggcactcgaaggcaaacgaggtcctgcgaggatggaacatcaagttacgacggggtgatgttttcgtagaaaaacagaaacaaaacttaagaaacctctgggctgagcagtaccgtgcgaaacaggtgccgtaggtcgaggtcctgctccgacggtaggcgcgcgaggccgtggttgtaccggaccagctggaggtacgacgtccacggcgctgcgacaggagaagacgcgcatgaccgcacgcatcttctcctgcatctggtcgaaggtcaccctctgctcaacgtcagtcaagtgcaaacctctgttcaacctcacttggactgcggtgatatcggcactgatatcccgtgcggcatcagcctatgcaagatggaaataaaaaattcagtagttgtcctatattatgcaagataaatgaaataattgtaagaagtaatacaaattggacgtaccgccacgaagtagtctcggtcacggtgcgtgggatacgcgtccgtgacagcagcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccaatcgtcaacgtactgctgtacacgtggagcccaaagtgcgcctgctagctgtccccgtcgagtcaacctgtgaagagaggtaaattatatggctcgatgaagtaattatcataaaaatttagaaatgaacaatccgaactcacgagtggtcggcagggaggacggtcggctgcacgttgcccggaaacacctgcctaagtccgaactgtctcatcacacgctgcgggcagtgaggctcaacgaaaatgtcgaagaccatcggcaggatggtgagccagtaagcctggtcgcgtgtgcacaaggacgaaattcctagcggtgctctcgcagcgacggcctcttctgtgtacggctcccagatgacgtcgctcggctggagacggtcaaactcgaacacgaagtccgggtaaccacgtctcacctggacgtgagcgtaacgacgctgcaataaacatgatcggaattagacatgttatgtgaagaaaaaaaagaagacgactgataaacttataacgcagcgaagttgcactaaccccacgtcgacaccagtaagtccccatcgtgggaccgtcctctggccactgcgcgctgcgaccaaccccgtagggtgcgctgtccaccactggtcgacctatggcaaacctctcggctgcccaaagctgaagcaacatagggcagccagcgatgatcgctcccgcgtcagtcttcgtgcacgcctcacagagggcacggtacgtggctgctagcacggcagaaccccagctccactgcggcacgtcctgtggctgagcatccgcgatggaccgtgcgtagtggaccagccggaagtccacagcgtgcccgtgggtgctagtgaacatcacccacccgaacaaccacaacaggtacgcctcaagggagcgtcggaccgagtaatcatcagcgtcagggtgcagaaggtccgcctacaattaagaatgaaattttagtacaaaacactcatccggtcgcaaataagcatgtatgataataacaacttatttacttacagtgaactggagcaaccaagccttgctaggcccgactgtagagtacggaggaagggtgttggccggtcctaggtgtggaaggcgcatcacctgctcgaagcgcgcagtgatatcctccttccacccaaaaacaccgtccacgggaccaactggtgctcccgccagcggtagcccgagcaggtacgacacgtcctgcagtgtcggagccatctccccacagggaaggtggaacgtgtgcgtctcaggtctccagcggtctacaagagcggcaaggagtgaccggtctgcatcccaccgcttcgctgggtcacggtcgtccgccgccgcctcaacaagcctacaaagtggtagaaggcctgccgcatgcaacctgtatagagcaaacttcaaacataagtacgacacaaagcaaagttgagttgaaatgtgaacatacgcgtaccaaggaacgtgacgggggtcgacacgcaaccactcgcgcgacgtgcgtggacggaaggtgccgagctgtgcaccctcgactgctgacaggaacgagcggtggttcctgtcaatcccacggttcaacagcgccggtgtgtcgtacgccatacctgcatcaaataggttgatcagaaacatataaataattagttcaacataagtaataaatgttcataagcgaattactaacacatactaaacaagagtacaaacaaacaaaagtgtttagtccgaacactcatcacgataacattatgatacaacaccgaatagttcgaatactactagtacaacaatagtcggaggtactcattacaacaacattgaattgaaattacacgatagaagtatttagtccgaacactcattacatcacaacagcattttatttcctaaatcgaaagcattgttacaccatggaatcgcctgctgcgcgacgacgccttggccttgcgcgcctgcttgttgttccttcaccaggtggtcgcctaccatcacttgcctgtccagatggactagcatctgcgccgcttggaacttctgcattcttcgggcatttcttgtaagtatggccgcgcagatcacacttgctgcagcgtaaagtcctcccacctgcttctgactcatccatatcatttttgatgcgtctagtttggcgtcgaccctttttcacccttaacttagatggatctggaatataaaaaacttgggcactcagcgttgtgtaagatcctgagatcccgaacccatatatctcctcactccatgtatgaaagattgcttctttcctgaaataatttgagacgtacacattgggagatatgccacaatcaccggcagcagcaagaacgtgtgagcaaggaaggtgatgaagcttcggcttcatacaactgcaggtacatccaccatccgcctt

SEQ ID NO: 42338 - DNA, 3025 bp, Oryza sativa
atagagaccacttctccttaggctcattctcaatccactgagtgaaatttctgatggacgaccctgacctccttctcattgttggtgggtcatcatgtaatgcaccaagaggtatgggaggctcgtcaccttcaactagtggtctgcgagattgctcatctgtttgcttcgttgtcaactcatccaacttgtccccaactcattaaatttcttctcttggttctgtgcacagagcctcttaaagagctccataagatgcttgttcttgaattgcttgtagaaatttgcacccatgtgacgcatgcaccaccgactccgaacatcaggccacttagctggaagtcccttctcatcccaaccgttctgcaagtagtcaatagcccgcaacatacctgcatgacgatcatgtataaggcaaacgttgggcctcatacgcaccactgcaatgtgcactctctctaggaaccagtaccagctttcagtgttctcactctctacaaatgcaaaagccataggtagaacctggttgttcccatcacacccaattgctgtcaatatctgacctcggtatttacctgtcataaaagttccatctatgcatagaacaggtcgacaatgcacaaaagcattgatgcaagcacccaatgagaaaaaggctctttgcaacacactctttgttcgatcatcaaccgatgtaaatgtatgtaggtcatagtatgtattattattcctctgggcaatggtggctaacaaacgaggcaaattatcataagaagcttcaaatgtgccatatctcatctcaatgatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaaggaaactgcccaatgcttcaccgcctccttcatctcatccttatgagcataccttgcaccctcaattacctcgttctccttatactcccagggtacatgatcaccctctgatataacaagtccagagaagtcctcatttgcccaatcagtggccattacatcaccttcctcatcggatgatgcgtcgtcgtccgcttcctcattatccgaatcttccctctccatttcatcaacaattataccgactctctccccctcatccgccatgcccatagcctgctcctcccttggttgattttcctcattttgcatcgatggtccaacaacatcccctgcattgataggaccctctacatcttcggtttgcattgaaacatttatatctttctcttgtaccgacacaaatataacgaggggccatgaccgttcaaaagccatttccacataccgtctccaagcatcagtgttgtccatcggcattagttcccaaaaataaccttctgttgcacgactcactacaactgacactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttacttaacattgtgcctgatgaaaacaataactgcgttaacctcgcatttctgtactacgccctaagttacattctctacaatattgttctctaaatttctaaaattacgttacattctccagatcaaactaaactacatcttacaattaacactactgtctatgtctcaattcatactattatattctatgctctggatctacacatatgtgttgtgtgctacagatgtgctaaaatatatggaactaaaactaaaacgcaacatatatactcaaacataacatattagtacaaatgcaaaagatgtatgggagcatacctgtgatgaattgagcgaaccagcagggcttcgccgctcctcttctgctgccctcccctctctctctttcgttttttttggatttttagtgaatataatgaaatttcacagaggagggactgggctttataggggggaggcaaaatcgccctcccccgcacagtataaaatcgccctagcggaggacggcaagggggccgcctgcaaatttcgttgacggccgtctgtcacgtcattttcgccgccctctgagagggcgatttttaaaaatcgccctcccagagggtggtaggggactacttccgtcaattttcaaaatggaaaattatttttgtaaaacttttaataaaaaaaattataaataaaaaaaattctgcctacctccagccaacccccctcctcccagggataaaaattgagcggacacggaccgataatgcttgtaccatattcgttttcattttttttatcggatatgaaaacgaatacggatagttcgaatacggaaacaaatacggattatctcgaatatgaataagaatcgaatataatcggacatgaatacggaaacaattttttctcgaaacacgaaaaccaactcaacttctaatagaaacaaatatcaacatatataattagctcattttatatatgaagtataatttataaatattttttagaatttaaataatattaatagtacactagtgttaagagataaactactattaaaatatataaatgttatagagttaaaaagaaatggggtatgtctcatggcttatgtggatatccaaatagcattgttcaccggatatccgaattattatctacagaagcggtaccacccattaggcggggttg

SEQ ID NO: 42339 - DNA, 6992 bp, Oryza sativa
cttgggctgcctaccaccacatccaatttgcaattagcccataaataagcagcccaactgtccaattttaatcctgcgtatgtgatgctttcctgagtcaattcctcgacactactcacccccgtcccctactatagttaggtgcctaatgtttttctctctctctcccttctaagcaaaataataattatcttattctgggtatgcgatatcttttcatatatttattttttaaaagatatctatcaactatgctttctgaattgactcatatttacaaattgatatgtttactagtatctttttatgtatgatgaatatggcgcaaaaattattactttattttaatatcatttttgttttttgtttgccttaatttattgattatactatatgtttatataacatataattacaacataaatatggtattttttgcgtttagttgttcttattgagaatagcatcttcgccccccatctttattttaatcctgcgtccgccactgattatccgtatctgatggaaacccaggtaccatatccgtattaatttgtatctgggagaaaatatccgtatttgtatccacatccgaactatccgagaaatatccaatctgaaaggtatcatatccgatcggaatatccgttttcatccctacccccaaaaatctctgccgcacgcagtgactcgtgcgtataaatggtttcacgtgtttaggagtgtgatgcgaggctgaaaacactctgtataaatggttgatactatatttttttagctgtactgacgttactattcaaactttctactaccactgtccattctagttctgtatcacatgtatgctttacactacatttttgggaccgatgtagtacttttttaggtataccgactgatagcactaactgcacataacggaggattggtattgagtagctcattgtcaagaattttatatatatatgtttttagcgatttaattgtatggtaaaaaataaatttcgataaaagtttttaatattttaattctggcaacggctgatgttaagtagcagtatttgcaaacgggagagatttttagaaggggtgacaggccgagatggggtcgtgccggcacggtgggccgtggaacaaaaggacttgtgcgcacaagttatgggctgtattttggagttggtccaaatggagtagcaaagctggcatggcgtctccctaggagttaaggtcggtagaactaataagtacggttccgactcggaccctgcactgcagcctagctacgtgtctactcctatataacctgtcacgatatagcacgggatcagcgcgatacgaattacgaaagcagaggagggaacccgattaatcaccgtgacacgtgggtagaacagaagacgggttcagagcgcagcatgtcatcacacggcgacggcggcggcggcggcggcgggaaacggcgcctgtacttggtgctggatgactccaagcacggctacggcttccgcagaatcgatatggacgagtactacttcgaagccgacgactccggcgacgacagcgcgttagagaggatgacggagtatctgccttcccgccggtgtctccgcgtgaaggcgccgcgtcatcaggcgatgctcttcaaggccctcggcaccaagatcatcgccacacacccgtcgcccacccgcgccgccatcccggcctacgatgcccgggcacaggcagtctccgcggcccagcttggccgccgggtgagggtgacagcacgctgccgtcttgctcgaccgtcttcgtccccgtcggcgacaggctgtacgccctggacggcggcggcgacagcggccgcgccgtcagcttccaggtgctcttcccgagcggcggcgacgggtggtggtcgtggagcagcgtcgcttcggcggcggcgccgccgttcgacccgtcgaggatcacgttctacgcggcgcaccccaacggccgcgccttcttcgtgtccgtggcgaggaaggacgtgcccttcttccccacgttgagccgtggctggccgtggctgcacgcgggctccaccttttggttcgacacggagagcttggagtggaccgactacggctgctggatgctgccgttccagggtcagggacactacgacgccgagctggacgcctgggttggcatctgccgccacccggacaagcccggccgcctctgctcgtccgacgtcccggccccgcgcatcagaggccgggacagcaggtggcgggtcccgtcgtgcaagatcggcaaggacgtcctcttctgcaaggacaaggagcggcaccgaggggtcgctctccactacatgggcagcgacagcaacttctgtctgctcgagtgcgtggagcagccggcggcgacggcgagtcggctcatgtacgtgcggatgttccgcctcaagtacggcaaagacggagggcttcggacggccacgctcggccgctggggccgctgcttccttctgcctcccgaggcttccagcttcgacgtgatggatcaaaagatcacggcgttcttgatgtgtataacttaattaattgtactactccagttgctattttctactccctccgttctatcaagattcgttgtactaattatatcccatccataatttaatctaaattttaggttgaccttttttttagaattaagggagtatataagattttatttgcacgtaattcgtatgagtgatcgattgctaaagagaacacgagtcgatattagttaggaatgacaaattgacaagtgattagtgtgcggtaggggtagatcggctcttatgcaggtcagcacggaatctagcattatttttacaccgtccaaaaaataataatattaactacatatataaacatattaatatgattggatgcaagggttggcactcaatatcgtgcacaacagataaatatggtacataatatggtacatgtctactggtatgactaggctgattcgacgagagagacgaacacggatatatatatataattcttgacaatgagctacttcctccgtcctataatatagcaacttaataccagataggacatttcatattacaatgaatctagacactcttctgtctagattcgatatactataaaatatccaatccaaatactaggttgctatattatgggacagagggagtactcaataacaatcctccgtgatgtgcagttactgctatcagtcggtatacctaaaaaagtatactacatcggtcccaaaatgtagtgtaactaagcatacatgtgatacagaaccagaatggacagtggtagtagaaagtttgaataggaacgtcagtacagctaaaaaaatatagtatcaaccatttatacagagtgttttcagcctcgcatcacactcttaaacacatgaaatcaatttttctaccacaagttatgagctaaagattgcatgatcagttaacaaaaacatggatgcaataacagaagtcttatagttatactactatattgcatatttcttcatgtaggctccattttttttctgccctggtccttttgtcagtagccgtcaaatacacaacgttgaaacaatgagctttgtagagcacagcggcagcagattacacttagtttgacgaaccacagcaaccttgcgaaacagatcggttacacaaattttaggattcaaaagcatggcttcacaaataatgaaataaaacatgtataaaaaagattgataaactaaacaatgaaataatctatctctgagcacagagatgtatatattaaagcaaaccaattcaaagataaaatataaaaagatttgactcatgatattgctttacctttgcatcgtgagcaatatacagttaggatatgtttaggaaaacattgccattgaacaagttgatgcgcaaactaaattgaaatgtacctttaaatgaaatttgtgtccgtttaaaagatgaacaggaaatcatctctccatgatggatccaatccatccattttctgttgcgacctaataaaaaaggaatatagaggtatgtcatgaagcatgaataaatcaaggttattctagagaccgaatgttttcaagactcaaaattggagtcatcttccttttaatgaaaatgatcgggtccgagacatatcctaaaagtgtgtatagtcataatctggagactggcaacaattacattttctttaaacaacatgttattcttttggtgctcatctttttttgtacagaaatatggcatcaaaggttgactcataacctctctaaaatttgctaagacattctataaaatctaaaaaaaaaaatgatgctgtgctacttaaaaaaaatgaacattctcttttgtacagagaatgtcctttccccatctaggcatttatctacagtgttcaagaagacgctagacgctagttgggcgggagggtggtgcctagcgcctagggccaactaggtggcgcctaggtctgactagggagggaggagtcagcaggcaacttgtatccaatggctaagccaatttatcaatttcatttatataacatagcaaattgcagcatgccaacagccaacttggagaaaatacatgtgtttaggatttgaatattttatattaccttttgtttgatggtgccaacatgccaaaggctgaacatagcaacttgcacctccaattccagggcttaggccttcagctcagtgaagaagctcatcatcaacaagcagcatgccagcaatgcaatggaaaaataatcatatagtcagttaagctagtataattaaaattgtcaacttttaagttggcaatagtgcaatacaaaaataagttggtaagagaaaatgtacctttatagctttggttccttggttgaatcaccactgtttccacaggactcaggacagtagtacaaatggttaaatacggtatcacctcaacaagaataaggtgcaagaagcaatgaaacattgaaggttgaagcagattatccaaaattcagaataattaacctacatatgccaaagcggaaaagccaaatagcagttctaatacaccatatcagcacaatgaaactaaaccagagttctcagtttctcaactctcacaagtcttggacaaaataagcatagtagaggaaacagaggtagccattaagcaagcaaaattgatatcattacatcaatcatcaaggattgagtcaatcttcatcctcctggtcataaactttagttggaacgatctcatccttgtcagactcaaagtcaataccctcttcattggcctcatcttcttctccagaattgaaatcatcttcatgaagctccctcactctagcactcctacgaggttgcatggctttagtagccccacttgcttcatagatgagactgaatggaagtcctgaaatgggatcaatatcttcctcatctccaccatcagtgatccacccttgcgcatgcgaatgcatctgtagctaggagcacatctttgttatttttccattgcgtttctcagcccttttcagcaaccttgcattgaattgaacatagactaagttgtttaggcgaccagccccaagcctatttctcttctttgtatgaacctatgattcagaagtgacgaagtaaatacttaattgaaagtagcaactaaacaaagtgctaactgcatctgcatgtaaggttgacaagttaccatatcaaaaatactccaattcctttcacaaccagaggaactatatgtcaaggagaggatccttatggccatcttttgcaaattaggaacatggcatccatatgctgcccaccagtcagctataagaagtatgatttatcatttaacaaatagtgaaataacgagttaatgacacagcaatgcaacatggaacaaatataatgcagattgtagttgcagcagaaaattaccaggagaaatgcgatttttgacatccagttccgcagcaggtttcccaaatgcccctagctagtccttaaacttgggaagttcattgatcacttgagcttgaagatcatcatcaccacataaaaggtttcaatacaatcaaagaaaccatccatgatagaaggatccaaaaagatagattgatcatggtaagtgtaataaggaatcaatatatatgctgtcaaatgcagtggagcatcaagcctaccctccatctttttagcaatatgttcaaagatgggattgtaggtgttctccaagttttttgcagctaccatgatttccttctttgcctctagaatttgtccacagatgaaggtcaggatagaccatcactattaaccatgtgaagtactttgactaatggctcaaaaacctgcaagagatgaaatagcacatgtcaattatgcaaatattgattgatcaacatgcaggacagcacatggtataaggttaggatgcttgtattaccttcaaacactgagaaacatcattccaaaaggtcctactcattagtgtagaggtagctatcttgccttttgctttttttagtgcgggtgcattgttcccacaatcccactccacactaagcgccattgcccttagctcacgcttcttctcaatcaagctttgcaaggttagaaatgctaaagcaaatctagtcacacccggccttatggtatctctcttcttcgtgtgcttcctcatcaaggccaatgtcttgtgatgtgaatagactttgcatggtataatgtggccaatatgttctttgatcctgcattttgtgaccacataataagcattggaccctatctttgtttgattcattgaatgttttgcctcattcccatcccatgtcattggagttcctctaatgaggatagggtacttctgttaccccagtaacactggtggttgatgagacaatttgcatatacaggaggaccaaaattagtaaattattgaacatctaaatctgagattatatcaatttcat

SEQ ID NO: 42340 - DNA, 4095 bp, Oryza sativa
  unsure (1)..(4095): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacagatacatacgacaacagcacaaactattagtacgacggcttgcagacaagcaatcgtgcaaccatccgaaatatcaaaaaccgagttacattgttatacatctctcagttacatcatgcatcgccgcgcagagttgctaaaaagatcgcttccttttcatctctgttccttgcacatgcaagccatcagagcaacagttatatatgttcaaggaggtatacagtcgagccctatgttgtcttcttgtttatagagctttgtctgaccaggctagcaatcgtcaacttgtgtgattcatcgtggcaccctcattattgcagcagtccacttctcttcccccaacccatggctactatgtacataaccgtgcagccagcaatggttcccaaagtggtttcccaaaatttcatgtttgatgctcgtttctcctcctcatttgtaggatcagcataaagcgatataccgatattcatcccaaaaagaccaacaacggccactccagcagtaatgacaacagttgcagtggagagcatgacccccatctgtagaagttgattttgcttgtcatccaacatgatgttgatataatcttctgtatcatcaacatactctctcagctgcaagcatagagaagaaacgtcaaatctcaactgcacataaaacaacatgaatttggtttataaaccctcaactgcacaactccctggaccagtttcccacagttgcatgcgatgctcatataggagaatcaaaataaatcattgtaaagaacctcccatgaaatcaggaaaaaaacagagcaaatgccaatggatccatgaaacgcaacgcacaaccttcctagcagcccaacataacatgcataaaacattataaaattgtagattcgttggtaatatacttgctgacaacaaataataggttgtaagaacactttggagcaatacaaggaacagggaaaggcaaagtcattacatgagatagcttattaagtgtgccatcaatttgaacaaagtaggcctccaaaagcatctccagttcttcaatgtgtggcttatagccaataaaggtaccattgcttacatctgcctcacttctataatcttcatccctacacagatataaaattatacatacacagagacaacaatggctgattatgggtggaagagacacaaatacatcctgttttattctttcaaggaaaatgtagacatgttgtgctctcatgacttacctatccacctccagttgagatgggtcatcaacctcaactctagatgaagtctcacttatttcttgtcgagtaagcttttctgtcaaatacatttcagccatgtccatttcatcatccaacaaatgctcaagttcatccctcacctataagaaataaatattttaacaagggtggaatgcattcagagaatgttgaaggaaataatattcagaagaaaggcaagcaagcttgagaggaaactatggaggacaacaaaagaccgatgcttgtgtgtgcatgcacatgcatgcgattgttgtgggctgcggttgttgtatttagcctttgggtgtaagtggtgtgggggaagtacttcacacaactatatgaaggttaaacaagtagtgttgcagccagcagaaggaaaaaaaaaaatcatgtttaataacacctgaccaattaggaagttcacacatttagcagttgcacttgatcaaaaaaatatgtttgatggcataaacatcagatacacactcagtgtttatctccaaaccatgagagcaacataaataagatttaacataggtaagaacgaaagaacctacaggtaggtgacatgaagtgtgattgaaaaggtacaatttcctaccttctgcacacgaccagagattgcaaccaggcggctcttaatttgcctaactcgctcaagatttagtgtgcttatctttgaagtcagctcatcaagtgccggatacgcctcttgctccagagtcgacgtctgaaggaggaaaaaggtcagacactataaacatcaagtaggctatgttttacaggttgtctggtttcataagatgcatgagtttctccataactaaggttcagaacacctctttcacagcgaatttgaagaaccatgcttcatcaaatttctatatgtctctcctaagggcttggcctcaagttaataaccacttaaccagcacatgtgaagataaattatctaatcttctatgtaaaaacaatgaccacttagttaccaaacaaccgaaaaatgtatcaaagctttttattaattcagttccatatatgcattctaaaacttcaccaaactttacatacaggtgattgcataagggaaagcacttacttcctcttctaggcttctacaggctgactcaaggcacacttcaagtgctcggaattcgaagggtaaaactttggtatttccatcttttgcagcagtcaatgtgggcatactgttgctgtgagtcattccgcctaccacattggaattcttgttagtcatctccaattcatttggtgtggttgaagtcagagcaggaaatggtgaagtaactgcagatgattcgccttccatatcagtaaattctgcagcctgataaagaagaaaagacatttagtgatataacccctaacacggtcagcacatagaagtaaaccatcatctattgttctgcctatgcattatcctggaccatttctccatatctatctgcacctgctaataaactttgtcttggttacgattacctcacaatggctactatcagtgtttgaggaagagggggggggggggggggagagataaacaatggctactacgcaaagttcattgagggaacacaacagaaattaacaagcatctacatgtgatctcgcaaatgtactcaagaagagtcaagatgagtagggccagcctgattgcaattctgataaactacaattaaaaaatatataattccacaaggtatgctgccgatatacagtaattcttatccactcgaaccactgctaccataccatacaactcctaaaacatacagtctataggcaaaactgcaaaagggcaaaatgattagaacccgtacaaggcagttcaatccaccataatctcggacctcataccacgattcttcatataaattagcaacagggagggagggaggaggagatgttggacctggtcggaggacgaggcgaggacgcgggcctgcaggtcgcagacaaagctcgcgaaggcggggtccttggagttcgggagcagcacctcggcggcggtgatcacggccttgacgcgctccaggttgacgacgatggcgcgctcgcgacccaggatcgtggaagggtacgacagcagcgggtccagcacccgcaggtcgcgcgccggcagccccgtccgcgccatcaccgcgtgcttcccggcctcctccacccgcgcctgccccgacgccggcacgaccagccactcccggctcgccgcggccgccgccgccgccgctttccgcctcccgccgccgccgccgccgccgcccgccgccgccgagggcctcatcctctctataccctagggttagggtttcgatcgacggaaaccgtggaaaggggggatgagttcgcgggagccggatgtcgggagatgcggcattcggcggtggttggctcaggagagacggattcgtggggagtaatacgcgatttagacaagggtgtttttggaaaattacaggatcgctggaaattgtggagatcagagtaagagtaagggtgtttttgcaaagtttttttgacatgagagttgaaagccat

SEQ ID NO: 42341 - DNA, 1353 bp, Oryza sativa
aataggtgcagtacgatgttagttacttgtaaaatatggggggggatggaatctagctgttggtcacgtatggatgctccaaataaagcaacggcaaagtttgccgtatcaccctgaaggcagaagatgccaacccgccacaatgcatcccaaacagctaggccttcacttcagcgacgtgggcgaaaaccaatcgacgcaccgggccatcacgctggcaggaatttttttttgcaaatgcgtagaagattgcaaattaatattaatatattagatgatgccccacgctttgctgcggtatatatatcagataatggagaaatgatgaaatgatttggattgaaatattataaaaataatttgagaataatgatttagcatgtgaatgttttgttttagaatgaaataaattgtagatataattaatatgtgcttgcacgttgagtttgtgtgcataatgggtttatatggcatgcttgcatgtagattttataggagtgctaataaatactatgtttgcatattgagctttaggtgtttagtggacaataactttatagaaagaagatattagaaagagagttcaattatacaccacaatcaaccatagagggtcattgtccgggaataaggataaagaaaaaaaaactgagttaaaactggacgctacttctatacaagagagaggggaggcggagccccactgcactcccaacaagtccccaaaagacgcggcgccagcagctgagcataggtgtttttttagaatggactcgagaaccaccgaaactggcgagagagagagagagtaatctaacatagagttccgatccttctacagctactaggagacgaggaggactaaggaatcaaaacccttgtgacaatactcaggcaaacagaccatagaggtcggcctccagacctgaagagaggagccacaggccctaaggtcttgtttaaagagtttaagattataaaaaagctgattagtagctacggaatctggttcgtagtttattttaaatttttgtaactacactttttaaaatttcgataaaagaattttgagtgcttgagagtgattttgattttgggagaagctgtaaatgacagaagcccttcacctttgaaagcctaagaaattttctgctaagttgttggagaaggtatgccaactgtgtacgtgaaatagagttccctttgtttttttttaaaaaaaagatagtgttccttcaccagaaatatcacaaaatatattagaagacttccaggattcaagacatgtttctgttttcagcttgataaaatagcacgaggtattgatgacatgctggatgtattgcatccaag

SEQ ID NO: 42342 - DNA, 33928 bp, Oryza sativa
  unsure (1)..(33928): unsure at all n locations
ggggacctcagagagatcttcctcacaagtccaaaaagaactcgcaagaacaaaggggtgtaagacactcaagcagcttggctgaaaaaaacattcaggttatcaaatcatcaaaagttgtttctgaaagcacataaggaatatttatactaggaacaaccctcctagataggtatgaaaagtcttgaaagaaggacatagactagcccaaaggcctcaacaagtgaatttccgagaagactcgcgcgtctgtttggcttatgagtagccttcagtaaaaaaaggtcgttactccttattggaaagtccaaatgacatggggtcagttgcgttggaaagctaacttaataagctttcacaccatgtgcataatgcactacgaaatattatagattgatacagttttgcatggaaagttaaatgtcatggcagactattggccttcggagcagtgtccactaatctggccataactctttagtggaaatccaatggacgagcggtttgttgggtgtgaaactagactcaataagctttccaaaaaaaaatgctcattcaccttcatagcttttgagaatcaaaagttatgacgatttcttaaactggtctgttttgaagttgaactggtccgtttttcactgtagcggtttgatcttcatggtccgattcagcttcctcttgttgcataatcctaagcgcaaccaaagtagaacatttaggtagtataacattctcatctatagatgcatcanatgtagcaaggagtgagttcacctgttgttgtagtttctgcgcacgactttgcgtaatcagtccttccattacttgatcatgtgtagcagtagttgaacttggtatagtcatgattgggatgtcctcatcagaaaactggcgactagcaagagacagcgacgcaggtgccgccggagtcagatgatgcacctagctagctagctgctgctggagaatggagatgatcgaaggaaatgaattgagaggatgaataaaagagaggatgagagatggacagctcaccgctctagctagctgcgcctgcgaccgcctcgtggcttcttactcatgcctctttctcaatatcacgcctataaaataaaattatttatgaaagcacccctaggtaagtattcataatttttgttccaaaaaaccttgacattttgaaatttcaagacatcatattcatagctcaactgacagtatgcataacatgcggaaggacacacctcctctacagtacttccaatgtaatagcagtggctgatacgggagtctgattccatatattagtgtctgcggacaatctcattgatacagtaggagtatacagctatatacaggttttagttctattcatttcatataattatgagctaaatatacgtgctttactgaacatagaataaaatttactataatattacataaaattcaaattcatcttaatttaattttatatgtcactgttttatttggatttgattgaattttaatatttaaaatgggtaatttataaattttactatgagagtaagtggagtaagtggaattttactataaaaatgggtaacgagcgtcactattttctctaaagaacatattcaccactcctaacaggatagttaaaatcacctaaaatgaaatgatgataatccacataacctaaaaaattctagcgattggatcaacataaagaaaaaaaaaggcatgaaaaagcatgctcacgtgtgtagcaaatgcgtgaaaattatttctatatatattttatatttttttacatgttctcaaataatataatattattaatagattttcttacactatttatagtaggatggccatagtcgcgtgaatgcgcgagtacaaagactagtatattgtgaactacttcaggtctaccttgtttggtttgaagcaatcagcgactcaaccaaatctttataattttaatgaaatttgattattaatataaacactattaatattgagtagtaaagactatgatgcttcctcattaaatgagagattgttaggagtgcatagatgatttaagatcaatagtaaaaagataaataaagatggttgatgggatagacaaaactctaggaatacttacatttcgatacaaattttaaagactatgatgctactaaaagaatccacaatgtgtgttttgtaggtactaattaagaaaatctttttcctaccagccggccgtatatattgggcggcatgggttatacgaaaaagctaaaataatcgttcttctcttgtgatccaatgctttaaattagtaataatattatttttaattgtttacaactgaagaggaaaaacgagagatcgtaagaggcctgagttcaattttttgtttagtacaactgaagagagaaaaaaccgtttacttttttcacattgtacgactttttaaaattatatattatcaatcatggaccacatagtgccacgagaaaataactatacattgcacgaatcttgctttgctaacccgcttttctttgatgcgtgttgctattacctcgcggtgaaactatacagtacgttttttctcctatctaatactccaacgggtttcaaaaaagaaactatatacggacgcccttaataatggcaaagttgacacactgttgcgacagcaaacctacttgcctgctactaccctgctactacgtatactgtactgtatacgtatatcaccagactgtagtctgtttattaatccgcacaaaaggaaaaggaaaactcagtcggccacacaccacgtagcgtcacatcatcctcatgtaacagcctagctacctcacacgacagtattggttttccggccgttttcgatcgcctgacgcccaggaaaaagccgctattcctgtgaggccctgacgccgaccgaaactccggtacagcatatgagaacaaccacctaaccacccttcatccatccggttaaggcaatcatgcaagaagcaaacaaaaaatccgtttatgcctctgtttaaattggtgaatgtactgtgatagccagctattaaactaactcatgccgtaattaatatgggacaaattaagtatttcatagaaattcttatatattttagtttggaataaatttaagtgatagaagtccttatatttgaccacaacagcagacgacgtcacaacggcagctaatgcttctttctttgagagagagagagcggcacagcggctacagctagtgcgagccacgggtgcatatgcgaccgagctacaatgccgtcgaattcagctcatgtttccttccacctttttaatttctttaatttgcatgtctctccatcactaccaaattcggctgatcattcatgctttccattgatcccttctatatatatatgtatgaagtgtgcgtgtgtgagagagtgtgtatgtatcagtttgattgcatatgaaatggctgcttcatcgctcgacgccgaggcagcagctgcaggccaacaagacaaggccggcagcggcagctacaccactgcagccactgctcatcaaatagacacaggtgcaagcatatccatggtgatcgatgaacaaaccagcaattcttgatcttatccgttcgatttatagcaacaagaagcatcaggatccacgcattcttgacacatatattgaattgttaattattgatcggttttagtttaatcgttggacatgtacacatgtgcatgcagattcatggcagcaggtaggggtgctgctggtggtggggttcaactgcgcctacgtgctgagcttctccaacctgatgatggcgccgctgggttgggggtggggcatcgcctgcctgctgttcatcggcgccgcctcctggtacgccaattggctcctcgccggcctccatgtcatcgacggccagaggttcatccgctacagggacctcatgggcttcgtcttcggtgcgtttcatgtcagagaaattgggttgattaattagtgagatgaatagatgattaagttagctggaggctgaaaatgcagctgacgaaccttgttaatttacacggttttgtttgttttgtgaagggaggaaaatgtactacatcacttggttcctgcagttcatcaccctgatactcggaaacatgggcttcattctgctaggcggaagagcactcaaggtacaaaatttgctgttaattgtatcgaatatccgattagctgtctatctatgaccaattgtaagctcgcagtttagttagccgatttagttattcatttttttttcactgcaacctgcaggcgatacatgcggagttcagcagcagccactcaccggcgaggctccagtggttcatcgctgcaaccggattcgtctacttcgccttcgcctacttcgtgccgaccatttccgccatgaggaactggctggccacgtccgccgcactgaccgtcgcctacgacgtcgccctcattgtcatcctaatcaaagacggtaatcactaatcactacagtatagtactacatgtctcaagtattctctgttgcggtgctctataatagtagaaaacaatctaaacagttaatcttatttgatcaaatggttcatatttacattatcaccttattagttagtaatagaaacatgaagagatattattatctaagaaaaatatgtgcggagagatataattgtcattagcagtgactaaactacagtaacataaattaattatagttattactattattaatcatggtattagtaaattactaatttacccctaataatactctcagcagagaacatcggagtattaatctttgatttgatcatacatgttcatgcagcatctgatcgatcgaacaggatttatatgttttttttggtttcgcatttagggaaatcgaacaagcagaaggactacaatgtccacgggacgcaggcagagaaggtgttcggcgcgttcggcgccatcgcggccatcctcgtgtgcaacacctccgggctgctgccggagatacagtcgacgctgcggaagccggtggtgtccaacatgcggcgggcgctgctgctgcagtacacggccggggcggcggtgtactacgggatcagcgtggccggctactgggcgtacggcgccgccgtgtcggagtacctccccgaccagctcagcgggcccagctgggccaccgtcctcatcaacgccaccgccttcctccagagcatcgtctcgcagcacgtacatatatcatataccacattcttctcctcctccccgttgatggcgtgagagctcagcctagaacaaattaattaagctttaagcggattgatacattttagaaacgtggagcaaataatccatattaacaattcgacaaataatatgaaaagaagccataatgatgtagaacgaaaaaggtgtaagattggttgagtattattcactaaaaaaatttaaaaaatatttatttaatttttaaagcattttttaaaaaaatattttcacaaaaaatattgtttaacggtttgaaaaatatgctaataacaaaattgtagagtaactaagttgaattttagctctttagggtagggcgtttaatttgccgtggattaatgcgtgcgtgcgtgcgggtggcgcagctgttcacggtgccgatacacgaggcgctggacacgcagatgcagaggctggacgaagggatgttctcgcggtacaacctcgggaggcggctgctggcgagggggctcgtgttcggagccaacgccttcgtcaccgcgctcttccccttcatgggcgacttcgtcaacctcttcggctccttcgtcctcttccctctcaccttcatgttccccagcatggtcgtcctcaaggtatgacgacacatttctgttgagaaattgatagcactataattctatcaagatcatgatggatggatggatggatggaatggtgatgtgcagatcaaagggaaggatgaagcagggagatggaacaggatttggcactggggcatcatcgtcgcctcctccgtcctcagcgtcgtcaccaccgccgccgccgtccgtctcatcgtccacaacgccagcgtctaccatttcttcgcggacatgtaatcaatcgacgccggagattaccatttgcaccgtcgattaccatttgcaagtgcagtgtgctgtgatcagccgggtttagagctttgcattcttccattaaggatgagattgcaagcgcagcgctgtgattagcgggtttacagctttgcattcttccgtaaggattatatcatctttgacgaacacattggacctaaccaatgttaagctatgccaacctattacacttgacgccgaacacgatattatttttaccgaggacggcatgataccagtgtaacatagttgaggcaatttgcaggtatgccggcatcagaacaaaagcaggggacaaattcactagaaaaaatggcaccaaaaaaagtcactttcaatcatatacgaaaactgcaaatctttacaaaaacgcatgaataaacaaacaaatcttgcatgaagacggcactggaaaacgaatcctctaaaacttatgtcggccacggtgacgaaaccaacatcgcgatatgtacaaatgttcgactaatcagacagactcctgttcgatccatcaggatttctccttttctttcttttcttcaattcgttagaatattttatcaacccacttcttgcactggagttcggatcattcctagtgggtttcaatacttgagacatcccctgctccacaatcttggagcagtggattgctggccttgcgatccttgtcgatgcaaacccagtacttaacgggcttgtctgcaagccgttcaaaggctttgcatggattgcacttgaagcatccaatacaatccatcgcccaatgtgacacaaggtggtctccagtatgccacccattcgcaaatgatccaaactgccattgctagtatagctttattcttgtggagattggactgcgacatattgggcacgattcgaggctctgcccacaatcacagcaggtctgcaaaattatatactttgttagaaaaggatgctgacgctgacgtttcaacaagcccacaaaagcagaaaatgacacccccaagaagcaagaaaacactgaatctagcaagagggtgaatgtctcacctggtgtccgcagccaaacgccatgtctttggggttcacaaggcagattgggcaaacctacaggagaaaaagaattatttaagacacaaaattatgcaaatgcctgccttaagaaacaagcaacagatagcatgttgtcaccgcacgcgaaggtatacctgattgtcataagtagaagaaggtacagcagggctcgaactctgtgcagtttcatagtgaggatatgacgatgatgatgtactactctgtgggtaggtacttggtttactaaagctttttgatccatacgagtaagcatcatggcttccaccagggggagggagaggaaccctttcaggcgacttgaaagagcgacgactgatgccacatcaatattaattttagtcagaatactacagaatgaatcaataattcaacagatcaaagcattagagtaataacgtgttaggggcgtaccctaaaattcctaattcaacagttgctttgtattgctgaggtatctccatcaaggctgaaagtgcaaatgctgcctctttccttgattggggcatgtttttgttcatgatctccgaaaaattcacaaactacacagataatagatcctcagtaaggagtaacaaaaatttcatctaccatatacaaacatgcctacatgggttcattagggttctcagtgacttacttgaaaattgtcaaaagcacgagaaggaatgttgtcgtcaaactctttcatcatgtcccaagggccatcaccaactcctactagcacaatagacaacggcaattcactgcagacgaaaaccagaaagcaaaacatcagcaacatccatgacagaggcaacgcaaactatgtgaacatataaagtaatcgccacaaaaacaggagtcaaaatgcatgggagttacaggcggtatgagcatatcaaaacaatgtaaaaaaggaacttatgaagtacgaacctagctctcacaatagcatcaacagtcttttgctcttgtgaactcagctgcccagatgcagtgtctacactccttgtaacctgtgataatatgacagctaataaggtataaagaaaatgaatgtctagtcgttaggttggtccaacatgtagaacaagcttcaaactaagaataacctcaaataaaaaattgctcgactaaggatcatgtaggacagagtatcaaatgacattacaacatgcttcagatggaacacaagtggacatagaacatgccatttctaatcctcaaattcaacagtccaccgatcccagcacgtgaaactccatatatgaaaaacatgttttgtcattcaaagctttaaaatagtgaactgaaaacaacgattcatatggggaaaacaaaatttcagcatgaatgttttatttaacaaaaaaaatatttccctttgtgtgttttacacagtacctgcccatcagcaattatcaacagaacatggtactgcccgccactttgttccacgatggtcattgccatctcaatgattggtgcaaaggatgttggtcctgttcaaaaaacaacattccaagtatgaattaacagtatagaaccagcataagaggcatcactgggcaacatcagcttaccagctaagcgcaagtgtggaacaagttccctgtaccggcttagagcttctgagaatccattgcaaggtctcaaatcaggataaaaacagaagacgtcttggtcatgtgttgttgctgaaaaaacacacccagttgaattatgattggacaaattataatatagtgcgagaaatggtcagctaatgaatagaatcgctaccatctccaaatccaaaacagggaatcaagttatcttcatcaaatttcgacagtgtctgtccaatgatcgagattgcttgttcatacggattaggtgcattgctaatgtgatgtaaactgcgtccatggaaggaaaattttcctgtaaatgaaaacaaaccataagcatcaaggggcaatgcaacacaaaagactgataagaaaataaaccaaacaacgatttgttagtactaacctaaccattcattgctctttgtgaaatcaatgccaacaataagattcgaagactcaagtcctgcttgagctagtgcatcagtaacctgcaattaatattaatcctgagcaaaccaattcatgggaataatagcaacacaatagaaactggattgtttgcttatgtgcctgattcttatactaatggttatgaggccagaatacagaaatgttagaaaagtttaaatacaacatatgaaacaacttttaccgataaacaactaattgtgaacaatagcgtaatgtgctacgcaaaaaataaaaaaaaaacattcagaaaacttagacatggagttagtaatgtaagcagaaaattggaagtgtgaaacattaaactggtggaccagtttatcccaccaataaaaataaacatcctccaattgccgcattttggacattgaggcaaggagcattcaggaagtacagaggccagactcaattgattaatgctaatttgcgtactcataagatctttgagaattgagaagaccaagcaaaagagaccaactacaaccaataatgatggttggccgaaagctggagccgccaataatgcccaacctcacaacaaacatttttttttaattcttcatcaacagtgattggcagttgaccagcaggcttaacgagtcgtctccttctgatttttgcacaaacatcaattcgatccaccactacagatcatcctaatctgaagtttcaagtggctacagctacagattgaccaactatgaagtgcaaatcggtaacgagcgattcgctaacaatcctaagatggaaaaacaaaaaaccgcgattaagggagaaaggcctacacgagcgggttcgaatcaaccaaatccgatgctccgaaaagcaggatcgaatatccaaattccacacgaatctacagaaccgcaggatatgatgctcgggcagatacctgatccacggagtggtagtcgtcggcgatccgcgagtagcggcggtcgaggcgcggcttggacgcgccccccgcccgggccggcggctgcgtcgccgctggggacggcatcggcggcggcggctgctgataagccgggtacggcgccgcgtatcccccttgcggcgccggcgcgccgtagtagcctcctccatgcgcatcctgcccatagggatacccaccgccgccgccgccgccgccgccaccgccaccgccccactgctgctggaacgacggcgagtggccgtacctcccgtggccgctcccgtcccgcgggctcctcgactggccccctcccatctcaactagatcgaccaaggaaaaaaatccaacaaaaccaaccaaccaaccgatcgatcgatcaaccaagcccgcgacgcggggggcgtatatctcctcgtgcgcgacgcggaggcggcgggggaacgacgacgacgaccaaggtgagtacgcaacgcaaccgctcgcggcgccgcctttgcggtttatttttcgggagaggcgcggcgaggcttcggggctccttccttcgcgttgcgtcgccgcttgggacttgggaggcgtgagctggtggtggtttggctgcttctgcagtgccacggcctcacgggtgcaactgtgcaaggaaggaaagacagtagtttggatttactccggtatatatacaacgcgtgttcgatccaatcaccacacggtccacaccgcatttggattggagttggagtttttcctcgtcaaactcctcacgtgcgggaaaacttcacccaggtttaacttcaccgcgtttaacgtacaatagcattgggaatctgtttcagggcctgtttgaaattttttgagtggattgctagaacatattatttatattttattaacatggtaaattagtattttataaaaaataaaattcacaaacaacttataaaaagtggcctatacattgccgcgaagaaattttatgaagaaatttttttaaaaaaccgtaaagcaaataatctaggacaaaaatcaagaaaaaattgaaaagaacaggggggcatgttaggaattttttttggtggcagttgaaaacttgaagtgttggatttattggactgggaatccaatgatggggaattggacataccatgggcactcattaaaaggcaaatgacttttgtgggagccatgtgatgctgacattgtacacattttatcaccaggtgggcgggccgcagaggtaaccgtgatcttaatagattagctaggaaaagtgttaatagaggttgctcgggcttgaatggaatgtttgtagtcttctaatcactactacgcgtaaaaaaccgtaaaattcatactccctccatcctaaaatataatgatttttatgtagtgtttagtcaaccatttttaactttaactattaataaaaaaaatattactagatttattattaaaaaaactatcataatatgcaactctttttatttttttaaaaaaaatcttatttttacagatattgttggtcaaagtagcatatcgaagactataccgaagtccaaaaatacttatattttagaacggagtgagtaacgttttactacaattgttttggctaaactattagaatatgttgtgactctagatatagtattttagattagataaattttgctatggtgcatttaaaatctgtatattttactggtatacatcataaaaacgtgtcaatattgaaagacaccttaaaaaaataataatttgttggacacactttcggtataattaaagagagaaaatctttgaatagatcataatacctctagtgccacaaactttctaacacagtgttgaagtgaaaatttgctttcagattattgcaatgtagcacatggttttattggaaaactgtaacttccctcatagtctattaaaaatattaatggatgttggatgaaactgagtttatgactattattcaagggtacaaataatcaaatacaaatattagaaagttaataaaatgattctaaaaggttttctaagaaataatgatgaagttttttaataaaaaaatcacatcatttaagatgttttagaaagtgtggtcgtggtaattcagtggatgtaatcgaaaaagaatgacttcatataaatatatgtcatattgtttgtgggatcgcggttattgataaagttgtcaactttgttacgttttcctcaaatatctcaataaaaagtagtgagcaataatttattcagaaacaattgcagtcttgttatattttagatagactccgtatgtaggctttttatggttataattagtcaatgtcatggtttgtacaaattcctcatccgccatttttttttatatttaagatgttcttggcatgatgttataatatatttgatttggcatcatttctttagaaccccaagacatggtctgtaaatttaccttatgatgttatgtatttgatacacatgaggtaccttgttgaagccttggggagataattcattcaaaaccccgcacaaaaaagctaaatctatcactcaattttgtgcatataccacttcacaacctaattgatagttatagaagtttttttaataaaaattccgtgccaataccacttcacaacctaattgatagatgtagcatttttttaaataatgaaatgaatatttcagttgttgtaaccgtccatcctatagaaccgtgtagctcaaaccatccgatagacggacccacttatacatagtaccctgcttacactttcgttctctgtgtataagaattaacccataagtggtatggttggagcgactcgttggttccactttttctcaactagcaagcaatgtagtactaatcaagtgcacatgtcactcatgtgctacataggccgcatcctaattgaattagaatgtcacaactgcactaggatatgcacaaagatattcttagctaatatgtcatttaagatttataaatatatacacacatgtaatatgtgtatgtagtgaattgcttagattgccttgctgacgagccaatacaattggatcacattacacatcaattgtaatacacgtttcagtaagtgtcaataaacgcatttgagtggtcatatatgttgaggaattacatatttaagaacctgtccattattataaaaaaacatatttaagaacctaatctcaagaacttcttcaagttattgcaaatggccacatgctaccactaactattggtccaagcaaataattaaccgcctaatataatgattacttcaacgttccatggcaagttggccgattgtactaaattaaaatatgtaccaagtgcagtggactaaattacgatagataaggtatgcttaaatgtttagtttgatgtcatttgaatcgttgaatgggccttaaataaagagtttcttaaggctacgatacactaacttagttttatttttacaggtgcatcggctatatatgcatgttatccaaaaaattctccagccattatatcacacttaaggccttttctttttaccttattcaatcaccggatactcgttccgtgctttaaaaaaattttcttctactgcattacttaaaccacttattttaaaaagttatgtattatgtttatgttttaaaaatatagtttatccgtataataaagtcgatagccagcactgtacgtaataatttgctcaatactctaaattaaacaaaaactacttgagattaaccatccattgggctacatcccatttgatactttgcaagtgaagaatatataattgactttacctacaacacactagtccactctaaaggaaaataaataagtagattcgcgggactgcccgcttgcaccacctccaccaccaccggccagatttcgttgaagactatatgtgttatgcagtcttcaacgacaacggatttatcaagtcgtgttagtaataaaccggtaaagtggttggcattttccttgatatacacctcattaattataaaacacaaagtggtagttctacaataatgaatgatatcgacaagctatccactggctatatatatcaatatatgtgaattcgcaatgtatttgtacgctagctagtggcgatatgatatatattaacatgatgatatatacttaactcagaagaaaccaaaagggtttgcctgctaatcaaggttagcagccagctgggaaaccaatcggtcatttcgaacgaaattgatcatcatatattcatatatatactgatcgatatacacctgaatcgtcatcttcaccgggttggcgcagccggaagtattttattgctgcttttttggtgttgacgttaattggatttgaaccccaggattacgtgctggaccggattaagtaacaccaaacacatctcgtcagtccttaatttatacggcccattttgctaatcacattagctgccttgctctatcggttaattaatgctgactaattgccaggttgcaggactaggggtcaaatggttagtaggagaaggaagcgcggggtgaagacgaagacgaggaagaaattaggccgaaccatcctaatttgcaaattgtccactatggtaattattttgttggagtactaaaagttcggcaaacggcaatactagggttgtgtttagatccaaagtttggatccaaacttcagtcctttccatcacatcaacttgtcatacacacacaacttttcagtcacatcatctctaatttcaaccaaaattcaaactttgcactgatctaaacacagcctagcttacgagttgcaaaacgcgaaacccattccacaaaggaaaatgggtacgtaaaagcgccatccttttctcgatggcttagctaccagaaatacagtttctagattggctgatttgcctagtactcgtctcaaggctttaacaaaaatagcatttgaacaaagatggacgaaacgtacgtgtcaatatgtcatacggagtgatggcatacttcctccggttttattttaattaacgctttagacaatgacacgctttacaagatatacctttaaccttatttttttattataatatatacaataaataaatgcatgtatatttttattatagtgttttaaaagacaaatttatagttttttaaactaaatatttttaaagttattgataattaaagttataaaagtttaaccttaacattgtccaaaatattaattaatatagaaaccgagggagtatatacgtatatatatcgagaaaaagaccttttcaaacttgccagggacgacgcgccgtctactactctaccactcgtgtctctcgggtttggattagtttgctgtgtttgcgtgcgtgcgtgcgacgcgcgaggccaagaccgccaaacaggaagccaacttccccgcgaagcgacgcgtgcgtggctggctgccgcctggtgctttcaactccctccgtaaaaaaaaaaaaataaaccgtaggttttcgtaccaatgtttgactgtccatcttatatgaaattttttaataattagtatttttattgttgttagatgataaaatatgattaatactttatgcgtaacttatctttttaatttttttcataatttttttaaataagacggacggtcaaacgttggatatggaaaccaaggtttgtcttttttttttttacggagtgagtagccatctaggcggagtatatgactctatgaccagcaaccagacgtccagatgtgttcgcgtagcaaaggtcagatttcggttggttgtatgtacttgtatgacgaccctgtcctgatattgatggcgaagtgaattgccgtgaagcctctcaaatgaggaggagagtttacctagtcggctggtccatgtataaactgtatgcatatatgtcactatcattagaatgttctgagtctgtgtctacgttaaacttatgacttatcacaatcgacaggcgtagctgtcaaatttccaattttcttttccggtgaggaactgaggattatacgaggtcatgactcatgagttttttttttcacattttatcggaatgacactaacattacaggcactaatgtatagggcaatagtaggttggaactcgcataccagtaactataatagtaatgacattatggtagacgatcctcacccggattttgtttgggcgagaaattggattaaaccagagattttgttatacatttgtcgataaattttcttctaaaattttgacagatgtaaatataatacaatcgtaatgtaattaattacattgtaactggtaagtaactataatataactcgtatgcaacttcgtaaagttttaaacattagatttgctttagaatttgtgcaagcgaggaagaaaagaatcacagttggcgcctatgtgagaagattaggtcccatgacctccgtttcacactaatagcatgttacctagagaattttgaaagttatatacaaattagattatagttacatgcaagttacaatgtaattacattatgattatactatatttacatatatcaaatttcttcgtttaaatttgacgacaaatagagtaaaatgtattcaaggtgagtcaacttggcaggtgagtgcaaattggtgcaacaacttgagaaataaacgtcatagtgcaacaacttggcagatgggtgcaatttagcgtaagaactttataattgaatgtataagtcataacaactttcaaggtgggtccagttttgatacaataagtagaagtgacgcgacaaataattattttgagatttttctatacaaattcaattttacgtacttatactaatgcaaatttgtgtaagcatatttaaatttttattctaataactgaaagtcaactaaattttactaagtataaaaatattatatttcggttgagatttgagaaggtgaagaaaacaaaatccaaaccgttggtgcaaattggttgtggaacttaattcttatggtcgagttcaagattataaggtaatatttgtaagattgctatatgagagcatattgattcagtgaaaaaaattatctaacactcatttaccagaacaacatatactttgctaagttgttgtaccaaaaaattaataaattgtatttgtattagaatacacccacttaccaagtaattacacttggacgttcaattatcaattttttatactatatcgtatctatctaccaagttgctagatcatgtgtaataatttactacgatgaaccttgttggcttgtactccctctgtcttaaaaaaatgaatctagtactggatatgacatattctagtacaacgaatttaagattataggtatgtctagatttgtagtgttaggatgcaggttagttttttatgggacggaggaagtatggtttaatatatttgggccgatttcaacccatcagatttgggctaatctttcaaaagagaacttatgggctctctcccttcagtttatgggccttccacagtaaaaagccttgtgctcttttccacttcgtcttcctcctgcgaacagtccaacccctccgcctccgcctctgcagtccgccgccggcggccggcggatggccgcctcccgccgcctcgcgcgaaagctcccgtctctcatctccaagcaccagcgcctcatctcgccggagatcgatgtcgagcaagccgccgagagccccgcgtcgtcgtcgtccatcccgctcgacccctccctgcccattctcccgctcgccgtctcccacctctcgccgccgagccctctcccggcgctcccctcggtgcacgcgtccaccccggccgcgctcctccgcatcctccgccgcgcgcggcaccacccgcgcctggcggcgctcgacctccacctcctcctcgcggccgcgtccgactccccggccttccgccccgaccaccgcctcacgtcactgctcgcctcccgcctcgcggaatcccgccgcctcccctcgctccgccgcctcctcgagctcgtcctcttccgcccctgcccctgcaccgacgactccatcttcgcctgccccgagctcctccccacattccgcaaggccatcctcgccttcgccgcctccggcgacatccccgccgcgtctgacgccctcgcgtccctccgccgcgccgctgattcacctctccccgccgaattctacaacatcatcctccacgcactcgcccgcctccgccgccacgaagacaccgtccgcttctacggcgagatgacctccacccaccgcgtccatccggatgtctacaccttcaacattctcatcaacagctcctgccgcgctgaaggcgttgatgctgcgatgcgctggtttcaggagatgcgacgttggagctgttcaccgactggtgtgagtttcaatactctgatgcgtgggttcttcagagaaggaaggtgcaaggagggcattaaggttgcacgcgagatgcttcagcttggatttgggctatcggttgcatccatggagatcatgatcaatgggttgtgccgtggtggggagcctctgaaggcggccgaggttttcatcgagtttttggtcgatggagtggtgccggaagggtttgattgcttggatctggttgagtctctgtgccgtgttcggaatgtggagaaagcagtggaagtggtggagttgatactggaaaggaattgggtatcctgcttgggtgtccctgctggtgtaacggttttggagtgcctgatgaaggaggggaagctggacaaagcatgccagatgatggggaggatggttgctgcggagatagttccggataccatttcttgtaactatatttttgaggcgctctgtgaagctgggaggacagtggacgcaaacaggctgaggctgcaggctaaagagaaaggttttcaggctgatggctttacatacagcatcattgtgcagggctttgggaggcagggaataaggaaagagggggaggctgtattggatgaaatgctggatgcaggatatgtaccaaacattgcgacttacaataggctgcttgatggcttacacatggggagatctatgcaattacaacaaaaatgttcaaggcataggaatgcagcaaactgaaagaatatcatagagatgaagaagctagcttggatttcagagagatgctagatgataccttctcaattgctctgatacaggttagaattttgccaaggatttgaactgaagcgtttctgattatacttttccactgcaaattactaatctcgattgcgtcacccttatgcattcttagtaaaagtgcctctatatcttctccacaggctctttcatgtgtgatgttaatcatatctggctatcggcaaacaaattgagtatttttatctatcttcatgcacattttatgtttattctgttaatcactttgcttagattcctagtaaggccttctatggaacaaaggaaaaaaaaggttgtcagggttgtttaatttatattatcttaggttgtaatgttttatctgtataccgtccagtggtcagttttaggtttttacacagatgcagcctagataaaccagaatttgctaaagaaagttaaatctgattttttaatagtgacgttgagcattggttttgtaattacttcatttacctcccggcgtaattacttcatttacctgttttgagtaccacttggattttttttcagggatcataaaccacatttttatagcatttttatgcatgtctctatcagtaaatttggtatggatttgaaatgtatcatcccctcagttatcttggctccaagaactgaataggaataactttgtaggaaccttgcctaagcaacgaagggtcaaatatttcatgaactcgtccttttcttttcaggagcttgagatcagagatcaatcagcaccggtctgccacagcaaccatccaagcctgagctgcgcgtggccactgccaaacgagttgcaactgcactaggccgaggttgcctatccggtcctgtttcagcccccagaacaccaccaccacctcatgctgctctgctcactgctattctcttggagcaggaggctgccgttgagttgctgctcaggatttccagtaagatgtttccttgcgaacacgctggcggtggtggcaatgtggattcagtcatcaatgatgggaaattgggaacgacatcagaggcaacaagtactgaactctgcaagagcctcagaattttctgaagggaaaggatgtgaggatggtatcttgtgcctgtgaatgtgacaagcaatgaagcaaatccctggaagttttgacatcggcttcacccaaaaacccgttgtcacatcaggtaccaaaaagttttggcaaatatattacaagatgatcttgtcaatctttcatatgttggatagaaatgctttaattttggtcgcttcagagatcatgcatctacttgtgacgttggctggcatgcatggctatttggtcatattggttatgtgtactttcggtggttgagcatttcattcaattatcatttttagattattgttgttctaacatatgcagaaattctgaagtagagcaaagtattcttgttttcatctattaggaggtatactcaaaattcgttcatttcagcttacaagttttgagtacatgcatgaacccttgggatttatctccacagagaattgacatcttctgattccgaaatcccaaccaaacttcttaaactggatttgactaacttgaaattcttcagtagtttaccgagccacatttactctggaacattggtcgatgcatacaaatactctgttttacttcatatttacacattttgtcaagtagagcaaccaatattctaccagatatccctaattcgttctaatatacccgtgaaatgcaatcgatgagcagcaaaagggtcagcaccgcgagcgtcgcagtgcgccgctcggcggcgggtcgagccagagcgtgcactgcggcttgacccagtatctgtacctgaagaaccaccggtcgaagttgagctgcgtgcggaaccggccggcgagccgcagcgccaccggcctgccgcccttggccgtcgcgttccgccacaaggccgcgtcctgccgcgtcacggacacactgctgaccaccaggtgcactctccggggcacgctgccgccgggcgccacctgcactggcgccggccacaccgcctgcgcggcgaccacgctgtcctcgaagtagaggtcgaaccgcacgtagcgcagcacgatgccgatcttggtgttggggttggagatggcggcgaggacggtgaggttggcgctgatcgcccgccgcgcgctgtcgccgcgctttgtcgatgtgcgccgctgcgttcagggtggcggaggtcactctcagccggggtgacttggggtggtaggcgagggagacggcgacggtggccaggcagacggcgatgatcagaagcaatacgtggatgtagaacaggatgtggcagaacgccagcggcttcctcttcattttgatctgatagtggagactcggtgtcagcggccgtgctgcgccgtcgccgtcgcccgggtgcgccgccggtgcgcacggttgtcttcgggatggtgatagtcctggctggccgttctccggctagcaccactaccggcgtcttctctgcctgctgctgttcttccggcgcggctgcgcgcggtggcgccgcggcgtgacgctgcttcttcttctcctcctcctcctccacccttctctgccacaaaggcacataggacggccgtcgcggcggcgcgtgcttctgccacggcttcgtcgcggggcgcgacgccatgccggaagcattcgtcttggtgtctcggctcgccgccgccgcccgcatgtggcgccaacgggcggttgcccatggctcggcaaggccacacacgtacgtgaaaggagcacgaaacggagtagctagtcagtgtccttgaatttatgggacgaggaagaagcgagaattttggagggaaaaggagaagaaatgagaattttggagggaaagggagagaaggaaggtatccttgcttatacagtggtagtggtactgactagtaggtggtagccaaggaatttttcgctggcttggcaagcgagcttacttccatttttctgaaaaggaacagagagcttccttcattgccacctattccaaaactagctcattaatccagcagagaaatcactctgtaacacatcaggtaacagaaggttttggcaaatattgtccaagatgatattgtcagtcatcctaatgttagagactttctgtttcatgcacttgagcagatcaaccccatccttgtgaagcattgcgtcttcaatgtaccgatatcgtgatcacatagattctattcatttcagcctaagtttcgagtacttcacggcttcaccggctcctggatttatctccaaggcaaaactgacatttgctgattcccaagatccttaaaccggtaatcactaacgtttaaatttgcaaaagtttatcatggaaaaacttgcacatttttgtcaagtagagcagccaaatattctttgcttgccatctctaattaactctatccttggttccataatcccattcgagcagcaaaaattgcagaagaattcaaattaattcaatcaaaaaatagctaatcgaagataatagaccagtagtttgtagtttgctcttctaggctgatgaaaacgaccagaaattaagcagattgacgcagcagcagggggacgaacgcgcggggtcagctgcaccgcgcgcgacgcagcgcgccgctgggcggcgggtcgagccagagcgtgcactgcggcgagacccagtagttgaacttgaaccaccggccgaagatgagccgcgcgcggaagcgtccggcgaggtgcagcaccacgggcccgcccttgctcgttgcgttctgccactcgtacacgtcctcctgcgtcatggtgacctcgctgacgacgaggtggacgctccggagcacgctgccgcgggggccctcgtgcagcggcgccggccacaccgcctgcgtcccgatcatgctgccctggaagtagaggtccagctgcatgtagcggagcacgacgtggagcttggtgttggggttgtagatggcggcgaggacggtgaggtcggcgttgagcgcgcgcgcgccgccgacgatgccgagctcgtcgacgtacccggcgttcagggtggcggaggtcacccgcatcctgggcgactgcgggtggtagatgaggaagatgacgagcacggcggcgccaacggcgatgaccagcagccagaagaggatgcagcacgcggtgaagcagaacgccaccggccgcctcttcttgtcgttccgagggcgcagcatcggcgacttggccggcgtccgcgccggtgcctccgacgatggcgatggcgatgcgtacgacccaggctcattgtgcggccgccatggtgacggagagctgcggcccggcagcgccggtgtccccggcgacgtgcgcggatgtcgcgccgccgttgcgaacccaggctcatcttgtggtggccgggcggccgggaaggtgcggcccggcggcgccggttcggccgggtaggtgacgccgtcgtcctcgtctctgatcgtgctggtgcgctcgatactcttatgggtgtctaagatcttcgccggctttaatcctggtggtcctaaccgcggctcctgcggttcttccggcacggcggcgggcggtgctgggtggccagcaggcgccgaccatggcgtccggccatggctaccctcctccgcccttctcagccgcgcaggcaggtaggacggcttcttccctggcctcctcgccagggcggcttcctccccggcgacggcgtcgccgtgaaccggcgattgcggcacttccgttacttgggtcacgaaacgagtgcgtcggtccggacgggcgctggtaccggcgccaccgtcgcccggcgccacggcgtgccgtacgccatggacgatctcttcttggcgacgctcctgcggcggcgcgtgcgtctgcggcgccggcccccgcgtcgtcggcgccgcagtgccggacgcacgggcacggctcctcggctcgctgccgcccgccggctgtttgcccatgtctcagcaagtcacacagctacacaagtgagagagagagagaggagaggatggagatggatcggaagtgtgagaggttcttggctttcttcttctagtgagcaattcagcgtccatgcacttgaaggagaagaggaagaagaagaagaagcaagaaatgggaattttggagggaaagggaggcaaggaaggtatcatttgatttgtgactgaggcaagcaacttagcagccatcatgtctggctgtctgaacatgcaatttcatagtattacactggagtacttaccactactagtagtagccaaggaatttttcatggcttggcaagagggcttcctttcttcgctgccacccagctccagctgagaccaaaacttgtactatgcatccagcagaaatggctgccatgatctgcacaaaagtggtttttgtcgagaggatatatagatgtttaatgattttatctcccattggttcattattactgggcaatctcgctgacgaattaagggtgcgtgttagtgacccatgttataagcagaggttaaaaatgaccttatcagccacactcaaaatgagaaatataattaacatataattaattgagtattaattattaaaaaaaatatattttatttttaaaatcattttttatgtaagaaaactttcatacaaaacatatcgtagcgatatgtaaaacgtgttaacaaaatttgagaaagtagccaagccaatcccgattttagaacatgcgctcaacgtgtgcttaggggctgttcaaattgatgccattttcaatcatatcatttttggtaaagttactaaaataatatctatgtttagtttgttgctaaatttgataaatacataagaaattctgctaaaattttggcaatattgccatcttgctaatttggtaagatttattttggctacaatctgaataggcctaaagtgcttgcttggttcggattcaggtgttcttttgcgttttttttttgatttttttctgtttaagaaaaagttttctaaatcgagatcaccaaaactccaaaaagcgatcgtgtttagtggacgagtctacgggtcgggcgcccgattggtttggagaaaaataagacgctgatgtcccgatttacgtgcaaaattactttaaattgattttttattaaattacttattcaaatcataatccgattgtaccattaaattcgttgcaattaaatcttcaaaacaagaccacacatggatatattttgacgaaatttttttagcttattattgaattatttttaaatgttgcatgatgttccaccaggtatatcggaattgttttattaagtagatcgaaaatgtttcactcgttaaaatcgggtgttgtttcaccttatataaaaacaatgtttcagcaaatagcgaaagaatatttcagttcactgcaacatttgatccatacatagtgaaacattataagtacactaggtgaaacatttttcggtggaacaaaaaataaaacgaattcccttaatagggggtttctaaaatatgtggttttttttgttgcaatggaatattttagttcactgcaacattagacctatatatagtgaaacattgtgagagtctaagctgcgaagggttggtggtccctgtagctccaagggctccatcggagcttttctcttgcctttagaaagctcctctttcggggactccacactccccccacttggtgctcttctccaaacggcatggtttggagactcaaatgatggatatacaagcgtgataacttatatgcttttccatatctccataaatctacccacttttgcttgcattgtattatttggtctacgtaccagaattgataacattcgagattatgcaggattatacacgaaagatccttttttggctctttctttagctgtacactaggtgaaacattttttgatggaacaaaaaataaaacgaattcctttaatagggggtttccaaaatatgtggattttttgttataatgaaatatttcagttcactgtaacattagatttatacatagtgaaacattatgaatatagtgaaatatttttggtgcaacaaaaaataaaccaaattcctttaatagagggtttgcaaaatatgtttgtgatttgttgcaatgaaattatgtgtgtggataagtagcaggtggggacagggggcatgtggtggaagcccagagaagctgctggtgtacacgtgattgggggaggggggagcgaccaattttttcccatcccccgtgtgaccgagaaggagcattctcgtgttggaataagttcatcgtaggtcccttaacttgccaacgaatctgattttcatccctcaaccgaaaaaccagatacaacggtccctcaactatcaaaaccggtgcagattaggtccctcggcggttttgagggtggttttgtctgacgtggcgcctacgtggctaatttgactcggtcttcatctgacgtagcattgacgtggcgcctacatgtcaattcgatccgaaaaaataataaaacacatgggacccacatatcagtttcacagaaaaattaattaaagaatggtggggtctatgtgagccccatatgtcatcctcacccctcttcttcctccactctccccatctcccctctcttcatctctctcctctcctctcctttctctctccaggcgacggagaggcagcggcacacggcggcggagctggagccacacgcgcggcggctcccggtcgtcgctggccgacttgtgcagcggcgccggaacaggaggaggtggcggccgcgacgccaactacgacgtgctcgtgccgtcgtccttcgtgcgcaccgacggctgcggcggtggcgagtggtgaccgcttcccgccggtccacacgtttggcttcggcaaggaccacgacgcggtggcgatgcacaccatcgccgaggtcaccggcgggacgttctccttcatcgaaaacaaggcggccatccaggacgggttcgcgcagtacatcggtggcctcctcaacgtcgccgtgcaggagttccacttcgacgccgagacatggagaggaccggacggaccacgagtccacgagcgtggccggcgacaggggcggagtccggcgtcgccgagcgctccgtggaggtggaccgagctagtccgggtggaagccatcgacgacatcgcgctggagccaagttccgccgcctcgacgagaactccgtcgtggtctccttcatgcagtggttggcgcggagctactgattccaaccggtgctgagaaaactcaacaaactaacagactctgaaactgaagaaaaaactgacgcgctacagtatctaagactgaaaataacaaactcaggagaaaacacaagtttacatatattccaacagctaccaccacgtcgcctgccacgacggcttcaaggtgctccaccagctgtagaaggcacctctacaacaacaacaacctctagctccgccgccgtgggcaggagtccgacgatgatctcgggttcacgttgtgcgacgattactactcgccgccgccgaagttggtggacttcgtcgccgaccatccgttcgcctccttctagctactccacgccacgaccccttcccgtgctgccgctcctaggcactgttgcgaccggtcacctcgccgcgcgacgccctgcgaagacgatggattgcgacctctcctcgacgatgaagccctgcgaggacgaggagctcgcccgccgccgctcctcctctgctcccccagcccgcttcgcccgctcgtccacgcctcgccgccgaagtgctgtcctgctcgtcggcctccacgcgcgctcatcggcctccctccgtcgcctggagagaaaggagaggagagagagatgaagagaggggagatggggagagaggaggaagaagaggaggggtgaggatgacatgtggggcccacgtgggccccaccatttttattaatatgtgtgtgaaactgatatgtgggtcccatgggttttattattttttcggatcaaattgccacgtaggcgctacgtcaatgccatgtcagatgaagtctgagtcaaattagccacgtaggtgctacgtcagccaaaaccaccatcaaaactgccgagggacctaatctacaccggttttgatagttgagggacccgttgtatctgtgttttttcggttgagggacgaaaatcagattcgctgacaagttaagggacctcagatgaacttattccttctcgtgtttagtgccggccggcccacgcaaggtatgctgggccggacaatgcaccgcaaaacggcgtaaaaacctctccccctatttttttatatagaaaggatttggacggatgtgattccctcgcttccgatcggacggacgggataacacccatgggcccacttgtcattgagcgtggagacgaccagccaccccacccgacgcctcggccccctcgcaaatgtaggaaaatcagaagagaagaagcgaaagcgacgccgcctccactccgccgcgcggctgctctctctccctctctaaaaccctagcagaggagcacggcgaggagaggagaggagggggaaggagggagaggccacggggaacgcgatcgccttcgtgccgcccatggagacgaccatgggattctggggtgcgttcctcttgcccccgaaccctactactgtttctcgctcccgattcgacgccatctttaattttttttggtcgcgcctagtcgataggggaaattttgaggggtaaaaatggtgtggtggattgttgatcctcggtttcttggttaaatgctgggtttccccccatatgctccggagatctggggatattttcaccggcaatgcttcctgataggatgcggtggtattttggtgtatttgggggagaaatagaagcaatattcgtgtaggaaaatgcagtcatacccttgaactttaatcaggctcttggcagaactgcaggaaatttggctattccattgatgagttggattcaagtgaacaagttgatatctaggagtaataaggcagtagtttgtcttaatgaactgtgccttgctctggagagtaatacattccctgcttctgtttggtggttcctggatttagtatagtttgtattttcatgttatggttggatgatttagtgcttcagtttttttaatgaattaagcatggcatgaagcttactggagagtgttgactggcaaggtcgatgttgattggtcaatctttgatttttcaggtcttcatgattgactatggtttcttcttgcccatgtagatatgaaatatttatcactgaaatacgcgcattcttctacttatatttgccttcgattatgcgttgtacttattctgaacacaagtgtggcattcaaactgcccgttggcatgccactaatgttttttcccctctgtgtcaactgtgaagagatcttttgatcgcgttggacacaagcgtgatgggcatatttgtagagcttaagaaagaagcaaatgtttgtcattcccaatttcacgtgttgctcatttttaccaatgtttactaatggctttcatgaatgtaattcacatttctaggagttgctgtcagacctggagagacagtgatgtgtgatccaccaggagaattctattatcatatttcacaggtttgtttaacaaattgtacctaaaagctcatttggaggtggatcaagtttgtttactttaagttcccattttcactgcagatagcgttagagcctggtgagctgaatgagaacgtgcaagtttttggtgaagttgatggtaaaaggattctgctcggcacactttcagttgaacatcgtcctcagttgtcaattgatctggtgtttgaaaaggagtttgagttactgcatacctcaaagacctacaacatcttcttttctggctaccaagctgcggatgcgagaagatatccttttgcatttataatgatctttcttcaaataaatcatgagtaggaatatttttccttaaccttttgcctggctgtatgcacatctgactctcctactgaagaaggtatgtgtccttgttctttactagtagtaattggtcatctctgatgtttccgctgcacttggcctgattctcataagatgtgatgtttcaggtgatgaatctgatgaggaggttccactggctattccactattccccaattcagatggtatataatttgctaatcgtaacaattattttataagacttaagaagatagcatggtaattgaacttataagactttatatatttttacgctagaatctgatgcacatgctaatacaagctggtaagcgaatcttcgaatgatacactcttttatgttatctactttcagatgataagatcaaagaagttcaaaacagtccaagtaagtttgccacacttaagtctgctgctgctgcatcccctacaccagaggctattgtagaggaaagaaagaattatgggaaatcagaagctgatgatgatgacagcgatgaagaaagtgatgcttcaggcgaggatgaatatgatgatgatgaggtttgtaaaacagtaacactattaaaactagcagcatgctgattcttgttcagactgaaaccatgacatggttttggacttcggtaggtgtgcgaacaaagttttctttatgctagatatgttatgatcatgcgatatatttgtaggatatgattgataaacaggattctagtgatgatgatggtgatagttcggatgaagaagagactccttcaaaggtgtgagcttgttcaaggctagcaaccccaattatggacagcaaagctggtcggaaactgtttcttttgatttgttttcccccctaaattcactgttttttttatggcacagagattgcatttctcacttgtagatcttgtgtgcaggaactggcaagagaagtggctacgtccatgtcgcgactccttatccagcaaaacaggcaaagaagacacctgtaaacaatgacatggctaagcaatcctctggctatgtccacgttgcgaccccttatccagcaaaacaggcaaagaagaggactgccaataatgacatgtctgagcattctgctggttatgcctgcaagccatgcaacaagtaaatttttgttcttttcatttgaatgatttaccttagtaatgctgctatatcctcacatatgcacttcctattttgctcaggactttcaacacctctatgggtctggaagctcattccaaggcgaaacacactgcaactaagtgatctgaaataccttctgggcaatcctgtgtaggtgtgttagtgataggtaactgaattctgaagctggagatccagatattttgatgaagcacaattttggagcacttgccaagtttctgaaacatgtagatatatggcgcttttttaatgaatgcgtatggatgttgcacgtttcattgttctgggatctgctcttttttttttcctgagtgtgtttggacggacaaaatctggtttaacgatcccaataccgggataaaaaactgctcatatcggacacaatctgggttaacgatcccaataccgggatcaaaaactgctcgtatggtatctttggatttcgtggaaaccaatgataaaccaacaaaaactggtggtgtatgtctgtaaaaaaaaccgtttcgtctgtgttttagacaagtctgggatgtccagatttacatacaaaacttgtactaaaattctcaaccgttcgattccttaagtgtgattagccacgagtccatgatcgtggcaataaaacaaatcattgccttggagtgcagaaatcagcatatcatgatttcatcgcagagttgagttactccctccgtacgtttaggataatgttcaagggtctgcttagttggtgaaatgaaaatttttaggggttttatcggacgtttgaccgggtgttggaagggttttttttatacgaatgaaaaaactaatttcataactcgcctgaaaaccgcgagacgaatcttttgagcctaattaattcatcattagcacatgttttgagcctaattaatccatcattagcacatgtgggttactgtagcacttatagctaatcatggactaattaggctaaaaaaaattcgtctcgtgatttctatacaaactgtgcaattagtttttctttttatttatatttaatgctccatacatgtgtctaaagattcgctgtgatgtttttggaaaaaaattttagaattacacagggcctgtttaagtcaaacattgggaatataaatcatgaacaaatctcaagttgttgagtttgaaaatataaaagttatacaaatatatttgtcttgaaaaatattttcataaaaatatacatatatcacttttcaataaatattttttatagaaacaagaaccgtgtcgctgtttaaaacgacttccgttacaagtatggagggagtacatgcgatcgtgtgcacagaatggaaagaaaacgaagaacttgaccaaatatcaaatacccaaaccacagtagagcatagaagacagagtataaaacctcgtaaccaagaaagcagactagtctccgcattgtcacaggccatcacagcacaaataacatcgttttgtaattaatagtcacacagaccatcacagcacaaataacattgttttgtaattaatagtactacctagcttgtaacctcatccaacttggatgtttctggatttttaagcaacgttttcgccaaaaaataaaataaaagaaacatttagcaagcaaaattgggtatgccccaggttgtagggccaaaactgcctattagaggatcatctttgaagcaaaagcagctgcagtcaaacatgccaccagtagttcacttggctggatgtcttgccttctgatgagaccggagtgatttatcactactaaatgccctgtgagagaaaagaaccatctaatgttagaatgcttgtgataagactgcatcttatcacagcataataataaactgccaagctgtatacatacttgctgcaatacttgcaggcatgggtgccggaggattcgggagtctccttatttggtttgctgattgccggcgtcttgccatcttcctttgctggatgagtattcttatcacctttagtaaatgcgaaaaattagctaaagttgagtcccctgtgtgttgcaaggttaataaaaatagcgtcagtccggcagagctaacctgttttctggccaaagtgtgttgcagtctttgacttcttaccagaagaaagtgtagatccagcagctgtcagcttgctgctctcaggctgccgagcacaaaacaagagtcagatcgcatcttagagacaaatcaagagtcagatcgcatcttagagacaaatcaagaacagtggcagatatcgggcatactttct

SEQ ID NO: 42343 - DNA, 2226 bp, Oryza sativa
atacccataatgtcacagatgtcagacatgttttcatttcatctgaaataaggacatactagttagtttatgttataatagaaatattggatacttaaacaatagaaattatttcagaaatatcagtcaatgaatttaccctcatcttcacgagaatcggatgtgagaaaagaaacaacatggttaaggaaacaaggttcccaaaggatatttcaaataaaatctaaatatgattcgaaaataattccaagtgcatatgttgaaggatattcatatgggttaggcatgtcagtcttgtaaccacacaggaagacactagtagtctttgaactgtgtgaaagctcaaagtcattgccaataaacaaatcacacataaattgaggatgatttttagccgatagatttccaataactgtcttcttgccatcaactttaacagatacaactacattctcacttcctgccttctttgtttctcccagtgcaacctaaaaaaagtaacaataacatgaaaagatcaattatgtaaggaccgagattgagaacgaacacaaattataaataatcagacaagttgtatttaaattttattctctccctccctttttttgttcgttgtgtgtgtttggaagatgagggttgagggtgctaaacctgtgatatgtgaatcacacactcatcatcaacgttaaatgaaacagcctttcctggcttcacttcaatacctgcatgattcagatcaatcattcaaactcccatcataaatcacactttacgaattcccttgcatagctggagattgaaaatgcagcccatagtgcattgagaaaacgtagagttatgccaaataacaaatcagcgcttgaaaagctcccacaatctagcatcaacaataagtcaaaaaaaaaaacttttcactacttgaaatttgacaacccactaaatgatcatcccatcaccccacatataatggcataggagacccttatcaagttatcatcaaactacaaggctttctacagggaaggaagggtgatacttaacagtacatcataaaattcagattataatacagacaagatggcgaatttctcaacctcggaacacaaaaccgatgataagcccgttcctcggcactagacaaaacagagcctaaagtgggatcgcggagaagctcgttgacgagaacaccatctaaaatcgcacaccccccaacaccgtttgaagcattaccaacatctcatcacgggaacacgacacgcccaaaattcgcaccaaaataattgcaaataaaatctccccgagaacacaacacaaatataatcaaccagaatcttggagagagagaggggggggatcttaccccagaattccatcgctgcctcgttgggacgacgaatcggaggcgcggccgcgcgaaaccctaagatcgaggaggaagcggggacgcggggtttagggtttaagcaggggatgcgaagcggacggcggggaaggtgaggcgacgaatctgggccgtcgattcgttccggtagccgagatctgtggccgttggttggttggctttcccggttttgattttggaggagggaaggggatcagggacacgaagtggtggagcagataaaattatgaaattgggctttgtctgggcttaaattgagaacgtggcctgtttagctgggatggtatccatattcggcccaatttcacatttgatcccccagaaaatcacgatttccattttctgttcatatttacgcaaagagtaatcgagtgatcactgatcagatgtcaattatacatttgatgatcaccataacatcacgacttccatttttctgctcacattcacgcaaagagcaatcgagtgatcaaatgccaattatacatttgatcaccataaaatcacgatttcctttctgttcatatttatgcaagagtaaccgaatgatcaaatgtttactggagtagtttttataagaaaaaaagtccggtatgtttatgtaataatagaacaaggaaacatgatttgaaaatggtctctctttttatccttgaacaattggtttaacacctacaggctacaggggcatgatatttgcgtgtttatcgtcagcaacaactttgggggcttattcagtttctacgcagataacatatggacaaacacacataacaactgacacacaccagaaccaggtcagctgttctccattctttggg

SEQ ID NO: 42344 - DNA, 9160 bp, Oryza sativa
gaacgcttggggggtagctttctgagaggaaccaccaggggaggagcacacgctgctaaagctgaaccatgaaagattagtaagttattttgcactgttgcatagataagtaaataaacaggcattcacaggctagtatgaaatcttagtaccttggttgtactttctcagattccattgtaggcattggccattgcaactttttacacaactcatataatgcaatgcgtggtcctcctttactcgttttcacaatcacgtgcactgaaacaagataaaattgttgaactttatcaaattgattcgttctacagacgtggatatatgaggtcctgatatgaatgaaagcacagagataacaacaaaaacagaaccactggtgattgagaacatacatggtttaccaagcaggggatcagaaatgttccttgaatcagctgcgtttttttccttggttggttttggagtctgtgtatccattgcatcgacatgcaaattgttgaagggattagtgctgccacaatgcttttcaaattgttctgtcttgcttgcattctttgggattattagtcctttttcctgcaaaaacgaataaacctgtcagcttatattatcccctaaaagaacattgcaacatacactaccaaaatagtggagcacaaaaataggacacctcgagatctttgagcagtaaggaagatgcatgcgctttcgcatcttttcttttcttgctaaaaccttgcctcacaagaagcacctctttgagctgtacatcaagagtagccactactgtgtctccttgatctctacagttaattcctacaaaatacccatgtttgccacaccattcgataagctctctgtatggaggtaactccagattctcaggtgtgacaattggggaaagaaggggttcaaaaataccccagactacatccaaatcaagtttggtgtctaaaagaattgcacctgcaatactttctacaatatcaccaaggacctgtatcacaatagacaagtgaaatatgatatattaatatagataaattgtaaagatgattgtgtatgtcaatactggaagatgacactaaaaaggacacaggtaatgcaatgcaaataacttgtaaaaagtatattaaatacatagccatgcatttataagatgctctaacttaaagcaaatgtcattcatatgaactgaaatcctaacgtattgacttgattttattctgataagagcaaaccacacacatgttaaaacaaagaaagaacgtactttaggcccttttgggagtccatctgataacagttcaactttgtccatggatgaaccttccaacctattcacatattcagtaatttggtctaacagaagcccagaagaatgctggagaaagtgatggaagttgtgctttactgcaacttgtgcaaagttttcattattgactgatgcagaacgtaagtctgtcaactccccctcattagtgtctttatgactattgaaaagatatcttgttaacagaatgtctaagaccgcatcaccgaggaactctaggcgctgttaaaaaaaaaacattagagaagttgggtaagttaagacacaatatgaaggaccagcaaaatagttttatgttcacccgatacctcgtagcagtattttgcacctaactcctgctgtgatgggtgagtcagagcctctaccaaaagacctttcaccgagaaagaatagcctagttttgcttcaagcatttcaaatacattgtcttttggaagataagtctgcacagaagcactcaatatggcctgcacaatcaagtcttcttcaatttcagccccgatgcccaaccatttgagaactgccatggctgctcttaaaccaccccctgcataatatgccccaataatagcctcaacacaatcagcaatggttttggaacacatccatctgtgtcccttgtcacacgccttgcctagaacaatagccttgtcatcaatgatatgaatatcgtcagttacaacctcagattttacagggcattcacaaggagatggacgaatagagagctgtcctggtgctagccatcgacgaggatccaatgcagcatcacgtacgtaaccctgttgattacattccaccaattgtcaacttagctcagacaattaaagctcagtgtgtccatgaaatacaaaatctctagacactgccaaatgataatgtgaatttacctgtacattgcgttcaattccaagcttataaagtgtggcattacaaatcatatggaccttatggatgatagctgcccctcatccttattaggaaatttcaggaaaagatgacaactcactgcatacttcaatacagagtctcccaatcattctagacgctccatagagaaatcctcagagcacctaagcgttgtaatagcttccagaatctaaagaacatgtgccaatatatcatttcatattaaagaaacagaaaatgtatgtatagaagagagaggtataagcatctataccaggaaacttgatatattagaatcgctgtatccaatttcacttcttagttgactagctaacgttaatgactcaatccgatacatcaaagccggaaacaaatagaatgatctcaaaatttccacaggtaaatcaaggggaatcagcaactcaggaggcatgtggacacggttgcttgttttatttacaactggtgtgccattactcatattctccacaacattacctaaaaaaaagcaacagcaatcataaatattagatcagcctatatacgacataatcaacttggctacaaattacaaaaataaaacagtttatgcaaaagtaccagtctaacaaatgggtttatcactaatcatcgaagtaaaaaaatagagatgcttcaaactaatcttgcttgaaaaaactaataagtaaccagttagggaagacaaacacaaggtagaacaaaactaactatatagaagaatagatacagaccttcatccctgaacttcgaggaaagaaggttgtgaggattatgactaggcttcaaaactagtagtggctgtgaggggtggcgaagtactatgccatacctgtaaacgaatatattagacaaaaaaagcaagattatacctgagcaagcacatggacatgcacaaaactatacacacttctttttgaaatattctgcgaatgtccggaatttacattctttcttatcagatgcaccatcaaaagcgctatcgccagataattcagtaatatcaagagcagtatatatcttcccagtgtgaactgctagaactaccatatctttgaggctgttagccttacacgacttgttagctaaatgaattaaatctccaacattttggtcagaatcaaatattccaagtaattctcttttattctcagaataaatccttctcataagtttaactgccgtagctgccgcatcaatgacactccaattaatacaaacgttggagtcaaaagaaggatttgttggtaaaagcaaatatacactcgcagtgttccacacaaatgtatcctctttattaagaatgaattccctcggagcattaggtacttttgatctagtaaacagctttccaaacaaaccattgaagagaagcccttgaaacaactttgcttgttccatctgagacaaaaaaaaaggataaggaatttttcagattaaatgggaaaaaaacaaaagtaggggacaaacttcatcatacctgttgagcatccaactcaagaagtccacaagaagaaactgaagttttgaccatcttgtcgtgcaaatataggtcaatctccaaagtagcgacttcatccggtaaagttgcatcaattaacagaacaaattcagagtaaatctgaccagcttggtcacaaacaaaattcattttgtagctttgaagcttgagtgcagttttctttgacacccaattgccagaccaagcatgaattcttgttgtaccatgtagctccttccgtttggttgtaccttcaagaaggtaatagagaacattaccatgacatctatttctttgtaagaagtataatggagttcagtcctacaaataagcttgactacatacgctggttacaaagaaccagccagcatatggcatcttaacttggagtaaattgcatggcgaatccttaaacttgtacacaggactaatctaggtacatatatgtagaaaatgcaaatctaggtccaaaagtgcgtaaagtagattattaactatacaatccagaagaaatggcattttatgtgtggccgtccctctctcttctcccttagatatctcccctaaattgttgtactattttgcggtggatgtcacaagtaacaacacaattcatggagatggaaacttaatgaggtgatgatgaagcatgcaggtgatgttcactcatgctcccagagatgcagctgaccttaggtgcagcatctagttgacaaaaacagcatttgtgatgttgcactcgtggcacagttttttttgggagggttggaggttgtggggaggggccggggggcacaaggatgccagatccacctcagtgtatcatgtccacaaggaatgctagttacccagatggacctaaaatgaccaccttaatgtactttatggactaaaatatgtagtttctaagtacaggaacccagatggtgaacaattagttcaagttagaggaccagtgatacgatttactccttataaaacttggcaatcacatacctataccagtacccttatttttgcttacaatttctggaactggatcttcaacagatagacaaaggtggtcatcaagtgctcctagctcatgcaacttcttacatgcatcaaggcaaacgagctgttttgctttgtgcatgtttcttgcttttgggcccaccagaatttgaagcacagcacttggtggtaatgctaatgtacacacatatccatcatcatgatgagtgaactcaaatgtaggttttggggagtagcacctgtaacacaagcagaaatggcaagaaagtgaattggaggtctccaaacaaaaacgataacagactgaaaccaggtattgcagatctatttataggtgcaatctgtgtagtcatgtaaaaagagacaactgaaaatgagatcaacatacttatcctgcggaagcttctcacagtatcggtagacaatactgatgcttgaatcagcagttactttcgctcctgttgtgcctacatggtattcgtttatttcttcattgggaacaaaaccaggcgacagatttccagactctctgcttgaagcaatcttaaccattgaagtctcacttctcacaattgcagatatcaaatcattttgcttcacgttccccctgcattagaagaaatgaattatgtatccttgcatccttcttgtttgccattcctctctgcattcagttaaaagcacgtgaataaaaggtgtaatggggtagcattaaggttataccgttcaatcatgagaatgtactgagagtcttcctggcgtgctcgtccacgtgactgcacatagctacgtgttgtccttggcaaatcaaatcgtattacacaagagcattctgggacatggataccctcttcagcaacatctgtagtaaatagtaagttcacctgcattttagaaagggaaaacaaggttatatcatgagaactatgcttcagtttctccaagtgttgacatatcttaattacctttccagagcgaaatgaatccaatgtatccttctgcattttgggtgtcagagcatccaccgaagatctccctccagtaagaaaagaaactgtgaaatgtgcaaggtggccaattttcttaatcatccggtcaatgactctagcagtgatctttcgatcaacaaaaatgaggcatcgagcatgacgagagttactgttaggaatagaaatgtgtcacgtcagtttaaaggcacacaattgaaaaaaataaacaagtggaccttccccaagaaataatacctaaaagagtgaaagatctggatgagttcatagagctttggggaaatatagcccgtctttgctgcttcaacacatccactttctgagtttagaagcatgtcgatacctggaagatagcaaatagtttagagaatacacagaaggactgagcattttcatattgagaagagagccaaaagactgaagtaccatcttcatgctacacacagacatcaaatgaaaggataggaattcatcaaggagatggtacatgatacttcctatcaaacagattcatcatactccataagttcatatagggtgttgcagtgctatatatgcttagatccattggctaatggcatggcataacagtgtaaggttgcaaataagtttacagacattaccagtccattattagtttatctacatagtcataccttgttggaggcgtttgtcaattaaatgcaaggcttcctcaaagaacttcatatgaagcgctgaattttctgcaaataggcgtgatccatttgcatcagtttgctgatctgtggcatcaactacttccttcagccaacctttctcctggcccctttcaatgcagatttttgtggcctaagagaatgaatgataagttattatttacccatattaagacatgaactctgaagcaaagtgacggtaaaagaactcttcaaacatagaaagctaacgttgcagtatgagagagaaaaaagaattactaagagatgggatttttttggttaagaagaaagtaacccaaaattaggctgaaaaggatttaaataggttgtgaggcgtgcaaacgcgcttcgcaccaagttaagctcagttcctgtaacataagtagctagaacaaatgaatataacaaatacctcacttgcacaaataagaccaacatcatcaaggcagtagcaaatttttgctatagatttagaaaggcgtctctttgattcttttgttatatcatcagcatctttatacatgtcgcttcgcttattctgcaactctgttatcaatgcatcatactgcacatacataaaagagtgtgttcttagaaacattaaaaatgctgagctgcaaactttgatgacaaatttgatcaatatagaagagaaaaaagagatataaaaccttggaacataaaactcccaattcttcactcaaatcttcaaaacaaactggtttcgagtcatagtacctgcacatttcttttgcagaaggaacacaaaactctatctcttctctatctgaaactgtgtagatctgttacagataaaaattaatgagaatcaaagtacgcagataaccgtatcacatttttaaaaggggtcataggtgtatcccaaaatggcatgggtaaaacagataaatatatatcacctaagctctcaaaacgaacacaacagtaaaacaatttgcatttggttgaaaaccacaatcagtaaataattggaattcaggtatgtatatatccttgcacttcaatagacaaagtagaatagtgtagttatcagaactaacatgtcctgtataatctaacccagcttattcaaataatatgtgtggcaaagcaggaaactgaacataccttagcatctaacaggttctccaattcacagaactgaccttcacaatccaaatgagaagagatacctgcaaagaaaaccatgaaaactcaaatcatctaataagactaagtgatgcgaataaatcaaatctgccagaaatattggcatttatgaactctatggccaaagtgaaattggagattatgcgcacgatcattattcctggatatttctcttagatggcaggtcagaattaacacatgtcctaaatgccactgtttacaagaaatttattgctgatcttttctgacttataagtctcttaacatcccattcctccccccacccacacccacacaaaagaaaagaagaagaagcattctatagctcttgcagataactgaatacttgccttttcttataacaggtgatgctgtcataccaaacacacttggcttatgttctgatttgtgatagaactcctgagatagtgatgagttataacatatgacaaacacaaaaaagaaaaacctaaatgctaatgtcaaaaaaaaaaaaacatgataagatggtatttcacaataccttcattattcttgtataagggtggtttccagttgcatgatggcattcatcaaatatcatgagactaaccatgtccaagattaagaaagcattgcgtaaagcttgtaggaacacctgtggtgtcatgaccatgacctgcaattttattattataagtgttgaaagcatcaacaagtagatagaacaggggaaaaacatctatgggatattcttaacaaaagatgttgagtaaatttcacaaaactatggatacttcgatcaaactgtcacaaaactacagagtttaggtgttatatcacaaaactacagatttagcatggaatttctcatagaactacagatttaagatagagtatcacaaagataaagattaagtagcaaatttaccacaaaactacaggtttagtgccaattttaagcacaaaactacaatgtttatagctctaacgtaacggtagtgctatagatttatactctagaatatgttgttttgtgataactttagtattaaatctgtagttctctaatacttggccttaaatctgtagttttgcgataatttggttaaaaatctgtagtttcgtgaaatttactctataatatagtgaacagaagactgcagatcataagtgctgctagcatggaatgagtattttctttagcacatatgatgaatcagtgagcctttaaaacaacaacaaataaatgcttgcctggtattttgagatttgctcttgccatctaggacctgtccattgatcaaccccctttgcaccatagtattgttctacctcaaaatctgtgtggatttcaatcacctcgcattgctgtggcaaaaaataatgttagtataaattacattacagttaggataaaacgaacagtctacagactggtataacctgtgtaacaagttgaactgttggtgcaagaaatatgatgacttttccagcattctttgttctgtttatctttccgaac

SEQ ID NO: 42345 - DNA, 9696 bp, Oryza sativa
attgagccgagcactcaattcaccgggattctcccgggattgcacatctcatcccatccccaacctacccaaacggtgaaaatctttccaaacggagcccttgggactggacctttttaagatttttattttaatattttataggattgagattgttagataaatattaagggcttctttggatcgcaggaatgagaaaacataggaataggaaaaacgcaggattttgataggaatgtaagtgtaaaacagaggattgcaaaacacaggaaaaacacaggaatggttgtttgattggaccgcaggaaaaacgcaagaattataggagagataaagactcaaacgaaagtttccaagaggttttacctcatgttagaattcctccaaaacttgcatagcattacgcaatccataggaatttcataggattacataaaatccattcatttgattcaaagggctatataggaaaaattcctatagtaatgaaatcctctaaaattcctatgaatttcctttgaatcaaagggggtctaagtacatctgagcattatcggattaagcacggctcaccacacaggcgtgtcgtgtcagcccatatgttgaggctgaagcccaggtatggtctagtgagatgtcaggtcgtgttgtgttgaccttgcacgactagggggcgtagcctgtgtggagacccgttaacctaaatttgatatataccaaggaaaatatgctaatagaatccattcgatcctcctacacaaactccagcaaagctccggtgaggttctccgctccgatagcacattccttttcctcctcgccaagcaccgtcgtggcccttcacttcttacttccttcacctgagccgataagcccccaaggaccaacatacttagtggatgtgcttgtgaatggggttaattgcaccaccacctactaacatcgttgacatgcataccttcgggcggagcttaaaaatacattctacataaaagttgtttatataacttatccaaattcattttttaacattttaatatctaattaattaattcgtttgtgttgtaacatagacggatataccccctcaaccccaatctacaatgaacgggttgtcatgataccaccaaccaaatcctgacgagctgtcgataacctattgtctcttcattgcaatttgcaagctgtagatgcttaggggcaaatttactacatgacaccaaaattttatgtaatttactgacagacatcgaaaaaacgtgttacggctgatgacattaaaaaaactagtaatttcctagataacattttcagctcaattggagagatgaattcttaaaaaaaagataagaacgcctctatggtcacatgcttcaaacatggtgttagagtaaacttttagaaattatgcaactcaaaatttgccatagcccaaagtggcaaagtacatcactagcatacatcatatttcattttcactctagtctcggctaaaaaaacgtttgaccgggtcattgtcttatttttaaataatttatctattcaattgagctgaaaatgtcatccaacaaattaccaattttagagcgtctttcactcgtgtcacttttttaggatgtctatcatcaaattacacaaaagttgggtgtcctatagcaaattttgccatgtcacatcgacatcatcccggcacgtaaatcgaaacatgtgttaacacataattaattaagtattatctaaaatttcagaaaaagatcaatatgatttttaaataattttcctattatttattaagaaaaacataacatttagtagtttgaaaaacgtgcgtacgaaaatgaggggtttgaagttgggaacaatgacttaagaacacagcagcacctcgaaacgaccactcggcgctactacgatacaagcagccgccccccgccggccgcggccggccgaatggccgacccgaccgtctcaccctgcacgctgtcgtccctctccctctcattgttccattcatctccacaccaaaaaggcaaaaccaccttctgatcagccaaactcacgttagaacatctcaaaaacaccaaccggccggatacgtacgtgaaaggatcgatcaagaggtttggttgccatggaggtggagggggcgccggacctggccgacttcatgaacgactggttcttcggcaccgtcggcacacggcgcagcggcggcggtgcgtacgacttgaccggcgatcagagcagcggcaagaggccttcggcgccggcggagaagaagcagcagcagcagcaggggaggagcggcggcggcggcggtggtagcgcgagcaagcagacgcaggagtggttggaggaggcgaggaggatggtcggggccgggtcgccggggaggaagggcgtcggctcgccgtccacgcaggtgcccaggttcgccgccgccgccgccgccgggacggagccctcgccgtcgctcgaccgccgcgacccgatgtcacgctccgcccgaaggtacgcatgtcagtgatgtcactacgtcgtcgtccgtgcacgtgcgcgcgcacaggcgagctgtattagcggcccaatcgttagatgggccagtggcccaacaaagctatattagcggcccagttgcaaaccacatttttttggtttgccgcccatggcggccccgcgccgccgccgccggcatcccgctgccgccgctcactgccggtggcgccgtggcgatttccttctactatgtattcgcttactactctctcttcctccggcgagcttgcaggcaccggcagccgggaggcatcggcgacgagattctgcagcgcgcgtccatctcctcctcgcctccgcgcgccgacccgttcgcctccgcgccggcttcccccgcccactccctgcccccaaacccgccgtcttcccgccgcaagtcccgcttccactacccctccgcccctgacgccttctcctcctcctccgcctaccgccgcgccgcatcctccgcctccacctcgcccacctcgccgcaaagcctcaccaccgccgccacgcctccgcctcctcctcctcctcccccgccgccgtcgacgtgttcgacgatggcgtcgcgcgcctcaactccttcctccgccgccagcgcgccgccgtcgctgagctcggctccggcggccgcccatcctcgaggtccacgaagatcgtcctctccgacgcctccaaaagtaaggattaccaccaaatccatccccaattgctccaattgaatctaccccaccacacgctcacttgcgatttcctgttctatctccccgcaggtgtcagctcaatcgcggcggcgatatgctacgcgtggatgctggcgagcaaggaggacgccgaggcggcggtgccggtggtgaacatgcgccgcggcaggatggagaggtgcaggcaagcggcctggctgctccaccacgtcggcgtcgacgcctctgctctgctcttcgctgacgaggtactacacgatagtgatttgcgtgagctttcaggccgtttagcttagcgtgggggttggattcgtctccgacaaatcggacaactgtctaggccccggagttattgggcgtttattctgggcagaggcgacaaggatgggcaatatacagcaatcacattgcagtcgtgtcatgtgggtgttccggtttttgattggcaccatgtggctgtgatttggggttttgtggttgataggcttcttgcaattgtagcttcatgtgctgatatgggcatataaagggaaagcaattctagcaacaataagcaacataattttgaaatttgatgcatttaacatctgcgtaagatcaatttgacatgggcatctgtaatagcacctagtaaatcttattgatggcctatttccttcaaactgtttccagttttatgggcatataacatgtcaggttctccactttgaaaggaacaatcaagatgcaagcacaccattcatttccttcaaactatctcctgttttatggtcatataacacatatgtttctccaatttgaaaggaacaaccgtgatcaagcacgctgtgagtaatggtaaaatgtttatgatactgattttcataatccgacttaggttgacatggaggggctaatgatggataagcgagtcagcttggtagtggtggggcaggatgttctgaaaccaaacgataaggtaatgttatgtacttgtacagttgtactggtacttctcaagactcttgccgaggttaatgtatatgattccagcttttacttaataagcatgctcgattttgtcccctagatgggctcagtttgcacaatcctcaccaataattattgtgaagatgcttatagtctacttcagagcctggacataaagaaacttctggttagtgcatttgctatacataaaagagactgttatgcataatttagtggaatgttctgaccatgttttctgggttccccctcagcttgcaggtatcctgttagatacgaaaaatctttccaacatgtgctcaaacagagattcagaggcagtgcaactgctcttgtttggtacctctgagcatatgaggcacgaattgtttcaacaatgtaatatagtagtcttcttcattcatactatatttatttatgagtatagaatcaagaagtagcaaaaatatgtagtaatttccattcgtaacttgcttttgctgttctcttgttcagtgcttcttgatcacaatgatcattcttttgtcgagtacttgaagaacaactacagagagccgtccacaaaaggtgagcttttattcatactatatttaaatagattctgaaatccttctgtacaattttattaactggatgtatgtacatttatgttaaagacaaatttcactgtttgtcccaattcttcttaaaaatttaaacagcgttggtatgcaacagctcatgctattagggcaaaatattcttgtagtaacttcaatacccatttcacttcttacaaccttcatgactaggatgaaatatctgatagctcctcctgctgggttatattctatcactaagatagctttgattcaagtataatgctgacttactgtcatcgtcgtatatgtccctttatttttacttaacacgtgttgcctgtttcttgttattcctgacataattccattctgttgttcatattaggtgaagggaacagtcccctggaccagaaacattcagtttcagcatcagggtcatcccaagatgctaagaagcccaattcaagtaattttttctagcgcctccagtattatttgacaagtagattgtctgtaaatagttgagcaattcacagttaatgatgaggtcacactttgctggtttgaccatgacttaagaaaggaaaatacaagcgatggcttcggcgtgattatatcaaatattgaaccctggggattttacatctaatataccactaagactaagcgaaattccaaagtcaattcatagccaatgcaactttaggcagccctcccgcacacctttttttaaaaaataataatgcaaatttcttaaaagaaaaaaaacattcaactttggtatgtggtatactcttgctaatttggtggcaactgttttgcattgcagataatcagagaccggtgcacgggaatggtggaaagacctcagatgaaactccccgtgggaagaacaaatatttcttagcaaaatggtttggttttggatcaaaatagcatgttttgacttatactaattcatatcaaaatagcatgctttcacttctattaattcgactattcatttgatttacatgttgagaattcatgatttgtcacaatgttgaggaagtataattttagataacttatttattgtcctcattatatattattgtgaaaagagcactatatatgaaaactattggaactagcaattttggtcaaattaatatattttccatggttacatattttaatttttactaccagaaaatagtttttccatggtcaaactattgggaaagagcacttcctttattgtatttttgggattctgagaagagcacttccttggtatatttctggcattcctattttcaatccggatgtcaactaatgaggacatgatgattaaaaaaacatcaggaacagaactttatgaactcagttgtcttccaggattctgttttctttttcctgcatcctgtatgacatatgctaactcatttcttccagcttttttcaattacttgtaatgtttaatcattatatgattgaaatcttaactggaattgtggtggtaccaaagctacatggtccaaatgtgttaccgaaaaccatgatgaaaagtatgcactccttgactagttgcctttaacaaaagtacatctgaattatacaagtgttgtactatcaggggtttgcaccccaatctactcttcctttacttgaggataggagaagaaactagggtcaaagtaaatgagtaatagaaaaatgagagaggaggagcagagcatagtactagataggagggaccagccaccagccattagctggagtttctctggataaataagcatgaatgcatgattgggaaaggcagtgccattgtgaatcctacctgtcaccaccccctatgtttctctatcaggaccagcctgttcctactcccaggactatcctgtgcgtgcccctctaatgcaatcttccatgtgcccaacaccctctccatgggagaggaaatacaaaatggcatcaataatttcttccctcttcttcttcttctatcttccaatccattacatgatctgaattaccagttcatagcatggttaaaaaaaaaaaaacgtccgcccgtatcgcagtaacaaagtgtgtaggctcattcaaccttccatgcgtacagaaacaggcagaaatctgaatattcatcggtgctgaattcagagctcgctcccggcggcgacggcgacggcggctcgggcttgaagatgaacaaggcatgcctcatccctgtgccgaagagccagtcatgggcgtcccagtacacctgcaccttgagcttgttgatggagatgcactcgttgcctctgaacttccactggaggtgcctgacgaggacgctgacgcagccgtcgatcttgatcgccatgtcgacgtccgtgccgccggtgaggttgctgctgctgcactcgatgctgatgtcgtgcagcttccccctgtcgctgaacctggccttggtcacgaacctcttcttgctgaagacgtgctccttcttgcacaccagcaccgcgtcctgcagcgacggccgtgaccccgtccgccggaacgcgtccttcttgaggttgccgaggaggaggacgacctcctcgccggcgaccaccgcgacgtagtagtcggacagcggctccggctcatcggagaacctcgcgctcctcaggtcccacaccacgtcgatggcgttgccgtccacctggaactgcttcgccccgtacttccgccagaagtgccacggctgcatctccaccttgcacgcgctgcagctcttgccgccgccgccgccgccaccgccgtccgccgccgtggcggcgacggcggcctcgccgtactccctgccgatcttgtccttgccgttgcccgccgacccttcgatcgacaccgacaggccgtgcgtgagcaggttcctgcaccacgtcacggtgacaagccggcggtggccggagatctccgcccggtagaccagcgtcaccgcgctctgcctggccgccgcggccgccgccgccgtgccggagctcgggatgtccggcagcttctcgccggaggagaagcaggacggcaccgagaacaggtcctgcatcatgtactactgtttgtgtacgatgatgagacgagagataggactaggagaggctatacataggcgccatggagaggcatggagccatgcagagatatggagttgggcaagaagaagaagacgatgatgatgagtaggaggaggagaccatgagttagcaaaccgagctggaaaggaaggaggccaagaaagtgagctgtacatgaaagtgagtggaggaagccctcatggggtgtttaaaaactggaggaaccttctctgcctgcttggaataaatgctctatctttcatggaccaatcttgatttctctgcagtacatcatgctcctgtttttctactcccaactctcaccatggggcatctctcaagattaaaaaaaaaaaaagagatcgaaaaactcactattgggaggaggaggcaggcacaggccaatggctttgaggtatgagaattgctgcattgtcgaatcttgcacccttccctcctaactgtatgtttctcccatgcattggacttgggatccttggtggctcaggtctcagatattgcaagcaggtgcatgtgggtaacatgctgaagatagcatgacatgtggtggaggggaggcactggatttcttatggcttagggagtataactgtattgtgctgaacactctgcaggcaagggaatgtaggggattaatctgtggagtttgttgaccaactttaagctggattaattcagtctgcaaaaggtacttaactaagactctggaataactgcttagcaaatcatttgccacatgacacaacgaatctcagtcttcaggcagtagcaggatctttctgtttactggattccttcaggtggatcagacgttgaactcactgtggagtgtggactgtggtttgcagggggcttgaatggatacataagtggatggaataaagtttatggatgaaatgcacactgcagctaatggcagaatctggccattttgtgtgtggaaccacaggaaagtgaggctgtgtcctagttaagccaaaagagtggtcaatggacacaagtgacttttggataagagctctgattttcctgaaaggcaggggctttagcttgataaatactataccctacctgcaaaatcttaaaaagaagataagaggctgtggataaacttgtgaacttttctgtcgttatcagaagccatcaggatctatctgattggtcgactgattgttgataggaggctggctcccttggaggagctttgcctagctttacaaagcttttgggaacggtgatggatgcagtgtgagttgatccatcatccatgtggacttgatcaacggatttggtggcaaatggcaagtgacagcagattcagagttcctgaaaaccttccgtgttggactggaccagtgattgttagtactagtttatccgatttaggcattgaaatccaaggtagaaaagggaagaaagtttcagcatgtgttgaactgggaacctaaatgaacaaggaaagaagggctcaagagttgtctagtcaagaagttggtaaatgcaagctatactagtacttgcagagatcagagaggttgactagcgtataatcctatcccgtggacatcgcatcactaaaaaaatatagcgaagtcgctctggaatatagaagaaaagtgtagaacatgtacatttggcagccaaatttatcagaatgcatcggtaaaaagaactgtagcatcgtattttttcaacgtttaatcatccaatcaatatatgtttaaccgtaacagtagttaatttaaattaagaacatagacagttatttgccat

SEQ ID NO: 42346 - DNA, 7157 bp, Oryza sativa
  unsure (1)..(7157): unsure at all n locations
tgtttcgttcattgattgttacactcgaatgacttggtatttatgtacttaagcacaagaatgatgttcttcgatgcttccaagattttcataaattcaaatcagtttgatgcaaatgttcgaatcattcgaactgataatgggactgagtatatcaacaacgaatttgtctcttatgtcttggatcaagggatcatacatcaaaccacttgtcctggaacccctcctcaaaatggtgtagctgagaggaagaaccgacatttgttggaggtggcacgttcacttatgtttcagatgaatgtacccaaatacttgtggaagtgatgactgctgcatatcttattaatcgcatatcttgtggagatgacaaggaagaatgatggggaccaaattagggaatttgcacgggagcaagttgaagagtctgaacaacctgagcatccagtccaagaatcctccccgtgcctctctcctccaactcccttgcccctcattgaaacgtctggtgatgttccccctatacttgaacaagtagaattacctcttacacaacgtagggaaactagaagtaatgctgggaaacctcctatacgtcttggctttgaacatattagctctaagcatgacattgcaaattatatctcatactcccacatttcacctgcatacaaaactttcattgcatcattacaagcagtgcctgttccgaaagactggagatgtgccaagcaagatcctaggtggaaagatgcaatgaaggaggagcttcatgcccttcaggagaacaagacatgggaacttgtgagacttccaccaggaaaaagagcagtaagatgtaagtgagtatttacagtaaagcaaactcctgaagggaaggtggatagatacaaagcaagatcaattgcaaaaggttatagtcaaacttatgggattgactatgatgaaacatttgctcctgtggccaagatgggtatagtgagagctttggtgtcttctgcagttaactttggatggcctctacatcagctggatgtgaaaaatgctntcctttatggtgatctacaagaggtctatatggagattccccttggatttggaaataaccaaacggtaggaaaggtatgtaaactcaagagatcattatatggtttgaagcagtctcacgtgcatggtttgatagatttaggcgtgcactatgtgagatgggatattcccaatgcaatggagatcacacggttttttatacacataagggttcatgtattaccatcttggcagtgtatgctgatgatatagtgatcaccggtgatgatgggggaagaaattaggtgcttgaaggaaatgtttggaaagacctttgaggtgaaggatcttggacctcttcgatacttccttgggattgagattgctcggtcgtcaaagggaatcgttctctcccaagggaaatatatccttgatctattggcagaaacatgaatgcttggatgtcgttcaagtgctacaccaattgataaaaatcatcaactatgtgctcagacaggtgatccagttgacaaggaggcttgtaggacgcttgatatatctgtgccatacaagacctgatatctcttatgtagtgagtgtggtaaatagatatatgcatgatcctaggtctggtcttttggaggcagctcatagaatcctaagatacttgaagggatggcactatggtgctccattgtgataataaatcagttatcagcattgcaaacaatccggttcagcatgatcacataaagcatatcgaaattgataggttgttcatcaaagagaaaattgatagtggagtgcttagcctagagtatactaaatcttgtgaacaactagctgattgtctaacaaagggattaggcccaagtgaatgagttattttgtaacaagatgggcatgatcgatatcttttgcccatcttgagggggagtgttggtgtaatatgcaactttatcagggacctgcttgtaattctgttaaataaatatatgcatgtgtgggggtactggtcagtggtgaggccaatcattccccaattcccaaatcaatctacacatacctttgcaggagtctcttcttcatcagaactctcaccttcctttgcaggagtctctttttcatcagtactctcaccttcctttgcagtagtctcttcttcatcagaactcttaccttcataatcagcatcatcacttgaatcctatttgtcaatcatatcatacaaatgtatcgcaggattataatatatccaacacaattcatgactgctcatttttaataatgtcactgttacgtacctcattaccagtagattcaccaactactgaaatatcacggtatcgttcattgttgtcatcatcagcttttgatttctcatagtgctctatttcctttacaaaagccttttgcatggcggatgcaactgtagcagactttgcaggaagtttacttttctgtgcttctttgatcatattatctgaaagtttaacataaaaaaatatatcattcgaagattcgcttaccggctcacattagcatgtctagcagattctatcataaaatgtaacatggacgaagcacttcaaactacacaagcatactgatgtgaccatggttaccatagatacaaccatagttcacatcatagctcaactagaagacatcgccgtagaagttctaaaatccaattcggtcacctgcaacagtgctgatttcaaatggccgccaaatgtgcatacaagctccgtttttggcccatgagtacttgatggaaagctcttggagtcttatttccaactaatctagtctcatctccaaattccatctcggtcgaccgcaatcacagaaactaggtgttgcgtcatctataatggacgtataggcttgtaacttcatttagggcctcgacccaagtgggatgtgcccaacctggtggagcacgactctagagaccccatggtcgtcctcccacctctttaaataactaggtacctcttcagggtttttcaggttttgtttagattaaagtttagctttgctactttgccatataatctcgtgacttgttagatcgttacggaattctaacttgttatttgtattcaattcttatttgcaatttacattgctttttatctcgctcttgcttgtttcttcgatttgcttgcgggaacaaggttgatctacacccgtacgatatgggagaaacgtttacgacctgactacaaccgtacgagacgttgttgtgttacgccttaacgatcgatacaccttttcgtgggttgttgatcttgccggtatagattaaccttattcctgcaagcaaataaaaaaaaaacaagcaagaacaaaataaaaccaatctaaattacaaatagcaattgaatataaatgataatttgggattccgtaacgagcaaacagacgatctaacaaatcacgggattacacggcaaagtagaaaagctaaactttaatctaaacaaaacccgaaaaaacctgaaggggtacctagctatttaaggaggtgggaggatgaccatggggtccctaaagtcatgttccatcaagttggggcgcaccccacatgggccctacttggaccggggtcccagacgaagttataaacccataggcccattataggtgatgcaacacctagtttctgtgattgcgaccgactgagatggaatttggagatgagactagttccgttgggaagaagactcgaagagctttccatcgagtactcacgggctaaaaacggagctcgtatacacacattgggaatcagcactgttgtaggtgaccgaattggaatccagaacttctgcgacttgatcgcgatgtcttccagttgagctaatgtgaactatggttgtatctatggtagccatggtcacgccacatacactttatggaagttgaattagcgtagtattctataaaaaaggtaagcgttcttaaggcttataaagtaattattatgattagcaaagcatataccatctaacttggggtatagacgaatacctggtggaacctcctcatcagattcatcacctgaaacatcacatctcaagaattgtgattatcatgaagccaagtgtaggggaaacattagagatgaccaatttaccttcagaatcagtgaattttcccaaattctttacttgatagccacaaaaggcaactttgctgattagtgaggtgtggaatagttgaaagttcttcttgaaacagaagtcaaccttgatatgcggatgccttttggaggaaagcgtcccaatcgcaaacttctcatcattaacttcgacaaatactttcacattggagtcttttagcccgtaagcctcatcaagggctacctgcgatttaagttataacagtaagatgagacatcactataaataatgagacctggtaagaaaattgataatatgagagataacaagtactccctctgtctccatcctagaatatagcaacctagaacccaacttattacaatcctaggttgctatattctgagatggagggagtagaacataccgatgttagatgatacagggtatcctcaggacaaaagatctccttcttattgcacggctcaattaccactcctaataaacaataacattaatcacaaagttgtttttttttaatcttaatgagacagttgttatttaaatacactaaattggaaagaggaaacaaaccccaaaaatcgacgtccattgctgcttttgttattttcttcccgagcttttagagatttggcctgttaaatcaaatcaacaaatggattaaatcagcatataattatcttctagattgacatgactaacatttaggtcaacaatagatgcactacaaagatctccaatgcatgcataattattgttagttatgaatgcgccaacatcagattaagaccatcccagaaagaatttcacttgggaaacccaactttataatgcatgtaaaatcctagattttacaggaactcaaatatatgtactgaataaggctaaccaatcagacaaataattagttcacctagaatttcaaggtgctaaaagcatgctagatcaaaagggactaaaagaaaaaaaaaattacaagaaaatacatttgactctcaaagtcttcatttgccaaagaaagcaaatgtaaagggcggcggggaaacactattaacattatggtctagggcttatgagccggagagagataagagatgaagcgtctacctaccacccaccccgctcagcgatcaactgctataacggtcactggctagataaagcccctattgaatcgtccttgtcccgggcggacgttgtacaggccccgccggtcagcgcctgccctcctaccctatcgtaggtggatattgaagccggtttggcatctggtgcaacacaaggtgtaaagaagggttcgctgccatctggccaacaaccgcatttactcgttctgtgtagccagctcgccctatcctgcgttggctccaggtgaggtgcttccggtgtctagggataggccatcttaaggtagattgcaaggggaacatcggatgttatcgttgctggtaccttggccatgttgagcatttctgcaagtttaacaaagaagagcacaagcgctcccctgtagctgacggctcccatccttgccacgctgcggtggcgatgtcctttgcgctcattatggctaccactctctctcgtgcacgcggaagaggggggctgctacgacggctgttgtacccactcataagatggattgcgacgatgatataggtgttggcgatccttccatgtacccaccctatggcttttgtgtcctctcttggacccaagggatggtggagatcgagcagcgtctgtgcaagcaggctttggaggcatccgtcttgatggggcgctgagagatctccttggccatggtggtgttgatgaaaaatccgcgtccagccgatgataatgaatctgtgttgacgcgaaccgtgtcgacaaacatacgatggcttgggagatttgcttagctccagtgtaggtcctaaaattgatgagatgcgggcatgccattcagtttgatcctgcaactgacaagaacagcatatcaaaaagccgatcggctgacgagccgatatagtgatactagccgatgttgataccagtcgatgctgatggggttttgagcaatcggctatatgtccaatgtagagtctgactcttgaatgaataatgatataaagataatcaactgatgataatgtaataaaataatatataattcaatagaaaccaattagtcaataatgatatgatagaataattgcttgatccgaaggttaaattaaatccataagattcgataatcaatgaaacctttgttgcaatcggctaaaaccaacttgtatgtaatccttgtaagccaatgcaatgtccagataactcatcgactgaaatcgcaatgaaacccttattggcaatcaaaggcagcttagtttttatgattctaagcacgacttagtaggtcaaatccaattgatgcagttctaaatatgaaaagaaacataaagtctaaacaatcaagtcttagactaattttcaaggtggtggataccttagctaatctaaattgataaaacaatttagctgataccaacaaaaccctagaaaagatctgtcctataaaggtaaattgagacatcgacttagattaactaagatatatgataaataggtgtttacgccgacacaattagtgtcgaggccctagccccgccaatacaaacaaccataattagtcttaccccttgtcggagattgaagccgatgcaacccaacttgaaacaagaactcatcgagaaagacgaaaataaaaagggtggcgatgcgccaaagttctattgattgagagatagattacaaaaaccccaagtgtacatatttatacccatgggtagatactagtccatatcgaacacgtcatatattttctaaagataaaaggaaagataaaagtcttgatcggacactaaataaacatttcctaaagataaaaggaaattactacatcctacctaattaatactccctccgtttcaggttataaga

SEQ ID NO: 42347 - DNA, 12178 bp, Oryza sativa
atagttatattttcaacccaagataaattcattataaaaatatatttaattattaatttaataaaactaatttggtaatgtaaatattactttatttgtctataaacttagtcaaacttgaagcagcttgactttgaccaaagtcaaaacatcttataacctgaaacggagggagtagatagaattaagtcaccatgccgtagtcttcacgattccttcttaaactcggtcttttctggataagtttctgtcgactgactgctctttctttaaccgaatccactaaagaatcttaccaaattttgccgttaacaggtgattgacgcgttgggccgttcctgtggcatcctgtgggctaacgttagagttggtgatgaggccctctaactttacggggactgcacaatggtgcggcacacaatccagccacttccaggtagacaatacctggttgtcttttgccggtggcaccactctaccaacacaaggagtaccaggatgccatacgtcatcaggctagcaattgagggcctacctgctcatacctgtgagccagaggccctcaagcacatcctcaacaagctcaaccgctagcttatcgagcactttgagccactctaccaacacaaggaataccaggatgccatacgtcatcaggctagcaattgagggcctacctgctcatacctgtgagccagaggccctcaagcacatcctcaacaagctcaaccgctagcttatcgagcactttgagccagcggatgcatgcacgttcaaggtgcttgcctgggcagtaaatcattctctgatccctaaggagccgcctctggacatctcagaactgatggtggaatggtggttgtccagaactgatggtggaatggtgggaaccaccagaggacgaccaccttgacatgttaggcgctatcagtgtaaacaccgccacgcccactccttaaagccgtgcttgacattcggcctcctcatcttggagacggtcgacccggtgcccccacctcctgacaccctgcttgcacacgtacaacacctcccttggctagattgacggcaccaaccctaggccggtgctaggcaggacatgacgagggaggggggaggcgtatcgtttcgcatgacatggcaccgggatgacgtggcgcctttttcttccaaggagttatcatgtccggcattcgcctcggcgtgcttcaccactaaaaaaaattatgctttcaagatcttcctcaggatctccatggcaatgctgcatttatggagccagtgaattcctagccagtaacctcagctgcttccccgcctgagacaaccactgctttgctcttttttacagccaagtaggagacgagaagttccaaaccatcaggaggcgacaacatgcttgggccaagcaagcgcttctccagcctaattacgaccttctctaggcgcgcagccccgcacgacgcgagggccaggagggtggttgatctggatcgatcggcgggccaggctaatgggctggttgagcatctcaacctaagccaacctaaggtgacagaggttgcaaggtggcccagaacgacatgtcgtcgagggctccaagtgataaagctagggctacccactctgcagcaatcctcgtcaccgtttctgcccaaccgccatcagctacaaaggcggcgtgttcttcacaaggcagcaccccattggttgtttaagcaatggcggacgtcatgcagtctccagcattcttggtagtcagccccgcgcgttggtttagaacaagctagcggtcttgttcacaccacaccacaatgggcgtatagaagtgaagaacggcgacaagcaagtgcacacgacgaccaaggcgcaatgatccataatgaagagtttgggcatcatggcggatgagaacaaggtggatgaacatgatatcctttgatacctagggctattcaagagtcctctcgctccgtcgcatgtttaggcccttgctaccttgtgtgatttgcaggcgcatgctgctatagaagctcggtaagcatctattaagtttgtgcccgtcatggacttctatttcttatgtcatcgtgttgtatgttggtgtggaatgtaagggggctcaatcaggtaaggaagaggtccctagtcgctgaagtggttcaaaatgcccatgtgtccattatcaattatcagaatccaaattagttgttgttggtaaggtgtttatcgccaagtcctgtagtcctgtagtatcggttttgatgtgttcgatttcctgccgactgatggtgcgatggaagggggagggtgtctcttcacagcctagcgaagcaatcgattcgttgtctcgtgtcagaaaaggaacttggtcactgagcttgtgttctaccaatttttaagggcggaagggggggagtagggatggcaatggatcgagtcgggcacgggtagagcaaaaccatgcctgacccgacacccaactttgcccacccgaactctacccaatagggttagcgggcaaaactctatgcccatacctatgcccgacgggcacaggtatgcccggtggatacccagtgggcacgccttccgcctgccgttgctgccgcctgccgtcgctggctcaccattgtcgtcaatgtcgtcgccctgagccaccattgtatgcatcacgctaagacgccatcgccgccatcgtggccctgagccgccgccacaacggtgagaagggagcggagcggtagcagcagtgcaatggaagaggcaaggagcggtggcggcgtgcgctctctcaccagatctagcaacagcaaacaccagatgcagtcaggtgagcgacggcagcggcagcagtgaactcattgccgcctgcatgagttgccgccgccgcttgttgcgccgccgccggactagggagagaggtagacgggagaggtgggggtggggaattaggttagagtttagtgagtgagtatatgtgtctctgttaatgggccaaatggactaagaagaaggggatgagaattaagagatgggcaaaaaatagctaatatatatatatatatatatatatatatatatatatatatatatatattatgtacatgtatctggtcgggcataggttactcacgggtaaaattcaaaacccggctattgcccactatatcttcaagcatcgggtgggcatgcccataggtaaaatgttacacccatgcccgtgcccatcgagtcgggtatccgcggttacccggacccatgggcaaaatagccatccctaagggggagggggaagggggaggatgtatgggccacggttggtgcaaaggcaaattgtcattcctggaaaaggtactatcggtcgggcaagagtttgtgcaaggggcctggtgtattgtcgggaacttcaaccttttggcagcggaatctgataaaaacaatggcaatgttagtagaaggctgataggcaagttcagggatgtcatgaatgctttggagcttagggagctgtacctttttggtcggcgctatacatggagcagcgagcgagaacgactgactctttccaagatcgataaggtggtagtgaatgctgattgggaggaatcgaggaagtatacaaggatgcacacctgcaagccctcaactcctaagccccggatcactgctcgcttctattgacttgtgatcagccgatgcaccagcaccgaaagttcaaattcgaggccttctggacccggatggagtgcttcgatgaggttgtgcagcaagcatggaattcagctcgaccaagttccaacttccaacgcgattagtgccttccatttcaagcttcggtcagcggcgtcgatgctaagaacctggggatcaaacagaattagtgcccgcatgatgcaattggcagcggcgcactagatcatcatccagctaaacaaggcgcaggacatcccgtagcgcctcctccgcacgtcgcttaaaggccgttgtctagcacttgcgtcgctggattgaatcaggctgagtcaacgggcttggctatgtttcctcaagcatagtagcaccagcactcaattcttctaacccaagatcaatgcacgacaacacaagaaagcaattccaatattatgtcacgtcggcgaatgggtgacaacagaaagcaacaagctgagattggttcacgacttcttccttgacatcatggggcgccttcctctccttcatcaagcattgatctagacggcattgacttgcctcactttgacctatcaaagctagatattgagttcgctgaagatgtgaagaaggcggtcttggaaatgccaacggactgagcatcagggccagatgggttcaccaatgaattttataagaggtgttcggagttgatcaaaggagacctgctcacaattctagcccttgtgttgcaagtgaattcctagcacttacatctattgattgcactcttccccaagaaagaagactcgatacaactctcgaattacaacccaatgagccttatccatagttttgcgaagattttttctaaaatcatggctaccagattggctgcacaaatgggtgagctagttggaccagcgtaatcggctttcatcaagaagaggcacatccaggagaacttcatttatgttcaagggcgatcgggctgctacattggtcgaaagtgaccaaccatcctgctcaagctcaatatcaccaaggcatttgatagtcacttgggttttgggggaaaaaatgcagggatggcattgccatcatgctgggaagggcgtcaacaataatctccatcaacagctacaacgcaaaaaggcatcgggctcacaatggggattgcagtagggagatccatattgtttcccctgcttttcgtcctcgtgatggaggcgtttggggcactctgctccacgccggtgcaacgaggggtgctttctccactagttgacgacgtgatgcccttgcaagtgtccttgtatgcaaatgacaccatccttttcttccacccctcgactcaagatgttgtggtagttcatcctgcagctaatgggtcgtgtctctggtttggtaactaatctagccaagagctccatgactattatccactgctcagacgaccaaatagtcgaggtcgcaacgatcctcagctgccaggtgaaggatttgcctctaacctaccttggtttgttgttctccgtgcgcaaaccaaccaaagcacaagttcaaccaatgatagaccgactaacgaagcacacggcaaagagtgaaaaaaatgttgcggtttcttgtggaagggcgacggaaaagcatcgggggaacacaacttggtggtctgggacaaactctgtttgccggtggaatatgggggattagggatccgaaacctgtagcttgcgggggtcgcattgcgggcacgttggcccggctacgcaaagcgcagccagaacgaccatggacatcactctctcgatataaaagaaagtagcacggtgattgtggggaacggcaaggggacattcttctggactgataactggttacctaaagagggctcgattgttaattgtgctctaatcctcgcctccttcgttaagaagcgatctcgtagggtggcaacagctctacatgataatgcctgagtggctgacatcacaggggctctatctcctcaaggtctggcgaagtacttcatggtatcagaaatggtgtcaagggtgcagcttgctgatgacatcgacgataaggtctattgggctccaacggtggatggcttgttctcaatccgctccacctacgcctcctatgcgccgccaagacgaaatgtcgcctcggaaagataatatggaagtccatggccctgtcttgatgcaaattcttcatgttcatagcaatgcaaggggcctgcctcatgacggacaatcttcagcggcgtgagtggcagcttgccttcatctaccacctctacaacatggtagacgaaacttgtgcttcgatgctatatttccgaattacaacaaatgctatattcggaaacttgtgcttcaatgcccttcaccagaccctgacttcccgtcctggtggtgcgaggcatgcaagagtgttgccaagaaagaagagaagtgtttgacgctgttatgattctgattacatgcagggcagacctaccactatagcatgttgtggtgcgtgccatagctaaccttcgtagagagcaccctcaccctcagcttcccagggatggctactaccacaaggaatgctcgaatggtctcctagagtagcattagaagctttggactcgtgaggaagatgacttggtgtgttaatggatagagatgggggtgtgagagggaatggttgtacgtgttaatgtgctaggttagctggcccatagcctactcattttcctcaatccccaattccccatcaccgattcgtcgtgctagggctgatggagtggtgggcattggctgctagctgcttgattaattagagcttggcgtgtttgaggttgccggcggattggtggctcaggtaggcgtcaaatggcgcgcggcggagcaaatcataggtggcgcatgtgacgatggacgactggtcattacctcagctttgatctatagcaggaagaggagcacctagctgactagctcgtcaagccgtgtaggtgggcctgattgtagcaatggcagccgacaaggacaacaaggaggcggctgctcgagacacggcaacagcgaagctggtcgccgtgcgtctgcgattgttcccaggcaatagggaaagcaagtaagcaacagtgacaatggccaagacaaccaaaactagtgcttagtgagtcttttaacttcattttcttttagaaagcatcaactactaagtataatccacctagctactttgtttatttggctggttcttcattattgtttcatcttgtttagaggactaaaacaagagtctcaaactgtgatatacagtacattagcttggtattttcttgtatgtactgagtttatattttccgtgtttgcattttcacagtagatgttgattcgaaatcactcggttagtatgtatctgcttatttcataaatacaatatgggcatttaaatgtttttcctgtggttggattgaaatgctcttagacgattcattcgtctccgccataactatgattttttccagggtccgccattggttacatggctggtgcggaaggaacgaaagtacgaaacacacggattttcaatggaaaggcgctgtcagtacaggccgggcgctctgtgcggctatatatggaggacaaatggaagacatggcaggaagctggtctgctaaacgcccagaatgacgacggaagcgcaatggggtggcgattggcgaaagtaacgctgtgtcgctgcgtatctggcttgagttgtatatatgtgctgggctggtgatgtgctctgtggcgccagctcgagtctctcggcggctctcgtgctgtagttcttcgagtcctgtaaatttgtggaacgttttttcccccaccttaataaacttcggccgcattctcgctggcccggcgaaataaattaaaattaagggcagcgggcagcctgattgccttcttctagtaccaaatatcaaactcatagtacatctaaataacaaaattagatacaactagctggtactcaaagcacattatgcaatcccacaaacaagaaccaacgagctttagtaagaaccaccaaataccatcagcataagtactagtttactacgtgagagaaatatcacgaaatttgcaagtaatgaatggtgcaggatttcctagtgctccttgaagctagattttcgtcctaaagttggcaagatttgtgttattgcaagttgctagagctgcaaaagctgaagaaaaataatctctatccccaaaggtgtatctcgagccagagacttactggaggcagcgccacggagggaggtcaagcggtgggcggcggcgagatccggcccggcctcgccgctcgccggcgcccgctgtggtgaaggggtgaggagagaagaaaaaaaaaatggtgaagtgaggaagaagaaaggggagaggaggaagaaaaaggaaaaatgacgaacacgatgaagatatttgcctcccagttgacagctgtttgccaattttgcaatcttatccttcgacttcttcaaactgccacataagggtcttctcttttttggctttttatttctggatccttagaaactttcttatttggcggttgagtccttagcatcaccgcagcgtcctactctctttcccgtgctcgcggagaaatttaacaatatgccactctataggtgtgactttaacatgatgccacctcataggatgaccttataaaaacgccacttcgtagatgtggcttcttaatgaaatgccactttaggatgattagaggcttttaatcatactttgggtgattagcacactttttaaccgaaccatcgccttctaaccacctcgccgctgaccacgacgacctcctccgctttcatcgccgctgtcgccgagcccctctgcctcgcctcccgccgcctcgccgccgtgctccacccgctgctcttcctcctcctcctcgccgccgccgtgctccacccgctgctcttcctcctcctcctcgccgccgccgccgccgtgatggggacgcattgctatcgccggtgggcggagagggagagaaggggctcacaggtttacgccttcgccccttctcacccttccacacggttgtcgcccacctcgccgctgaccacgacgacctcctcctgcttcccccctccatcccctatctcctcttcaacctccccgaccccgcttccgtcgccgccgtcaccgagaccctctgcctcgcctcccgccgcctcgtcttccttctgcctcgcctctcgccgctcgccgctatgctccgcctgctgctcctcctccttctcgccgccgcttgccagtttacgcccttccgctcagtcgtcacccatccgcgcgcccgccggcgtcggctcccaggtggagggatgcggcggcgggccacatctcgcttgccggctccgcgcagcccggcgccgaggcgggcgtgggagtattcggcgaacgcgagggcaacggcggcagcacaagcgaagaagggaggaaggagtggtgggaagggccgagagacgtggagcaggcggccggcgaccaccacgtcagctccggcaacaggcggcaaggagccgcctcgtcacctcgtgctctccacggcaaggcagtgcagggacaggaaggaggacccgtcgcgcgttggccgaggtggggaccatgtggaagatgggcagacggcctcgaccccggcgagcgcgcaggcgagggagacagggtcggaaaggtcgacggcgaggtggtgggtgagtgggaacgtgaagaagtagacggcgtgggcggggccggtgccgagcgccatcgcggggaggcctcggtacaacgccctgacgccgccctcgccgtcgagctaggcccgtcgtcatcgcgtccaactaccacctcgttccagagcaccgcctccccgcggcgctcgaggacaccgaggtggctctcctttggctcgcgtcgcaggcgcctcggcggccaaggaaggtggaacggccgagagaatcctgttaaaacctctaatcaccccaaagtgtgattaaaagcctcaaatcacctcaaagtggtatttcattaagaagccacctctataaagtggtatttttataaggacatcctatggggtggcatcctgttaaagctacacctatagagtggcatattgttaaatttatagtgctcgcgttatctgtacggctgtaccgttcgtttgttgtgtattgcgggaacacgatttgcaccgaaagtttggaaatttgcctcttcaataaaaacttttttcataaaaagaattgtattgataaaaaaaagaagtgtaacctcgcaaccagccctaatggcgctgagatccaacaggttaacattgtgctaagtcttcactaataagaaaacattgtgctaagtccataccaccgccgtggctacctcgtctcgttatcgggtcaacgtagcaaatgggtgtacgccataccacttggcgttgaaccaccgacctcaacacaagggctactatagatttaacttacattcaggagatgcttgaaaaagttaaaacaatcctatcacatacttcctcctttccaaaataactcaatttagtatgggatgcgactcatcatttattcttcagattcgttgtcctaggatgggtcacatcccatcctatgttgagttattttgggatggatggagtataaaatcacaatgtcattgtagcatatggttaccgatgcttgttagttttaatttaagtgaattgtaatttgggccacattttattgctaaagttatattttgcactacctttaaactaaccttattatttttggattggataactgtgttttttttagtttggaccacccaaaaaaacttaattaaacacagatgaacttctacatccctatacaggctgtattttcaccataaatagatggtagacatagaattgggtggttcaaagaaaaactttatttaacaataaagagtggtttaaactacaatttactcatttattttttaggcatggatttgaccaacagtgttatttaaatatcaaatcacgtattatcttattgtaccttttcatttgtgtcctttttacactgctaatagagtaacgggaaaagccagaaggcttagggcttgtttggtttgaagccaacttttactttactacaatcttggtagtgtcataagcttggtaagttttggcactaacaaattgagtagtattaagattaaactttatggtaaaaatttgggtagcaaaccaaatatgtatttactactattgaagttacaagaatttagtagcacaataaccaaacaaagcccttaattactttcggtcaaaactaacaaatattaacctctctaaaatcgaatttggtaggatttgtgaagatttaatgcgccacgtcagtccaccttttgcaaaagaaccccgctcgttcagttaattccgcaccaggtccccgctacggctctacgtccaccgtccgatctcgcggtaggttcgatcttaccgtccatgtgtctcactgtgacggcctttccacaccgctcccccaccaccacgcgcgccgcctcgccccacctcgcgccgtcgccgccgccgccgcagctccctcctgctccactccctcgccctactccagctgctgcctgtccctcccaccgagcagccggatctcccagtgagtaggcccgggccgccagatccggtgaccccggtctcctcgccggtgtatccggcgccgcagggagggacgagagccgccggcgctgccgccctttctcctctctcatccctgccacgccactgcctccctcgccctagacctctacgcctcgatcagtgcggtgtaatatggctcggggaccgtctgactcatcgaccttgacagaaggtgagaagggaggggagagcgccgactcggccacgaccgcgacgaagacagccgcggctcggcgtcggcaacgacggctacctggtcgttcctgctctcctttttcctttttggttctagctcagtgccatgagaaggaagtggctggaccttagttcttgatgacgattacaaccttgatttgcttataatgtgtgtaaggcatgatttagttacagtgtgtaggttgtgcagagaaatttccctcggcatgtacttcaacactgtcatgtgtgatcaaactgtttagtttgaaacaatgcacactgctactcacatttctctatgctgcgattatttatttcagttaggaattgcatatacaactttggagggcaaaacgataatgttgataggtttatttgttaccatttgtgctgcagggcgtattttcatattcagacagttttggaagctgcaagtacacatggcttgcctcttgaatgtacatcaaaggagttttttatatgctgctgtactgtgttcctttcactgatgtgtgctatatgctccaagcgcataaattacaggtatgttcca

SEQ ID NO: 42348 - DNA, 1171 bp, Oryza sativa
  unsure (1)..(1171): unsure at all n locations
cctgttccagttgagggtaaacctattgatggtcatccgacaactgaaaatggccatggagatggtgcttcaggagaagcagctgaaacgcaaactagtgctcagacttcacaatgattacaagatcagccgctgctgttgttgctggtagttgtaggtttgctttgttgtgcttgtagaacaaaattactttagagattgtgttacttgtaaaatacaacaaaacatgatcatgttgtaaagttacctgctcaggtttatacacgtccatgtaaatcaaagttcatactgtaataacttgtaagtatgtaaacatgactacacgagaggtttgagggtaccattttctcatgttttcggtggcaaagataatttttcggatgaaatattggcaaagcagtgaaacatctatctatctattatattattaaaacagctttgaaaagaagcaccacgttcgctgtgggggctagaaattcccacattaatcagagaaaaagaaaaaaaaagaaaaggagagtccaagtaaaaatacaatttaaaataaggaatattgaaagaagaatccatataggaactcaatacaagattaattaaaattcggaataaaaataaaataaaatctgaattagcaaaaaaaaaaagagtccaagtaggaatacaatttaaaaataactgaaattcggaattagaaataaggaatattgaaagaatagtctatataagaatctaatacgagattaattaaaattcggaataaaaaataaaaaaatcgaaattagaaaaaagaaaagaaaagaagagttcaagtaggaatataatttaaaattaactaaaattcggaattaaatataagaaatattgaaataagagtaaatataagaacccaatagtagattaactaaaatttggaataaaaaataaaatataatctgaaattaggcaaattaaaaagagagttaaagtaggaatacaattttaaaacaactgaaattgaaaataaaaaataaaaatatcaaaagaacacaatacgaaaaataaaatacattctgaaattagaaaaagaaaaataagatatcatctaggaatacaatntataaataactaaaattggtgataaaaaataaagattactaaaataaaaaaccatctgaaacataggacgggatta

SEQ ID NO: 42349 - DNA, 18904 bp, Oryza sativa
attcctgcagcccaagaagtacaacgggcaggttgtgaagcaatcggtcaaggcgggtggcaggagttctagaaagtaaaaaaaataaacctaatgataatcatatttgatttctaaaatctcaataataataaaaatgagaggcaacgggcgggtcgtataggagtacaatggcaaagtcgacgatggttggtgggtcttctagaaagtaaaaaaatgaactccaacgatagttatgttcaacttttacaatcctaatgacaataaagagtatgcggcggatgggtcgtagaggagtacagtggtagcgtttgacgggatttctaaaaattataaaaaaaatgaaacccaacaagacaataaactccaatttttaaaggttcgggcttctaaaaagtaaaaaaataaaccccaatgataatccgtttgattttgaaatcataatgacaataaagaagggcggcagcgggtgagccgtagaggagtacagtgacaaagtcgctgacgttttggcggaacttctagaaagtaaaaaaaataaacctaaataataattatgttcgatttttaaaatagcgatggcaataaaagagaagatgcagtggacggtcatggatgaatataatggcagtgtttgtcaggacttctagaaattataaaaaagatacccaacagaacaataaactctaaaacctataagtttttagatccaatttttaaagattccaagaagaatgaatagaaaacagtggtagatcgagcaagcaaataaagaataatgtgacagaagtaaggggtaggaactgttgtgacttttaaaaactaaaaaaaattaaaaacacgaggataataaggtttagtctttaaaaatcttaagacaacgagataactatttaacaaatttgaagtaaaatcatattaaaaatatataattttatataggtgctagccgtgcaattgcgcgggtcacccagctagttgaacatatgattagcgtgctgttatatattctgtcaggttttgaacaatttcaggtttctagtcagtaaaccaagagaaaattcaaccagttctggtaaagcccggcccatattggcccactagaaccgtggccactttcctcggcccatcgtgccatccgtctctctcaccgtctccgtgctcctccgccgcccaagggtgtctccggcgactcgcccggcgccgcacgcgaagcccggagatccggctgcggcggaggcgagaaggaagagggagatgagggccgtggtgcagcgtgtcctctcggcaagcgtcgaggtgagcgggttcccctctcccactcgctagctaggaggaggaggcgagcggctgattcctgattggttggttcccgtgggttttttggttgcaggtggaggggcgggtggtgtcggcgattggccccggcctcctcgtccttgtcggcgtccacgaggccgacaccgacgccgacgctgactacatgtgtgtgcccagcttacctgctcttactatttcgttctcgcatctcactgaatctggaatctgttattttttacgtgtttattagctacttagcttctttagtggagggagatatcatgaattcgtaatgtagaatgggagaagaaatgatggttgttgataaatcaatgatactagtacttgttgccatgtttgatctggaaacgtgtatactgtatagtttggaaagagcttcttagttctagttcaattacaaaagttccatctttgcgtttcctgcaattttgtttatgctcagatcttcagtaaatgtatgatgtatccttgtgttatattgtcactctcatactaacatgaccttacgcagttgtcggaaggttctgaacatgaggctatttcctaatgagaagactgaaaaggcatgggatcaaagtgtaagtcctgactcatcttggtatcaatatgacaaaaacaacctattcaagcatgtcacatatatctcctgtacttcatttgaggtttgaagatgaacctaaataactttttccttcttgcaggttttgcagcggaaatttgaagttctattaggtaggagtaatataatacagcatttctagtcccagatttgaaaattcttaagctgtagtagctttgttgttattgacaccgttactaagctgatatactattcagtcagtcaatttaccttatatggaatcctgaagggtaacaagccagattttcatgtggctatgccacctgctaaagcaaagccattctatgcttctttagtcgagaagttccagaaatcatactcagctgatgcagtgaaaggtaatatataatgcatatctatcatttctttttgcactatgtaactagcagtcctgagttcctggttatctaattgttgttcttattacaatttgttcttttgtaatccacacaaatatggctatgttggtgtgttgcggatttaagtgatttttttccatgtttctcatggttcctacactcaagattattttataaagcacattctaagatgtattgctggtattgtacttcaccatagtaacttctgctatcaatatattataattgttcaactcttttattatttttcctttcactttccctgatatattaccatgaacatttatattaagtatttgctcagagaacaaaatttatttattgtaagccattgtcagatgagctatttctaacatgtctatacttttaactcgtcttggcagatggcatttttggagcaatgatgaaggtacctctgaataaacatatgctgtaattgcctttttgtgctctattaccctttaagatgtaaattcaatacttttgcaggtttctttagtgaacgatggccctgtaacaatgcaagttgactcatcctcattgcaaaatcctgctcagtcaaggtgagctttcctaaatttgcgtgctcatgctcataaggacatggctgattttattcatttttgtgaatctttattagcaatggtgatgttggctcagttggggacaatgaagcacaagtacctaaagagacttcttaatctctgtaactggtcttctacccttcctgcacatgatttgaacatggttatcgctgtcccacatcaagccatgcagaattttgagtttgtttttgaggtttgagcaggaagaagccctccagtgagctcgtgccatgggtgctacaagtcgtgttttcatttctccacttaaatattgattactggggaaatatattagtattcatttcgtcttcaaagacatgaattttattactgatctgtcattcatacacaaatatcaaattgattcagttggccttagtgttttgtcattgtcgtttaactccagcagtttacttccttcatcccataaaaaaccaacctagtactggatgtgacatatcctagtgctacaaatttaaacatatctctgtctagattcgttgtatcagaatatgtcacatctaatctcatatttgtttgttttttgggacggagggagtactcaagttcagcactaacagcttaaaggagtaaccgaaatgattatattcatttcttctgtgagatgatagcattatttgtctgagaaccatacatcaaagggatatgttcatgcatattattgcttgagcttttagctggttcctagaccttaattagtacttttgcagcatattattgctagagcttttctggcaacgctgctactagcatgaaactcatctctgaagctgatgaacgtacaagaactcaagaaggtgtattatattctaatttgacccactcctggccatttgctgccagcatcacctgcagttgcaaaacacaacgcagacgaagccaatacatccacccgtacaaaccctgaaccgtcaacaaaagaaagagagaagctctttcagcttacctcgcggcgtcgctgatcttgtccctgtagtcaccctgacctctcacagctgcgccggacctcggcacggcggcggcgttcgccgccggcgggcagacagacacggcgcggtatcggtcgtcctgcgcgtgcgcgacgaagccggtcacggtctgcgtcgccggagcttgcacgtgatgaggcggcggccgcacggacgacatggctccattgccgttggcaccgcggacgccggcggcggcggcgacgaagccgcccggcacgacggtggcgttgtgcggcacaacattgccaggcctggcggcggtggcgccgttgtacgccgagaccagcagcagctggtgctgcagcgtcgtcggcgacgaggcgtgcctgacgccggcggcgccggcgcagcacgcgcactggtcggcctggcggcggagcgcggcgttctcggcgcgcagggcggcgttgtcgcggcggaggcaggagacctcgcggtagcacccctcggaggggtcgcgctcccgccaccgcgcctcccaggtgagcgtctcggcggcgcggcggcgcgccgcctcggtggcgttggccttgatgagcttggtgaggttggccaccccgaagacgaggtgcagcgcgcggaagtcgttcatcctgttcgccgggaagtaggcggccagctcgcagttgggctcgcacttgcgccgctggtgcttgcacaccgcgcacgcccggcgccgccgctgccgccgccggtcatgtcgacggccggcgacaagccgacgtacgtacaacgatctctacaaactcagctgcaagatcgaagcattagcatatatatgcatgcgatggcaggatgcgagtcagcaaggagagagagagattgcgtgtacatgcatgtacacgtatatatacactcacaagatggtaaggttgaaagtagggtttacggttttgtaggttgctcacaggaagatttcaccgcagaaataggggcatggaaacttcttatctgacatctgtgtagctgcatgcagcgacactcccaatatatgcaagatgtatagtagctcatgtaccatgtgaggagtttggggacaaatgagtaaatgtataagtggaatgtagtagaaaaatgtactagtatctagtatcaaccgagtaatgtaggacagaaaaatgtatatgcagtagaaaaatgtgctatatcaacttcaagtgatattgtaagaagtggtatgtatgttgtctccgaataaaaaatttcattccagaatgcagcggcacaaaggacatgtgtgcttacattcagttatatttactgagtgtctttttttcagatagtggaaaggtcatttccaactgtgcagcagaacataacgattggttatttttgaaccatggttcctggcacagattagtttagcaacagatagaatctgttgaaatcatttacttctgatatgcaatcaatctcaacaaatatcactagacagagtaaaaggaggcattcagttcagccgtagctatgtgcgtgatgtgttagcaaagtacaatatcacattcacttttactctttcgaacttgttctatagttacttacccagaagtaatctacatgatacagtgcctttttctatccttggcctctattattttagggtgtctatggatcatccggcatatattttgatccatacaccaaaagaatgggcatggcaatgaactgccacacaagaatcacaaaacagatcagtgaaattttgaggtgttttgcgcatcaacttaacaaaatatcatcctgtttcgcctgacccaagttaatttgattgatcaagcaggtgttgctgccttgctgctttctgctccatgaacacctttgaagttcaagattcctgaaaggcctcgtcctttagcgaggtgctcaatttcagcaagcctcagtttaagatcctccaaatctttagataaactctcttcccgttgtttcaattccttgagatcaataaaaacaaccgttaagctatattttggcattatcaataaggaacctggaaatgaaaacaaacatctctctgaacctacgcatattgctaacttttactatgaagataacttaaatgatatattgtcaagtagaccggtgattaacttcttataacatttcacatcaagaatgacatactttacatattctaataatattctggcaggaactaagattttaaattaatagttaataagagattttttggtcaacagtgagtagtaaataggtatcctcattccacatgcaaagtttcaccaggtaaatggtgatttcacacttcaaaatgtttctaaagggtggcattcaaggtgtggttgaagaacacctagcagttcactaaaaacatttctgcatgtgcattccataaatttagacataaatccatattatttgggacatgttcaactctgcttactgcagcagccgctgtggctgcgacagctgaaaacgactgcaagacagcaggaggcatagtactaaagcatgtcttatcaactgatacgtcaggcatcgatcatgaccagttcctggtgattaaactaaatcaggttgccacctgctaattgttttcttatacaagattcagtgtagttatttgggttgttcattcctgattttggatgaactgtgcaaaactgggcatagtaatttttctgatgtgtcctctgggagctaagctaaatatgacactaagcacgttgatttccacttttcagtcttaaacagattgagtaaacccagaatgaacaggcctagtcgttatgatactagatatgtctatctccgtatttacatgacaaattttcagaacccaaactgcaatcatgagttataacatcttcctatggacatcaaatttaaattactctggctacagcataagggcttatagattagagttttgtatgttcattcttacgtgcaagattaaatagtgaatacgggatatatggctgttaagtgttgtagcatatttatgttcgttcaaactccaggagaaaaatatagaaatgagtcaatgctagaccgaaccacgttagaaagtaccacctcaagttcctgtttacgagcttcctccttcctagcctctgaccttgcatttctttgcacctcaaaaattaaagcagcaacagcaacctaaaaccaaaaagatgcaggtttcatttcctgatatttcaattattttctttattttttcacataacagagcaaggttacttcagcccagcaaatatattcctgtggctactataaatctattggcatacaaggttcattgtaggttaagtgaagtaccgaaaaaataaagccttctccaatgagatccgtagcagcttgtacagctttctcctcatttaaaggtgtgatttccacatctgttgcatgcccataaatgcgcctttgtatccttgtagtaacacgatggttaatctgtaacaattgttatagttacaatcggttagttatatgtcagacctcataagggcacaaaggatacggccacagcccacaacacgtaaatacatttgagagggctctatcttagaaaaagccagatgtacaaatttccaaaagcataaatcctaaggacaaggataaatctcctcaaggttcatgctccctgtattcctcaatccttatttctctaattaaaagaatatatgatgtgtattctaagtcagatatgtgaaatatgaagctccatatatggcagacagctcacatcatagacagaaacctatcatagatcagtgtccagccatttctgacaagccagaatcgaacaacctcaaatgggatgaaacgcttattgatgaatctatcagctgatgatcaagaccaactgacctacaattaaactacaaaatgcttgcacaacaccaaacagctaaagttgcttcttggaaattgctccacccattcgccagatggtactgtgctgaagtatcatcaagattcaagacagccacatttcctcctactactctttaattctttatctttacattctgtcaactctgcaaaatcccctttcacgggcacacatttcctctttcctttttcccccgaggggcacacatttcattaagtatgtaagtttttcgttaccaagaaatggatattgggagtaaatagccctaaccagatccccttcccacgagcctaacggatgctgctccgatcattttcccttatcaaaatttccttcccttaggcgctactttctccgaagaacacaacacgatgagggggagtaggaggaggaggaggaggccccgacctgcgcgatgcagatgatgaagttgcggaacttggggtggacggcggcctggttcttgaggcggctggcgatgggcttggacagcgtccgcagcgccagcgtccccagcttcgccaccggcagcgacattggcggcggcgattccctggcctcctcctccggcggcggaggattggtggaatcgtgaggggattcgattcgattcgattcgattcgatggggggagcagtacaagggtgggacgctgattggttgtgttcctgtgaaacggaacgggagtaagggagggaatgtggacttccttttgtgatgaatggcttttcgagttttgttgacttttgactaattcatcttcccctttttaaaattcaacttcttcaaaccgtattttcttgtcaagcaagtatacataaattaaaattttcgaatcagaaggggataaatgggtaattaagtggttacgaatattcatattcttgaggcatcaacaatccggtgtattcgagccatctattctattattaatttctcttgttttgaacgaagtgagcatagtttagttgtggtggaacaatttatacgaatttaaattttagatttgacacggatgatcgtatttatgactaatttttctttcagtggtagacaatgtacccctcgacttgtggagtcgtggtgacttcgtcaatcttaagataagatatgttggctcactttatggctgattattcttacagtgacacacttgttataactttgtcaatctcaagatatgccggcccagtctttcgaatgtgctcatatagatagatgtgcatgtatgcatttatagaggtgattgtgcatatgttgtgagcgtctgcgtttgtactatgtttctaaaaaaatattctaattgtttgaactaagttaaagaaatgaaagaactatcatttaccaagaaaataaaacaataacgggaaattattgaccttgtttcgtggttccaatgattttattgatttacttagttacttttgccggtttaagacatgaagggattttttcccacttttatgggataaatcgtttctgaaatgccatactaatagttattacctccgtcccaaactatactatatagataaaatctcttatatttgtgaacaagatagtatattttttaaaataaaataaaataaaataaatatgtgatatatcactcaaagtattccataacatttagggtctatttagatggttgatattttcagctctaccaaagtcggtaatgtaacaaattaactaaatatgtttcttccaatactacctaccaagatttagtaattctgaaaaatactatcaaattttggtaaagcttaactctactaaaatttgatacaccaaaatacgttaaaatttaacagtactaaatattggtatggttgatgtaggtaataattatttcgtcacttcctagatgggcatcagcccgttggtcatttggactaacgaaaatgcatgaacttaattatccttcaagaaattaagcacagaaaagtcagaacacagtataatctataatctagagtcatcgaaaaagaataactatatttgttcgggtagttttgttcttcttgtgtgataaggtgtttcaattggctttaggcatgcaccgttagctttcggcattaataacttgacaaaactaggcaataatgcatggatttctcgtaacatttaaccctatctcacctaggtaaaaaaaaaaggacatttttaccacatataccttctgttaacagcttctcaaattaaccatgctcaactacacatgctatgccctagccaattccatacattagctttttggctctttaacaaaagtgatagctagcaagtcagtgctagcttatgaacagttcaaagttgatactgactaactgtaagaagttccctcacgtatagccattttcttttgcaagtgtaaacagttacctctccgatcaagggtagatttagaaaatttgtgatactggtaagtgtcataatacactgctcatatatatttaattcatagtatcatcttctatatataaacatttgaaccatagctttcaccgaaaattgttgcggtcatctaacctacgcatatagtatccattatccaatatgtaagtatgtaactctaccaccacacttcatatttacacccttttgctattttttgacccaatacaatgtgcagtcatgtactaaggatcacttaatttttttgaaaattagatcaagcaaagctctttcatgctttccatgaacactagcccctgaagtctttaacaaaataattagtgaaaacatcttcatagaagatcctgtatcagcacaccttccattacaactaaaatgcactaagcatacagacaaataggcaattaagttaagcagcaagcactagcctatgtgtgtggatgtgcatcactaatcaaatgcaaatttctggaagggcgccaaaaccagtggcatcctcaactggataaccacctccccttgttggtaggttattgggcaccccattgctatgttgcaagctcccctttagcttaattcaaccttagaccatttgacatttggctaagcacagcaagacagctacttaaaaattgtttattattaggggcaaagatcatcctttatatatatggcactaaggctagaaataaaaatgcacatatgttaaaaacaggatcaagctagctgcattgaaaaggtaatttggtttgtgcaataatagagttgtaaagtgacatccccaattgcctttttttcttaagaacaaagtagtactagtagtaaacaaaggggagagatactctttgattaatggttcttgagaatatgcatagatctcttgccacctttttgcttgccagttaccattgcttctcttcttgctcaatgtcttcttccatgaacccatatagagcatttgcacaaaaaaaaaaaaacaactccgttgaatagttagtgcagccctatcaccatggctcaagttccatcaacttcaagtagcacgatcaagagcatggtttgtgaaaacaagaaatgaaattttagtaaattaaattgggtgctcttcttgagcccttttgtgagcttgcatgcatgcttcactccactgtagcttacttgcttacatagcttcaaaattagcactaactaatctcttcatggctacagaattagcatgcaaattaaggtttaaatccacccatgtatcgacgacgagcacagtgcttgcacgccaacgcccaagaaatccctagtttcctctctcccgacgccgccggcgtccttcaggccggcatggtggcgcaccgccgacaagacgtcgtaaggcacgttgccggcggcccccgtgagctcgctcattgcgccgccgaggttggcattgtgatggctcgcggcggcgaatagggctgcaccgtcgaacttgccgcactcgtcggccggtgaggcggtggcgccgccgggcttggtcggctcgaacggggacactaggggcatcgcggcggtggatgtcacggcgccgatctgcgcggccttctgcagcagagccgtcgcggacatgtcggtgggcgccgcgggcttcgcgtgctgctggttgctgaacacggacggcacgctctccgcctccttcgccgccgccgtggcgctcgtcagctcgctggcattcgacgacgagagcttgccgttcccgtacagccagctcagctgcgccgcgtcgaactgcggcggcggcgcgccggagctcggcgcgaagagatccacgtacagctgcggcggcactgtcgccgcgccaccgctggccaggacgccaatgtggcccatggacggcaacgcctcgccaccccacagcgacagcccgccgtgccgcgccacgccgccgtcgcacaggtccccaccgacgccccccgccgccggaccgagcatctgacccgccctgagctgccctccagccgccgccgccgccggcggcatcatcatgtttggccgcatgcccgccatccccggcccacccgacccggcgaacaggtagctctgcccgcacagcgacgtggccgtggccgccgccgccgccgcggcggccccggacgccgcgttcagcctcgccgtctcctccgccagcgcgtcgcagaacgcgcggtgcgtgatgaagctgtccctcctgcatccaatatccaaccatgcatggatcgcgttaagctatcgccaccatcgtcgacgatcatatcaaagcctggagctaacaagccatataaaactaataaactatagtcccctcttctaatgaatgtatgctaaaattttagtgggggcttttatagttgtaacgccggtagtaggggctcgagatcctcccgtggccgtggccgtggccatggcggggcggcgggtgtacctggagaagagggtgccgcagtcgcagcgatactcgcgggtgccgcaggtcttggagtgggccttccagtcggactggacggcatagcgcttggagcacttgtcgcacttccacttcttctcgccgtgcttgcggcagaagtgcttcttgatcccggtgaggtcgccgagcgcgcgcgacgggttgtggtggacgcagctcttctccgggcacacgtacacccgcttcctcggctccttcccgctccgctgccgcagcttccacggcaggttgtgccctcgccggtgcagctgcaggttctggtctcgctggaaccccttcccgcatatctcgcacacgaacctgttcgtcgccatcagcgtcctcggcgacagcgcgatcacctccgcctccggatctgcacccaccgacatcgccgttgatcagtcgagtcaaacacagcaaaatggggaagattttgaggttaattgtgttgtgcacttgcctggtgtgccggggagattgcgcttcttcttggcgggaggaggaggaggaggagggtgttcttgctgatggttggtgagaggagcgaaagggttggagatggctgcggcttcactagtcgccattgttatcaaattgctaagcttgtcgttggcttgttgctaattaatcgatcgatctctcttgggatcaaactatgctagttgctgatcgatctcctcttctgcttgactagttccctttggagacaaaagggcaacttttgttcttaggtatgggtcattacccccaagcataaataagctttgctagctagtggcaacaacaaaaccatcaaggcaggataaatatagagctttgctagtgagagtgagatcgatggagagagattgtttgtgtgtgtatgtgtgagaataaaatatttgaagtggtaaaaaggtgaaagttgaaaggtgtgtctttaggtgtttgtgcaagcatagcaagggttagctagtgtagctagtgtgtgtgggtgtgcaatgcatcatgacacatatgatgaggagaaagatagggaaagggggaaggagggggtggtaaaaagctgtggcttggtgcctttgcatttggcatgattagcccataatgtgatgcttcctgcatctgcatatccccccttctcatcaaatctcagccttcctccctctcccactgcaaaggtaagctactgcagctgctgcctctggagcctgcactgcaacagtgcaatgcatgggctgctactttctttggcctggacccacatgcaggcacacaccttcttaagtttttgaaaactagcttgttagttgttaaatagtactccctccgtttttaaatatttgacgccgttgacttttttaaatatgtttgaccgttcgtcttattcaaaaaatttaagtaattattaattatttttctatcatttgattcattgttaactatacttatatgtatacatatagttttacatatttcataaaagtttttgaataagacgaacagtcaaacatgtgctaaaaagtcaacggtgtcaaatatttagaaacggagggagtactagattgattggatcaaaatcaagaaaagggatttgctacaattgtcaattgatgttgtttgagccgtcatctcaagcggggtcccttgataggattagaatcacttgatcctgacttgacctggatttgaggctgataaaaagggtgttatatagtggggatcatgtggtcgaatttgttatcgtcttattgatcgttttgactagctaattgctatggttaaaattattatgttcttgctgactagacggaagagatcgatggattagtaatttaatttctatgataggaggagagtgatctcagcttgcgtcaataccaaaaaaaaaatatctgatcgatcgttggcgtttctttttcattatctgcaccagtgtaaaaatgacataatagtgtaagatagatggagtattaaatgcatagggccgagcaaatcaatccatttctctcaaaatttagtatgttcaaataacacgattcatggtagacacattgtctaaaaaggagttatagacaacaaaagtgctgctttttttccttgattaagttctgccttttcaaaacggaagctttcatgtgaagaatcctgtcatcttagatttgttaatttggaaagaatatacatagcttcgcttaaaagttagtaccgttttgattttaaaggaactggcgagatcaatcaaaaatagacagaatggtgcatcaaaacataaattaacaacgaaatatgtttctttctcttttcttgcacgccaacttccttgagaattgaaggaaaacaatacaagaacggttggcccgagaactactagcacacaataccacagattcactatagcactcgtgtactccttccgatccgttccaaaataattctatgttgaaaaggaaccgtcaagattcgttgtactattctattttaatctaggttgatctattttgaaattgatggagtactcccatatatggagaatttgctacattttacagtcgatctgcttctctttttttttgagagagtctctgcttaattctgatcgtgaatcaacaggtagctagtgtgaacgaggtaattaataatttctccattagcccgctacagctagctataaactatactttttcctcccttaaaagttaccaatatatattttcactccatattacgcacgcataggctagctaactatgcatccgatgatccgaaggtcaaaccattagtatacgcagctagcctttctactcgccttggatgccattctacgtatgtagtagtagcaatgtagcatagcacacgagacgacggtgacacagtagtgtctagctaccactgcactgggagctaagctagcgcacgcacgagagacaaccccagcatcgtcatcccccacgcgcagaacgagacacctccgtggattaggggacaaattacaatgcaaatcctcttatatattctaccaatgcaaatttcattgctatagcaaactagtaaaattgattaattactctgtacgtgcgtgctaatttgattaatcatctaggagaacctacgccggcgacgtagccatgatcgagctgggcgcgcgtgcgacgacgacggtgaggtgagccccagctacacgtacgcgggcggcgcggcgggcacgtgcggtggcggggcgggcggcgcgggaagcgaagagggagagaggccacggccagggggaaggcgacggcggaagcgacagcggctggaatatttgtcgctggatggcgccagcctgcttgcgtctgctcgctcgttgtattggaagactagttaaaagagaggagatcgagatggtggtggtgagattattaacagagaggtcaaaggagctagctagcactgcaggttaatttgtgcatctaaatctcacatgtttctagacatataggagagtatgctacatgcatgtatccactgatcgatcgatctctcgtgcacatgcatacgatctgatcagttttattgattccctagtttgatcgactacatcaggaacaaccccttttaatcccgggttgtaaactgagacgtccagtccgggactaaaaatatccatctttaccgccgatcaaaatagccaacaataaaaatggatttttattttttagtcccagttggtaagatggtagcgctaccatttttagtttcggttgattagtttttttctttttttccattgtttttttttgcttgcatttattgtcaccctcaaatccccacaaatcatctacaattgcccatccacaatatcatccacaatccacaagtcattgacaaaatcatccacaaatctaaaataatatacaacaaagtttacaaatcattctaaaaatattttaaaaaatcacaaaacaacagccgccgccggccgctcccgccgcccgacggtctcccctctcgtcggatctggcggaggggagactacctggccgtgcaccgcctcccatcccgctgccactgccgcttcagcggcccggtcgccgctgcggccgcttccgccgctcggccaccgccggaggagaggccgccacctgccatcgccgtcatcggaggaggggggaggaggggaaggggaggaaggggagggggaggaggtggaggagagaaaatgagataaggacgagaggcagcacgcggctcgggagagttttcatgtttttttttttaatttgggtcctggttgatataaacaattaggactaaagataatagggtctgacatgtttttgaatcgggactaaacatgatttttagtactagttcttactcaaatcgagactaatgtgatttttacgtgacttagcaaagatcacttttgtagtagtgtgtgtatccagccgtacgtacgtacgttgctggtataatatgtacaacatgtacatgactctttcgtgcgtatatagggtgctgtagttttaatttgatttgtaccgcaatttggtttgttggttcacattaaggccgagtttagttccaaattttttctttgaactttcaacttttccattacatcaaaacttttctacacacaaaaacttttaacttttccgtcacatcgtttcaatttcaaccaaacctccaattttaacgtgaactaaacacagcatcgctagagccagtcaattttggaactagccctagttaattcatgtcagtggccgggcgtgcaactgcaggcaattaatgttgtcaacgcctgccatatttacatgcaccctgcaggacgtaacgtatatgccggcatgcaacacaacatgtatagtacgtacgttacgtacgcactatatattgccatgcatggatggacttctcatgtttgtcttttgcaaatgcaaatcctttctcaacccatctgtaaattaattaacaattagtcacccttttaaaaaagaaaaaacaacatgcatacatatgcatgccaagacgaacagcagtttaccattccatgactttctggagtatagatccagcgtacgtacgtcaagctgattttttgtacgtatgcaacaagtgcaaatgctcaaggacgattctcaaattcaaaccaacatgcgtccacaactacattacatgcataacaatacaggttaagctctgcgtcatttagaaatgattagtttggatcgatgctgctggagtgctggtcagtacagtgtggtcacacaaacattggcgtaattaataaaggattcagattacatcaacttgcatgaacatacatacctaacacgtactgtaacatgcaatgcctagtcagctgatgtgtctgatggtcacatgcttgtctcacttagaattagattcctctttagctccatggaagcagtgtatgtcagggataggagatggtgaccaactacactgtttaaaatctctgactagatgagtataaaactatggatgtctagctatctgcgaggagctggtaattaattaactatattagttggctacagggtttaattatctatgtagttatgataattaaccgcaaaatttgcagagttaagtacttgcattgtactgtcgtgtctcgcttgtcacacactgatggaagctttcacctggtctctcgtagaactagaacggcgtagctaggataactagtagagactagagagagggtgtgatttttacttttaccttccaaacattttaaatttgagttctgtacttgcttccaacattgcggtaattaaggagatagagtcatagagggatcattcattaatacgatcgaatcgatccttaattagtttagctggctatatttcatttgaggtttatcatttcaatttctgaatatacatcttaaaaagcgcctttaatttgaagcaaaagatggtaatttaaccaagccactcaaaaagtaatcccacacatatatgtcgtcgatgctaattaataagaagattcagtcatgcatgactcaaaaaaaaaacaaatgctaattaaatgcatgcatgggtagtgtcatgaacatgtcatgtcagtcagatcagtcagcgtactaccggcaacgtgttggattttagagtcgctaggcgtgtatcagttaattacaattaaacttaatttgcacagctcttccgaaatccaatgtgacgagaatatatcatgc

SEQ ID NO: 42350 - DNA, 9647 bp, Oryza sativa
gtgacaaatttacaattaaccatttttagtctgatgggcatttagttgattttttaaagggaaatttagttgatttgacgatcatagtctaggtaagggatgcatataggagaaaaccataaagaataaggaaagagctaagtttaatggattattttaagaacaaaagagttagtgtagcgggtagcaaaacaaatgatgatgatagaatataacgaggtcacagtatttatgttaggccgttagtataatgtttgtgaaacatttactatatttatagaattttaaacaaacataaagtatatgtggattgaaaccgcagaattaaccactataaaatatagtcacacgagtataccaaaatccagtgcactttctggtggggttttgcaattttcctaattgccgagaactctagtccttctgaccatgtgagtatgtgaatgtgacagcaaccacgcacgaatcctccacagtggaatgataacaagaaggagaaaaagggaaagcctcttcttttccccttttccggattttgatagatcggtagcgacgacatgtgacctgccggccggatccaacgtgctcgcacttgctatctactaacattagcttacattacatgtacatatgttcatgataataattatcttggtcatcaagacatcaacgtgtcattaatcaacaacatctgtagtaataatgatgcagcgacaagaggaccaaaagagctgatcactgcaattcccatcccaaacattccaattagctgcttacttactgctatacgtactcaactgctgtgctaagttcagaagaaccacacgtttatctgtatcagatacagagcaaatagttcccttgatgtataaagctcaaaaccaattattccgacgttgtcaggatgatttggtcagtgtttttttttattagaaagggaataaataaaagatgattgacaagtcatgttaactagataagggggggattaaattaaacagaaatagtgatgatcattgggctctgttttccagttgtttgtccactaagagaaaaataatgagcaagccactattctgttttttctcatctgtttcttaacttggacacaaagaataaaagtttagagaacttgattaattaaattaattttctccctgctcatgatgttagtcagtagtcaccgactttaacgacgttgttgttagatgaagccataatgtcatctcttccagaggaatttctacaaaacaacacctaccatctctttctcagacctttttagctttcccaatagacaaattaacctacgtgtgctagcaaactatgttatacataccgatatgattcaattggtatgtgaatgagttacggtggcccatttccctatataaatgaggttagaattatttgctaatagggtctatatgttaatcaatcacccaaatagctaattaactggtactagtaggaccaatctaattttcaatagatcaatgtagggccattttacttatcaacaataagcagaaagggaagacatgacagccaagatggtgtcacggagtcctctccagaaagcaaagcttggagacaagctcattcgcaagaggaggcgcacatggaaaccacaaacacaaaaaaaaaaaaacaatcaagaaagcaatcttgcaatggcgattaaattagtagcagtgtgttaagcattaaattaatggagagcacaagataaagaagggcccccatcaaaaaccttaggaggggaatcacatgaatacacatgaggctagccggcccatccccggcgagtgggcccccaccctgttcacatgtctccatctcaccccactaaacaactcaaagaaaaatcatattccattccacactaatcctcaacataatattttaccaaacttttgaaataagaaaaaaaaacttttaagatcacttgctttttataatacagaaggaatcatataagaaatctgtttaaaaaaacttgcatactaacttgagacgatcggactcctaactgcagttcatgattttctaaaaatatatatatccaagcaaactcccacagtgaatttcatcttaagtaaaccatataataataataagactaaaatagactttacctgttgcaacgcacgggtatttttttctagtaaaacataaaaataaatgataggattgttacaacttctaaagtgtagccaccccattgaaccaaagtgtaagtactcaactgcaaattcccccgaacacttcggtggcggaaggccaggcgtgaaatattacaacaccaaagcagccgcgcgcactcaaccgcgacagcgcctcgcctgccctctgcctaccgcgaggcgcgactcatacctcgctcgtctcacctcaccgccaaattccacaccaaaccgaacgatcaaaaggcgaggcgaacaccaccaccaccaccaccacctcaccacgacaccactccccatgtctaatccactccgctaatcaccaccaccccccgcaccaaataagtacacccaaccccaactacgccacaaaagaaaagcttacctctctctctctctctctctctctctctcttctcctttccctctcctcctcttcccaccaccaccaccgccgccgccgcctgattggtggtaatcggaggtggaggtgggcgtgatgatctctacaggcagcggctcgtcgtcggcggcgtcgtcttctgcgtcgtcgtcgggggtgagggtggcgggcatggcgaaggtgcgggggaaggcgggtgcgggtgcgggcgccgcggcggcggcggcgacgaggaccaagtggaggagcggcgcgcaggagaggatctacgggcggcgcctgctcgacgcgctgcgggccacgcgggacggggctgcaggcgggggcgggggcgcgccgtcgcatccgcgggcggtgaaggcgcgcggcggactcggcgctggcgctcaccgcgcgggggcagtcgaggtggagccgcgccatcctgctggccggcgcggcgtcgtccaggcgccgcgtgctcgtcaaggccggcgggaagatccgccgcggcggcggtggcaacagctgccgccgcccgcaggcgcgcgccgcggcggcggcggcggctaaggcggccgcggccgcctcctccgccggcgagcccccgatgctgaaggagaggaaggtgaaggagcgcctccgcgtgctgggccgcctcgtccccggatgccggaagctccccgcgccggcgctgctcgaggagacggccgactacgtggccgcgctggagatgcaggtcaaggccatgcgcgccctcgccgacgcgctcgccgccgcgcagctctcctcgtcaactccgcagcaggcggaggccgccgccgacgagaccgagatggagaggtgagggtttcgtggtcaatcgtgagttcatcacacgatcgatgatgctggattcgattcgatggctcggaaattggaacggctcggggaaaaaataagggcgattaattagtggattattattgcgagagggtttgggatttgaggagggtaattgcgatgattgatgctgctgataatgctgctgctgctgctgctgctgatgatgatgatgatgacgatgatgatttgtaaattcttgatacttgtataagtaatgctgctctgctcctctcttgtttttttctccttgattcttgaaatgtttttctcctcctgatttccaaatcatgttggggattcctgatttcctgtttcatcttgattagtagtattatgctgtgattggggattagtgtgttttgccctgtgttaatcagggattatatgttctctctttttttttttttgcttgcgaagaattggagagaaaaaaatgtgaattctctcaaaataggtattatctcccaatctcccatactatccacttgtcaggacgatttcttcgtaagataaggtacaaaaacatgcaaattgattgacagaatctgaaaaagaaatgcctatgtagctatagcaccagcaattcgagactcgattaaataccaaatcgatgtatgaacagttcgtactttgcttatcgcaaatctggatgaccaagaacaaagaagcaatccatgatagccaatttggtcattgcggggaaagaatcgcacagtgctaaccacactgcagctactgcactttcgcaaaatggatttactgttattaaatttctaacgattttgctagatatttgtcatcaaatttctccccctaatatttgtcagatgtaattacagtacaatcgtagtgtaattatactgtaacttgcatgtaattacactgtaactataatgtaacttgtatgtaactttcaagaatctctcggtaacatgttatttcagtaaaatagaggtcgtgggaacaaattctttcatatatgtgtgtgatgtgatttttttcttcctccatagaacaaatcttgtaatagatctaacgattcaaaattacgtgaaacttacatacaagttacactgtagttacatgcaagttacagtgtaattacatacaagttacattgtaattacactacgattgtactataattacatctgtcaaatttttagtagaaaatttgtcgacaaatgtataggtggtcccaatttctaatgccgtcaagacacggcaatagtgtgcggattgaactaataattgggtaattaaacaagaacgcgtaaggcgaaagcttcctctgattcctctctggtctcccctgagtcctgacccttctgctaccggatcagattcagaccgccctgacactcgttggattaccagaaagttgccgcatttgctgacaagaagatctctgaaatgccttttttgctggtaaaaatgttctctgcacgagcgatcgacagcacggtgatgtgcaccctgcatctccttatcatcgtcgacttttcatttttgttcttcaggttatagcatcctgcatcctgcatcctgctcttttcgatttgaagaatgggaaatggggcttgtcttgagcttttgttgcttgttcatctaaacaaacttcccgtcaaaatcacatcatcttagcagacttgtggttgaactaaagaaaatatgatttggtatgcacgtgaaaatcctgaaaaaaaaggtaggactagttgcttggataggaaattacaatcggttaaaaaaaagaaaataagattgacaaacattactctgggtttgctaattagcgcacgtgtattatcagtgcacatttattttcctttccaatagcactttcatacgaaactttcttctcaaatcatttttaaggcctcaaaacttttatcttggattacaaaattttcaacttaaaatttgaaaacttttattaaaaagtgcatgtgcaaacgcacctgcacaaaatagcaatttcggcattactctcaacctgaacagtacaaatatacaatgatcatcccatttaccagaaggaaaggaaaaagattgtactgtctcgtcactagatagttataaatgagtgggtatcttaatgattctgtgatcactgtttcatatatataagtttttttgttaaattaggagtaaaaaatgtgaccattcattgttccattccttaaaaatgagattgcttaggacacttaaatttgtgtaatttgcttgtaaacattaaaaaagtatcatagctaaaaagacaccttacaaattaccaatttgctggaagatactttcggctcaattaaagtaaaaaaattcttcagacgataatacccattgagccataggcttcttacatggtattggagtgaaaacttagaaattatacaagtctaaagtatcctaagtacattgctagcatatatcatattccaactttactctagcctcatgtttgaaacttttggctcttagagcattcttatctttttaaaaaaattcttcaattgagtctcaagtgtcatatagcaaaatttgtaaaaaaaaaaaaaccctaaacactaccagtgctcttgcaacgcggcaattcttaccgaagaggaaaaaataaaagaaaaagagtaatttttactttgggccactttttattaccggtgtttcgctttggaccacccttcaacaaatgttttcaaattggaccggttaagtttaccattgtatcactttggactaccctcaactctcttattcatctacatccaatttttcatatgttaaagaaacggtctaaatacagctaaagaggtttattgacaaataggatctggcatactcgaggtcgttcatatacttgagaagagaatcggggtggtccaaagtgaaacaaatgtaagattacccagtctaatgtgaaaatgttagttgaaaggtgacccaaagtgaaataccggtaataaaaggtgacccaaagtgaaatttcctcaaagaaaaataaccatttctaattgaacggtcaattcttacccattcatggttcgattaaccatgaatcggttaaccgaacggtccaaaacactgagccaactgccaaccaaggcaaaacgggccagtcaacggacacgtcacccggtcagcgccatcgagctcacgccgcgtgtctcctctcctcctcatgccgaggagacgacgagcacgagatctctctctctctctctctctctagcttccacctcctgatccacccgaaccctagaatccactgcgacgagcagctgaggaagaggaggaggaggaggaggcgttctcctgggaggggaccccgtcccgcccgtttccgccatggcggcggcggcggcttcgtcctcctcctcgccgtgggcggggcggatggcggcggcgttcggggcgccgttcctgtggctcgtctgcctgatctacttcatccaggttccgcttccccctccccctctccgcgcccaccatttcctgcgacgcgattgatccccgattcttttggaacgctctccgttcgttcgatcgttcgttagataagagttacgcggcttcctgggaggagtgacgacagctgtccgaaaacctcgcgtttggatccatcagcaaacgcggagcggaggcgagatgccagacgagtttgagatcgacatgtggtagtgtggtacatccgtgtgcaagaggccgaactggtcgctgtctgtatagagatcgaggagtgcttataggaatttgggttcggatgattacatggtccttttgcttccttcgcttttgtaaggcaatcttggattgtttttgccaggtcaaatcgtgctctctgtgtaggatgatattatggattgcttcttgtgtcttgggtttgcctaaataagtaattatgtcattcattttaagaattggaggtctgatggctgcatgaacacatttttcttttaaatatgaaatcgaaggtagttcatttgtgatccgttgtaaggattggaactcatttagggcattaggagggtagagttatttctatgatagatgactcaatatgtttcatactagatttaactggttggttggtgtgcagacttaggtagtgaaagtttctctaaaaagagcttaatgttgatggagaatctcagatttgtgaaactatggaatgctatacgagttcagcttcggactgtaatgtctgaaaacagcctagtgtgataatttcacaattatagcaaggattggtggtatgtcatatgtcttagcatgacatgcaatgggatggggaccaaatttgtttatttgtgttgtgagctcatgtgccatgctttggtgatatgtcaaatgttagcatgttcaattagttgtaaattccttgtctcaatcagaactcttcaagataaactgtattttgtagtagagctaactaaatataaagaaggcagttttggtttaccgaagcttattttcgccattagttgaaagcttaacaaagcactacaccttttactttgatagattttaatatttattctgcaattctttagggtttcaggtcttttgtctggacagctgtctcgtaccaaatgaaggacatgatgaaactgtcaccatcaacatcacagtttttggtctcagttgcatatttcccttggagtataaagcctgtatatgggtaatgttacttctgtttgcttctgctgtgaactgaaatttaatcatgttccctacaacctaattatgttttttttgctacagagtagtttttgtaatgtactgtttcaaacatcatgtgccttacacagttacaccttagtttcagaaatcttacatgtaattatacttcttacaacaacagagtttccctgacatgtttactgtggcttatctctattgcaagtgattaaagtgtagttgcttacaaacagatgggtgctcaatatttcctgagcaagcaacaattattacttactgccttcggacaatttgtcaattatgacaattataaatattcttttgtagcataagagctaaacaatttgtcaattttatatttactgccttcacacagattaacacgattaattctaaaggatgtttctgaatagggtatatatcaactaattttggaaattattttactttagtggaaaatggattaatatgtgcactgcatttggagacccgacagtaaatgtgaaagggcaaaaggaagtgctgcaagcactccaacatcgatgggtatttttttctgttggatcgcttagttttcctcatgcatttatacccactcaaatgtttgctgcatacttgctgtggagctgtgcattatggcattatgtaacagatagtcctgtgtaacattaaaatcacaggtcttagaaatttcttctatgttgaattgcacggcttgtcggcttctgagcactggctgcccattactgtaaaacatctatatgcgtttgtgtataactataatgagtttcagattgtactgtacaaaatccagatactcgttacttccggatgagtctcctctgactacgtcagagggactttgtcactgacatgtgggacccacaaaggttgggcccacacatcagtgacccacgtccctctaactttacgtcagaggagcgcgatccgttacttacacatgcatctttgtgcctgcaggattttgtcagactgtattcccatcaagcagaggaagcgtacgccctatttgatcatttctagctgtctatctctatttccgtggctaatccttgggatgtcagaacctttgaggagctcaagcaattttcttactgctttgctgatagtacagaacttgggatctgccatggcagatgttgttatagatgcaatgattgcagaagcagttcgatcagctgggtgagtatcttagtgtaatattttcactggttagcaactactatatgattacagattatctgaactcaaaacttgactatatttttccaggccagaatttgctggtgatctccagtcactatcttggtcatcaatggcagtaggggggatttttgggagcttattggggggatatgcactgtccaatctccctatacatgttatatatattattttctcggcgcttccattgtttcaactaatttcctgcatatttgttgaggaatctccaaaaggatttgagagtagaatggata

SEQ ID NO: 42351 - DNA, 3736 bp, Oryza sativa
attatccgtggccgtcgcagttttgcagtgagtaaagtgatcgatcgatatggccctctctagatagctaggaggaatctttgcatccatggccacggcggccattgcagataatgttcaagatggcccatgagtagtgcaaaaggcacaaaagatgataatcatgatactagatcacttggtaattgtcccacactacgcatccacactgattcgatccaaaattccaaatgtgcaccgatttgcaaggtaaatttaatcacaccaccttcaaaactttctccagtttctttcagaactgatccaatttctctggagagaatctattctataccactaagtttgttcaagttcaatgatttgtcatcgacattatctctttctataatataccggtgactttatcaactattttacaatacgttattgggttgaaccttattttcaaaaatagccttagagatatacaatattaacagttgatttatctcatccgaagtttcaaaaaactatgaattttttttgtggcctccttacacaacatgggagtttgtatacaagtttcaatttttttttctgcatatttagtttttagaaaaaatatttttatgtggtatatgagagagaatttgcttatacaggacataatagcataaaaatatcttatgtagtgtatgaaagatgatttatattaaaaacaataataaaaaagtattttataacatataacaaataagttatatttttgagtaaatttcacaaaactacaggtattttgtataatttatcacataactacaaatttaagagcttgttttacaaaactacaggttcggtgtctccgtttatcacaaagctacaggtattgtgtacaatctatcacaaaactacatatttaagaacttgtttcacaaaactatagatttagtgtattcgtttatcacagaactacacatttagtgtctccatttatcacaaaactacatatttagtgtctccattatcacaaaactacattttttaataatgctaaaacctgtagatttgtgataatgaagatactaaacttgtagttttgtgataaacgaagacattgaatctgtagttttgtgaaacaagttcttaaatctgtagttttgtagttttgtgatatattgtgcaaaatatctgcagttttgtgataaacgaagatattgaatctgtagttttgtgaaacaagttcttaaatctgtagttttgtgatagattgtgcgaagtatacgtagttttataaaatttactctatatttttttaataaaaaatagaaataaaaaaatagaaatgtaaaaaacttgcaaaattgtgtaaggaggccacataaaagttttcatatttttgaaactttaaattagataaatcaattattaaccttgtatgtgtataagggtattgttcttaagtattataaaataattgataaagttatcggtatattatagaaagcggcaatctcgatggcaaatcgttgaattctaataaattcagtggtatagaatagattctctcatttctctgggattcctttgttcaaagggaagttggtttagaatgtgcaatatgcgttattacattctcagagcttttatctttgctctttagtttatcagccacaaccaaaatttaaattttaaatcttactttttatatttggttttagtgttttgtcatcatagtttcttttccaacgttatcttttaagttgttaaaagtacatgtatataaaaatcttacctacattttttttattttttacgttaatacacgttgccgtttataatagatggaacgatgggactcatgcagtatgcctgccagattaatgattggtcatcaatttttcaactttcaagtgcgtacggcacgcatatatgttcagttgtacattcaaccttgcaccgtggaacataagactttgaattttgtctaaacccgactactagaatatcttcacctaatagtattatatcttcagttgctttacctaacaaaacatcgcttggaacatggtacgtcggtgcatgcagcaatacttacgtttcgccatgaacagtctggcctcatctttatcttctatatatgaattcaacatccaaggaaaagtatatcctttgagtccttgatgattttggaacatccaaggtaaagtataatcttggtggttttcacgagaaaaaaaaaagccttaattggtggtttcaactgatataagtttcgatttcttgacgcactgggaaagttggaaatgaccataattttattatcagttatactgccacgaatatttttcatcacggatagccaccaagaaaatggacttttccctcgttctcgttggcaggttttcctcgttggtcgaccgacaaaacttgttaccttggtgatttttattccatctttggtgggttgtgcctctcaataaaatttgggattctggtaatgacataagtgggtgtaatatgttgtgtcaaatgccccgtgtttgttcgttaaaaaaaaattgacaagtgccaatttcacccgatggcgttgaaaccagggttgccaaaattttggtcatttcggtgaccccccgatacaatattaattcggccaaaatttttgaatttttgaattttttttcatgaatttgggtaatatttgttcaaattcaactaaattttgttcaaaattttggaaatttcggacctaaatttttgaaatttcggtgacccccgatcaacaaccctaaacggatagagtgaaccctggttgaaacttgaataacatgtggtgatttttctttgatttttcgctacggattatttgctcgtgcttcttaaaaatatgatttctaaaaaataacctttttctatttcattgtctatactgtctattctaacttattaaagttttttttttaaaaaaacactaatttactgtgtttaatcaaatgaataatctgtgtttatgaaaaaaaaactgcatcaaacagggggaaggaatgaatgatgggtttttccaagattcgtggatcaggacgtttgttgggctcgaagaccaacactggctattattgggctttcttctgcatctcggtggcgaatcgggcgaaatgaaggcctgccaaaattatcgtcccgtttgcgatcattcaactccccaatcaccaaacaagctgcgaatctgcgataggatgaaatgaaaaccttcccgccaccgccacacgcgcgcccacccccctctcgatctccgctcccgccgcggccggcgcctcctccgcgcccatgccacgacgacgcctcctctccgcgcacctcatcggcggccgccgagcgcgacctctcccgcggccgcaccaccgaccggcgcgctgaggctgttcggcgaaatgcctgtggcggaccggaatgccgtctcttggacggcggccattggcgtgctcatgcgggccgggagggtgtgtcgcatgctgcaatgccacgatttctgtgtactgcagcagcggtcgtgcccacgatgcttttatgcattatttgaggggatgccgaggaagaacgtgatctcttggattgcgatgatcagcggcgggtatgatcaaaatggttaaagcaagaatgccctctccttgtttagtcagatgtgggctacgggaaggatgaagcccacgccaagcaccttggcatgtgccaatgtgccagacatattgcttggtttgca

SEQ ID NO: 42352 - DNA, 8566 bp, Oryza sativa
taaagtgggatatctgttagtggtagtatagaggaacaacacagtgataattagagatataaacaagttatgattaaattatgcaatataattgatcatctatggaaggcagggttacacatcacatatatgtgaaactgtacacttgatgaagaagaatacaagatgcatggaaacaaataggatggtacagatttaattgagatggtgattagggaatagaaaaatatttggtacaacaaccatctgaatagacatggacttatgattgacaaaaaaagtttccaatgctctgttgcaaataatagcacttcaactaatagggtaggaccacagctgaaaattgctaaaaatcatttgatcaatcgcttagcttgcatatatgacacaaggatggttgaaagcactgcaaagatgtgcttattttttttctgtttgaagcagaatgtactcaaattaataccaaaaagtgcctgaagatgcctcaaaagagttccatgattaatcacccccatgaatttctgctccaaactagatgctatttgcaaaggtgcaatgagaatgacataatactatactttaggtgacaaacgacatcaagcttcatcgttgcaatcattgtgtagcattaccatttttgcgggtggatagctataacttgtatttctcaaatatcctatgttatcatcatataccaatattccatgtttcaataggtcaaattatttgactcacataacagtggagataaatgctgccaataggataacttatacatgttgaaaaacagtctaagcaaaacgaaaccatggatgaagtagtgttttaaacataaaaagtagatggcattacagtgtacctgttccttttccagttgacgtgataaaatagttccaaccaacttatatggatcctggaatagtgatcaaaacatgtcaaaaacatggatcatgatttaaacagtacaatacatgtaactggaatcctcatatcattttttactaataacctttttcagagaatcattgtccaaattttctttacaacttatcatgcagtccaaaataaccttctgaagtctttccattgcctctgaaaatgcacaatagatagctggttacattgttgatgatgatatcaatgcaaagaagttattatgtacatgtaaaaaaaagcaggcaataaaagttatacataaactgtatcatgtgttccaagagaaatgcatcacaaaccttgacaattaggacccacattttgatttggttgtctctcggtatcagtctctaccaaatctagacgttttggggtggaagaagatccggaacaaacatattcagactgaacatgacttgcagaacgtgttgcaagaggtgatttcaagtgcttgaggtgcccataacttcctccccgttgcctccactcatgataagacttcaaggaaatgacacaatcgacaatcttgcctactgacccagcatcaatattgtcctgcagaagcaacacaattttctgggtgattacacatcccaccatcaggattaaattgctaagcatagttaagtagcaaccttttccaaatcagaggcctcaaagcatggaagcttcagctcttgaacagcaaccaagaagttccggatgttctcaaaatactggaaagccgtcgatggctggctatcacaggaggcattagccacgacctttggcacagcgcctggttgtattttgttaattgccttgcataggacaatgccattccttacagcggcaacaaattcttgctccgatgggcaccgggagaggccgaagggccctatcacgctctcaagccaggttgcagcctggtgccgtctcaatgcttgcagaaatcaaagaaactacaatcagccaacgaatttaacgaaaactaaaccagccagcattagaacagcaaagaaattttgcgtgctacattctattaacattatttacagtactatattattctggagacaaggatgggatccatgtggctattgcttatagaaatttatctacggatcattgggattgaaacagcacgagacagcttggagaatcactgagaactagctctctaaacgcattccttgcagaaaccacggtccaagcagaagaactagctctcataatagcaagactatcgcgatttaatcaatagaagcaaaagctatgcatcatatcgcgtaagattgattcggggcctccgcatagaagcgcccaaaaacgatcacgaagtggaaccccagcgcgagattctcgcaagcactccacctaagttagcagaaatgcccccaccaaaaaaagaccaagagcttttgcccccccacaaacccgcctaaactctaaaccccaagcagcagagcaacccgcaagcaagcaagcaaaccatggaaccctcgacgagaacgccatgagagcgatcgatccaccgatcgaagaaccccctcgatcggtatcgggcccgtgggagaagagatcttaccagcctcctccgccttccgcgacgcgaggcggccgtcgcggaacgacaccctccgcggctccgccgccatgcctccccctctcccgcgctctcaacccccgccctcgttcgccacgagccgccgccgcggcgccctcgcgacgccctggggcttctggaagcttcgattgggaggaggaggagagggaagcgagacggggaaggggattggtttgaattcgaaatgtggggtgggtagtggggtgggcccggtctccgaggcggtccgagatctcgacacggatcggacggacacgctcgccccgctgggtgggtggtcggtgcgcgtgcggtgcggcgcggcgggtggggagctcgaggctcacgcttacacgtggggcccgcgggtggtggggcccagttgtcatcggctgctgcacgaagcagggccgacagcgtcaggtgctccgtcgcgactgcataggcacggcttaacagctctatataccgaccgacggccgacgagacggcagctccgcaacgattgaacactgttgctttgctttgcttttgatttgggatattaggagaaacgagaatgctaggggacgggataccgtcccccaacaggatagctcctatccacacgtgatttttatccatacactcacttgtcgccgtcgtcgtcccccgccgctgccgcgcccgtcccccgtcgccgccgctgccgccgcgcccatcccccgtcgacgccgccgctacgcccatcccccactgccgccgttgttgtcccccgccgccgccgccgccacgcccatcccccaccgccgtcgcgcccgtcccccgctaccgctgccgtcgccgtcctcgtctacaagggacggctgttgggggcgaccgcgcgtgtcggggtgctcctcccccaacgggatgtccaaccatatttagtaggaatcacctgatacctggtaggtatcatccgatacctcgcaagtatcacgtgatacatgatagaaatcgtctgatacctcgcgagtatcatgtgatacgtggtagaaatcgtctgatacatgacaggtatcgcatgatacctcgtgagtatcacgcgatacgtggttgaaatcatctgatacctgacaggtttcacatgatacctcgcgagtatcacgcgatacgtggtagaaaatcgcatgatacctgataagtatcacatgatacttgtaggtatcacttgaaacgtgtgtagaatcgtctgatatctgataggtatcacacctgatacctactcgggatcatcctgttgtgtagaatcgtctgatacctgataggtatcacacctgtcgaggagagatcctcaatagcggggaatcgtgagaccccccatttgtgagttcggcctggggcggaggctcatctcttggaaatcactcgctcgtccctaggattaccggcaagcttgcacgcagtcggattatacaggttcgggccgctatggagcgtaacaccctactcctgtgtttgggattatggatgtgttttacaaagatttcttcactctagaaagcgcactcgcttcctctcttctggagttcaggttttctcggcgtcccccccgtctcagtgggcagggtcctccttttatagctcaaggggataccacatgcgccgcctctacctaccctctctcggagggggatcccactccacttttcctgggctttaaatcgtgccttctcccggaagctaagcaacaaccggttctcgagtggaaccaggtgccggcccccgcctgacacggtggacagccctgtcattccctcataaatgaacgatgacctgtgacagcccttcctcgagtgacgctcggacgtgacgggtcatacccacccccactccgccgggtacaagagcgacgtgaggacatgattgccctatccgtcggatgtgacggtgtcaggccggtcacagatcggtcacatccgttggacagaggttagctaggcgcgccgcacgtctgcccttaccgcattaaatgcggtgagggacagttggggcatcgcacatttatggctgttcagcctgtgctctcgctctctccctccgccgcgtggcagccgggtgaaggcctcggggcgaagccgcgggatagcccgagggggtgacgccatgccccgagcccccccccccccccccggcgctttcacgactcgcgtgacgcacgaatggggctaacttgcagagtcacgtggccggagggaaagtaattcccctctacttcacacacatacccccgggtccatatctccgacaacacctgatacttactcgggatcatcccgttcgaaaaacgggataccgttatattgcagccccctaggagaaattgtttctactgaatatcacgccctccatcccaaataagtgtagttttgggttttcatgttcaacgtttgatcgtccgccttatttaaaaaaaatgactagtatttttattattattagatgataaaatataaatagtaatttatgagtgactattttttttaaaattttcaaataagacggatggccaaacgttggatatgtgttcctaataacttaaaaaggtaatgctgaaaagtaaactacgataacaaaaaaaatcaactctaaaattaagtttttaaaatttaaattttcgctagctatggctgaaaagattaaaagcacgtagagctctaaattttgggctaatttggtttgagatctaaattgaccttaccaatatttggcaatttcaatagtgtttagtgtttatttagtttggagccaaattttgatatgccaaattttgatcgcccacctgcacccgctcgatggcggcgacgtctagcggtgacttctggagttaagacaaggccagcatccaactggaggggaacgagagaggtggctggactgtattttcccatctatcagccacttgttctttctctccgtgacaaatacttatttagtcaactgagtttgacttgttttgggacatcgattttcggcctgacacatagtagccggcttctacaatgtatttggttcggttttttctgcccgcgtcggtttttgtctcacaccggagcatcctattagaatattgcactgaacatattaaaatatatatacaccatactcggcataagaaaccgaaaaaaaaaacaacacaatattcgtgcccatattaaaatttgctaatcaaattctcgaacttacgtcttctgcctttaaataagtgacctagtaacacctaatgaaaaggttatttctgttagattccgtttgtttcctagctacagatgaccaccaccaacaggcaacagcagcagcgtggcgccttgaccgtttgacctcgcaaccgaacacgcaaaagtacagtaaaaaaacgacctggcgaggccgttgcgtgcatcagcgcgcgcgagatttcccacccgccgccgcgttggcgccccgtatattcttccccgcccgcacgggccacggatccatccacccccttccttctctccgacgttgacgagcgcctcctcgatcggcggcaccggcgcgccgcccccctctcccgccttccctttccttctccgctaatcaaccggtggtgcgagagcgagagcgacgggcggaggggatcgacgatggggagcaacggcggcggcggaggtggcgggaagcaggtgctgtgggagttccacgcgacggggccccgcaacatctccaaccccagctggagggacctcatccgctcgagctggttggtggttcgcgacccatcccttctccctccctcctccttccgctgttggatcgtccatgaacatgcacatgtgctcccattcttggtcactcgcgtacggtttttgtttacatcattactacatgtctgagatgtttggagtgttaaggccattcccaacccaaaacactagacatagtttccataaactctacgtcatcgagaaattagtactagacactaatcttccaatgcaaacaccactattccatatttaaatttaatgctacttatctcacatgatgtcttggatgttgtgtagaaacgatgtcattctctttcctcatttattcatttatcatattatttttcatcctatgtggcagcttatttaatgctatagacaccattctaggaatggccttacgcgtgcttgggtcacttgtctagaactgtgaattgttacgggatttttacctgcctgcctgagaaatggttaactctgcgtggagttcagggatttttcgtgctatttgatcgaacctcgtgtcagtcgtgtgcatggagcttaaggattcctggtgtttctttatgaaacctacagagctagtcctaaaagatattatgtataaaatacagttgcccattgagaagtcatacataagtacataactgaaaaagcagaggaatgtggtgcaaacagctgttgcaaccaattgccgaggtaacgtgtgttcgtcatatttcagtatgatggcaactagatagtaccatgccaatatcatgttttttttaatcaccagtcaaggctgtaaacaaattgaatgaagtagtaactaggattgttggcaatatgttagttgaccgcttgtcatactccagcttgtagaatgctggtcgtgtagtggaaataattttcaggtaaaggaacatgtcaaattttatggctttaacatggtgcattgaacaaaatatatatatatatactactctctatgtgcagtgtcgtgtccataattttgcttaaatgtaaatgaaatttagtccacattcttgtcctagggatatgagttccctgttttgtttccatttctggagatcatgcctttttgtaatgtttgataaccaaactagtaatgtgggtagcactgatttaacagcattatttatgcttcttcaggacagatcccaactaccgaagaattgcggtttcatgcttctgcaggctgcgtatctactggagctagacaggcaggagaagagaaacggtgaaagcgcccttgctcctaactggtggaagccattcaagtacaagctggtgcgtcctctaattgattctagagatggatccatatatggtgtgctgctagaatgggaccagcttgctgccctatcagacttgatagtgttgagacctaatggcgccccgaaggttgtcctcgcgataaggggaacagtacttaagcagtcgacagttgtgagagacctcgaagacgacttccggttcttcaccatggagagcttgaggggctctgtcaggttcaccggtgctctcgaggcgctcaagtcggcgatcgacaagcgtggcagcaacaatgtgtgcattgctgggcattccctgggggcaggctttgctctgcaggttggcaagactttggctcaagatgggatctttgtagaatgccatctgttcaatccaccatcagtctcacttggcatggggctgaggaaacttcaggagaaagccggcaaggtcttgaagagatatgtcagtggaagttcttcaaatgctacagaactttctcacccaacagaggatggaggagcagcttctgaaattggagaagaaaagctgatcaaggaggtaaagagatgggtgccaaacctgtacataaacagctgtgactacatttgctgcttttatgctgatcgcagcggtgtcgccactgttactgccgagaagcatgatggccattctgggactcattccaagctgtttgtgattgccaaaggaccaaagaagttccttgaagctcatgggttgcagcaatggtggtcagatgattatgaactccagttggccgttcatgatagcaagctcatgtataggcaccttaagtcgctgtatgtgaatgaatcataggaaactgaattttgtaaatgcatcgtgttcttttgcttctctagccaagaaaatgtgaatttttcttttgaatggcgcatggcacaagcctcgtacattctttttttttttttgacctggaaaaacaatcccagtgagatcgctggtcaccaacttcaccacctcagggggtaca

SEQ ID NO: 42353 - DNA, 6643 bp, Oryza sativa
tttggccactgaccaatacgggtcagaccaaatatttatgtgtgaaccattaccaactctccatatcatcccattcttcagtaccccaaggcctcgacagatactcctccaagtgtaggacatgcttgctgtttgctttgcctgcaagatgttcccctgtgggaagtattttgctcttcggacctgggcacacagagactcaaggttttgcagtgatctccaacccaaacaactaactgtgaatgtgaatatgactttttttttttggtaacccaaacagctaccttattgagtatagttgtgggattatgtgtccaatgtttaatcgtccgttttatttgaaattttttatgattaatatttttattgttattagatgataaaacttgaatagtactttatgcgtgacttttttttatttttttcacaaacttttcataaaccctactggacttaaaatgggacggaaggagtacattactactttaagctctgcgatgggataacaaatccagacttcatcagacacttcttgtcagatcgagcaagtgactactactagatcaccagttgacagtgacaaaagttgaaaaccaagccacaacttctattttcctgtcacattagatgtaggtattcaaaaggcgaaatcgtctcaacctgatttatttatgaccatgaacaagggcatccgttctccttgttaaacattaaaaaatcaaacggaaaagaaaagctgaataaggtacatcgcagacgacatactaaatgtttgtgcatccatgagatatacagtatgtacaataacgacacaatgtaaaatgtaattaagcagctccagcggtagctccgattattatagcaatggtggcaaggacagcctgttacatcataaaaatgccattagagtgactggaatttttttaaaaaatacaaggtacgactgaaactagataactgatcaatctagaatttcatcaaagccatttccacttatcattacattagctgttggtgttaccaagagaatatgcatcaatgaacgaattatgttaaagtacgacaatgttctctggacttgatccttcatgtatatatatgctctggctacatacatgtccaaaactcgtgtggattataatggtattggctcaagcaagcgtgcaactggtgaagagcagagatgcttcaaacatgaaaaacagtaacctaaggtatgcactgtatatgattgaacgaagttaactctattgtttttttctgaaccaacattgaaaaaaacattgaaaaaaagatcagacacaacaagttcattattgtacctgtaacctatttttgcagtactttttttgctggaatgctgaggctaacatctataaagtcatcagtccaattcctagttccctacttgctcctgatgcattattcagtatttgcacaacaaagtctgatagttgctttgtttttagaaaccaaacttcacgccttacaagagcaagatggacaaatagccgatgtgcttgaccattcgtttttgtttcatgaagattattcatgtaaacagctatacgaggaacccaaaacaagcgcgcacaaacttcatgtacaatcctgaggtgaactaatatttacatcagcatgtcatgagaaatatattttcaagtttcaacacacaagtatgacaaatggaattatgtattccttgtaaatgactagtactgatctgtttgatcacacacaccgaaaaagaacagatggaataggcagcagaaatggtacaatgcactgcagtaagaatcaaaacaaataatgttatagtatcggatgaactcaagaataaattatgttacttaccgctatagcgcatgctacatatcctggtttctccctgtagtccactctagaacaccacagtaggaatgctccgacataccaaggaatagcaccgaggaagaaaccgactatgaatctaaaaaacaagggtttgtcatgaggataagcaggtacagttcaagaaatggcatgatgcacctaaaacttttggggtactttttccagatttcaaagatgatgttgctacaataagaaatagaagaacaaagcaatgctcgcttacaaaaaccagccaatgccaatcccacagcaaggaaggcggtcatgaccatgtccacgagcacctgcttcataatctcgagctgaaagaagagcaacgaggttacaatgtactggtaattttgtaacaaaacttatctgaataagtactagttaatttggaatataataaatacataaagactggactaactcaattctgtaaaggactgctttttatgtcagaaaaatcgaactccatgtgccaaaatatttcaccgttgattacatacaaaactccaatcaaactaaggtactaaagaggtgttaattttgccattaagcaccaccccagtagtcactacactagctgcccaggtttatggagtaatggagcaatgagttttaaacaacaggagcacactactcgcctacaactggacatcacgtaagtttcaagcagaccacctaagattttgcatatcttggaccaacaacacgaaaaaaattgcataatggcagtaaataaaaacttcaattccacaaagcacggtaaatttcaagcagatagatcccggatcgcgtgatcatgccaaagatctgtaagaaaacgccctctaatcctccaattcacctcaatttcgaccaatcactcatcaaccggttctagatggttcagatcaagcagaacccctccacgatttgagcccgatcacgcaccaccgaaattccagtgatccagtccagacctaacctaacccgcatccctcgtgatcccccaaaccaggcaggccagaacattaccgggaatgccctggtacccgccgcgggggcggtagtatggatcgccctggccgtagagccccggcggcggcgcgggctgcgggtacccgacgaccggcgggcgcgggggcgggtagctgggcgggccctggaacgtcccgtactctcctcctccacctcctcctcctcctccgccgccgccgcccttggccttctcgcgctcgtcgccgccgccgccgcccatctcgtcctctcttcctccttgccgcgttcacactggtgacgagagcccaggcgaggggcgtttagacagcttggatgtacagcgacggggtcggggggcctcgagcgcgcgtggtccgtccgatgcgtgaccgacggtccagatcgtacctgggggatccattctactgttcctgtcgcgagaaaggaattaatggctcgtgacgctgatcgacgaacgggaccgtgccatcttattactacgaccgtgtcgggccctcgataaatcggtcgagaaaattgacattttgccattgtcaaaacatgttttgctagaataacacttttaaaaatgatttcgttaaaatatcactctcaaacaggggcaacatgttgcaatgccatttcatccatttcttctcaatttaatgattttttcttgctgagatgataaaaatacccttggatcctatctcatctctcttctcttacctcatcctctcttcgttgcagatggtgggtggcgctggcgcagctcgagaccatcgccgtaccgctacgagatgagaaagctggccacgtcggggatggtgccgacgccgcccttcaccgccctcaccagcttgacggcgaagctcaccgggttcacgcacaagttgccggcggtggcgacggcgaccgggaacggggaaggcagcgcgccttgggacgaggaaggcgccggcgtggacggggacgacagttcggctcggcggcgcggcgcaccaagcactcgacctgaccgcgcgccacggtgtcatccccttctccgatgagctcctcgatgtgggcagcgacctgctcacggcggagctccttgtcgaggggacctgctcgcgcgcgcagccgcagccagctccacccgcaacgtccagtcgcttgagcgggcccttcaacctcatcggggagagagatcgacgccggccatggtggagctcgccattgaagagggactttaaaatccaccacggagttaagccgatttgagtgggatttgtcgggggaattgatgaggaggacgagaggaactgatttttgcattcaaatttgggcaagagcaaccaaggagggagatcaatttggggcatgagttcatcgaagagagaaggatggtggtggacgaaggtggaagacgctcctgccaagcaggccccacggctgaggcaagggcatttgggtcaaaccaaataagcaaaatggtggaaaacatttgcaaataatcaaaattggttaaaatggcagtgtggcaagatggggtcatttgaagatggcattataacgaagccacattcggcgatggcattctggcgaaaccccaacccgagaatggctaaatatcaattttctctattagatatcccatcgtttcacttgttggaggaataaaccaagcaatatttacaaatggaggaataaaccaaataacatatttacaaatgagaaataatttgagaaaaaagttttatatatgtgttcttaacgatataaaaaaaccgaaaaataaacttcaatgaaaacccctaaaatcaacttcaaatttaaggttgaaaatttaaattttggctgataagcataagcgtaagctaaaagatgagaatgtgggattggaactcgaaacatttcgctttggtattatgttaaaagttgtatacatcgactactaatgcaattaaaaccatagggaaaagtacgaattaccccccgaactaccgtggtcgtccgaattacccctccccccgaaccacaaaaccgggcattcttcacccccaactatgcaaaccggataaattacccccctcgactcaatccgcggtggttttggtccacgtggcgtacatgtggcagtccagttagtacacgtggcagtacatgtggcgtacgcgtgggcccacttgtcagtttgtcccctcttctctctcttctcgccaagaacgggcgcccgcggcggacctccatctctctgtcaccgagaggcaacggcggagaggggcggcgacgacaatgtgcggaggcggagctcgggtggcagaggaggagcctgtagctgccggcgctcggggcggcgaagctcgagaagcccgcaactgccggtgcacggctcgtcgaggcggtggagggggcgctcgcagagcaagcagatgacggcggcgggcagagctcgggccggtgatggcgataggcggaggcgaagctcgggcggcggaggaggcgcccgcagctcggacggctgcggcgggaggacgcggcggcggcgggcggcgccaaggatcccccctgctctctcttgcgcatgctctcggaatggcagccagcggcgggcggacctcatccgggcagtcggcggcggaggcggtcctcgcccggtcggcggcaggcggcggaggcggacctcgtccggtcggcggccggcggcgaaggcggacctcctccgggcggccggtggcggaggccgaacctcgtccgggcggccggcggcggaggcggacttcgtccaggcgcgagcctccgcggcggcgccctccaccgcccgcaggtgcgccaccgcgcctcctccagcccactgccgccccgtgagagagaagagagaggaagagaggatgaggagatgacaggtgggtcccacaatttttttttataaatagagtgctgactggactgccacgcgtacgccacgtggatcaaaaccaccgcggattgggtcgaggggggtaatttgtccggtttacatagttgggggtaaaaaatgcccggttttgtagttcggagggtaattcggacgaccgcaaaagttcggggggctaattcgtactttttcctaaactatagaattgatgatgagagaagaacagccaaaactaaaaaaaaaaaaagaggagaaaggtaggctcccatcgttgagtaagccaaacggcatatttgcaaatgaaaagaaaatttctaaacaaaacttttatatacatgttcttatcaatctaaaatcaaaggctgaaaaataaacttcggtaaaaaaaaatcctaaaatcagcttaaattcatatttaaggttcaaaattcaaattttgactaataagtactccatccgtaaaaaaaaaactagatttattgtagttcatattgattatactggaaggggattgggttaaatccgttaattttttttaggacggaggaaacataataataataataataaggaaaaagtacgaattaccccctgaactatcgcggtcgtccgaattaccccttgaaccacaaaactggacattcttcacccccaactatacaaaccggacgaattacccccctcgatctaatccgcggtggttttggtctacgtggcgtacacgtggcaattcagtcagcattctatatatatatataaaattgtgggacccacctgtcatacggttctcttcaatctctctctctcggggcgatgcacggctacggggcgagcaggaacggcgggcgcgggtggcggcgagcggcggtgtgcgggggcggacgg

SEQ ID NO: 42354 - DNA, 2758 bp, Oryza sativa
tcctgctcgccccgtcgccctgcatcgcagagagagagagagagagattttgaagagaagaccatatgacaggtgggtcccacaattttttatatatatagaatgctgactgggctgccacgcgtacgctacatggactaaaactactgcggattgggtcgaggggggtaaatggagaaagctacgcatcggacgtctggagatttgcaaatctccggacgatgttccactgtatgttgaatgaatgttgcaatgttccatcgctcgaaaaaaaaaatgtttcaacataaaatctccagacgatgtttcacattatgttgaatgaatgttgcaatgtttcaccgctcgaaaaaaaaatgttttaacaaaaattgtttcttgatgtttcatctttcattgaatgtttcaccgtgtttcaccgctttatcgaagatgtttcaatcgaatgcaacactcgataatgttgtctgcaacaaaaaaaaccaatatatgcaacatccgaagaaaccaaatgcaacatccactaccgatttaagaaacatccagaaaaaatggattgcaacatcaggaacacactatgtgcaacaaaaaacatgtagtgtgcagcctcctcaccttcgtcgccgagctcagaaccctctcaggtaatggcgtctcaagcatttccgtcgtgctgccccgttgccgccaatgtggttgccggcgctcaccgcatcccgctgtcggaactgctgcaccggccaccactcgagcgcatggtagtcctcgccggcgacgagcaccaccctacgcttccttttccatctgtcgtcggggagaagctgaagaacagcggcgcgcggtcgtcgccgttcgacgccgcccgacgcctccattgccagtgccaccaggaacacggccaccgcgtctgccacacgacgccgctgatgaacgtcgccggcgacaccagaatccggccatccgcgacggcagccccgccgtctacagcggcggtggcggcaccggcgccggctgatgacgccgtagccgcgtatgcagcgtggagacgttgagaagaagttgaacgagaggttggggatgagaaggaagaggataagatggggaaaggtgggccccatcgaccgtccggagtttgtctcgtatcggacgctcgatacgaagcattttcggggctaattcgtccggtttatatagttgggggtgaaaaatgactggttttgtggttcagggggtaattcggacgaccgcgatagttcgagaggtaattcgtactttttcctaataataataataataataataataataataataataataataataataataataataagtgaaaagatgaggccggtactatcttcacgtaccctaattagtaatcactagcttatcaggataaataaagaaggagagagatctgggcgccgaccattcggacatttcgaagaatctggctcttggaagaaaatttaagcacggtgtctcgtatgatcgtctcattaggattggattctcagatagcccattaccacaagccaaaaattaaattttgaacattaaatttagagttgattttaaagctatttcattgtacgtagtttattttcttcatttgcttttaaatcattataaacacgtatataaacgttttacttataaattattttttatctactagaaaaaatgcacgtgcgttgcaacgggtaaaggctattttaattttattattgttatacggtttagttaaagtgaaattcatcgtgataattcgcttagatatattattttttttctagaaaatcataagctgtaattaggagtccgatcatcttaagttaacatataagtttttttaaagatatttcttatacgattgctcatgtatttctgaaagcgaacaaacttaaaacttgactcaaatacggaaatatagatctgtatttctaaaagcgaacgaacttaaaaaccaactcatcaacagatgacgtaccaaagtaccggtaaaaacatctttaatttttataatagtagagatagagatagagatagagataggtatatcgtttagcttattcccttttaatctgctcaatcacacagtagaattaacgccagatgtcacagatagaatgctctctggtgcaccatcactactcactcacaagagaacgaccggaccaggggaccctgcacgctgctggctggctcaacatggcacgtactccatatatgcacgaattccacgggccatcgctttctgaatcctgacaatatctccagcctaattaactacagcaacaatcgtacgtggacggtggacccacggcatcgtctctggtcccgggtaatcccaaattcccaatatccaaatggattatatcgtcgacaataattgttctgcttgatgatgagctaaggagaaataattacgtactgtggagtggacacttgtttagcttaagccttaagataggtttcttgcggttaagatatggcatggtcaccaaagcaccaattaacgtgctccagatcgcacggtgggcacggggtttgagattagcgtcggcacgtgaggacgacgtgagctggcaggtgaggtgaagccatcgcccgggaatatccgtgtcggcaagataaacaagtccgcgtctctggttatttatttagtacaaagttagtactagtattacaagctgatgttaggtgttgatgtgtggctggtttgaggttgattatatagttttctattgta

SEQ ID NO: 42355 - DNA, 2400 bp, Oryza sativa
acttttgacataccggggaaaaccgtgcaggttagtatttcactgatgtcatggtgtgtagggttagtatctgactgatatcatggtgtggaattcaattaatatgcttttcttgtttgtttctaacttgatatagatcttataaacattttggtccttcacgcctcatcaaattttcagtccactacacttacagaccactggccgtgtaaagattgtgtatacgtaataatggagttagaaaaactatttttttatgttagataggactagtaatattagccttctaatatgatgtaaaaccaaccataaataaaagctttttatttatttggtttgttatcgactcaaccgtacttaaaattgataaagcaacaaacagaacatgtataataataactatttctaccctgacacagtttccttccctcgaagtttccactcttaaggcagtgttccgcgtgcacgttttttaaaaaagtttctatataaaaattgcttaaaaaagttaaattaatccttttttaaaaaaaatagctaataatcaattaattacgctctaatataccgctccgttttccgtgcatagatgataggttcgcaaccctctctaacgaacacagcctactaccaccaaaatatacccctaccctacattaccaaaatttagcaatttatttttttcatattactaagggtgtgtttggttgcaagccacactttgccacagtttgccacgcctaaggttaggcaaatttgacaggtgtttggttgtagccacagttgtggcaagattcccctccaacaaattgggtcccacgtgtcaatggctcaaaaaagtgtggcaagattcccttaggcttagtaagttgtggctaacaatttgatcacttcaccttagacaaggtgtggcaacttttgttggcaagtaatggtaaagtgtggctgggaaccaaacagcccctaaaacttgatagtgttagacaacaaccagtcacgaaagaggttgtgcccattggcacatgatgacatgaacctgaccgagccggagttgagttgggtgcgcgtgcgcgagcacctttttctgttggtcgacgttgggtgcctttctggcaacagtttctcacttaggcccctaccatttcccaaaataacttttccggaccagaccacgcctcactctcgtcggctcgtcgccttgtccgcgcgtgcgccaccgtttccacccagattcgcgcccgccacttccgactagctcttcgcggcaaaagagatcgccggctcgccggccggcccggagcgcgggggttccgcttccgcggcggagcagccgtcggctggggaggggagatggacgccggcgagctgcccatcgtgtaccacatcggcatcgtgctggccgcgctgtgggccgcgggctccctcggcttccgccactccgtcctcttcctcctcgccttcctctacctctacatggtacggtgctcttctgccgctgccgcccgcgcctctcgctgataagttgatggacttttttttttatcttttttgagctcctttacggcatatgcttaggtgacagttgtgatggatgcatcgctctctgggaggtttttttttttgccttttgtttctatcagaaaatttcctttcctttcctttctgcgatgcgactgattttgtatctgattccggttgcaaatttctttcctttctgcgatgtgactgatttaatatctgattccggttgcgctttctttaaacttgagtgtataattcttagtgtgtatgggagaaaatgatgtatatcgacatgctttggaatggttgaacatgctatatggttgcttgtgtgctatggactatggttggttgattaccactgggacatggtgctaattgatagttctctatccatatgtatatatcagctggtacaatggtagggacatcaatactgccctattaatcttatgtattccataatttttgtattttggcccttttttatggaattatttggtcacaattggatatgtactaaagttcatgttatggaatagaatttatttctcttttaaataaaagagatagagtggaattcatagtttcatacttccaatatagatgaatcggcatgtcttacacatcagataatcgaaatgaaacaaaaatatgttactctttcgttccagaactaaagtaaatattgtgttaccttttcattgtaggtaaatgctcgctgtgcaatgaaattgcggaagagaatacaacatgaagaaatgaaatctgcctaccaacgaagagtatgctcctttctatgatctatgatttgttcttcttttatattttgcaaggatgaacctggttaactaggctcccacattcttttgctacttt

SEQ ID NO: 42356 - DNA, 2150 bp, Oryza sativa
attccgtggtcagaatgtgtgtgtcaacatactcaaggaatatatattcaggagactatttgggcctgggcccaaaaccttagaactcctttgaattaaaggaattttgtaaaaaaaatatatggaggaatagaatccacaggaaaaaaaaacaatcctttgagagagcttttgaatagtagtctttgatttctttcatgttttggaggatttctaccaagaggttcaactatatgtttacaattcctttgaaagtttcaatgtactttctctcttcctctctcggtatattctctctcaataaatcaacatataatcttcattttctgtatttttcttgtgagatttacaaacaacaccactttgaataattcatgtgattttgttctcgtaagattcaatgagccacaacattttaaacctgtgttttttctattcccgtgtttttggattcatgcatttcaatgtagccctatgatggtagtatttactagggttttatgggtgaggataggaaatgggtagtgggcggtgagaacggctataaatagaagttgggggtagcggttgatctatggtgggcaatggacatgagcgggtggtgaggcggtgccactgttagagtcaagatagaagtgcaaaaaggttaagtagggaagtggcaaaccatagaagatttggacgattggtgttggtgtgtgggagggggggggggttgatagggggggtcccaacaccgccatctgtgatctcttgatttgggcatgagcacgtcggggagagagagagagaggaggagaagataagatcacaatgcaatgtagttgtatcaattctggatcaatctagatcattttaaaattattgtaattttcaggtgactgagaaattaacaatcccgtgtattaagatcaaatcacaccccaaaattgacatcatgccacaaccatccgtactggaccattgttgcatctagctatagctgacaaaaacaggaggaacacatgcaaacccccttctttttgggatgaagtaagtagtacttcagtaacatgatttgcaaagagagacatccctccaaatatttttttaaaagaaattatgtgtttgttaagtattgaacacatgatcttagattgaaatcacacatcccttatcattgcaccgtcaaggacatctctccagctcccatctctctgctgcgtggaaatgccacggaaccaacagctagccaatcgacatttccctcggtcagatcgaaagatatgatcatggcacatacgtataccgatcggtgtccggttgttctgcgacttggattgatgagtgatatcattgcagaaagaatgatctgatggcaactggatctacgacttcccatatatgcaggctgctgtgccctagcagtattacaacatgatcaaggagtgacaaggaccactttaattgtggaaacacctggtgacaggaaaatattgttacaccaaccaacaaaatctacgtgcatgacgaaatgggatcgatcagtccagcttgtagctgcaagaatgatcttgcaaatgtcaatccaggaccactggatttcgtagcatcgtgttccacttcggtgcatgctctcctgggaaaaatagcaaatacagaattattacatctggctcaccggcatgtggcaatagagtacaactctatcatttgctttggaacttatcagtcatatataaccaaaattaaattctaaaatttagcttttaattttttattgtgatttatttttatattggcttttaagcgacaggaatacatataacatagttttatctataaattactttttgtttttagtaatcattatggcttattatcagttatagggataagacggggactaaaaattttctggatccgcactggcacactacactgacccaaattaagcagagagaatatgatggctactattgttagctacactactacagtaattagtgctgctgtgctggcagcagccaacaaaccagatcgatcgaacacgacgtgcatcctcagtcaatcagttacccgcggccggttgcatcatcgctcgcggtgaccgtgcatcggccgatcatttgatcgagcacatccatgtgcacgagcgcgatgcacgctcc

SEQ ID NO: 42357 - DNA, 2439 bp, Oryza sativa
atcgacccaaaatagaactagatgatctttagtcccggttggttccatgtcagaccgtgtcaggcgcctaggatctttagtcccggtctaactttagttccggttggtgttactaaccgggaataaaaatcaacacgtactatataatctctattacttatcctcttctctcgtccacgcaacaaactttatctctttctttctttcttcctctctaactcctgccttatctctttcttctttcctctctttttttttggatcgagcgagatcgagggccggccgggcggcgggcggcggccggtgcggcggcacggagggccgcggggcggcggccggcacggagggccacgcggcggcagcctgcgcggcagcgggtggcggcgcgcagggcggcacggcgccgcgcggcggtggccggctggcgtggagaggaggcgacagcggtcggccgagcggcgcctttgtggtttttttcttttttttttagaatttatgatttattgcatgattctgtgatgtatttgatttgtgtgcgatgtgaacttgtgatgtatttgcgatgaattttgtagaacttgtgatgtaatttgatttgtgtaattttttttaggatttgcgatgtatttgatttatgtgtataagtaacttaaagatttgtgatgtggatttgggatgttaatttgatttgggatttggggatatgcatgccacttgattcaggagaaaataaaaaagagaaaaaaaaggaaagaggaccatctatactgctgttattccctctttagtcccggttggtaactccaaccgggactaaagatcccttcaatgtcttctcgcaatccttctacccattttctgttcaatggtttcaatacaataaaaaaagaaaccatgatactgaactgaatcaatggcatttcccagctttgtttttgaactttggtggtggcgatgaagtgttgtagccttgtagcacccttggatgcactccatgctctttcttatatttattgctcataaatgggcatggccaaacctgagatttccttcccaagactgattttatctttatttatagtcgtacgtagcttcttgttcttactctcaatcgcttgagtcggtctaagaacaaaccactaaatggtgcttgattctccttagtcgcaggttgataaagacgaaagtccacactcgatccttaaccaaacaacaagaagaggtgaatttcacatgtttttagcattattggaaaaagaacctaagggtgcaagagaaggttacaacaaagggtttgatctctatctttagtcccggttggagttaccaaccgggactaaagatcgatctttagtcctggttatttcacccgggactaaagattgcgatctttagtcccggattcgtagtcccggttggataaccgggactaaagggggtttacgaaccgggactaaaaaagcacttctccaccagtgtcttcatcccaaaatataatactccatccgtttcatattataagtcgtttgactcttctaattttgataagtttatagaaaaatatattagtatttttatcccaaaacaaacatatgaaaatatattcaatgctggattaaatgaaactaatttgatattttagatgatcttaatttttttctataaagtcaaataatttataatatgaaaaagatggagtaatttgtaacttaaaaattaatactccctcgatttcataataaatctacttattcttttctattattaaatttgattaaatttattaaaaaattagcaacatctaaaatattaaattagtttcattaaatctaacattaaatatattctaataatacatttattttgcgttgaaaatactactataattttttaataaacttgatcaaacttttaaaaaattaactagcagaaaaaaaatcaaacgactcaatactaccattgacgacgaaggtatagtaccgttgcgctctgcaaatcgcgcgagatggtcgtgagtcgtgacaggtgacgagagtgcggcgtcgcgcgctcatggttgtggtcttgtggatggtggatggtcctaccgcttgtgctccctggccgcgacgcctccggtggacggagccatatgcatgcgtgcgcggtggctggatgagttcactggctctctctcccatggatccaggaggataggaacggctgcgtgccgtgtctcctaacccaatctcgacctaatcattgggctcccgttttgctggcagccgttcgatcggcgatggacacagccacgggttgcgctggaccgtccgatcccgctccaccgtaaatctggatggatcgatatatatgttcgctgccgattcctatatccctccaccgtctcctgacactgatttttttttcttttaacccatacaaattatgggctgcaggaat

SEQ ID NO: 42358 - DNA, 3240 bp, Oryza sativa
tgcagcccgtcctcctccattagtccatccctttctactaataatcatatatagtatataatataataagtagagataaatgtaatagtttttttaggaagataaatatattggttcacatgatcgtatgatttggagttttggacacgattgtgtggttccggcttagggtgggtaattcacgagtatgcaagttgtggcgctacaatccagccgtatgtatggtagttgtgtcgtcgtctactcaggggctcagggcccatgggctgcaacccgccgcttctcgcactgtgtggctgttcgcggccaaaaatagcaaggaacatgtgccaaactggcaacaagagtctttttgtcatgtccacatagggcctgtttagatccatttagaatgacaaataacaaataataaaagttttggttagcgttgtaaaagtactagtcggtgtttaaatgcatcttaaagttttaccattttagcactaaagaaagagaaagagagagggtgtggtcccgaagcactttttggcaaaatttgctactatggactaccaaatgccaaatgccaaatgctaaattgccaacttttgctactagtgtttagatctaaaatagcaaaaagtgctttaaaatggcaaaacttttgttattttggagggccctgtgtgtacagtggcgggggcatgggacgaccagtggcctggccccctttaataatttttatacataattatctaattacaatcaattagataatcaacttaagaaatagtgcattagctctcttcaatactgttagccccctcccattttaaatcctggcttcgtcgctactacttgcttgcgtgtgtgccgcccatcggtccatgtactaaagcaacggactcttaaattcaaacatgtacttctacacctcatttcctattatccaaacataccctgagtgacctaagaccctgcataacttgtgccaaatgaaagtaagtcagatgatggctagggatggcaacgggccaggtcaggcacgggtagagcaaaaccatgcctgacctggcaccgacaatgtcacggttacgggttagacataccctttacccttcgatatacgtcacatatcggtttggtatacctacacgcatacagatgtttcccgcgtactgtaaggaaatccttcacagagtctatggatgggaagaatcctactcggataagattgggtcgttaatgtatcgtacagggtctgacatctccgagttctacttggagacctctagatctgcaatataaaagggactacgatctcgccggatccgacaagttcccttgttctctttgtaacctgtgttttctaccatataatcccacatcaactggattagggctattacctatcaaggggcctgaatcagtataattcttgtcttttgtttgcttgatggcgtactacgtagatccttgtaccaacgtaccccaataccctctatatccggtctacgggtatcacccgttgacagtggcgcgccaggtagaggccttggtactcaaggttctactactatgtcatccagcttcgtcgacaacaacgtcagcaccagcctcagccaagtactccctgcttcaacaatgctggtatggactcaagtcggcgaaatcgtcttcccggtttacaccacgacgccgatctcaaccggtcctccaatgaccggagacgagaacgtagtggctacgaaccagggcgattccatgtcgaaaaatccccccgtcgagacggagaacggaatatcgacgacatccaagctcaagaaggattttgatacggccaaaccttgtccttccgacatgaaccacgagctgacaaagatgacttccgaagccacaaggtcttggtgtcttatccacaaaaccaagaaacacaccctgcaagattgctgggttttcctcaacgtccgtgctaaaattcgggcctgcaaagaacgtggaattcagcgtacttctccaactcgggatgtctattgtcctatttacaagacaaagaatcacgacctcttgagctgcaaagtctttctcggcgccatgaaagctcagtctcctaagtcatatatccccatcagggataacggcaaggaacaaggagcgactccaacttcagatcgattcattggggtaatcgatatcgaccctcacgaaccatcggtcttacatctccttgaggactatgggtcatcgacaacgagcgcgccgcgggaggtattggctatcgatgacgttggcacgtcagcgcacgccaacacagaagcggggaaccaatcgactactccagtccagcacatcagggccgttcaagcgatactgagggaaactccttacgatcccgttctgaaccttgaccttgagcgttggacagaacgactacgggaatcggtgactaacctcagcaacgcatttaaagaagctgctaccgcagcacaccaggagcagccaccaactggagaggccaatggtgtaacaccctgaaaattcgaccgacaaaaatctaaactctaaaaatatgggcattcaaaaactttttaaataaattgcatcatgccgattttctccgcttatttcattggaatttagtttcgaagtttatcaataacgaataaggaataattaactaggaataaaacctaaaattaaattggcaaaagaaataattaagatataatttaaaataaagatgaggtgaggatagaaatgaataaaatattatcgcgaccatatttgtatcaattaaatttaaatgcgattgaataggaatttactctaattaaattcaagtaaattatataaaaataaaatatcagtaaaataaatctagagtggatccattggttggaataacacaaatattgaataaaccatatttatgcaaaatttaggatttatagaatcaaatttaaataataaataggctaaaatcgggttaaataagaaaaaacactgttcctttcactctaggtgctcgacgtggtcccctaacccagccccctcctctttcccctctctctgtcgccaccgtcaccacgcgccgctgcccgtcgcgcctggccgcctcgcgccccgagccgccgcgcgccgtcgccatcgtcgcctgccgccgcgccgacgtcgccatcgccgtctgtcgccgtcgccatcccatcgccgctgccgcgccgcgcgccgttgccccgcgcctcgagccgtgccgctgccgcg

SEQ ID NO: 42359 - DNA, 4867 bp, Oryza sativa
cccctctccccactccatcccctcctcctctccctcttctccccccccttctccacccgccgccgtcgtcgtgccgccgcgccgccgccttcgagccgccgcgccgccgccacgaagccgccgcgctgtgccacgccgtgcgccgtcgtcgccgccgctgtcggtgagccgctgcccccctgtttgtcaccgtgccgccgggtagagagagagccaagagagagagaggaagggagaagccgagggagagagaaagaaaagaaaagagaggaagaaagaaagaagccgggagagagagaaagagaaggaaaaagaaaagaaaagagagaaagagaaggaaaaagaaaagaaaagagagaaagagaaagaaaaagaaaagaaaagagagagagaaagaggggaaaatagaaaagaagaaaaggagaaaatagaagggaagttaggggagagattaggaggatataggaaataaaaatggtcggggttaatcatagattatttttggaaattcctagagtgtaatagtatttcgatcgaaattttgggttaattataggaatatgtttcttgatcggattagattaaaaattggtagtaatttagatgtaattaataactaaacaattagatgaattcttatagattattatagattatttttggtaatctctataagtcatcgattcacggtaggaattcggatttaatttttaggaattttagccgtgtattatatttaatcatttagtcatagactaaattaaatcgtacaatattataagataattttaggattttgtccgatatttagcttgcgatagaaatttctaacctattatatggatataatgcccgggtagattaaattaaaaacttatggtaacaaaatatttatacccgcaaaactagtttaggatgtataaatcgaaattgggtttgccctagttcgcgaatagtaaagttaatataaaagaatcaatttttgcattcgacttccatttggatttacttggatttttatttgaattctaaccgaatttaaatcaattttctcacgtaactataaagcccgagaagcccgagggagttgcggatccaagtgaaggccaagacccgcaagactttgagcaaggcaagtcatcactattccttgaacatgttgatcccatttacaaaattattttgtttacaaataaaattacatgcaatgatagacatcctacttgtgattatgccatgccttgattattgtttacccttaaatccttgtaaccgtgatttatgtataagtccctagtcaactatgacaaatgcttagaaatgctactctagatttatgcatactcatatttatcaaaagctatatgcttgggcaattacctttgggaagggaattgagatgcggcatgtggagacatgagcgccacattgccatgatgttgatgacatgatttgtgaaaggagaaataaaattaaataactgttttcgactggggcggacggaggatttgggtggtatccggaaaaggctagtaccgtccccggtcaattaaggaccgagccatgaagttaagcatgaaacgacgcccgtacaaccgcacttctcgtatgggtatagacctagcggaatatatagctgagcggaggcagtatccatgcatagtggtttcttgatgtgtgaggcaggggctctacggtggggcagccattggtagaaccgcgaggcgggtgtctacagtggtgtcgccatcggtaggactgccatgtgagaatttaaacataattataaattaattaatgcatgtgtgagtcttttcttcccgggtgcgccagaactcctctcactgctagaaaccgtgtacgcctagagtgcatgaggatgtgaagttcatggagcgggtactgccaatgcgaggttatcgaaaagctttgccatgacacgtctcatgtgttgggacgaggctcatgtgttgggcagtcgcggagtacgggtaaagtgtacatccactgcagtgtgagtaaatcaaaactattcgaatagccgtgctcgcggttattgagcaccgggacgtgtattacacttggctagactctaaattcttaatttgtgtgggatgggatattgcatgatgatttctttgctgatggagccacttcctgagagacgggaatgtggacgtcctcagaaaaccatgacgactcaatggcgggaagctatccttgggatcaccatggatggtggacagaaccgtcattgtttaatatgaacactggtactaaaatttgatcagtctgtgctaggtcttaggcttgtgaaaagaattacaaaacttgctttgcgcaaaagaaccatagccatcctttgaatacccttgtcatatgcattgttgctgtggtggcttgctgagtacggttggtactcacccttgcaatatacaaacttaatcaaaggtcggagatgaagcttcggaggatccctacgcttactaccaggagggtgatgaagacgatggcgctcagtaggtcttagttacagtcgttgcctatggcaatggcgtgccgctgccttgactccgctgccttacctacttctgtttttggaatgtattccggaccgcttggtccgatgatttaagactatgcctgcgggcttatgatgtaataattcgtattagacactcgtgtatgtgcacttggtatttcagctatgaattcatgtgtaccaaactacttgatccagggaaatggtacagtttacatgattgattcctgttataaaaacgggggtctacaaatggtgaggatctggaacggagggaatcacctcaacaagctacccctctacctcgcggcactggcgatcttcgagatcaaatcaacggccgccgggaagcacgacgcacacgagacaacgtgaatcgctctcggagtcatgtctcttcacggcgccatgataacggaaatcgaggagatcgctcaaacgaggaccgggaccacgacaaccaccacgatcacaacgatcgcgaacgacgggtgccagacaatactggtcatggtcgccgccgtatcgacgacgacgatggagatcggcgccgagacaacagcggaagacgacgacaggattcccgggatccaggccgtcatcctcgtaatcgtacaccggaaccaagcgacctatcgtcatcgtcatcatccgcgtcctcctcatcgtcagacagacatccacgaaggacacacgaccgccggcaacccactgcccccaacgctgggtgtagggctttcggtcgttccctacgtgatgtccgatggcctgagagattccgacccggagcaatagaaaaatatgatgggagcaccgacccaaaggagttccttcaagtctactccacagtactctatgctgccggagcagacgacaatgcgttagcaaactatttaccaaccgcgttgaagggttctacacgttcatggctgatgcatcttcctccctactcaatctcttcgtgggcagacctgtggcaacaattcatcgccaatttccaaggaacatacaagcgccacacgatcgaagacgacctacacgcgttgacacagaacttgggtgaatcattgagggaatacgttcgacgttttaacgagtgcagaaacacaattcctgaaatcaatgcttctgtaattcacgccttcaaatccggtgtcagagatcgctacactacccaggagttggcgacaagatgcatcacaaccactcggagattattcaagatcgttgagcgatgcgcccacgctgatgatgcgctaagacgcaagaacgataggccaaagaccgggggagagaagaaaccagccacggacacatctgagtcaagcaagaagaaaaatcgcaaaaacggaaaaggaaagctcaagcggaagtcctcgcagtagaatacgcgaaccctcccaaacgcccagacccacaaagcagcgacataaagaaatcatggtgctccatacacaagacggacagacattctctggaagattgccttgttttcaaaaagtcgctcgagaagcacatggcatttgaaaaaggcaagcgagtacgcgttgtcgagacgaacgaagagacggctcctcacgaaccggactcagcgtatccagactccgacctccacgtctcacacatcttcggcagttccacaacgtactcctccaagcgagaatacaagaaagtggaacgtgaaatctgtttgacgtggcagggggctgcacccaagatgaagtggtctgagcagaagatagagttctcggaagaagaccaccccaagaccgccgttatcccaggacgatatccgatcgtggtcgaacccgctattcggaacatcaaggtagcgcgagttctcattgacgatggcagcttaatcaatcttcttttcgccagcactttggacgcgaggggaattccgcaaaacgagttgacaccaactaatcaacccttccatggaattactccccaatcatcgtccagacctttgggcaagattacgttgcccgtgactttcggccaagccaacaacttccgaacagaacagatcacctttgatgttgctgaattcgatacagcttacaacgccatcattgggagaactgcacttgcgaagttcatggctgcatctcactacgcatatcaagtgcttaagatgccgggaccgaagggaacaatcactattcaggggaacgcaaagctagcagtggaatgcgacaagcggagcctcgacatggtcgagcaaacgcccagcccacacgccacgactgagccacccaagaaagtgaccaagacaaacaagacgccgaaaccagatggcgtcatcaagattgttccact

SEQ ID NO: 42360 - DNA, 2021 bp, Oryza sativa
cagagaagtacttcatccagagtggctagccaatccagtcatggtacggaaggccaacggaaaatggagaatgtgtgtcgacttcaccgacctcaacaaggcgtgccccaaggatcactttccacttcctcgaatagaccaattggtggattcaacagccggttgcgaattattgagcttcctcgacgcttactctggctaccaccaaatcagcatggcaaaagaggacgaagagaagacaacattcatcacgcctttcggggtattttgctatgttaaaatgccattcggactgataacagctgggaatactttccagcgcacggtccagggcgcacttagcaaccagtttggcaacaatgtcgaggcttacgtcgacgacatcgttgtcaaaaccaagacaggcgactcattgattgacgatctgcagaaatgttcgacaacctccgacgatatcgcctcatgctcaatcctgagaagtgcacgttcggagtaccgtcgggcaagctgctcggattccttgtctctggcagagggatagaagcaaaccctgagaagatcaaggcaatcgacaatatgaagtcgcttacaagactcaaggaggtacaaaagctaaccggatgcatggcagcactaagcagattcgtcgctaggatgggagaacgaggacaacctttcttcgctctgttgaagaaacaagacaaatttgtatggacacgggaagccgaagaggcattcattgcactcaagcgctacctatcaaacccccctgtacttgttgctccccaaactaatgaagaattattcctctatattgccgccacgccacactccgttagcactgtcattgttgtcgagagagagaaagtacagcgaccagtttattacgtcagcgaagctctccacgacgcaaagacaagatacccacagatccaaaagctgctttacgcaatcatcatgacatcaaggaagctacgccactattttcaagcccacagagtcatagttgtctcctcttcccctctcggtgaagttgtgagaaacaaagacgttgtcggccgcattgcgagatgggtaatcgagctgagccagtttgatgtccactttgtgccacgaacagccatcaagtcccaggtactcgctgacttcgttgccaattggactatgccagataacaaatcagacaaccaaggcgacaatgaaacatggacaatggcgttcgatgaggcactcaacagccaaggaactagggcaggatttatcttgacgtctccctccgaagatcaattcaagcacgcaatccacctcaacttcagggcgaccaataacactgcagaatacgaaggactactcgccgggatacgagctgcaacctcacttggggccaagcgactaatcgtcaaaggggactctgatctgatgcagatccaggtacacaaagattataaatgctctaattccgagttatctaagtatctcacagaagtcaggaagctagagaaaaagttcgatgggatcgaggtccgacacgtctacagtaaggacaacatcgagccagacgacctagcacgacgtgcatccagacgaaaatcgctcgagcccggcacttttctcgatatcttgatgaagccatcggtgaaagaggttagcggcgaagtcagcccgaacacccccgacattagctcggaggtcaccgaggcagaacgcgccgttgccgacatcgaaaccacagacgactggcgcgtcccactaatcaaattcatcagcagcgaggagttgcccgaggacgatacagaagccgagaaaataacccgtaaagcaaagatctactctatggtcagcaacgatctatacaagaaagcgctaaacggggtacttctcaaatgcgtctcgaccgacgatgacagacacctcctcctcgacatacatgaaggcatatgtgggtcacacgccaccggtcgaacattggtcggcaaagcttttcgacaaggctttttctggccaaccgcccttaaagatgc

SEQ ID NO: 42361 - DNA, 8293 bp, Oryza sativa
acttggccattctcgtgctaggggctagatatacttgggccattcccatgaggacagggcggctacagattcctattcgtggcgatcgataaattcaccaaatggatcgaagcagtacccacgggggaaatcaaggccgacaacgccatcaaattcatcaaagggatattttgcagatacggactaccacaccgcatcataactgataacggctcccagttcatcagcgctgatttccaggactactatatcgggctgggggtcaaagtatgcttcgcctcggtctctcaccctcaaagcaacggacaaatcgagagggcaaacggcatagtactacaagggatgaaaaccagcatctacgacatactcatgtcacacaacaaaaggtgggttgaagaactcccgtcagtactatgggccgtacgcaccacaccgacaacgtctaataaggaaacacccttcttcctcgtgtacggctctgaggccatgctcccaggcgagctacaacatcagagtacacgagtacagaagtactccgacgagaaccaggaggagcagcgagatatcgatgtaaatcttctcgaggagcatcgggaacgagttgccgtctgagcagccagctatcaacagaccctccgctgttatcacgagaagcgcatccgtgcacgcatactttcgatcggcgactatgtcctccgatgagttcaaagccaagcagggcgaaacaaactctcacctaaatgggaaggaacttacacgatcacacaagtcttgcggccaagcgcattcaaaatcgcagacggcgacggtcgtgaattagcaaattcttggaacattgaccaactacgtaaattctatgtatgagtcaatatcatccatacatgtaagcacccttacagtatcaataaaggctatttctaggcccatatcacaatcaacgtgtttcgcccgatgatcccccactctgatgacacctagcgttgaaacctgtccttatgtccctttacgccgtctcgacaaggcctccgaggaacctaagggatctttggctggggacgcccaaagccgataaggccttgtcagatcctgtagagacgaaagaccatgtaagatcttgtcgtgtaagagttctcgccgtgcgtattaaccaagccgtgaaatcggaaatcaactttccaacttcacggctgggggctaggatcagagcttattcaaccaaggcaggtcaaaggtccaagagccttatcctccgagaaaattcctccgacgacaaggctgggggctagggagagtgtacgactcaaacggctgactaaagtcgttaactgagaacgcactcttacacatgacatccagagtaagaggcatttgtcaaagatagatttctttattcacaaaatactccttacagttttttcacaaatcttttgctacattacatctttttcctaagatatttgtcacaaggtacgagtactaccaagagggccaacgccagtccatagactggaagatcttttcggccaacggcgacattgaccttgccagatggtctatctccgccgaagtcctccgagaacgagcaaaacactcacgaaggtgttcgagctccaggtgcgggcgataatctcgtaggcaagccaacacgtgccccccggcataccggctcgatcgacgacactcctgcttcaaggcctcgtcgatacgcttgtcgattccatcgagttgggcacaggccccattaagccacgagatgtacccggccgctgactcctcgggatctccgcggactacttgaagctccttgcatactctggccatggatgtgcagcaaatcttcaagtacgagttaaaccatacctcacggcctcggagcgtttccacagcctgctctttcgtcacggccagcatggttctctcgagctccgccacttcaaacttcgtcttccagtattggatacgacgatcttggctagcaagggcaccctcgatatctgctaaatgtgataaccactaagtcaagctgtacatctcttttggcaacatggctgacctagtcaggtgggcattaaggggtgaagggactactaacctgaggaagtcgtcgccatccttccctctatatcaaggggttgatccacatggtcaggcgagacgtgtggttcgaactcgaataccggaattactgccagtgactcgggctgcccacgctgctggacatcctcgtcatcagtatctctacaagaggacaaaagttcccgaggtcagcatactaaagtaagccgggatagtaatcgcatgcacaaagacggtcagagttcgagttttacacattatctaggaaatacaagaagtcctactcttcaaaaagggggagaacagactctcccagatcaccgatttcttccatcacctccttacgcgtgtcgctggccgccccctggtccaagatctcgcgcagatcaagttcaggacgcgacagccttacacacgcgaggacatgacacgccccggtgtagattccgtttgacgtctcctccgcaatcctagctgcatgcttggaggggatttcccccattgccgtcgccagttccgcgagagaggaggtcagcgaaaactcatcgggattcgccgggatcgtggacgtgacgccgcataccccggcgagctggtgaaggccggtgtaggtgaccctcaacgagccccggatctcagataggttgttcccgagttctgacattcggtcctcgagccccttccgttgtcgctcgttgccggtcgccaactccctcatcttcgtgaggtcttcacgggctttagccaactcgcgcacaagtctgtcagcgcgttcgccgtcgccgcttccgacctcgcctccgcaatctcgcagccaatgccgcgagcaccggcttcgaggaggcgccccatctcgacttggagctcctcccaggtgaggactgcagctggcagatcacgacctgccgcggggtcgctgactgggccactaggcgtcgcctcccagctcccggctgcgggcatgacatccgtcgaggccacaaggggcgacgcactagaagctcttccggacttggctcgcgcagcctttgctcgcgcctccctacgggacgaccacgagtcagacaataagcgaataagaagcgcggggattcaagaattcatctacttacttctcgccaatcgtcacaatgcgttgtcgtcgtggaggtgggggagatgcatccgaggcctggaatacaatcaacgcaaagtaaggaaaaatccttcttgctgcatgatttaacgacaaaataaattaccgagggggtcgacaccatgcgacgttgtccgcttacagacgagaatttcctcggctttatcggaacattgccaccactagtggtggcagcatcagatacctccttgacggccttcactttcaaagatgacgccacctgatggtccgcgagcggtccgatgatatcagtcaaaggaagggcctacgctcaatcaagtcataaagtgatttcgaaaggagaatgcgggatgttcaccaaatatacttacgttgatggcttcatcacgttccgctgcccccttttcacaaaggggcacagggatgtcactcgccgtagtcgggccgctgatcatcacttggccgacgcggcgctccacgttttcgccgctcagacctgttaatcgagaaccaaccttcgataagtcaagaggaatgcggacacaagtatgtcaagatgaatgcgagaaagataccccgaggagaaacccgggtcgcgtcctctggcccggaatagttataagctggatgggcccgagcctgaagcggctagatccgcctaccaacgaagtctgcaacgacttcatatcccgacaaaccctgtactcagagatcgtcgatgatgtcgagaaacgactgaagagagggggtcaaggggggcttggcggtccaagacggaatcttgtccggttgatcttcgggaaccacgaagacagggttcgagtccttgatctcaagataaaaccacctattcctccacttgctgcgagaagaagggcactggaagggaatgtaacgcaacttcaggccatcccgaagtcggaacccaacgcaaccagataccctgttggattccatccaacgcagttcgtagtaaaagcaaaaaagatcaaggaaaggctctaccccgatgtaggcctcgcaaagatgcacaaagatgctaaggaaggcgatggaattggggttcaaatggagaagagaaagaccatagaaattcaaaaccaggagaagaaattcagaaggaggagggagaaaaccgcagagaacataatcttcgatcgcaaccatgcgacccaagatgggctgaggattagtacctcctacttccctctccatggttccacagccaggaagagcgccatcctcctatagtttctttaacgttgcactggtggaagccgatttgccgaggtccattgctgatcgaaggtcgccggaaaacgagcctagattgatgaactagggtttcttgcggcggcggagaaggcaaagagtgcttgcagtggggtgtgtttaacaggtttggcggacttcaaaatggactcccaaaattcctttaaataggcgcactaccgacggtgcgaattccagggaatagagagagatgcccgccggaaatttctggtcccattacacgcggcggttttttggacttcagtttaaaattcgttcgtgaccgttgggcttcaaatggcgtgctcgactacggtctatctccgcggtcctcgcaccgggaatgacaacagtctcgacacccgaagtcgcaaatggttgcacgagttcattttaagcagaagttgggggctactgtcagggttacaggttaggcataccctttacccttcgatatacgtcacatatcggtatggtatacctacacgcatacggatgcttcccgcgtactctaaggaaatccttcacagagtctatagatgggaagaatcctactcggacaagattgggtcgttaatgtatcgtacagggtctgacatctccgagttctacttggagacctccagatctgcgatataaaagggaccccccggggagggcctaaggcatcgaatctcagagccagcacaacccacacagcctacgaagccagagcctgcagggagccaagtcatcgggatctagtcgaaccaactcgactatgatctcgccggatccgacaagttcccttgttctctttgtaacctgtgttttctaccatataatcccacatcaattggattagggctattacctatcaaggggcctgaaccagtataattcttgtcttttgtttgcttgatgacgtactacgtagatccttgtaccaatgtaccccaataccctctatatccggtctacgggtatcacccatcgacagacaatgcccccctgaatcatgcccgatagggttagcgggcaaatctttctgcccgtaccccgatggatacccggagagcacccgacgctgacgatctgagaagtgcctgtcattgcttgcatcatcgctcgccgccgccgagactctactgatgctgtcgataggagagttgactacctgccgtggttgcgttgccgactctgtcgcctgctaagccccccgccgtcattgactccgctggtaccgccgcttgctcccgccacttgctcgtgctaccactgccctgagagccgccattgttcccacttgctcgtgcattgccttcagccgccatcgtcgttgcttgcccccgcgctaccttgagccaccgccatcgtcgcttgccggcgctgcctccacatgttcctttgctaaatgtgctgtcgtcgccactgcgttgaagtgaggtgggatgaaaattaggttatggtttgatgttgttggctaatgggccaagagagagatgagaatgaagatatgggccaaaatcaataatacatatatcgggtcgggtatgggttatccgcgagtaaaaggtaagatccggctgctgcccactacattatcgggtctcgggcgtgcatgcctaagggtaaaatattgcacccatgcctgtgcccatctggtcgggtaaccgcggatacctgaacccgtgagcaaaattgacatccctaattttattctctagctgcttttcctagctttcgtattcatgtgaccatgcggggtctcagtcagccaaaaaaatccaccgtgaaaaacagtcctgggggtgtaaaataaattaggtacatcatgtacggaaactgctatttcgcggctagtcgcgcgcgccctccccagcgtgactggacacagcgcgcacggggaggagggtggcagacagccgctcttttccttttttttttccttttcccgtttctattgtttcttcccctcttttccgtttctttttcgctttttcggttgtttttttcctttctttcgtttctttttcttttttcggctgttatacaaactatgtatacacatatactaagtctgtatgtatgcgtgtacaaactttatatacacatatattttttcgttttttaaacatacatatataaaatatacaaagtttgtatagtttgtatacatatatatatatatatatatatatatatatatatatatatacatatatacatatatatatgtatatacatacatacatacatacatatatgtatgtatgtatatgtatgtatgtgtatgtatgtatgtgtatgtatgtatgtatgtatgtatgtatgtatatgtatgtatgtgtatatatatatatatattatatatatatgtatatatatatatatatatatatgtatatatatatatgtatatatatatatatatatgtatatatatatatatgtatatatgtatatacacctcatattgtatgatacgaagtttatacgtacatatttaagacatatatacatacctatacatactgagactagagggctagcgctggtcgcacgggcgtgccgggcgatcagccatcccccatcgtatacctgggcagtgctgttaatgtccgcgaattaaattcgactcatatacgaggaacctaatatgaactttattttcctgttgcgagtgtatcccagcccatgtaagacgcccgtagcccatatcctatctcaaagcagtcagcgcaggcccgcatgctatcgcgacgtgcgtcctcaatccccttcgccttcccgtctgatgccacaaatcaaagccctcatcctcttcagttcaccgtgaacaccatctatggtggaccgtgcacggcctggccgattcctctccaggagtgaaaccgtcgcaatcaaagtgcagccaacaagtgtccgtgtttaattcttttcacttaacgtatgcttttattcttcaatccctgtatatcatcgttgacccttatacttttatcaagtgtacggacttactccctccgttctataataattgacgttttggacaaagttacggtgaaatttttataactttagccatcaataactttaaaaatatttagtttagagaaactaaaacaacatatatagatttgtttttcaaagcaccataataataaaagtaaacatgcatttatttattgtatatattataatagaaaaataaggttaaaggtatattttgtagaccgtgttattattcaaaacatcaattaaaatgaaactggagggagtacctgggttagcagctatcagcctatcatgccctcaccaatttagcacgacctagctccctccgttcttaaaaaaaaatctagtactccagattcatagtattagaatatatcacatccagtactagattatttttttatgaaacagaaggagtatgcccccaagaacaggcacttgcacttctgatactcatgtaggatgtagcttatgacatatactttgttggtactttgtccccagtatacttacatgatcttttttaatgattaattgatcatttcctacaaccagctctcatgtatattactatcctatctaactgactatatacacaatgcagtgttgggcaccaaagcaatatctggccatgacaccggttcacagccgtctgtcactggccctgtttgatttagcttaggattattataatctggattattaggagtaagctgaaataaacaagtagattattacgatagattattataatctataagccagattactataatctaataatctcctatggatgagctttttccagattattaggtggctaaagaccca

SEQ ID NO: 42362 - DNA, 7420 bp, Oryza sativa
gccctaagtagcttctaactctatagtagattattaatctattagtttcttttcactttcatcatatacgcgacatcaaccatttcatcactaacttatgctccgagagccacctacaacttatagcccataacttttactcaaatactccattcatagcagttcaatctagaagagtagcccgactatcattcctagaggattgtgcgatagtgtaggggaatactgagaagagggtggaataatttaacccataagggcccctttgaatcgtaggaataaaaaaacggaggaatagaaaaaacatagaattctgacaggaatgtaagtgtaaaacagaggattgcaaaacacaggaaaacgcagcaatgaatgtttgattgggccacagaaaaaacgtagaaatcggatgagagagatatactcaaaggatttttactacaaggttgaacctcttgctaagtttcctccaaaaactatatacaataagccattccataggaattttgtaggaattagaaaacttcaatcttttgaatcaaagggctacatagaaaaatttcctatagaattttaatcctataaaatttcctttgattcaaaggggccctaaaagtgtggaactgctttagccaggttcaaactagaaagcatggaatacttcttctttttttcttttttgaaaatccaagtttaaaaccaaacaaacttctcagaggataaatggggtcctctcttatcgtgaattcatatattccttatggtgaatggggctatctcccgagcgtgggttgaggttcgtcatcactcatcaatgaaaaaatggaacacttaacagcattttttttactcgttttagttaacatatctttgtacttgtgcttattgtctgatttatgttaatgcatcttcttaatatgtctttgagcagctttgttttcgtgccgtttcgaaaggattttcataatagtagagagctttcagatagtgattgacgttgatataaatttatcaacaatacgcacaacaaaaagtacattctaagtgaaattttgattggttgttgggaattcaaatttaaaacaggccagttcaactaaaatttgattgaaattcagaaaaaagaaatcataccattgagactcgagattcgacacttaatcagaaaggtgaacctgagagtaaatatggttcactgacaagtgaaaacacgcccaatatataaactaaaaccattggacaggttgagagggttttacaaaagggatcattttgcccatcgaaaaccgccccaacctgctcagaaaaaaccacaccccatatgttttgtcaataaaattgacaaccgatcaccgatgaaaaccaccgaaactcaaataaaatttgtcaaaatttctagtttaacttcttcctaattctgaacaagaacaagatcgataagactgataaccactcaatcgttgcatgttgaaagtcgagtcaactatataaatccaagtatccaactctctccacggataataaacccagttgtccatcaacatgactggataatgacgagccaacatgtataggttttgtttggaagagctcgaaattccaagaagtagcttggatcgtcccgtgcatacctctgctctctgacgacctagactggtgaatgaaacatccatgtaaacacattttgatgtgccgatcagagttgcatagatcaacatcaacatggaaaatacgttcttatatcctgtggcatggtagggataaaccaaagtacgatctgggactgatctaatccaatcaaattcatgatgaccttgtgaacatctcttgattgatcaactctgtttctctgaagtttcgaagtttccatatgatcgacgcaattaaagatagaattgtatcgagaacgaagcacaaacaaatctacagttaaaaaagatcaaaagggacatgcatatgttttaagcctaatgactctctctctctcatcgctaatgacgaagatcaactcagagccacagggctcctgcctgcttcaagaccggcacgagctcgccggccatgtgcatggccatgagccgatcgagcccgcccaccagcctcccgccgatgaacaccgccgggaatgccaccgccgctccgccgcctccgtcgcccgccgcagccttgtcgccgccgtccttgcgccggcgggcctgcagcgcggcgtcgacgagcgccgccgggtcggcgtcgtcgccgacctcgagcaccgccgggttcgcgccctgccccagcagcaggcgccgcgcgacgtgcgccatgcagcacccgcgccgccccaccaccacaaccggcttctcctccaccgccctccgcacctccctctcctcgtcggccgccgccgccgccatcgccgccgccgaccttgctccttgcatttgggagcgaggaggggatcgatcgcgcgcgcgcggggcggcgagtgatcagggcggtggtctacttgtcgaggtgtgaacgcgtcgtggaccgaagcgaccgctcagatatggagccacggatggttaacttggttaggtcagcctccttgtcttggtatgcaccaatgcacataaaacatggaaatcatttgtttactccttaatttctgctcgatctgcttcattggaaattttttttggaatatatgctattatctggaaatccggccattaaacgttgaaaacacggaaagtcattaaagaaaaagatatcacgttgtgagaatgatttgctagattgatggacattatcacacaggttttgtatttgggttgaatatgtatgcattttctttcttttttttaaaaaaaaaagaatgtgagattcaattgtacaagtcgatactacgatggtcaggtgctacttggttcaaaaacaaatggaattgcctagttgtactacatatgcaaggtcagcaaaactgttgccaccgagcaccagggtgttagcaatcgtcactgccatcatcatcagttgaaaactcctcgtcgtctactcgtcttcgctcggcttgcctcggtgatatccatgtacagtatgtgtggtgtgtgtcacatgtgcgtaattatgtactactagtccattcgtttcgtcatcagtgatgcgttccgatccatctcgtacttaatgacgaacatgtcgtcttgactccactagacccaaagtacagatcagcaggaccacgtagatcaatacgtagactctacttccaaacctgagtacataattagtactttttttctctctcaaacccataccggccagttcaagctatggtacaataaacgcatgtaaaatgtttggcaagtcaatctttttttttccgagtttgggtcgtggcaactaatgagcaattacacatttccttgcatagctagaagttgatttttttttaatagagggagtagctagtttggtagcgaagtcgttcttaaatttcgttccctcccaacgtgcgcataacaacatcttcaatagcattttcaaatcagactctccaaacactcatatagctaactccccatctgatttagctagtcaaactagatactcactccaacagatcaatgctctccaaaataacaacggacccacatgtcagcctctactcttcttcctctctctcccattcttccttatgtttccttcttttcccctttccttccttcccgtcgatcacattgttgccgacgacggccgacgcatggcgcatggtggtgcagcgacgcgggaggtggaaggcagaaggcggcgcggggaagtgggaggcggcgctgggaggcggacggcggttcaccaacgccgacgctgccgaggtggtccccctctccccgccgaccactccccgcagctgagcgccgttgagctcccctcgggttgccagatctagaggccgccgccgcgaggtgttttggctggccaaatctagctagccagcgagcgagtttggccatccggttggtcagtctgttggatctcttttttgtgcttgaatggccaaaatttggctggagagactgttggagatgccctaaggtcgtctggtccttggcatgtgatgtgcactagggtttccgatctttcaaaaggttctgataaacaacgatttgggcggagtcgtaacaaaaatcgatccagcttcttgaatgcgcacgctcttgagcctcgcaatcgtagcaccacgtctcctctggttatcacccgtgtcgaaacgcggatgacctcgctgagaaggctaatccctgtttgccaatcgaagaacacaaacaagaacgagatagaaaacaaccaaaattgcagatgaatgattaagctcacgagttggggtcttacaaaccgatctagcgacgaaactgttctcgacagaataatctaagcaaaacccaaaaacctaaagatggcggcgggtactgatatatagagtttagggtcgtgcaatcccctctcgacgcaaccctaatgggttccaacacgatacacgggccaaaggcccaaatacggtgacgcagcaccaggacagattctggacgtcaacttgttcggtcaattcccattgacccggagagaatttggacgtgggaccaaaaccattggaaaggttatcttcttagctttccatccatataaagaacgccccaatccgagcatgtatgcgacctgagcgtccgttttagtgcagactagtcctggactccgaattgcactcgacgtcgacttggtttgggcctccaccttgacttagacgtccttgatgatcctccatggctctaagtccttctccaagtgtcttcttgtctcctccattatttctaagcacaatataatcattaggtaacaatctattctcgaattcatacaaagaagaacataggagcgagctcgtctctaaattcaattgtcgcgcacgagctcttgttatcggttcttgaatgaccgttggaggattgttgtgtgtattcgaggtaatgatgtccgcagcagcatgtgacagccaatgcaaaatacagtgctttattctcgattcatctcttcagtcaatctctaattatacgagactgaataaatgtgttggtcgtgcaaaagcggccaagagcagggtggtgtagttcgcctattgcgcgttccgcggggtgtacacgtctcaatagggatggagctatcgtccggctagcccagacaatcgccccggctcaccggtgaaaattccattaaatattactaatacttttgaataaactgatcaggaaatttctatagcaaatgtagctatagtgaaatttgccccgtttcaaaagtttttctaactccgccacaggtctcagtcaatgtgcgcgtctgtggcaaactggcaatgtggcatgcatgcagctggaggacgacgacgatgacgaggaagcgcgcgtgatgcgcggcgcgccgcacgtcgtcagggcccggatgatcgatgcagcgtgatgcagagtgcagggtgcgcgccgacgatggcgagcgctcacctacctagctaccgtgtgtttcgtacgcatatgtggctacctacgtacgtcgtcgtcggtcgctggcgtacggtgtgtgcgtgtgtgcatctcgcatgtggcgcgtaggctggcgtcgggtctttatctgtacacataggcgcggcgctggcgaagaatgaagcggccatcgatggggatcgatcgatcgagctgtaggctggagcctgcaggatgcatacatgcgtgcagtgcacacatggggagcgacttgcggacggtcggcatcgatggttaagaggcagcatgcaagcgaaggaccgaattaaggggccccgtatggaaattttgttgctttggttggatttgatcatctgctctgttttaatttgccggacagaatgtgctgttaattcttggatccccacctggactcctggagaaaaggagtccggtccaacaattcggccctgtcgtcgttgctggcgaattttcagtgaagctcatgagctgatgtacgttggggtgtgggtgatggtgttgtcattcagtatttcagtgtgcccgttggttttgcgtacgcctacatatacattggttttggcttgtttgcctccatcgtttttctctcaacttttgttattgctggtccaataaaaccagtatctctatacagagtgccatgttagaacgtagaaaagggttctccaaaaatttctcaggacagtacatataaattataagaaaaaataattcaaccagggtcccgtagctcagttggttagagcgttggtcttatgagccgaaggtcgcgggttcgagccccgccgggaccaatttttgctgaaaataaatgcaaatcataatattgttaaatacattttttttgctgaaaataaatgcaaatcataaacatctgtatgaagttttttttattatttaatgcaaattaaaataagtttttgctgaaaacgattgcaaatcacaaacatctgtataaagtaacttctaaaagtatttaatgcaaattgcgaccaaattttgctgaaaatgaaaacaaaccataaacatctcgggtgtagctgcttgcctcttcggcgaactatggcagcgaggtcgaggaaagaatattgttaaatgcaatttttgctgaaaataaatgcaaatcataatattgttaaatgcatttttttgctgaaaataaatgcaaatcataaacatctgtatgaagttttttttattatttaatgcaaattagaataagtttttgctgaaaacgattgcaaatcacaaacatctgtataaagtaacttctaaaagtatttaatgcaaattgcgaccaaattttgctgaaaatgaaaacaaaccataaacatctcgggtgcagccgcttgtcttatcggcgaactatggcagcgaggtcgaggaaaggcggcggcacatgtagggaggggagcaccgtcatcggacgcctctctgccctggttgctattgccaggatggaagccaccggcttcaagggctaaattgacacagcggtagtgcagtggaggaagggagaaagaggtcgcggtgaaaagggaggatagaggactactaacggtaaaatttggcatattctattgagtaaggagaaagcgcagagcggtattgatggcgtgattttgggatccaaagttagaagattgcatcagctaaagcgtatcggcggcagagttatgaaagttgccgataggacatggacgataaccaggaatcgaccccttgtcggactcggtatgggaagatttggtgacgttaccaaggggaggtcgagttctcgataaggatacaacatcttaacttatttattaaatagattgagttagttatttccttttatgttttaggaaagtttgttttatagttcgattgggcttgta

SEQ ID NO: 42363 - DNA, 2402 bp, Oryza sativa
  unsure (1)..(2402): unsure at all n locations
ttctatcacagcttggtgctgcatcagttagttttgacctactaagttgtacttgaaattgtaagaactaatttgctctttgattgtcgatagggtcaccggggtttcattcggtcttacctgatataactattctgatttactgtctttgcttaatatattatatctatcatcttatctaagactatcaaacattcaaatctattaagcttgtaattggtcccgcaacatatcagttaagtccgatatgttgggattaagacttgtttagtatatttaactggaaacatgatatctgttgtatcagagttctagctgatatgttatctctaagaacctaagttacttcatcagctatgatataaattcatatattaatttatttcctcttgagtacaagcaactaatattgtctcggttaggtccgatctatctcgattgctcgtatttaaggcaaagatcgaattagtaattgcatgataattacctctaccgccgattgcaagtaatttaggtctaatccacaaacatatgttcatcgactagttatttcagttataaaattattctatgattgactttaactttattaattttatgctatataaattgtgtttgacatatattattgatttttctaagaaaaagttatttataattatatgtaatctagatctagcttatgaacaagtatccttcatatttatagccaattcatttgtacaatagtttacgcgatacaacatcggcctatcggctgattggctatcatttactaatttttgctattgtctatcttattaattgcaggatcacaccaaccggcacgcctttaaaccagtagttttagacctgcattaaagttaagcaattttttcagagcatcgtgttttgcatcaatgaggacacggaacgtgcaaggacacgtgagcttagagcggtgccagcgacaatgctccagttccattcatgtcttcttgggctatggcggcagaaacgagggagctcagcagcattgggcgccgccgatcccattctactggactgctgccactgccgggcatgaccatccctgtgctccttctgaacggttgaagctcgagcattgttgtcagctaaatatttcctaactaccctacctaagcattgttgccacgtcatcaaataccgtctacaatactgttatagaagtcaatctgtaccggttttaataatttgagtcttccatcccgattttatggttacattttaagggagttaaagtggacttttttctaaataaaaatacacaccaattgcctattgggcctgtccctagaatgggctcagtgggctcgctgcgagcagttacaaaacgggagaaaaattggcgagcacggcgcctccgcttcatccttttccacctctcggccggcgtcgccaaggtttgctgcgactgcgaggcaccccggagccacaaatcctcnccgccttcgcgcgagctcgccggggggagagatgctgctggacgagcccctcgacttcgagaaggaggatccgctcctccctaaggcgcgccccgccaagaggtggcaatccgtccccattctactccgctttctttttttttgggtgccgattgatttgagggttggagtggatgtcaggttttgagttccatttttgggcaattatatttctggcgcgtatggtcgggtctcgagtaatcggggtgggtgtgatttcgctggttgcgggggttcccttcttctgatttttctagggttttaggggataaagtgaaactgcaatgtcgttgctttggctggtttatgtttggtagtaggattgaagtagtagcagtagcactcagtcgatgaatccgtggtgtttgcagaagattcgtttgatgagtggtcactggttagctgacaagatgtgtagtgatgatatatattgttagttaccattggaatcgtttgccctcaaggtgtgtaaatgtgttaataacagtttggtgtaggtagtacgaccattttagagacatatttaatttaccactgcccattttcttttcaggaagaaggttattgggttggacgatcttttagaggatttctttgcaagtggtaaggatgaccttaaagcttatggtattgagtccaagcatggatccaaaggatataattcagatgatgaagacaagaaagtgaagagaaggagattaagtttcgcaaatttgttgaggagtatgaggagcaggtagttttcaaacaaacatctgttcataaaacttttacattttctatgtatattcctgtctctaagatattattgaatttacagtcgaaagagttggatgctggtgatgatgtgccccaatggggtcagagagtttttggttgccaggttaaatggcccta

SEQ ID NO: 42364 - DNA, 14859 bp, Oryza sativa
  unsure (1)..(14859): unsure at all n locations
ctttccaagctactctgttctaaagagtgccatactcaactatggatatatatttgataattgcactgaagtttccacctctgaaagtgtgattgcaggttggttccatccaaattgttcttcctttatttacagtttactcaatttttaattcactaattttcagcctcgtgattatgagcattcatgaaaattcatgtttatttcgttatttctgacttagtacccagtagtttggacattctgaaaattaagcttttcctatttaatatttgatacttcagatgatggcccacctcaaaacatcattgaatggttaaaaattacatctgcttgctgcaaaatcaggtaagtggaagcttctgaagctattatacagagattacattgccttaggtgtttctacttttctgtcattcacaaagtctaaaacaaaagacactattacacactaacaatttaacatcaactgatctctgtaacttcatatttgcttgttagtttcaacacagttattttgtgttgtaatctctcaagttttgggtaaaacaaaataatcagtataaatttgtgtgttattgcttatatagatgatagctcatagttatattatattaggactggatgtttctagctctgtctgtaatactgatgttatcccagtatgatgcaaaattctgcccaaatctgcggtcactatattttgcgatgataacattctagaattgttctactgctacttaagggacattttagtttcatgattctgtcctgttctgatgttcaggcttccagtgtggctttgttgttccactatttgtgatagcgatgtctttttgtatggtgaatgtaaatctctgtattcatttaatccttctaaaacaataaatattatgatattaaccagtgtttcagtaattctgctattctttttgtaccaagttaattctatttgaatatttatttgatttacagaaatgtgcattccatattctcatcttccgaggcagaagaactccttgttattgttatttccttatttttggaccgacaacttgagggcctgctgcttattttgggagactgtctgagttcacttatcttgtacttcaattcaagtgaatgggaaagtagctgtctaatagtggctcagtccatttcccagaggtaaattttttcaaaacgtcttatttttaagacgagatctgtattggtgatttgtaaccatttaccatttcatggtatactgatgcccaattgaacaagtgctcgagtaatttatgggtgaatacattagttagatattgactaggatgcaataatgctttctcaacaagatatgtcggcgatgaaccttgttatgccgtttgctctacgttgaggactttagcttctgtacaattctattccatctcttgcaatgtttcgtgtacagtaactcatggtattttgttaaagaatagctcacatggcttttgcttacgatatttgcccatctgaaatcaacttcataacattgcagagtcacaatggacctgaattgtttaaggattgttgactgtatcactgggactgattaccgtagcaaattcttaaggagccagctggccctacaattcctcaaagttagctttggccttaaggtaagcatgattgatgagcatgtctcttcaatataccttttggtatggttgtgctagcccataaatttttgtgtgttctgcgtattcaggtggcaaatgttgagaagatcttgaagtcagtcatgtccataaatgtgaaggataaagattgcaactttttcagtctgtacgtatacctagttttgatggataacttactcttctcaagtgatgcctttagagataagcatgcgatcattaattcttggcgtaattatctgcggaattgttcaacccaaataggatgcacagactggagattatatgcctcaaaggtactaaaacattgcattctttcagttggtttttacccatttctccatcttggttataccggaccattttgtttcatccaggttcggaacaaggcttcttatcttctgcaaggtgcggtcttgagaagatctgctggcggtgctagcttacccgttcagtaatttgaacttactgaactggatcaaatggtgctgttgacagtatctatatttaaactactagcaccaaaaactgcatggcagggcaaactttcaggttcttatatttgctttaggaattgtaggccatcttttgtagacaggggcaaaatgctggcagcttgtttatggtatcatggctgacagcacatttggcccatgtatagcttgttccagtatgtggaacctttcaagattttgagacacttgtagctgattagtgattaccccttaccgtcggttttgggatttgccatccggtatggagtgcacgtgcagcttcatcagatagagtctcctcgactgatcgctggaattggtcagattttgcgtgaagcgtggaattcatcaaatgtttaccactcatatttatgaaatattgtcagcattcaatgaatctgtgttaaacaggtcatactaactaatctttaaacgagtctattacaacgtccttgtttggctgaaccgatcttaattgtcagtttctcccgttcaattaaatggctcgtatctcgatgagtccatgttacgttctgctgctgcagctggtgcttaacatggcacaaaaatacggcgagtcggccgcaatcggtgccgattcgagtttgcttgatcatattcatatctgacatctgatgatgcgtactgtatgctgtttgtcattggatctctcgtgttatcggcgccgaactgtccagattccaaacattgtttttggacttgcctgctggtagccagaaaccggcacatggggattggccggacaaccagaggtatgcgtcgccttgctctcctgctatgctagtatcagccaaaaactcctgaacaatggttaggaatagcaacattttcacttgaatcgttgcgtttcctgatccaaggccccagaattttgctatattggcagtaacatggatataaaattccctttttggtcaagattgccttgctctcctgctatgatatcagccaaaaactcctgaccagtggttagtaacagcaatattttcattatgttgcctgatccaaggcctcagaattttgctatattggcagtaacattgatataaaattatcttttttttgtcgagattatatactactcacgttggctcccttggaacctctgaattctgcaacaatttcgtaggaaatgaaacatccacccttactagttactaggatagttacaagcagtggtgttccaaacaaaatttgtgcgagaattcatgagttccaaatggagcctctcagcattatagattgtaaatcctttcatttgggtattaacaaaaagaatagggcggttgccgccatattattcatagatcaaccaaaggaggatatataaagaaaaacaaaaggtgggaagagcactgaacatctacctagatggagtatcaccctcttggattggaatggaatttgcaggcgaaagtaacaaaactcaactactgaaatggtagtagtatcatcgagttggtgcttctggtttccgcggtaaaaaaaaaaaaaactcgtgtgatcgtgtgtctggtccggtcgacgccatgtatcgatccgattttaacactcttgtcggacgttgcacgccacggcctgcgcccacatccgaagctggtccttcatctccgccgccgacctcgcgtccgcctgctgcagcctcatcgccgccgccgccggtgatcggggcgccggccgccgcacgtggtaccatgcctccgacaggtacggccgccgcacggcggcgacggcgtcgctgccggtggcggttgtggctgtgtttgcgtcgtcgttgtcgctggcggagccggagccggtgggggtgggcttgccgcggaggccagggaggacgtcggcgaggctctcgcggagctcctcctggtcgaacacgaagcccaggtccctgaacccctgcacctcgatcgactccaggtcgctcgagctcttccacttcttgtcgtggaacaggctctggtgccggacgagcggctgctggttcgcgctgaacgaccgcagctctcgccgcggtggctgcctccgatggccgccgtcgccgccgcccgacgttctcggcgtccggtcagcctgcaaggatcaatgggttaaactcgatcaatcatcatccatggcggtcaatggcgtttgggggtgggcggtgcgtaccttggtggtgggcgtgtgcgagcggcagtgtctctccagcgtgctgtgggcgtgcctgagcctggacatgcccggcgtcgtggacccggtggcggccgccgccgtatcctcgcggcgggcgtcgtcgtcgcgccccgtcgcggacgacgtgacgggcatcgacggcgcgcgccgcagcgccgacctgacaccttcctcggcgatcctggtgcggagcacgccctcgtatatcgagctccagttcaggtcgtcgtcctccgcgtcggcttcctgatcgccaccaccgcccgccgccgccggggcctcctcgacgacctcctcgtcctccttggcgatctccatcccgacgcgcggcgacgggagcgacggcgtccggaggagcctccgccccgcggacgcgaacagcctcgacgtccccaccgcctccacacctttccccggccgcccaccaccaccactcaccgtcgacggcgacctgggcagcatcggcggcctacccccgccgccgccgccgccgccatgcctcccgttcttccccagcgtgttgctaaagaaccagtactcatccagcagctccaacgccggcgccgtcccctcgccgccgccgccgccatgccccgtcaagctcatgcccgcctgctgcgtggctgcccggcgactccggattggcctcaaagccggggtgggtggtggggtggcgtggcgtggcgtggcgcggcgcgacgctgagctgatcgagagcgatgcgaggacgccgctttcttgtccgttttcactcgctcgagtggctccggttttgttgcgaggcgaggcgacggggtggggcccgcttgcggcggtgggccagccacatgcatatgccagatgacaatgcatcattcatcgcatcgctcattattgattggatcagtaattgataagcttgatatatgtacaaccactgctatctccctttcatattatacgtgattttgattttttttctagtaaaactcctttaaatttgattaatttgtaaatgatatagcaatattttttatacaaaacaaatatattatcgaaatatattcagcgttatatttaatgaaactaaattgatatagtagatgctactaaattttttttataaatttgatcaaacctaaaggattttgattagaaaaaaatcgaaacaacatactaatataaagtggagggagtggctaacaatagcctaatactaccaataatttcatttcgttttcttccggttagttccatctctcgtgcagtagtaccacagccagatgacgtgacacatatgatagttgctaattgatttgttgaaagttttgaatgctggttacttcggcgagaagaaccgaatccggtatagcaacggggaattcagtgaaacgtacagatgcagggaatatatgtttctcgagatgtgtcatttagggtgccatttgtttacggttcaggctgcgaccaaatacatcgcaatcgagaatcgaccacgctcgccatcacgtacgggttaatcaccacgtcattggttagcatctctagagaagtcgccgtctaccatgatcactcgtgataaacatgtacacacatgtgtcacgaaacctagcgatcgcaacacggtgcgagcgctatcgaataatcgatcgatcccatattcccaccacgtacaacgtcacctattacgaactccctcatcccaaaatataatactccctccgtcctaagatatactttctccgtttcacaatgtaagtcattctagcatttcatatattcatattgatattaatgaatgtagacagtcattaacatcactatgaatgtgagaaatgctaaaatgacttatattgtgaaacggagggagtaacaactttcaaccctcagaaaatataactacttctccatcagcattatttttccaaccaatcacaaccctccactagttacttttcccacctacctccactgatcatccaatcacaactcctaatataagggattttgatatttagtgcaagcaactcctaatataagggattttgatattttgcttgcactgtttgaccactcgtcttattaaaaaaattatgcaaatataaaaaacgaaaagttgtgcttaaagtactttgggtaataaataataaagtaagtcacaaataaaataaataataattttaaaattttttgaataaaacgaatgatcaaacagtgcaagcaaaatgtcaaaatctcttacattagagaacggatggagtacctactttcttaatatcgtgtctaactctaaaacttataatattctgggacggatggagtaataatttaaaatcagatgagacatatctggactcctgtgcagatacattgtacagaaaatatatctcgtttgattctatattattatgttttgggacgaaggtagtattacgtacgttggaagttgagaaaaaaaagatgggataaaagaaacacggccgtatcaagtcgatcatttgctagctatacaagctagctcatctcgcatcacccaagcagttgattaatccggtcgcaatcatgcttagcgtcggttgggtgtgctgattaggctcgcctggtttggttggctggctagccagccgatgctgtgttggtcaatttaattttattggcttcttttttttttcttttagtagctgatcaattggacgacgagatgtgtgtgtacatgagctgcaaaatgaaaaacttgagctgagctgagctcgtggaagttatgacttagcgcgagaaacggcatgtgggggagagctggctctccatgtgcggtgggccccatgggaaaactcggggcgtttccagtgatcgatcgattgattgattggtttgtgctgccgttgccgaagccgtttggatggatcggtggccgtcaaaagggggggccatatgcccacgggttggtgggatctgacggcggggatatccgcgggcgaaagctggtactgagatccagtcgtccagagatttgtggacagggtagatgacacaacaagctagtcgtaggtcatccacgcacgtaggtacagtagtaggggtagtagggttcatgctccacattgggtgatttggttaattacctttttagggcactaaaactttgcacccatactccaacaaaggagtttaggcctctttagattagaggattttcatggaaatttcggagaatagtactactaaggattactccctccttcccaaattaattatcatgtaatgaaatttaaaatttctcaaattgatcatcatataactatatggacacggatttcatcggaatacaatcaatgcagaatgggagaatatgtgtgcatgctaggggtataattgacacggtgttctaatcgatacatgtattatgggagaacgtgtacatggtgtcttgattgatgtgatttaaattatcattggtcttggtacataaacatatatgatgatcaatttgagatggagggagtataattctatatggttatttgggtttaaggaaaaggcttaaggaaaataagagagctcatgtttttgtttcctttgctaagtccaatgcagctctccctttctctctctacttcctctctcttctacaagtgattcctataaaattcatgtgatctatttcctgtgaaccatccaaaggcactagctcaaatattatgtgttttaagatccatcaatattcaaaagagcatgacaattcattactacgtttttcttattatatttttttagtatcttgcatttcaaaggaggccttaaagaggtatgataagaaaattatcgaagaattcattgtcactcgataaagagaaaacaattgatcaaaattttgactagaatgtgcgcaaaggttctactccaacatcaccagatgaggcgtgaaattcgagttgaaagcatgaagtcgccaagtgataaaaaagtttatgttccaaatctatcaaccgtagctatatttgattgaagttatacataattgtttcaagattttgaattggtgaaggaggttgtaggttctattgtacaatgaatattcttgatacgataaggattagaaacgggaggtccatactataaaaggaggtaggataatatagtgaaatggtaatggtgccagatagccgggggtagcaagaacaactgcaggtagccaatatttgtgcacggctagttcttatgggtgggtggagaaggtagagccaaaagcatagcaagcatagacagtcctagagtgtttgatgccacaagtataaacaagacagagtggatataccgatgggtatttatctagctgaaaaggactcgaagatgcgagaggtgtaaaggtttcaattgggtctatgggctatggaatcttataaaaaattgggtgtatagtaagtttccatctttatattaattgtatcggtctagtttatacttcatataactataaattttcttgttaacgtattctattgtagatatattggacaaaaacaaagctttaggtataacgcgtgaactgttcgcaaaacaacatcattaaatcatgctcaaaccgaactatgacaattcgaaccatagaataaaacatacatgtatctgaaataatataaaactaagaccaatatactaatgcgaaagagaggtaaagtgggggagaaaacatggatattatgttggttttaatatcaactcttagcccaagataaaaagaaatgttgctgcctgaggctggccggtgaactaattaacgagatgaagagcttttaataatctacagtctcacctgttgactgttgtaagggataatctatcgatgacgtgtactgctttagctgtaataacaagctcaattattatacttgtcctaaatacatactcccccgcttcataatataagtcattcgaatatttcccacatttatatggatgttagtgaataataactaaatatctcgtaaaaaatataatatgtagacgtttagctccgatgagcaaaagatcgaagacagtagccactggcgagtatggccctgcaccttggaccttggaacaaaagagttgcacgcgtacttgttgttccggatcatcctgggccgacgcgccaccaagcgctcagttttggagtggaatcaacggaaactaatcaatcctaaggttggcgccacacccacatgcatcggtcgcgctcctgccagtccggacccgtgtcccagccgcgtcggcccgggcgcgcggcacacacgtacgcgggcttcgtacgaggcatccagccctctagctcaatcggcgcagtcctccacccaaagtcctaaggaaacccatcggtcgccgtctcgccgagagcccaccaagacgtacggtctcggtgcggtctcagaaggcaggcacacggtgctatcgttgagtcgttgccacacgcgcgcttgcgctcggtccccgtgcggcgcgcgccagtagctgtgtagcacgcgatcgcaggcggggctccctccgcgcgggtgatgtgctcgcgtttgcatggccttgctggcttgctgcgcccagtatacgtgcactaatcggtcggccgagctggtttcttgggttctttacaaatgttggggagcgctatagctttccacgaaatctttagctccccaaataatttggattgtcacatatattctgggaatacagttgtagaattcaaaaagaatgaactagaaatcagaaactgaaaatcttaacttctccaaattctacgagctgacattttaccgtgatcgaccgatcaatagtttacacaacagtgcgtgtttgtctcgttgaaaaggacaaggaaggatggatgttcccttcttctgaaacacaatatatatgaacataaatatgtacactttaccgttacaagcacatttaaagactgtaccgacgtaaatagattaataaaatcatcgtatatgtcgatatgttaacggatatatcgcctacaaagaaaataattaactgtaaatatgaacacatatgtcatacctagaatttgatcttgaataatcagattccaccacaatgaatctaactagttaaattacgctattaggatccccgtacctatattgttttcatctaatttatgtcctctatatgtgtaaccgaactatatttatattttggtatagttgttttattgcatagatatttgttaacatgtgttggacaacataaattaactttaccaactgatattcttacttttatgaaaaaaatatatgtggcgttatttgtaaaaccgatcgaggtactagtactgattaaggtaccccagttcccctccaggcctggaaaaaaagggttgtgctaaaaaaaaactgttgacagttttttgttgggaaaactttcgattttctagccattagatgcgctctaggattcgtgcaacatataaagccagaataaaaaaaaatcgcatgggcaaggcagtcatcgaacatgttaagctaagccatgcaacttcttattagcaataactcttttttattttatatcacttacaccctagttatatatcacttacatcttaattatagagtagttacataacacttataccctaattacagagtaattacatgatagttatagggtagttacattgtataaaattatgatttgcaatttttttaggagcacatattacttttgaatttgaaaattttttcccttctacatgtaagccaatttcttgttgttcaatcagcttggacactaaaatttatggtttgtactagtgtggattgtccccctataaccattgatgacaaatcctgtagtcaaaaaagttttggacctcaaaaattgtcgacaactccctggctagtcccggaaaaaaaaaatccttcagcagttcagttcagctctaaatcatttactattcagaacgaacaacagcagcaaaatttgaacccgtagtcccgtacgtagcataaaaccgtaagtaacgtgcgtatgtttagcgtgcgctaagcgaaagaccaaagtacagtatagccctgtagccgaaactatagtcctgcgcctcggtacacgatacgatgcccacagagaattccgtatcaatctggggctggcacgcaacacgcgtccaattttcacccacgcgaggagtggtggtgtgggcgcgcgcgggcgcgcggtgcatcgatcggtcgcgcgctcctgcatgccggccgacccgtttcgcggcctccccgcgcgcgacgttaactcggcacaccgcgcacacgcacacgcacacgcagacgtatgggtttctaacaagttacgacgatcgtagtcgtactcgtacacccaacacccagtctcggcgcaccgacgcgatcgagctaccgcgcgcgcgcgcgcgcggagaggagcggagagggggcgcagagtgctcgctcgctctcgctgccgcgcagacgcgtttgctcccgtgcggcgcgagcccgtagcagcacgcaatgcgcggctcgaatgcacgacccgtgctcgcgcgccgttgctgctgctgctggccttgccgcgccaagtacgtgtgcactgctcgattacggacggtttcctggattttttttcgttttatacggtacggagatggatagcaaaaagactccacacatgcacacgtcggctgctgtctgctgatagtctgacacatctactgaatcagcagtcagtcactacgaccatctccaattacacacagctgagtacgggcgcagcgcaaacttgtacttgttggaataatcacaagctgtttctatctggatcaaatctgatgatcaaatccaatccaggcggtcctcgaatttcctcccttgtttgcaccgtcgacgcgttcccgctggtttccgtttgttgatcaagatgcaccaagtattattcagtacagcgacagtccaagattaaaacaatgcacagaccttgttttcctcacccgaccgtctgcaagtttgcttccaagaccagccaattatccgtgcaagtacacgcttatgagaaaatggacattttaccatcttcaaaactaggtttcgctattatgccatcttcaaaacgtgattcgataaaatgccaatctcaagcctacgctactcgttggattgtcattttctcattttcttttatttccggaatcttttgcctcttcctcatggtgatcggacgaaaatgcccctggggccattggtggaggtcaagttggagggaattttcgtcaagttagatggaaggccaccggggctgctcccggaggcgcagttcgcggcgttcgtgcgacggcactggcgggagtactctggaccagaggagtacgcgtggcggctgcgcgtgttcgccgccaacctcacccgcaccgcggcacaccaagtgctcgacccgactgcgcgccacagcatcaccccttctccgacctcatccgggaagagttcgaggcgcggttcacgggcctcgctgccaacggcgacgacgaggcggccgatgccggccacggaggaggtggccgtcctccctgctagcttcgatttggcgcgacaggggcgccgtgaccgacgtcaagatgcagggcacatgcgcctcctgctgggcctttagcaccaccggcgccgtcgagggcgacaacttcctcgccagcggcaacctccgcaacctcctcaacctcagcgagcagcagctcgtcaactgcgaccacacggtacatcacattcacatcacactcacgccactcctaatctcatctttgaactaatcgagctattgcttgccgtcctcatctttgaactaatcgagctattgcaatgcagagaagaagacggagtgcggctgcggcggcgggctgatgacaaacgcctacgcctacctaatgagctcgggaaggttgatggagcattttccaatggccataggggcatttttgtctgatcaccacgagaaagaggcaaaaagtttttgaaaataagaaaaaaatgagaaaatggcaatccagcgagtagcgtaggcttgaggttggcattttatcgaatcacgttttgaagatggcattgtagcgaaacctggttttgaagatggccaaatgtctattttctcagcttattatatatagatgatgtgtttgttcccggcaacgagacctgcaaggaggagaaaaaagaaggcgccgtagtcaaattattccatagaaacagaaacgatatactctccctctgttcagttttgacagagtttgctcatgctatttttttcatgcctaaatgtagcttacagtgctgtccatttcgctcttcattttttttaacccttttaattggtaagcagtcaagcatcagtaataatgaagcatatatacacaatgaagggagtagaatggtgaatgattaattgtttaacactcaccaacttatcatcttcgtcccatatttttattacttctaaaaaacaaaaaaaaaacagaatgttaaatacagtatctcttttcaccgccaaaataaaaaaagtcagaatattcttatcttttttttttcaaaagagcagaatctttttatcatccggctactcctgaggcatggacaatatgacagtttgcccaatattagttggatacttaaatgtcagatgccgcccctacaaataccacaataggatccttaatcccgtggcatcagtttgctcaaacgagtggtttaaccacaaaaggtgaacatatttagcatggaagaaaatcatgttgagagttgagacccatccgctctatctgcccacactggctagtctgaacttaaaaccatactaccaaatgaaaagatagagactggaactcataacatctttataccatggatttcaatgacatcgtcaagaagcctggattctaaggcttttcctcaacatatgatccttacctaatttaagagccagagaacatatgatccttacctaatctaagagccagagaagcctagctttctgaatgttgatcaagaactagaactctgcatattctgaattgctctgacttgttttcatactcgttgtctgtccattgtccactagctagtccctgatattggggactgtagagatacaagtcatttagtcaataagagagaactaaaacttcttgaacatatctgaatgaaatggatgtattcctaattcaggactgtgctattgaggtgatctgaagttctgaacaactagccatccgttccccaaagctgcttgaataagagaaagctctacttgtttaaggccaagatcttcaaaatttaaaatcctgggagaaaagagtagaaatctacgggtggatatagatttcttcaacagaaagatcaaaagctgcaattcatagtgacaccaattgaagtatctgaactgtgcctcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 42365 - DNA, 938 bp, Oryza sativa
tttgagctacgcacattatatctttaagacatagttggcttagagctacgcgcattatggtttaagtagtcggtatactatctaagttcagccactcgcaaattcacaccgtatatgctatatatttatggtcaagtcactaggcttactgactttgtagttcttgactatatatttagttgttttctctctaactaagcacataattggaggctatgactaattaggtgtatctattcgatgcacttatttatttaatttttcttcataatccctccatagcttcttgcaatattttgacgaggactcttgaaggaagaactcccgaagccttttcaaggaagataaaatcactctgcaatgataaaaaaaaacctagatgaggattgcggactatgaagaactcagacgctatggagaacataggtatggtatacccacacgacatgttgttaatgaaaaatccgacacatttttatccaactacgaatagaaggttggtcagatccatataatatgtgatagcgtaagactcggtcactagaacgggatagctcatctgtaacgagtgggaagcctcatctgtgtcggcaagaggtaccgtcacgaaccaaaggtcactcatgtgaaaagtcatatgtgtcgggtcggccaccgtcacgaatgatagtcatctttatcgggcctaaatataagaccatcacggatgacactcttctgtgatgggtggtagttaagacctatcacggatgagattcatccgtgactgttcataagtacaaaccttcacggatgagaattatgatttttgaatttcaaatgcataaaaaaccctaaaaatattttaaatattaataggatattctaacaatggtcacacatcactacgtagaaattcttgttttttttcaagtgatatatgcatacatatcatacat

SEQ ID NO: 42366 - DNA, 7032 bp, Oryza sativa
accgatcattcatcattcttgcgttttttctatcatctcctttacaatggcatttctattaaaattctgtacttttccaatagggatacgcaaaatggacagactatatatgtataaactgtagaaacaaatatgctagtttatttgctataaaagcagaatcaatatatagaaagaaacagaggaggagaacaatatacaatgctgcaacagtagaagtgaaagcagaaccgttgccgtggccattcctgccaatagaaccgtcgccgttacttttcttgccaccaaccatattatcgccaccagccatgacgtagaggaagtagtcaatgtggttgttagggtgaggggccccgatagcggggatccgtatggaccctcttttatgagttcgactagtgagtaagtcgcacctgagagtatgccctgggccctgcttattcccctaataggatgaacacaaggaaatatatagaccgggttttggccacccgaaggaataccctactcccactcctatgagatggatttctctcctccgcgttaaaggatcttacaagttcatcgatccacggtatatagttcctctttccttccgttgtgtgtacgctaacaacttggctaaatgtgctgaagtatattctttcacacttcaccgaattctcccctcccccctcattcagggacacaacaagatcaaagttcaagagagttttttattcacatcatcattagattgcgcatgtgtccttagaagaggccgcctttagtttgttctaccttcctctaggtgtgccatatctggatccaccatggacttgggaggtgcaattgcttgccacacagccattcctgctctaccgaggcctcgggggcacttagtatggggccatgctaagttgcagtacgccgatagcctggcatgcctccgcacctaatccgcacatgcacgcgacaaacaaggattaccatgcctagctaaatatgggggaaccctgtcattgcctagcaaatggtagaaaaagaggtgctggtcccctctgttaagtggcagtcaaccacacgccctctgttaaatttctctgtcccgtgtcagaaccgacacatcatggatgcgaaaagggaatcaacatcacttgtcatcctgttttccacgcttcctatctgttaacgaccaaatttggtaagccatgaactagatttggcattgggattgaagcggatatgatagggaattgtctcctgggaacacagttcgcatcagctacgggggcatcggctgaagactgcatcggctagcatagattggacgaaagacagccgatgtagccgatctcgctaaggtggttatatgatcatctccgggattgattagcgtgctgcacaggtattgcaacgattgagataagctcacgagtaggcaattgtatctattaattaggatattttgaatagtttctttagagatatatctcggcaagggtctgccgtgaagattcgtttgtatcttagagtttgttagagataagagtcgtgtccggcaaggacctgtgatgtatctcgggtataaatatgacccgatctcatgtaaacatttaacaacagttcaataacacttttgatgcatcgccacctttttctacttttcttgtttcgacgagttcttgctttcgggttgagctgcatcgattttgatcttcaacaagaggtaaagcttatcatggcagcttgtgttatcgggattagtacttacatctttatgacactctaatcttggttatgtaaatcgtcgagttaacatatatgcttcataagctttattagtatcataatctaaccctacaccggccaatatctattattggaaggcagccgatagagttagatattgttggtaatctagattatatagcatatctaccatctcttagtgattttcatcaatatgtttggatcttgtatttattcttatgcttaatgctgcatcggttgagttcgatctattaagtaacattcataactgcaatatctagtttgtcttacatgggtcataggagatggctccccctacggcacgcctttaaaagaaagaagaaaattttcaatggtaagaaagaacttgggtctgcccctgagaatttgtccggagatcaagtacacaacatggtgaaagacattactaatgagtttgggtagaaaagaaaacgtagcaaggaggacaagaagaggatgtggaagaaaaaatccatattgcggctaccttactagaaagatctggaggtccgtcattgcattgatctgatgcacgtagagaagaatgcgtgcgatagcttgctagggctgttgctgaatatgcctagcaagacaaaggacgggttgaatgcgcgtcttgatctataggagatgaacatttgcagtgaacttcaacctgttacggatgagaagacaggaagagtgtacctcccaccagcttgccacacattgtcgaaggatgagaagatcgcaatgctctcatgcctggtagatattaaagttccttcgggctattgcgcgagaataagtaagtatgttaaattggaggatctaaaactggttgcaatggagtctcacgattgccacgtgataatcacacagatcttgccagttgctatcagaggcattctaccaccacaagtccgtcgcactatccaacagctttgtgccttcttcaatgcaatcggtcagaagattatagatccagaagacctagatgggttgcaggccgatattgtcaataccctgtgtcacttggagatgtattttccactggctttcttcgatatcatggttcatctcactgttcacctagtgaagcaaacaaaaatatgtcggccaactcttattagagaaatgtggccattcgagaggtacatgggaattctgaagtcctacgttcggaacagagcaaaaccagaggggagcaacattgaaggttacacgaccgaggaggccattgagttctgtatcgattacatggccgagactaatcctatcggagttcctgcgtctcgccacgaaggaaggttcgcaggtgttggcacaactgtcagaaaaagaattgttcccgatcaagcttactatgcgcaggctcatttcgcagtgctgcaacatatggctgaagtaaccccatactttaaggagcatttagcgaaggtccgatgggacaatattggtcaatcagatatttggatcaacagagaacatggtgctcgcttcaacgaatggttcaaggatcgtgtagcacggtcgaccgatggcctaagtgagatattacaaaggttggcaaggggtccatcttgggatgttgacacatggcaagggtacgatatcaatggatacacattttacaccgtcacacaagatgagaaaagcacagtgcaaaacagtggagtccgtatagatgcatatcagcatcaggttggatcaagcacatactatggccgcatagagcagatatggaagctgaactacctgaacttcaaagtccctttgtttcgttgcagttgggtgaatatccgcactggtgtcaaagtcgacaaggaaggattcacattagtggaccaggccaaggttggatacgtagacgaaccattcgtactagcgaagcaggtcgaacatattttctacataaaagaccccgcaaacaagaagatgcacgtcgttagggatggcaagcgaagaattgtgggggtggacaacgtcgtcgataaagaagaatacaacaagaatcttcatgtgagacctcagatcgaccttgacgatgatcccgaagatgaagtggcgtacgttcgttcagaccattcggaaggcatatcactgtaaatgatgtatttaatttgtattgaagccttaatgaatgaattgcatatgtttcatgccattccagttaattacgatttaaaactctttgaagaaatggatttgttaattatgtggttttaaaaagttatacttgttattttaaactatatgtgagaaaggcaattgtcaattatatgattttaaaaaattaataggaattttaaactatatgtgagaaaggcaattgccaattatatgatttttaaaaaataataggaattttaaactatatgtgggaaaggcaattgttaattatatgaattttaaaaattaataggaattttaaactatgtaaataagacatttgttaattatatgagataaatcaaatgtaatagcaattttaattcgcgtagaagttaattataaatgatttttataacttaaaaatattttaataagtcatctgtgacgggctttagtactatgcccgatagagattattccatctctatcgggcttagtgctaatgcccatcacggataggtatcatccgtatcgggcaaagtactaacgcccgtcacggatgagtgccatccgcatcgggcttagtagtctgcctgatagagatgaggattgactagggtttacttagtcaatcctcatccacgggtccttactctctcttactctctcactctctagatccaccgccgccagcgcctcctcctcctcctccaccgccgacaccgcctccttctcctccaagccatcgcctcccgaccgccaccgcctccctccacgccccccggttcatgatccaccgccgcctcctcctccaagccctcgcctcccgaccgccgccgtctccctccatgcctaccggttcaagatccaccgccgcctcctccgcgacgctgccgctgcttcctgcttcaagatccaccactgcctcctccatcgtcgtccggcctccccgaccgctagcgcctcctccacgcgcaagaccgccaccgccggcttcctctccgccaagtctgcacgccgccgcctacaagttccggaggccacgttgaccccgagcccggccacgtcaaccccgaggccgccgccgcatcaacggccccgctccctgccgcgtcgaccctgagcctggccatgtcaaccccgaggccgccgccgcatcaacgaccctgctcccggccgcgtcgaccccgagcccggccgccatcgtcaacaccgacgtcacctcttcttctccctggtgcgcatgtcctccctcttctttcaaatgccatgtgtgtagatgttgggatgaagtgggctatgttgccatgttgggatgaagtgggctgtgatggatgtaatttgtgatttttgggggaagtgccatgttgggatgcagtgggctgtgatggaattaatttgtgatttttggggagaaatgccatgttgggatgcagtgggttgtgatggaattaatttttgatttttgggggaaatgccatgttgggatgcagtgggctgtgatggaattaatttgtgatttttgggggaaatgccatcttgggatgctgtgggcagtgatggatgtatttgtgatgattggccaatgatgattgctcaagaacagaccatatacacttgtgatatttgggttttgtcaataagaacagaccatctacacttgtttgtttttttgggaggagtggcagtatgggttgtttttgcaagaatggatacatttttgggccggcctcactcttgttcttgttttggtttaaatgtgggtttttaatgcataagaacagaccctatacacttgtgatttttgggttttgtcaataagaacagaccatctacacgtgctcattgtttttttgggaggagtggcagtatgggatgttttgcaaaaatttatgcatttttggaccggcctcactcttgttcttgtttaggtttaaatatgggtttttaatgcatcagaacagaccctatacacttgtgatttttgggttttgtcaataagaacagaccatctacacttgttcattttttttgggtggagtggcagtatgggatgttttgcaaaatggatgtatttttgggccggcctcactcttgttcttgtttaggtttaaatatgggtttttaatgcataacaagagaccatctacacttgttctttttgggttttttcaataagaatagaccatctacacttgttgtttttttcaggaaagaaaatgagcaaaactgaggccaaacttattatatgtcatgacttgtgtactatgggctattttgggcaattttgagggaaatgggatggatatggatagggctgttattaaatgaagttagtgaaattatgacatttaggagaatacgaagtgttccggttgccaaatctggtttggtcgggttactgcctgcacggtaccgaccaagacaatttggtaaataggacatttcattcaaataagacatttctagaaatttgttatcgttaccaatatcctagattgctttcaaggtcatttctttagggaaccccattcccataaattcagtatccaaagctggttgctgtatctatgggaataagggttcctaacgaaatgatcttggatgcaatcttggattttgcggacgataacgttaggagtctagtgcaattgttttgtgacaagaataggaagggttttggttgcctgtgtgttctatctaagtccacctcgtcagcagatatgtaccatccatgttcctcaaggacgaagcagacggtaccacgacctcgacatcagtatcccattggaacttgctatcgttgtcactatcatatggtagtgacattgatagcaagttcgagtgggatactaatgtcgagatcgagttcccggctgctccggccttgttgagcatagatgctcctgttccgtcgacgaggcgaatgcaggtaagagatagaggtataacaaaccatcagagaatgtgtgtagatgtaattttctttttaaaaagtactttcttcccgtacaaaagtcacataggacaagccacagcaaggcgaaccaatgtcgacgactactactgggactacttcaagccggaatcctaggacccagaataagattcctaaggaagtctacaccataacacagatggacgaggttggatatccgacggctc

SEQ ID NO: 42367 - DNA, 11683 bp, Oryza sativa
ggcctggaggcagttcaagcaaagcttccaataccctacagaggccaaggcaggactcaggcggcagactctccgcaagatggggaattgttggaaaaacttcaagataatgctggtcacggagtacgtcctcaaccccgcccagctagaaccatttgggaaatacccattcatcacccgaaccatgtgggatgagttccatgccgccaaatcaacgaaagagtctcaagcaaaaagccaggcctaccgggatctacaggcaaggaaccttcacccgcaccggcttggcaccggaggctacacggggaaacaggaagaatgggacaaggaggatgaagctgcagcggaatctaacaccccgcaagtgcttgctgatatccttgtccagcgggcaaggaactgggcaagggcaagggtgaagaagaatagtgacggaactctttcgttcccaaatcccgaagatcaagcggtgtaccagaaaatcgtaagttgaacacatagaataagtttcattatgttgtatcgtattcttcatctaacgtgtcctaactgtaccccatgtcgaactgaatgctgagagacaggcctcccaagaggtctgctcacaaagacaggaggatgacatcctcacgaaagtgttgggaaacgaagaacaccatggatgaacaaggggcattggctccaatgttccatggaagtttgggtttccccaatacgtgtggcagtacaagaagcacaagctttcaaaggcgtagaaaactgcacgccttaaggaccaacttagagtggagcttaaagaagagcttagagaagagctaactgccgagctgttaggtatggaggctcgggtggaggcacgcatcagggataggtcgaccgatgccactcccggtcccatagtacaagtgagccccacgcagaggcgtagcagctgcgcatcaactgaggctccgccagaacagcctgaaggccccgccgcggtggatcacataacggtaaaaatagcttaataaggcatttattgtattagcaccacaaatacgttgcaacatattctaagaacactaatgaatctatcgcaggaacccacatcgtgtaccctagtcgttagggtgacaccaggatttgcaattcctgccgcagagggtcaagcgttcaagcataccacggagacccgagtgcatgtggcgcagctgctagctggcaatgccaaagttcaggtggacttagtgaagcccgattgggttggctactctatcccgcacccacctaatgacgagattctgacccttggggttgcacgtgggacctttattcaatggcccaagcatagcattgagatcaatataactccaaggccacgctaagttctcgtccgtcgccgacgcgtccccatccaactgttgtatctctccctcctaccgttgatgaaagagataaagatctccaattacagtatgatatagatttagaggacgacggtatgaaggtcgacagcaggccgcacctcccccctcctgccaaaaggagcaagagggcgaaatcttctccacctaaacttgacacacgcagaaaagctgctggaacagggagaggagtaggaaaggtgccattagccccaaagaagcttgatcttgtcaaggcgctagtagctcctccaaagcctccggccgaattcacattaggcatgccattggtcggagacgatgcattattcaagatgggccctgcatgcaaggagttgcatgggtactacatggagaagtccaacacaagaacgaaaaatagagagacctccatgttgggccatcacaatagtcagccgttcctcgggccttctaccttcatcgctgtagacttcaaagatctatgggacctctatagggtgcgagcgatcgacaccaacctccttaagtgctactcctcgtaagtatttctgggtacgtgatatggtagtaactacccataaattacgcttacccggactcttttcttgcttgtaggttaacctggaagcatgtccatcgtaaagtaccccatgttgccttactcgatccagctgtcgtcaacgagacaacgctgaaaaacgatcaagccaacatggtggactatatcaaggactgcttgtttgcttgtcaagacaaggacttcattatgtgtgcctacaatcaacagtaagcgtgtaccctacttatactaaaatgcgcgtcgcgtacaactgtagtatgtaacttgcaatttattaattttgcaggcgtcattggattgttctagtaataacgccgaagtggagtttggtatactaccttaactccaatatcaatccaaaaatatacgattggtcggccatcgaatctgccttgaacgaggcacgggaccaatacgtggcaaaaggcgagaggcataacgatgggcattccaaactcggctacaagaaagacttcccaatacgtcaacaagttggcgaccagtgcgggttccatgtctgccataacatgaggagcttcgcagataatgtgacattgctcgaccctaaggtgtgtccttcaattgtttatacacacataggatgaaaaatttacaagtatgtagactaacatggcgcctcacatgtagggaaaaatttcaaggattttggaaatcaacttcgatatcattagagaggagatagcaaaattcatactagatgatctcttgtcaccgaaagggatgtttagagtgaagtcctaggtatagctcatcttggaatggcagaacatttgcaatgcatatgcgacaaacaattgatttttgtaaatattctttgtaatacaatttaattctttagagtaaagtcctaggtagctcgtctctgtatatacttgcatttctaattacatataaatttgttccaatttataacttagttttgcagctttggagagaaaaatggatgtgaatgacatatacttcctccgtttcacaatgtaagactttctatcattgcccatatttatttagatgttaataaatgtagacatatgtatgtgtctagattcattaacatctatatgtatgtggctaatgctagaaagcctgacattgtgaaacggagggagtacatgtgatgtgaatgcatgtgttctgatggaatataaatgtgaatgagttgtgaattggctgtgaatgcatgtgttgtgatggaatgtaaatgttgtgatgctgggaatataaatgttgtgatgctgtgaatgctgtgatgctgggaatgggactatatatatgtgcttctgtcaattttttcagcgggcatggctagcaaaggtctgagtctagccaaattataaaattttattttttttccaaactcatccctgacgggcattttagtaatgcccgaaagagatatgtcatccgtgacgggctattagagtaagcccgatagagataagttatccgaaccgggactagtttgactcaacacgtggggtcaaaccaatcggtgacgggctctatctaaatgcccgattgagatgactaatcatccgtgacgggcttagtggtgtgcccgattgagattagtcatccgtgacaggtttctaactatgctggtttgattggtcatactcatctatgacgggctttgttttcggcccaattgagataacatccatccgtgacaggtttttgcccgattgagattttttctcatatcagtaacctttacctagtgacggaggctttactcgatagtgatgaggctttcagcccgtcatagataagcaatcccattgtagtgttcccgtgagaaggagttcctcagaattaaagtcagaggaacatgagttcctgaaaggtaagatctatcctcatgggcccacatgtcagatacacatgttcctctgactcaaattagaggagtctgactcaaattagaggagtctagtcatgtacgcactcagtcttatatacatattattatatgtgtgcatcttctgtccccgtccatgaattcctgtgttaacttatttaaacacttggacaactgggccaccacacacatgcacatcacgcttccttaatgtattattaatggtgttccatgcatgtactgcttatatatacaataatctggctgaccatacatctgcgtacgttgacctactaattaaccgtgtgtacgtgtacatgtcgcgtttcaagtttgtttttgtatgcaattggtgcaaccatgttcatccgtgtgctagttttattaaattaaaaccctacatgcttgttctcgagtgcacgtatgcctattccaaagcaaagaatataatggatgctagttgctagtagcactgtttattaggtgaattctgtgcaactcgtgcatgttcatgtgtatgctaattaaatacactaggtaggtagtattgcgcaggtaccgctatttttctagatgttaaattctttttggtgactaaaatttattactcgtaactacacatttttatataaagttcacatatgatgttcatatatctagtcagtgccacatcatttagtttgatagggaagagtttgatagggaagaactggaggtcttacttacacctatcaagtttgagatataatatactagaactgagattttggttaatacaaaactacctaagtaggatcgaattataacaactaagccaaccagagggggtgaatggttggtatgcccaaaaaccaaaacttttagcggaaataaaagttaccttcaaattcgacggatcgcggtctgaccgaagtagtagcaccgatctgaccaccctgaatacgttggtctgaccgatgtagatcgatcgtttgaaccgccgaaatcgactgctctctcctatcgcagcagccggtctaaccgtcgtgtgctcgccggtctgaccgctgcgataccgtcggtcggaccgccggtgtccagccggttggaccaccgtacccgagaaaacataaatcgaagaattcttaaagtagatgacgactttattgattctctctttgtttacaaagtgcaccaacagcactcctacaaaaatttcgactaaattcgaaaccctaactcaactatcaactcaattgctctcaaaagcgataccgggaagcctgacgctccctctctatttatacatgaggtaggcaacccaaagccacaaaccaaactcatactagaagtcctagtccccctaggaaaccttctcgtacaagacatgaactttacataaccaatcataccaaatttggactctttccaaattcgactccacatcccatacgcacacaatacctccatcgtatgccatatggaatcttcaccttccaggtgcattgaactctagccttagtatcccgcatgatctctgaccaccttggacatcgtcttatccccaagttgactcccggtccatcaccgcaaatactctcccggcatctcgagtcacctacagaagaaacaaacaaagaaaccatatttcgagaccaagctatccccatcttgactcattagtagcaaacaacagtattacatacacatagaatccatcaagaaatcatattcatgaaacaatcacggatatccaaacaaccaacccgaaatcgaaaccgacacagtgtcggccggtcagaccgtgggctgtgccggactgaccacgcaatacacgccggtctgaccggcagcacatgcccggtctaaccggaccacaaatccagtagtacctgtagatcacctgtaaaattcaaatcatctccaaaaccacttcgcaaataaatttcaaatatcaaaaccaataatctccaatatcaactgttcatcacaaaataataataataataaaacacttttgattttacaacctatttaatttttatgttttccttagggactctcgcgccttttctcatggttgatagtggttgcgaattgatttcataacgttaatatcaaattccgataatttcaactaaatatggagggtactgagtgatagaagttcagaagttccctatgacgacatctatacctcggttgatccactagtgaagaaacgatctttaacaccttatggaaactcctgtagcaactgtgacaagcaaattaggactaaagatggtaccgattgaaataaccggtactaaatattcataccaagtcaaaaaattatgtacaatacaggattctaactcaaaatctctctcttcagccctcacactcattatcatcccacctactacacatctaacttgaatagaaattctttatttttaaactaaccctggagacatctttagtccaattggtaacactaaccggtattaaaaatatctttagtctaggtagatactcgggttaccaaccggtattagaaatgaatttttagtccggattggtgttgctaaacgagactaaagatcatcaagtattagtctcggttggtgttaccaaccggtactaaagatgtatttttagtactggttggtaacactaaacgggattaaaaatgttccaagagacttggacttttagaactggtactaaagcatcttttagtagtgacatcagatatttgtgattttggagaccacaacaaaagataagttctatagtagtgacctcctatctatgactactcttgccgcttcaagtaaagatggcacaaataataatacgtagatatacaaagttaaaaagaggttcagtcatcgtaaattagttggcaagtcccttggaggtttgtcttggtggttcgttgtgacttttgccgggctcatttagtgcagtggttggttgcctagcaactagtgcaacttgatgctagtcagcacctctataaccctattcactttgcaatggctaaatacaacgttctaattaaaacactcactttttttttctggtaacacgtttgtatgaatattgttcctttagtatgtgatgacctagctataacatgggtacacgtataaattaagctataaaaattatctaacatctaaaatttaatagaggattaagtgtttgttgttttgcattttttttaaatgtgatctcaaatttgtcagaggctttaagaaatctagtaggagggttcgataacacgtttaatgcacttacaaattgactttttataaccatatgttctaaatattagtcattatatatttttgtttaattactgttacggcatatattactgagatttttcctaacatttaaaattatctttttggtggtattgtggacatatatgttttcttagatttgaagaaaatctcacgtgcgcatttagctatgtatgttaataaagctatatataggatgatatattcagtattgtcaatcatcacataatactttgtatacatgcacaactgagtgaaaattgaaccttactagtgaaattccagaaaattactaccgccattctaaaattgaaaattactatccccattttaaaacagtaataatcgaaaatatcaaaactactttcatgtatttgtattttattattatggatatattgtaataaaacatcaatcactaaatatcttacagtccaatatatccgttcatatggggttcagtaagtgatatacaattatatactatacatattatttgtttatttggaacttttatggttgattcgattgcatatgcatatagctaaaagagaactcgacataacacatttttacaacttaacgaatagttatatgggtcttcaatttttaatttggtctttcatctcatcaaaccaagaaggaaaaaaaatggaaaaagagggttcatacctattgttggaatagggctaggcccaatttattctcaattaattccattggtccacaattaatcctatgtaaaataatacaaccttgtacatttaagtgggactggttaaggtggtgtgggatagcaacacgctggcgcgcacgtgctgagccggcgggctgagggtgtgggcatgggcgtggcgagactggcggatgctgctgctgctgctctctctctctctcacacacacacacatgtttgatctcgcggattaactccaggcgttatcctcgcactacaattcctcccaccaacagacatctatctatgtttcctggagcactgcattcttcctcctcggttccccttcatgttgttcagctgcttctggcttccccgcgctacaattcctcccaccaacggacatctatcaccgtttcctgacgcactgtcttcttcttcctcggttccccttcatgttcctgagctgctcctggcttccccgattctattcacttgcgcgcacgggtgatcagtacgttccccttcctgttcctgagctgcttctggcttccccgtttctgttcacttgcgtgcatgggtgatcagtacgagaaggcctccagaactccgtccacttgcatacctgtatgggtaggcgagcgataaagtttctggggagcgctctcgggcgcgactgctcctgttcgacaatggttctgcaccgctacgtcttcctcctccacaccggcttctgcactgctgcgtcttcgccgacatgtcaatagacaacacccgtactggcactggagaaggcgagcacgacaaccgcaacagaggcaacaacaccaccaatgcctcaactagtacaagagcgttctcggggtatacttccatttccttactgttaatcatgctgctagatgtctctctgttaatacttatcacaatgttcgaattgtgttactatgtgaaatatgatgcttattctataaaaaagcatgctcatgttgctcatgtttagcaccttcttattgcagtgtcatgtttattatcttaatattctagattaaaatatgttgaattatgaccatatttccaacacctatgtacatgcacgtcaacaggaagatgtcagggatacggataaggcataccctccatcctacgacttatgaaatataccgataagatataccttcacgtacacggatcgtttccgttacgccgttaggaattcttctcgaattatcgaaaatctctacgagttaagaaactaccagagtcctactcggaggggatagaacctctaccatatcgtgccagtttacatatccctaagtcttactgggggtcaaggtattccacagtataaaagggacccctagggggaggcaaaggacatcacatctcatcgccagcacacccaccaaagtttacggagccggagtatgcggagccaactcgccgggagatcttgtcaaatccctcgattacgatcttgtcggtatcgcctgtttcagttactctctttgtaatctgttttcatcgtcatcaatctcatataaactagagtagagctattacctgataaggggcccgaatcagtataatccttgtcttctgtttgcttgatgtcgtactacgtagaccctcattccaatgtaccctaatacttaactcatccggtccgcgagtatccctcgtcgacagaagagatgtgggatttttattttgacaagtggggcttatagagataaatctaactgtgaaatctttaagatagatccattggtatatagggtataattcaacggttagatgtttcgtttgttttcaagattgttttagagagcgctacgtgacaatataggcgcgtttatagaaacatcacgtggtggtttaagatcgtttataggatgtttaatactctctccatgcaaacttggtcatcatatttgcctttttattaaattttcttttgttgtgattgcacggtcatgtaaactcttattgtgattccttcattctactacagttattcaaatatcccacaggcggggtaccatttagtagtctaatatacatagcaaacagatcaaatgtggacatttttcttgaaaactctttcgagacttttcaaataacaacaaaaatacactgattatttctggtccttgaatttttggaagtaattaacagaattcgaacagtgcaaatgtacactgctggccaaaattaatacacagtacaatacagtacgtacaggaagcagatgctaattgtgtcgccattactgcggctgggtggtctcgatctgtcgcaagaaagacgaccgagacaaaagatgcttgtcgcacgtacagcgccgcgcaggtggcaaattaaccggtcgatcgatcaacataaatgactagtattagattattaattaaagctgtacgttaaccatgttgtttggccggtggtcgtctcaagtgcagcagtgcagccgaaatgttggacatgtacgatccaatgttttacactggaagatcatgactaattaacaacgtcagataattttaagattttatgatcctagactcctagtacctaccggcttaattgtacggtggttgattctgtcgatgttcagctatgtacgaggtgtaaaagttaatggatgtacggagatacaaatatttagatatgttgagaccctttcgacaagaggtaataccaatataagaattgaatatgtcatgtgttgtattgatctgatgatctgattatagcttacgccttcaagaggatccctgtccaccttatataggttggaggatagagttacaatgagcaaaacttagccggaaacaacatcaatttcctaaactattatatggtagtatgcattggggctctatgctcttacctttgaacacaaggtaaaataatgacccactagtaaggatctaaacatcctcgacaagtcatctgtgtcgagctaatgtgacccgtttcggatgactcatctctaacagttcaaaaggtacgtcgtttaagacatgaatatcggggatgatccgtcaccgatagaagtcatctttgccaggttgtagtttgaacacgtcacggatgacatataatgagtcacaaccataccccgtcaccgatgttgggtcgtagctcgaaaacgtcacggatgacctataatgagtcacaaccatgccccatcaccaatttaaattcatctttgttgggacgcagttctaacacgtcacggaagacctataatgggtcacaaccatgcccatcaccgatttaaagtcatatttatcgggttatagttcaaacacgtcacggatgagctataatgggtcactaccatgccccgtcacagatttaaagtcatgtttgtccggtcgtagttctaacacgtcacggatgacttataacaggttacaacaattcccaatcacggataacatatcatccatgataggtgtaatgagatgacccttcaaacataacagcactcatccgtgacggatcttaattaacacccttcacggataacgttacgaacagtcatggatgaggaaaaattaaaatttttgaaattttcaaagaacctctgatagagacataccctatatggaagttatagatcttgatgagatctataactttaaaactgatagtatttgaatttgtgatagtttacatgcccaaatattcattataggtggtgagagctattttgaaatatgtaattttgaatttttcaaatgatctcggatggagacatggcctatatcaaagtgttacaagtgatgtgatctttttttttgaatttttcaaacgaccatggatggagatataccctacactaaagttgtagagctcgatgggctgcaggaa

SEQ ID NO: 42368 - DNA, 2396 bp, Oryza sativa
ggcgctcttcggctactaatgtcggttgtgggtggaaccgactgaaccactgacattagcaattggcattgagcactataaaagcatcttctcacttcactttcaacacaacacaactaaagtggagttccatcactttcatttttagtctactctctagtagagttagaatatggcgagagtgagggaaagcttgtcggaattgttggcatcctctccactcttgtaccttggtggatgcttcttttatataagcaagtattcatgattttttttgggtatttaattttcttatttaagtaaaatataatctcatcatcgaggtttcattgcttagtttttatattaaatgctctagtactaatactctggttaaatacggaagttttttgccaaggctagagtaataatcaatagcatagatgtggtctcttggttagaagttagcactgtttgttgtgtgctccacgggttctagatgtaggtggtaggtggtgatagccttgtccatcctttgtaatcctccacattcagttaatcatagagctacaagtcagacttgcttggcaaaccagggagagctggtgctggtagcaagttatatagttttaccttaacttaattcaagaatcttaacccttagaaatcttctctacatttcacctattatttagttgttgtccttggacgaacatgtttctaagattcgacacacgcgttccctgtgatttgatacccaaggaacactctaaggtgaagtgctataattgtatccatacgcctgcggatttatctgtgatcgtggcaaataccaataagcatttatggcatcgttgtcggggaacagttgttatgttatgtttgaacctagttcttcctctcatcctttattttatttcttcttttcttttcttttctaccatggagtaactatctagtcaaaactttttcactctgaatggcgagctctttgagccacccccttcttcaaaacctactctcacatctaactatgaactccgtcctggcgttatagccatggttcgggaacaatccttctcgcgccgttaggaagacacatggtgaggggtaactcaacaccaagttatgtcttccttttttttcccgttaacccatgttgtctctatacggatgaaaattgttaacttttggcagagtgagaaggattatgcattgtatcccgatgttttcaccgaaggtttgtttgcacagtagaaggtatggattgtatcctagagaacacctccttcatccacagtgaaactctccaggaaatcaagcatacccataaggagccctcaattgttgaatccaagcccatactttgtacatcacaagattcaccctttgaaccatcatctgaacctcatgaaccgaaggaagaagaaattcagccttcgaaaatccctttcgtgttcgaggaaggtctttttgaagactatagaaacacctcgaactattcctatcaaaagagatcacatgctcaaagggacagtaaaggagttaactaccatcatgagcgatgtgtggttaagggaagtggagccgtcttctgaagtaattcggatttcgcccccttacttagctattcaatgtcttgtgaaggagactgtggtgattgttctctataatcccactgtcggtgctaacatcctgtttgcaacttttgcgttaactttgttgacggtcgttaagtaccaatttctttcaccaaatagcacaattaataaaggaaaattagcatttcttacacgtatagcaataataaataatgtagttgtattatgattggagaatcaacctggtgttggtatttcttaacgacattactagaaatataattcccagcaatggcgcataaatacttctggtatattatggttacagagttcatccgcaagcgcacggatataccgttgtagcatttcacccgagagtattccaagggtatcgtatttattttatcccatgggaagatcatgtagagagaactcaactaatattttatatattacttgtgataatcatattctaagcatgggttaagataatccaagagtagagtgacacacaagcattaactactcatcctcataatatttcatctaagctaagtggaaagaaaagagaaaggaaatctattcctatacttataatatacatagtatacatacattctagttaactgttatactagctaataccctctatccgatgccctcctagtacttcgagaagccacccttgactgccgagttccttacgacagcccgtcatgaccatccaaccggggctaaatacggagaaataccctcccaggaaattaacttaggattatatataggcgcggaggaatacccgtactgagctgtcac

SEQ ID NO: 42369 - DNA, 5184 bp, Oryza sativa
cagcccttccgggttcccgactcctattctatttctattccaccagctagatactactaaactaaacttgagagaaatgagagagctattgcttgaggtgtgtgttgaagtgaagagagtgaagcctttatatagaggtggttatgacggttgtggaaggggaattgtccgaagtacgctccaaccgtcattgggatgcaatcctggatgtccacgccaaaacctggatccaacggcgccaggattggttcgactgaacctgggactggcccaatccagcccaatttcggctggtggcctcctctattgctccactccgcagacttgtaaattttggcccaattcattgtgtcagttctgagttcttggcccatttattcataagtctggttttcgacatcgtctgattgatttatcatctatgttgatgtcgattctcatctactttatgatcattctctgcaaaaaggttagtatacctaatactagtggaatattattattctaacatacttatgcattgcaaacatcactagttctctcctattttggtaatattgacggtcgaaactgatcgataacaaccgtcaacacctggatgcaggaattctacatctaagtgaaggagaaatcagggcggcatgcaaagaaacccatcaccggtgaatcatgtgtgagcacacggattaagcggcccacatattagaccaaaccgacctaaagtgtgaccaaacagccatgcaccgtcttaggggcccacatgtcaggccctggtgaaaggcggtggagagagaggtgggactaggggttcggccaaaccgccattgccacctctaatctccactccccacatgtcactccttcacccactcccgatgacaattgtgtgtggataacagcctccaaccgccatacaactgacttttggaggctacaaatagaagagagctgctcacttcacaacacaatcttaaggagcaattctttcttccactttgtattatctatagtttctattaggaataatgcttaggagtttcagtcctatagtcctctcggagttctgggtatgtctctagtaatttactcctctttgtattatcttctttatttatttatgctcatggcttatatttttgtttattgagttaatgttcaatgagtagtataaacttcgtatatctacttcatcttaggctaatcaatccatgctatggtaacagttcaatgacctttatagggtgagagtcccataggagttagtgatattatttactgacataagcgtaggctagataaatgccttggatgtaggtgtgccccacggaaagtgaggtaggcggcaggtgatgacagccctgtccgtcatttgtatttctccatgttcgggtatgacgtaagagtgcataaatgccataatcatgctggtagaccggcagggagtggtctctcggtagtacctggttgcctggaactaagtcctatgttgtaagcatctatatgccaagtgtatactagacctgattagtatatacaaaagtacacctgattagtatatacaaaagtacagatgaattgtagttacctaatgctaatttcctactagatatccttagataggtgaatctcctgtgtgtgtccaccaccttatcaattattattctaacccctgtttagactttggtgaaactaattataggtcaattaaggagatataaaaaaacacatctttatgccgccgccttcactgcgaaaatataaatacgatacccttgggaatactaatgggtgaaatgctacagcagtatccgtgcacttgcagatttatctcgaaacataagaaataccaacaaactttcttaggggacgagtcgttagcaccaaccgatgaaacgttccgaagtcccttaggtactcatagaaggttatgaggttctatgtggagtgcctctaaggcacgagatgttcctaatacatgttgtgcctaagaagtgaggcatgatgatcgttgaaaattccacaaacgacttgatcccacaacaaaccgtcataggatggaagatgtgtatagattacaaaaaactcaacaaggcaacttggaaggatcattttccgatgtccttcattgattgaatgttagagcggcttgcaaatcattccttcttctatttttttgatggttattctggtcatcatcaaattcccatccatcccgataaccaaggaaaagaccatgttctcatatccttatggaacatatgcttactgcggaatgtcatttgggttgtgtaatgcagctgcgtcattccaaaggtgcatgttgtctatttgctctgacatgatcaagaaaatcatggaagttttcatggacgacttctcaatctatagaaaaacttttgatcattacctcaagaatttagataaggtcttgcaacgatgtcaagaaaaagtacacaacatcctaggacatgtagagtttgactagcgtttcattaaagatttttctcaagtggatagacccttgtcttgcctgttagctaaagatgttccctttgattttattaatgaatgcttaaaatcatttaatactagtagataccccgcgctttgctgcgggatatatggattaatgcatgttatacattatagaaaaatgaaagatgtgtactttcaaataatattgagttctaaaaattcaacaaaattgaaaatgatatgtcatgttcgcttgatatttaaataatatagataataattcctagaaggtgatgatgtggcatactcgcatgttaacctttagtagtttgtgggcattaactttatagtaagatagggttctgaaagaatctctcatcttagcatcaagcattcaatccttaattggtcgctgtcgtttgaaatcatgtgtgatgctaatgattgtgttgttagggccgttcttggccaaactacccatgcaatcgcatatgctagtaaaaccttgactggagctcaaataaacttgttttgcatatccctgatagcttaggagaaattttaacataggactagaaccatttgaaattagactacataatctttccaacaagtactcatgagccccaagagtccttctagattaacagctaggtccaattgaagttgatgcttttagaaggcccgaatgtgaatccaaaacgtgcataaattattctcttgccttctgtgtaccaaaagtgatgtgatgatgtaggagtatatttggttaaggtcttagttataacacgcaaatctttcgcggaaaatatgcaccttggttcatcgataaataaggtagccatgatcatatctgaactagtaatgtcctcatcatcaaccataggcgccctgctccatttccctatctcgtcgaccacgaacgctccatgcctttccctcaattctcctgctaccttcctatgttatcgcttctctccctacgactacaggtgctagctctagctaccattcttcccttggtccatcagccagcagctaacgcttacaacgggggcgcacaaacccagcagagcaaggaccctggagggtttgggggtgaggattgattttgctccgttctgtgtaaaccgcataattgagcaaacggggtagttcctatccgttccaccttcgtgttacctcattgccatcccatagtcgatcaggaccaattgctcaccccaactcatagtcgcactcgctgcttgaagccctgttttgtgtcatcatcagctccacattattttttttcttatacccgtcactgagcttctattgttttgagcactgtatgaccatagtttcattgtatttcattgattatcatggcaaaaaaaatcatctaattaataaataattttgtagtataattgtataatatccactctttccgaccctttttgtcctcgcaacactctctccacattagcaaaattatatcaataagtttagtgaccagcaactaaatgtcttgtgtatatggcctagttttttccctaaagatatgaatggttgaatttgtgattattatttaagagtaaaaataataattagctatcctaaagttaaaaaaagatttaaaataattttaatttaataaatttatacttttttaaaaaagtaccattttaatactcagaaaatgtgtcacatcaattcagtgctctatttcttaaaaaggcacgatcgaaactactcctccatctctctgtcctgcggtttcctactagtggactgacacatatatggagatcgaatcctgcatttttcttttccttggctattgggccttgatctctaatcggctccaaagctttttcccgttatccgaaacgttcaagatactagcagtaggtttaaaatctcctagcacgtagcttgtaaaattgttggggtcaaggtagtctcaaggaataatcggaattaatatccgagaataatagagcactagctagttggggcctttcgtctgcttgctgggctgcaggctgtactagctagctagcctccaccgtatattctctcctcacacagaagactcgagtcgctccaccacaattgcatcttctttctacctttttgtgcaaatgcattcacagccgcatcatcggccactaccattaccactgagcccatgaccggaccaaaggaccaaaaggaaaaggcaataacacggtgcccagctatctaatccctccgtccaaagagatttggctgagttcgaaacgaggggttggaaaccaccactagcaagtaaaacggggcacggattaacacataatttcaattatatattagttttttaagaaaatgaaaatagattaatatgaatttttaaagcaaacttttttatatttttttagaaaacttatcgtttagtatttcggaaagtattcgcgcggaaaactaaggaatataaattgccaacatggagcaagaatacaaatattgttgtttaggagagctgatggttaagggtgaaattagtttgatatctctagaaatttacatggttgaaaaaaaaaggtcatgcccaaacaaacgtaaagtagtacttcaaaatcctctatgaaccaatagagaagcttctagggatcttatggctagctcgacaggagatgtgtagtgttagccggtctaggttcgaaatctcactcattttattta

SEQ ID NO: 42370 - DNA, 725 bp, Oryza sativa
tttcgcccgcgattccctgtccaaacccacaccaccaatccgcatgacggattaattaggcttaataaattcgtctcgcgattttcaggtgagttatgaaattagttttttcattcgtgttcgaaaacttcttccgacatccggtcaaataaaatgtttgatgtgacatctaaattttttttcgcgaactaaaaaaaaggccctagtcactagtgtgggaggcgttgactggacttcgaagcatatgagatcaggataaaaacctttgctatatatattcctcatcagctgctgtaacggactgaatagaggaggctgctctactagcctagtagtagtactgtagtatagagataacttgcacgccgtctttagcgacgattggagcagtcgtgtttcagcttctggtgacgacgacgacactgtcagcagcagccccgaccccgatagccctgcctggttgcccggaaagctgcggcggcatacaagtgccgtaccctttcggcatcggcgacgggtgctcctaccatggcttcaacctcacatgcgacgacgaggcgcaccaccaccagacgccgcccaagctgttcatggccacagacaacggcaccgtcgtccaagtgctcaacatctccttgccggacggcactgtacgcgttcgcagcaagctttcgcagtcatctattgccagctcctcctcctcctcgtctaatgcctcgtcgtca

SEQ ID NO: 42371 - DNA, 1073 bp, Oryza sativa
aactattactgtaataacaaattttccaagaatctggatgaatagagaatatgcagagatcaatctgccatctaacataaagaaggaagtgatagttttgttcaaaataaacattaggatacatcactgatcatacaaaaagcccagccttgctggatccctccttgcgttgcaggccacttcctgtcttgtgtcagtctagttctggaaaattatcatgtttctatcttcacaaataatcaagatgctgttaaagtagatgtttgcaccattggcctctgacaccagcctatgaggcttgctacccaacagtcaacaatgcttcagtagatgaatggttgaacatgctgaaggaccttacaactaacaacactgaggacagtgaaccaggataagcaaaaaaaaaagtacaaattcctgtttttactttgtaaactacttgagttcgtgttgtaatgaagatatccatgtcccttgtccacctatcataacacaagaactaaaatagcaaaagctcatttcttgttagaaaagtttatatgttgttacactccagtataatgaaaatcaacttcagatgcaacacacaggtgcactgttggtcttctaaaattttatgggaatgctataagctgtacaagctgaaggttgaagttcagctgtgtaagctgaagtttggacggtccactagccatctatttttcagatatcattttagtctgcactgtcaaagattaattgccattcactctgagactgagtatactggctgtcagatgtgttccctatcatgtcgcaggtattattattgatttattggaaacatgtcttatttcttggagtacttaacaattttaataaacatttgtattaattggctgctggtcttatcaatatgctttgtgcttcacaaaataaacatcagaagaaaaaaaaatagctccatacagccacccgaatcggaattagccagctttgacatctacccaaaagtcacaatcagtcaagcacatactctagctaataaccaagcacaaaagtaaaggtgcgatgcactgcgagagctgaagcct

SEQ ID NO: 42372 - DNA, 4848 bp, Oryza sativa
agaaaaataataagaaaggcaaaaaatatgccttccaaaaaagaacataacatttccgtcataatctttacctatctatcaatctatctattctttctattatatactaaaaatccattaaacttcctacaaacgctcctaaatcgacatgtggcatcctataaacgctctcgagtcgccacacgtcactctattaaaatagagaaatctgactgtcgattttcctttaaattggtggactcattaattttgatggaccttatcgttagatttatcttaaaaggaaatcaaaatctcgatccatccgtccaacgcaagtatgatccctccgtagcgtacgtactatccatgtatccatctgacctcctccgtttcccctttgtgtgtgtacgcttttctttcacttctcatgccggcggagaagagaagaaaaaaaaacacgtacactatttgacaaaaagaaaatatgtacgtacccagtcacatacgaaaaatatagagaaaaaaacacacacacgtacgtacccccggaaaaagaaaaaaacataacatgtactccctccatttcagtctccatttcacaatgtaaaactttttagcattacctatatacatatagatgttaataaatctaaacacatatatatatctagattcattaacatctaaataaatatgagcaatgctagaaagtcttacattatgaaacggaggaagtatactattagacctgtgttttgaaaataaaaaaacccagttataaatagcactctcaaaaattactcactccatactgtaaaaaaaactaatatatcaaaatgaggttagtaaatttattatgtattattttttctttatttatatattattaggaattaaatatcaaatatattatttttacatcgtgtcgttgtcatttatctcctactttaaacctcgttcgatcaaagcttattgggtgagtttatttaggcactcagaataatgcaagtcattagcacaggtttaattgagtattaaatattaaaaagcgaaaataaatttagttgatctttctaaaaaaaacttttatataaaaagtatttgcaaaacatgcaccatataatatactgtttagcaatttcaggaaacatgtttagcaatttcgggaaacatgttaaatataaataagagagtagccaatccgataagcactttagaacacagtcttaaatttgttacttagggtactaaacatatgtcctcacttatctccatatataattctatatacaaaccattgtccacaaatcgctaaataatattacttacgagatatccatgcacaatgcaccgaacgatagctgatatatgagcacgtgtgtcatccagcaccgaagataaagggtgatactaagtgcgcaaccatcaacaaattataggtaaatagaatataaaaacaatatactataaacaaagttgactacaagtacattacacctatgagtaatactattcctacacttctacagatactcctaagatgccacgtgatgctctaataaattagagagaatctatgaaaaattatataaaaaggtaaaatatttatccatcagtttacaattaaatcaatgatccattattttcaaccattaaattagatattctaaactaatccctatgtgttaaaaactatatagttctatgcatatgtacacaactcctacgtaagtatgtacataagagatataaaaagaaaaaaaaaagagtgtgtgtatattatccgtcccatctggtagttttctctttctttccagctctaagattttcctaaattgaagatatataaatgtagcaactactccaactgaggtggtaaaacaagccatgccatatgcaactgccttacgccaccctttgctccactctcttcccatcgattttctcgaaagtattctttttactaataatttaaaagacaatcatatgaactcatataaatatgtgcataagcacacttaaagtacacatgggtacatcctatccctatgttagaaaaaattttgtccaaaaaaaaagaaaaaacaaacgtatgtatgagagactactattccccccccctaaaaaaaaacgtacacgtaactacattatatctatttttttgttgttctcatccaaatagtgttaacaaattagcacaaattccaacgtatattagaccctacgtacatgcataggtgaattagatgtataatacaagtaaaaaaatatcaaaaccatatgtgttagcaaatgatcatcgcgagagcatgtattttttacgtgatcctcgccactgaagctattagatagtcgaatgatcaactgtgctaatcttttttaaacaatatgcctttactactaaaatttagtaccattcattaacatcataaacacattatgtctactctatacataaatcaactcaagacacaaaaaaaaacctttttttcattacctccatcttctttcactcattccctaaagggtgccgagcatggatctcaattggctatgttgtagtaagctatgcaggagtatgcattatttggttgaggtggtctgattttacaggttaccgttgaaaatagagcttaactggcttgaggagcacgactatatcaatacgagaccatgaattaaggcattagagaaaaacccttaacagctatagtcggcttcacccgattgttagagaggcattcttatataagtttaacggttttatcctattaattgatagaagcagtatttttaaatatttatatatagatttggacacatgtgagacataggcacttgggtatgatgtggagatttaactttttctggcattaatggtttattgggtttacttttaggtataactgcaattctatctattaaaaagatactcatatttcaagacaataataataagtaggggtgatagacgaatttacatataactggaacaaagtgattttttgtttggatataatacacattcttatcatttagtatatcaaaatctattatctatttcttatagtgaatatagtgagatagggcttcttttaatattctttttatagacaataaataaattgcccgcacatgtgcgcgggcttccttcctagttatataaattaaagatgattttatactcatcgtattttcgtccgttgtcctttcattttaacaaaccgtcctattccgatttagatccgtttttagcgttgtgaccatatttacgttttcctttttatatccacatccaatatgtttttgcacatatgggcctaaaattgtaaaaggtccaaattattgcccatctgttgacgcgaggctgtctcggtgaaaaacattgcccatcttctaagcatatgtcacatactatttatttcagatttgtttgtgtttatttcaataattttgcacacatgcaaatgcaaaacatactaaattttgtatgggcggctttcatgcatgtccatttattttgtgaaagattcatctaagcatgattctttttaacatcatttttcaacatatgatttcgttcggctatttaggattaagtgatttatattattaaaactgaagttgtttccaccgatagttttggtacgtcgtccgtatttaagttggttttaaaattcgttcgcttttaaaaatagaagggcttcagattggatatcaatctcaaaataaaaatcccatatactttttagacaaaaaaaatatatctaacaataatacaattaaaattagacttcacccgttgcaacgcacgggctttttttctagtaaaaacaaaaaaaaatgtgagacccatatatcattcacacaaaaaatgcattgtggaacccactaacacgtcgaccccacatgtcaaccattactcttctcctcctctctctctccacctatctaactctctcctcccgtcctcccaatagccgagatgaagggccggcgacggacgaggagaaccaaaggcgtgcggtggccctcgttggcagcagcgagacaggaagggggtggcggttggcggagagaggaacgtggtggctgacggcgacgatgctccctgggtagcgacagtgtccccacggcgaagacagcggccggtcgtcgggacggagaagggcacggagctcggacgatggagacgcgctcgatcggtcgagagaggcggcagggatccgaggagacgctactctccctaggcgacggtcgggtccccacagtggcgccggtcggcgagcttgcccgctcgtcggaggaacgccttctccgccctaccgtggccactgtgctgccgttcccgaccgctgtccccaccgccaccaccgccgccgctctagccaatgtgaagagaaaggccgagggagggaaagataagggagagagtgagggagggaggaggaagaagggaaggggagggaggatgacatgtgggtcccacaatatatttggtgtgaatgacatatgagtcacacatatttttttatttttgctttttattttaatgccacatagaacaaagacccggtcaagaccaccatgtaggcgccacgtcagccaaaaccaccaagaaacattgattgcaccggttttgatagttgaaggagtctatatacccgtttttgtggttggagggcatgattcatactcgagcgatagttgaaggagtcgaagtatactttttcccaacccagaattttcaaagtcatttttcaaaggaacaagtttactttaggttctacttgacgtggaatttgtcctttaaccgtaataatatatataggtccccaagcagtaccagttaaggatggaattcaa

SEQ ID NO: 42373 - DNA, 17035 bp, Oryza sativa
aaggaaaaaaagaggagaagaaaaagaaaaaaaagtaaaggggtcccatttgttagtcaaaataatgccacgtcatttctgcgtggcatgccacatcaagccacataggatcctgaaggagttgtagcgatttgggacctagatgacatactataacaagttatgggacttggatatgcattttgagagtttagggacttagatgacatacccctacaagtttaaggaccgcccgtgcactttactctataaaaaatgtctcaaaatagtacttcagtatataacatttacatgatcaatagcaagtgctcaaaatagtacttcagtatataacatttacataatcaacagcaagtgcatatcttctatagtgtgaccagtagaagtttatatggtatgcaaaccatagaggtttatatctcagttactcttaggacattgtctcataatagtactccagtcaattgttatcggaatagtgctcgacgtcgttgtcttaactgaagtgcaaaaaaggagatgtcgtgtgtgaacatgctggaaacatcttaaaaattgaaatgacaactatgcatttctggtatggacttacggaccccatgagcatgtccatcatcctagcagttgggcactggaagggatttcacactgcacatgtccatcatcctagcagttactgccaaaaaatactgctcaatctcggcttctagctaacttcccagccatccgagggtgacccatcgtaatgctggtttaaattgatttatgaaatctgacttcaacagaaatactgtaaaaaaaagccacatcctgtttctggaaaaaaaactgaagtatgtgttggaagtaatgtgtggatcagttgattttgttgaaggaataacaatattggaaaaatacggagcacaataaaacttcagatagaaaacatgatagagaaaaaggatcgcattacattggctggcaaatggaaaggtttatggaagacagcaatatgtgagtataaagctaactggatctataccacagctaggttagtaaagaaagccatggctgcatacatatagaaacaagtaaaaaagtggtagccattacttcattcctacatgtaaatgtaaaatatgatggcagaaaataaaaccaataaactgcagaagtgaaatgaacagtccagtttaagaaccttggtgtaagatttaaaaaaggcacatgattcccatcagggaagaaatatattgccaaatttgaactaaaaagtaaataaaatcattaaaggtggtccagatagtattatttgcacccagtaatcctagttatcagcaggtgggctattggaaatgagttaaagaactgaaattaaattaatggattagcatttgataacaagaaacgatgagaaagattgacagggatagttgacattcaataatacaagaaactgttagatggaccgatatgcaaatttaaaactcttttctagctatcttaatgtgtcttttctttctatctaattcctggacctgtttgtgaagaaataaaaccagtcttttatttttcttgttgtcagcctggatgcccttgttttcctgtaaaatattcgcttatttaatagaaatgggagaggctaacctctctagtttaagaaaaaaaatctaattctttcacatgataagaatagacacaaaaattagctgcaggggtaaacaagagaaaaatatcctgtggtgcatataatagaataagtggttgagccttctacaataaaaggttcagatatatggtgctgacaattaggaaaaaaaaatccagatattgaaacaaacacttatacaactttggtgataaatgtactctccagctccactgtccgaaaccagggattgaccattatctttgtttgtaaattttctaaattttaatctttgaagatttctctgaaatttcaggattcacatggtcttctatttttgtcaaaactattgcatgttcttctacaaataaaacttgattgagagaagattttctacatgacatatttgggagttgtttgacagtattaattaaaaaacattggtgctaaaacagaaccttgcaaaattctacaagcaacaataggggcaaagagtaaagactaagatttatgtatagaaaaacctctgagttattccctgcacctcatgaatcatgacggaactcctgatctatagaagcatgcaaaataacatacaaaagaaatatgattaggttaacactaattagttaaacagtagcaggaactacttctaatataatatgaagtaattgttacttgcacacatggcaacacattgtccttgacagtcaaagtgttggatcatgatcactgccttcatttgatctccaatcaaattcaatatccagatagtgtttccttcacaacaagctgaagcaattaatcaaggtccctcgattaaaaaaaatgtttggattgcgtaaaaataaaaattagcattcatgtcaagagatgcagaatgattaacacatttgtataagcattttgtaggcaatttcctgatatagatgctaatgttatccgtaaagcaaacaataatgttgctaaaatcaaatcataccagcacccaaaatcaatttgttagcaacaaaaaggattgattaatcaatttactccaatggttagataattacattcaggcacaaatagctaaatcttcaaactacatatgtaattctgtgagttatatattatataaatatattcaccgtaggactctcatacagtatttaccttaagaaaacagaagatcaatgctttgtccagtgcaaagcatctcttgccaatacattttttttgtgtgtagctcccttgtcctcttcaagggtatggccagattccagctaattaaagtacaaagttttatcctagaggaaagccaaacaatcatatgagcagctgaaattatgtttcaggaattatgcaatctaatatatatgcagtctagattaatttaatatatgctcctaggatatcaaagagcagattgatcagatctgtgacatacaaagccatagagcacatggagtgtgacatacctatcaaactctccaaagaatgaggatgggaatcatgtcactcctctgtgctctccatcctgcaaaagtttcatgaactggaacatgatatatttgatttctatccatgataaatggcatcaatccaagtaatatcacactactttggcacaatttaatttttaacgaattttaaaactataagttggaagtgtagctagctagtgtagcagccataaaggcacattcgctgtatgatgcaggaattccctgactgccacaaccagcacaggtttgaaagttgttaacgtcacaagtagatgcttgaaatacacctcgctagccaaccagaccagtggcccaggcgcttccttggagatggagtaggcagggggcagtgtcttgggtggctaagcaagccctgaattttctgctcttacggaatacacgtattttccctgaaaacacaagggaacctacaataacttcagacctgtaccataacacaaccagggggaggagattaaatgcaagaacatgcgtcaaatctacaatatttaccaatttgattttaactttttctgcaaatctacaaacaaatggttggggttacagtactcggattcatccatacgaatccaattcctaaccgtcagatttgcactatgatccaatccctaaccctcggatttgcaccattcactacaaattaaattcaccaaaatgaaggggagcttgcaatacttacatcgatgggttgggatatggtcggcggactggacgacagcgacctagtagggcaccttcactgcacgggggaggatccacacgccgtcgcggcgggggcatgcgagggggcgtaggaaagcgcagcggctgccgtagggactcgcggggtgtcatcgcgcgagggcgcacgtggggatagcgcggcggcgggcatcggggcgaggatagcgctagagcaggcgacggcattgtgatggatgggatcggatgaataggtgatactcggatggacggtacggataagtagatatgcaaatggacgctagggattgatcgggtgattgggcaggtaggattggaggaggccaactcctcctttttatattagtatagatatagatggtttattacttccgatccaaatagacctattttgtttggagaatatcagaatagtaataggtagcttttcaaggtaaattctttaagaaaaactgccaagatgaaattgcagaaattttacgagaaccttttcctgttcgaaatgtttgggccgttgcgtagtcatcattgccagtcaggtccttgacaaatggtctcgattaacatggtgcatatgctaatgatctcattgtttaatcactctaatgagcacacaatgagagggctaacatatcttgaaattaacgaagtaatcatgagcgccttactgtcaacggatacatcgtctaacactgtaaaaataattagctataaatatgagcacacgtgtctaagctaggactttaattcgagtaggctggtttcaccaaagggacctaaccagttcatctatgatcacttcatataacgatctcattgttgcgctaataagccctagaaagtaaataataataattgatgggtaaaatttttatattcacattcttaactatttaaaaaccaatactaaaactaaactatgacgaaaacctcaaaaaatttctaaattaagttggaaaatttaaattttggttacgactaataagccgaaaagcaaacgatggaactgaaactctcaactaggctgcataaaatttcctccatgttgccacacctgactatccttcctagcaatcgcattattaggcatatataaaatgtagagtcaggtatagtcttagttaatacatatcacttagaaactatactcctataataattgagataacaaaaactcttaaccattaatgcaccaaaatattttttctacacttctttctttttctccacgcccatacaacaaaattttctttaacaaatgttaggagtcaacttcgaaccattgtcatgtgtagcaaccacccccctatctctcttccatgtcatatattttacttacgtggcaacgaatagagaccgttattacacaccgttatacgtgcccttagttagccaattttaattctgaaatcccatgagatccaacaccctaaatacttgggacgttcaactttcacatgagacgaagttttcaaaattttgaactatcgaatcaatactgaaaagaaccaacagatcgataatccgttggagcatggtgacaaacacccttgatcacggacacgttgcttttgttgtgaaaaaaatgcgccgccccacatggagagggattatattccaggagtcatggaaagaaggttgtgacttgtgagagttgaactgagctgaaccaagcaaatttgccatttgctccggcctctggtttcttgagcaaacaagccttaattatatgcccacacaagtgatcaaatgtaacgtaaatacgccaagattttatactcctacgtcatgacctcaatcatgtacgaatcattgtctctttgtgtgctttgcaaagctgaaattgattttgaatttcagaatgtatttattttaagggttcttttgccactctcactaccaaagctctcttttcacgattttttttaagataatgagctctcttttcacgatggataagaaaagagagtaaaattcaattcttctaaaattattcttaaaagtcgaaatttagaattttaaaatagttttagcttttaagaaaaagctgatcagacaagtaggaattaatctttttttcatataatacctaatagaatcccatgaatattatttccttgatgatatatcaatctggaattctggatgcatttcttacatgttctctttcaaaagatatacactgcaaagtatagactgatctataacgacacaatacatgttgtataatcttatacacacaacacaagcagagtattcagtacacatcgatcctcattaatttggccacctcatcaaacttaagctacttacgctgcatgccccttctgtatgctctgcaccaacgacgtcgccgacgaggccgtcccgaccacggcgaggacgacgccggcggcgatcatcgccgcgttgagcgcgacggcgggccgcgacacccgcccccaccggatcttgaggtagaacgcgcaggggaagatgatcgagatggccacgctgacgagcgacccggtgaggctgagcacgtactggaagtacggcacggagagcgccagcgccaggatgagcagcagcgccgccgagccgacgccgccgcggacgagcgtgcgcgcgcgcggcgacatggccgccggcaggtggcgctcgagctggatggcgaagggcgcgaactcgagcgcgtacttggtgaccggcgtgagcacggtcgcccagagcgcgatcctggtgacggcgagccccggcggcatgctgagcgtgatctgggagctgacgctcgggccgaacatgctcgcgccgacgaacgccagcgccgtgtacagcgcggtgaccacggcgaagctcgcgacggacaccctggtgaacgccgaggggtccttcatggcggcgtggatgttggggaacacgatgtgccccgcgtagctgaacatgtacagcccggacaccgccgggatccgctccagccgcagcgccgggatgtaccccccgaggccgacgccgccgaacgccgccgcgcagacgacggtgccgaagatgagcagcgacatgacgatgccggcgaaggacaggaaggagatggtcgacaggtccctgagccacaggctggggagcgccaccagcacggcggcgacggtgagcagctgcgtggcggtgaggcgcacccacggcaggtggaggtgggaggcggcgccggcgaagacgagcgggaggttgtcgctgagggagatggtgtaggagacgagcgcgaagaagatctcgaggtagatgaaggcggaggcgaccacgcggcccttgccgccgaacgcgcgctcgccgatgtcctggtacgtcttggaggccgggtcgtcgtcaaggcacttgccgatgaggtgcgccgtgtacgcgcacatcacgccgaggccgacgaggaggaacacggacgcccacccgccgttctccagcgcgtacggagtcgacagctgcccaagtcctgcaaaatattatgaatatatatcattattaaaacctattaatttttcgagatattatcattttgatgtgaattatgacatcgatattgacataaaaaattaggagcttaggattctgataagcagcttacgagtataattaatgctaattaaaatattaagttggagtttgagaatatagagaaataatttggattatacgaagctgaagatttttgggtggccagaaacttgttgtacctatgagcattccgaccatgttgatgacggagtgggcgaaggagctggtcggcttgccatggtgaacggcctccacagccgcgaccctcccggcagccgcggcctccgtatgttcctcgccgcacttgcacggcttgccggcctcgacgtcgacgcaagcggcgtccccgccgccgccgcagcgcctggccgcggtgagccgctgcagcgcgagctgcgcgccgtggacgctctcgctcgccacctgcttcggcttggcgcacagcgacagcccgcaccaccacccgctcgccgccattgttcgctagctgccggagtgtgcgagctggagcttgttgctgctacgaactagaggtagcttgtttaggctttggctcttgctgcatagggatgccaagttcgtgcctatttatagtgtgctggagactggagtacgttgcaggaggctgcagggcaagttgggaggaggtcaggagggaagatggaatccatgagtgacaatgatgccactagctagtggtttcaggatttgggagcatacacaactacacaaacacaactacacaagtactcactctggattcagtgtaattggtggttactactactccgtagttggttagtttggttttcacggccagcatatatccacatcgatcccatccctcttccgttgaacacgtacgtcatacttatgatgtttcattaacctaaaccttagtgcatttgctagggtttaaatcttactgcttaacggatcagtgaccggtctatgtgtaaatataagcatgtcttaggctacgttcggttcggctcaacggctgagatgctttcccctttttttatgagaatgtttcctaaaatgttaaatggtgttttttttaaaaaaaaagatctagataaaagttactaaaaagatgaaataaataaaattttcaattaattatatgtttatggcttgttttatttcacgtgttgctgaatctcatattatcctctcattgtcttgtatatgctctaagcggttgcgagggagagggacggtaaaggacggacggtatcttggtgtggttaattggtgagtcgatgatggtaccactaaaacaacattaagggagatggtttgcggcgtggttaatcagtaggatgggtaggttgaaatattacaaagggaaccttgttgagaatatagacatataatgatttaatatattctatacataaatcatgacattacggacgtatactagcattaacgcatcattagatctacacatgtaaactaagcagtaaaacatgaacagatcaaatatgcgcaacatgtcgaacacgtactgaggtggcggaaagaccggttgctcggcaggaactactcgcggttgcgagcatcgacgaaggcgcgaagcacgcgagcggagagaaaggtgagccgtcgcggacgaacaaggagcagtcgcgcgaagcacttcccaaaaaccttattgtcgtcttctcccggtgcaggacgacgaaggcagaggtttcggagacctgctctcccgatcaccggtgcacgccggcgagcgggatggagtagtctacaagcgacggcgcagtacagagtaggaggcaaaccctagattgatttcgcgtgtgttgcgtgaaggcggcagctcggtttatatagagataggtcgcttgatcagggcgcccgcacgatctccactccgcgtaaccgaaccggataagccgcgcgtaacttatccggactccacgccgttttcacgcacaggatttttcggaatgtttccaacaacaaaacaaatccgaattttcctgcagcaaaacaaaaaagcaaaaggaggctgcatctgcgcaagggtgaggagctaattttgcggaccattcgacgcgtacgtcgtgcacgcgcgccgccggcccggcccggccaggcgagcgagcgagcacgcgcgtgtgttccccctcttctctccaccacacatgcttcaagtggctaggagggcatcctcccttttaaggaggtccccctctcctagaataagcaaggtggtactaaactccacatgcatgccatcccatgaggtgggtttttgtgattttccaaagaattaatcttcgaatgggccttagcccatctattaattccaacaatcccccaccaaatctcaaaatcccactgagatttgccttttccaatgtattgtttatataccagcagttcgatggagaccgattaaggttgaacaaccacctagaactccaagctacaattattcacaacttgaacaatggactacgccttgaattgcaagtcttgtgcaagcaagtttcactcaaagtcttatctggtactagaccgtctgtagactacccctcgggtggagcgtataagtcatactcttaggtctttagtaagcttcctagaagattcacccaaaatcttcatagactgcgaccaacagtcaagcttacaaaggtgagttctttcaagaatgctctgcaggacagcatcttcgctaattaaagccaacagaactcattaaggcatagccaacctgccttgcagctcacgagagtacatgcatcttcacttagagagggtatagattggtactctcctctagtttactaatggtttgttcttcccaggttctaattcacgggatctccgatcacatagactaggttaccaccatagtattactcacatgggtctcaaacccatctccttcaatgcattatctatcacatttcgtgatagtaccttcgtgaagggatctgccaggtttctagctgtttggatgtaatccaacgttataacttcggagtttctcaatttcctgacagacttcaatcgtcttttcacatgtctagacgatttcatattattcttagaactattcactttgacaattaccgtttgattgtcacagttcataaggatagccggcaccgggttttcaacaataggcaaatccattaatagatcacgcagccattctgcctcaacagtagcagtatccagtgccgccagttctgcttccatggttgacctcgtcaaaatagtctgtttgcaagacctccacgaaacagcaccaccacccagtgtgaagacatatccactagtggctttgatctcatccacatcagagatccagttagaatcactatatccctccagtatcacaggatacccagaatagtgaagccccaattccatagtacctttcagatagcgcattactcgctcaagcgcacgccagtgatcatctcccggattagaggtaaaccggctcaacttgctcacagcaaaggagatatcaggcctagttgcactagccaggtacatcagcgagccaatgatttgggagtattccagttgattcctagcaattctcttattcttgcgaagcaacaagctaggatcataaggtgttggagaaggcttactatcaaagtagccaaagcgattcaagatcttctccacataatgggactgcaagagtgtaatctcattctcacctctaattagtttaatgtttaagataacatcagctactcccaaatccttcatatcaaaattttgaaacaagaatgatttaacctcatttatcacctcaaggtttgtcccaaatatcagtatgtcatcaacatacaagcacagaataactccctcacccccaccatggcgatagtacacacatttatctgcctcattgacagcaaagcctgcagatgtcaatgttttgtcaaatttctcatgccattgcttaggagcttgtttcagaccatacaaagacttcaacaatttgcacactttgccttcttgaccttcaactacaaacccatcaggttgatccatatagatctcctcatccagctccattaagaaaagatgtcttaacgtctatttaatgaacgagaagaccatgtgaggctgctagggaaagtagcacacgaattgtggtcaatctagcaacaggtgagtaagtgtcaaagaaatcttcgccttctttctgagtatagcccttagcaacaagccgagccttgtacttttcaatagtaccgtcaggcctgagcttcttcttgaacacccacttgcaccccacaggtttacacccatagggtcgctctgtcacctcccaagtcccgttagcgataatggaatccatttcactatggacagcctccttccagtagtctgcatcaggagatgcgtatgcttctgaaattgacttaggagtgtcatccacgaggtacacagtgaaatcatcaccaaaagacttagtcgtcctttgtctcttgctccttcgaggagcttcactgtcatcctcctcagtgacatgttcatgtgtatgttcagtttgttctggtggtgtgattgaactgggaattattttagagggttggctagaactactatgtgtatccttcattgggaaaaagctctcaaagaaggttgcatcacgagactccataattgtaccaacatgcatgtcaggtacctcagatttaactattaaaaatctataggcaatgctgtggtgagcatatcccagaaagatacagtctacagtcttaggtccaagtttgctcttcttcgttattggtacattgactttcgccaagcacccccatgtgcgcaagtaagaaagtgatggttttctcccaatccatatctcatatggtgttttgtccttatttctgttaggaactctgtttaacacatgattcgaggtcaacaatgcctccccccaccatgccttaggtagtccgcggtgtccaacatggcattcaccaagtcagtcagtgtgcggttcttcctttcagcaatcccattagactcgggagaatagggaggcgtcctctcatgtataatgccatgttcctcacagaataagtcaaactcgtttgagaaaaactccccaccacgatcagacctaagtctttttatctttctgtcaagttgattttcaacttctgccttataaattttaaaatagtctagagcctcgtctttcgttttcaacaagtacacatagcaaaatctagtagcatcatcaatcaacgtcatgaaatatcgtttttcacccttcgtcaacaccccattcatttcacagagatctgagtgtaggagttctagaggtgccaagtttctctcctcagcagccttgtgaggcttgcgaggttgctttgattgtacacaactatggcagttagaacctttgacaatggaaaacttaagaattaaacacatgctggaaagccgagacatcaagccaaaattaatatgacataaacgtgagtgccatacattagcctcatcatccacactgccacaaatatggttcacagacttattgcagaaatcagaaagggaaaagcggaacaggcctccgcactcataacctttaccaataaaatatccatgtttagacacgactactttattagactcaaaaaccaacttaaatccgtctctagtcagacgggagccactaacaagattcctgtcgatagaagggacatgctgcacgttcttcagctgcacgatccttcgcgaaataaacttcagatctaccgtgccaacaccatgaacagaagcatgtgacccattccccattaggacggtgaaaccccgtgcgacctgataagaagaaaacaatgagatgtcagcacaaacatgtacattggcccctgtatcaatccaccaattagtagactgattaactgaaaaaatagtaggtaaattaccatacccgcttccatctccagtgttgccaatggtcacattagcagacttagagatctaccctgcaggtgccttcatccccttgcgttgtggacacttcctggcgagatggccaggttgaccacacacaaagcaagtcctctcatcctgattaggattgttgttgttgttcttcttcttgaagttggtggtctgctgagctttgtatttccccttgctcttgttctgggccttgtgcacaacattggcagtggactgcccaccatcgcccttagacgtggcatcttttttctgagctttctcctcaacatcaagagacgctatcaacccctcaacggagtattcctgtctcttgtgtttgagtgcagtaccgaaacctctccaagatggaggtagtttcgcaataatgcacccggccacaaatttgtcgggtaagacacacttaaggagttcgagttccttagccatggtttgtatctcatgagcctgttcgactacagaacggttgtcagccatcttgtagtcatgaaactgctccatgatatacagatcattgctagcattagtagcatcgaatttagtattcagtgcatcccacaactccttagcgtcggtcatatgcatatacacctcgaccagacgatcgccaagcatgctaagaatgcatcccacaaagagagtagtggcctcatcgaattctttctgctgatcagcattaagaatgcccataggcttgctagtactcacccagaagcatttcatagctggcagccacagagtgaccctgatctgccatctcttaaagtgcacaccggtaaatttattcggcctcagtgcatcggcaaaaccagccatagtaaaatcacagcgcctataataaggtttttggattgttgagaatataggcatataatgatttaatatattccataaataaatcatgacattacagatgtatactagtattaacgcatcattagatctacacatgtaaactaagcagcaaaacatgaacagatcaaatatgcgcaacatgtcgaacacgtaccgaggtggcgaaagaccggttgctcggcaggaactactcgcggttgcgagcgttgacgaaggcgcgaagcacgtgagcggagaggaaggcgagccatcgcggacaaacagggagtagtcgcgcgaagcgcttcccaaaaaccttattgccgccttctcccggtgcaagacgacgaaggcagaggctccggagacatgctctccggattgccggtgcacgccggcgagcgggatggagtagtctacgagcgacgggcagtacatagtaggaggcaaaccctagattgatttcgtgtgagttgcgtgaaggccgcggctcggtttatatagagataggtcgcttgatcagggcgcccgcacgatctccactccgcgtaaccgaaccggataagccgcgcgtaacttatccggactccacgccgttttcacgcacatgattttttggaatgtttccaacaacaaaacaaatccgaatttttctgcagcaaaacaaaactgcaaaaggaggctgcatctgcgcaagggtgaggagccaattttgcggaccattcgacgcgtacgttgtgcacgcacgccgcctacccggcccgacgaggcgagcgagcgagcgagcgcgtgtgttccccctcttctctccaccatacatgcttcaagtggctaggagggcatcctcccttctaaggaggtcccgctctcctagaataagcaaggtggtagtaaactccacatgcatgccatcccatgaggtgggtttttgtgattttccaaagaattaatcttcgaatgggccttagcccatctattaattccaacaaacctagcaaatggaccaggtatcatcaatctcagtccaatctatttaatttaaaatataaaactattttaaaagtaaaataggtaaacattttctaataatggataaaccatccaagacaatagctagagctcaaaggcatattagtacaatagcctaggctgtgtttttttcccatgggttctgacccatttccctcgtttttcgcgtgcacgtttttcaagctgctaaacggtacgcgttttgcgaaaagtttatatcggaaagttgttttaaaaaaatcatattaatctattttcaaatcttttatagttaatacttaattaatcttgtgttaatctatcgcttcgtttttcgtgtggagggaagggttctcaaccctccaaaagaacatagccggggataaataaagggctggttcactttgctattattttcaaccttaccaagttttggcattgccaaattttagtaaggttgccaaaattttggcaaaatttcatatgtatttactaaaatttagcaataaattaaatgtagccactttttttaactttgccaaaaaaaaaaggtaagattgaaaatggtagcaaagtgaacaagcccaaagcaacaggttcttagcaagataatcaaacacccagtctcaatttacacagtccggcctgttgctagaccattgttcgtataaatgctatatgcgccataaattcaacgattatcttgggataaatttgtatcttgagatgcaattggaatggtgacatggccggatattggcgctacgtgtgtgaggtgtaaacgtgtgagcttggattcagatacgccaggaatcgatccaacatagctaggatagagagctggtgatcgatcgatctctttagtgatggcgtatgaatcatgtggtcataatggaattggaggcggcatggcatacaacaccagttgcatacatatatacgcagtataatcaatttgtggaatcatattccacggagccaacgagcaaaggtacgattataagctattgtggtccgtttgttctagcaatgtggccaaaagggcatgggggatgagattaaccacttcattctagtgggagagagaggggcaagatcaattcaaaaaaatgtattgatagtcctagcccgggtagtacacatatataactagatgaataccccgctgcattgttgcgggaaattaagttgcataatatatacaagtaagataaaatatgaattaaaactaaaacaaattaattgatactcatgaattttgaggcctaaaaatgattgagattacttggtgttatgtgagaaaaaagaagagataatttgaaccatagatctatcatccaatggctacaaataattagggtgatgtggtttaacgagagaagagaaaaatagtattaaccacacttagtggggatgaactatataagtacataggattagggattggctgggtgggtggattgagaataaaatactggatcgtggtcacacacatacgaagtggcggacgatctcctacatggtagaaatgtgtaaggaatgagacgtttgaggaggacggcgcttttaaaatagttatagagatattttgcatgtctaatatatatgccttacatatttattgggataacacatatcacaatacatgacatatgacatatgtacgcatataatgatgatgcacatacacacgtttgtgtgattatacatgtctagcgcacggttgacacatgtcaaggcccatgttctgccacgtgtgtttgattatcgatgccggctacttgccctgtatccgttggaaatgcgattgtttttttaaaaaaaatttatgacactatagttttaaataaataatact

SEQ ID NO: 42374 - DNA, 8251 bp, Oryza sativa
  unsure (1)..(8251): unsure at all n locations
ttgtatttgtattttgtattatttattcatacagttgaaagaaatctttatgtataaatgtgaggacaatattaatgaatatcaatagaactcttactaggacaagagtgttataagggagtttaacggcctatttttttttcctgattccatcttttggatttttgtttgcacgctccacgctttccaagttcctaaatggtgcttttttaaacaacttgttaactttctagaagttaattcattcatttataatctcaaatagctatcatataaataagataattcatcaattttagttgtcgtaaaccctaagtagtatatttttttttcatgcgagtcatggtgatcaacatataatcaagatcgtaagatgaatctgtaacaggtactgtaacgccccaggtagccacgtacctggagtgccacactaaaaaaacactcaaaccactaactttcaaaattagaaatttcagcagagtctcccctgtaaatacggacatccacgataggcaactgtaagttaaactaataacaatatcattcccacaatacgatccatccttataattcatggggaagaaactattagaaatctaaaagattattacaagaccaaaccaggatataatttaagtgtcattatggacctaagcaatatagtttgatagtgtgaaagtggatgtgtatataagggtgctacttcccgcccatgcatgtcggtctcaatatgtacctaaaaccaaataaaacacaagagtgagtataaaaatactcagcaagtacaatatggaactagaaaacacatatacacaatattggcaataaagcatgaacagaagtctttctttcgttgatacaccaagtcaaagaagatagtagttcccatctcgggcaggcatgaattgaaatagtagtttccatcccggacaatagtgaatacatcctagcatttgccggcaaagccgagtaagcgtgatcagcgcttacccataggaaattgaataaagaaccaaattgcactcccatgactacgcatggtacttgaataattgaaaccggaatcaaagaaccaaattgaaaccatattgcacatccatggcaagcagggaacttgaattatttatgcagaaccagaatccggaatattgaaacaagaataacgtcgtaaacataggataaacatgaaaacctaaatggcacgaacaacaatatgaatataagtggtcacatgtcacatagaaatatatctaaaataaatagatagagcaaacaatccatgaattacacaattagttcgtcatgcacttgcctccaatgaatggttggtatcatgcatgatctgaagtaccaccacctaatcacaaacaaaatctcagcaaacacattcaaacatgcgtataaaacaatgaaaaaaagtgaacctactgccctatcccatcacaacgcaataacaaggaacgccgcttggactataaacaagactgctgcttcaaacctttatatcttgaaatatgaaatggctatgaccgcaaataaatacattttggaaatctgaagaacaaggcctacaactcttatgtgaaatcatatttttattatgccatttaaatggtctaattagcgcttgaaagcaggcttcagaatctgtccagaatttcagactgtccacactaaaacaaccataactagagttctactcgcccaatcaaagtgtactttaccaatatggaaagctaagaaaaacctctacaactttgtctagaggcggcccaactgattccgctgtttagcccctgcaaaaacagtttttcaaaggatttttaagataccttaagaaaaatagaacccttaaattattacaaaataacattatccgaactttagtttttccttaatctatgagacaaaatttttgaacaaagaatacaaatcttacttttcaataatataagtgcccgcgcatgcgcgcgggccaccttcctagttataataaattttggctagaaaatatgagtatgacgcgtgtgccaaaatactaataaaatatgacttaacccaattatgacatttaatcaaacactaacctaataaattgtgacacgactaaggtttggtgtgcaaactgtagccaccaaccaaacatacccttaggcctatgggtccatgggtcctaaccaattaccatccttagttaggggatacatacgggggtgtgagtataatgttgtggctgtattggtatgtcgattttgctatacatcactcgggttattctttgcatgatatttgacgttttttctcgctgctattatctccagggtggggtggggcccatacggccaggataaagcaatgcatgcaactccagtgggatcattagaatccgattttgctatagcttttgcgattttgctatacatcactcgggtgattctttgcctgatatttgacgttttttctcgctgctagtatgtctgcgtgtgcctgccgtgcattcgaattttttttttgaaaacccagaaaaaatcgatttattttttcttgtgctcccaacggagcggaagctagaaatgaaatgccagcccagaaaaccaggtgggcttatccagagcccacgaaccggcccatattcctttcctttccccgccccggccgccgcttgcaaggtcgccgccgacgacgcgcggagaggagaggagaggagagaggaagagaaaatcttccgattccggcgaggaggggatggggtcggcgctgctgccgacgctgcggcggaagccggaggtggacgccgccatccgcgacacgctcgacaaggtcctcgtcctccgcttcggccgcgccgacgacgccgcctgcctccacctcgacgacatcgtgagcgaacctctccttttccctgtcgattccacgcgatgcgattgccgcttgctatgggggattgattggttcatctgctcgtgcagtaggtttttaggccgcccatggtcctggaagatttttgcttgctcgaacagtattatttacttgtgggaggctggtaaacctagcagagctagaaacgaaatcgacctacaattatgcatgtctgttagttacaactattgatggaatgaattggaagcatgtgaatggagaggaaaagagagcggtgcatatccttgttaggtattgttcgtttaatcccccatcctatgggactgaggggggatttggaggggattaattgcaaacctattatggtgtggaattattcccctcatttctctccaatccctttctcatggggactaaacggacaaagccttattgttccagtcttacactatggggtgggatagtgtgtgcaaatttgttatcaatccttttatttacaaaaaaaaaagagaagaaaatgtatatgggagttgcatggcttctgcgtgctggttaattatatttccctgtttttccttttttaacagctcgctaaatcttcttgggacatatcaaggtttgcgacggtagcattggtcgatatggattctgaggagatgcaagtctacattgactatttcgatatcactttggttccagctaccatttttttcttcaatgcccaacacatgaagatggactcagggtataagtttgttgttttgtgtttaccttagtggtggtataatgttatttggatcattggatgtggccttattttcaacttgcttgagttccttaccatcgttcaagtcttgtctcttaaattctagtagtccaccgtgaacataatttcttatcagctatttatgtacactatactatcgctgcagttactaatacttggttttcacatgtcatccataagtcatatcaacaaaggttgaaaaattagtttatactctactctataaatttatgttgaaagtgctagcttcaggaatagctatggacaaaattataaatagtatgaatttataaaagggttactggtcagcaaaaagactcagtggaacatatcgagcgaagagtaagaatcaaccagtgtctccttgcttcagtaattaagctctactttagcgtgattactgatgaccaagactttttgaagttataggaaaattttttgagatcttaagatctattaacaaaaatatgagctacagttttttttgtaagttttaatgctctatgggaattgtgtggtgaacctaaatgacaccgtgaacatgtatttctttctaaaatttgaatatgcttgttagaaaaaaatgaaagctactgacttcggagttttgatgaatatttctgcttccttttttaaagtcaactttaagtagtactctaactcttcttttttattatgaaacgtatggaattaaattttgtgaaaacaagtgaataatgaaataatggctgcaattcagaacaaattcagttcctttgagtcaattcttaaagaatgttgttttctttgatattgagtgatatgcaccaacaaaaatatttttctcattgcacttttcttattagttgttttagggtgtactatagctgcatcacaaatatgccaaacttattgtaatgtatatacgcaggacacctgatcacacaaaatggattggctctttcagcagcaagcaagatttcattgatgtagttgaggtgagtgggccaataagcttttcatgggattaagatttaagaacaacctttttctttgtcaattgaccaatgttgtaaatctcgactttgcttttttccttctactttgtcatcccggtccaggttaggccaaaaaaaaaatgtgatggcgtatgaatgaggccaataaattaatagttgtgaaatttactttatcttcaaaatgattcatagagtacataactaaagaatatgggaaacaataatggacatctataaggtgaaggaaaattgagatggttcactctaggggaatcaatttgtggttgttctaggaggccaaattttctttgactgcctttcgggtcacctcagtactggttattccaggatgccccctttacctgcccaagataattcacaaacctttgaaagttttaatttggtctcttgatcttttattctttagaatgttcttgtttatagcagtccacaaggcctaaggtacaaccatacagcagttagatgtatgctttggtttgtacttgttcaccaggaaggtcatgatgtgccatagtgaacaatttggcaagggtatggattgctttctgtctgaaagcaatggccagttacaatacagcaagtggtccagcattcccttctgttttatgaaaactacaactcttagatcctttcagatctcatgtgtcatgtgagatctatattcagcactgtctgttttggagccggaggaatattttctcactgtagcgtatcttttggtacgattttcctgttcttgtaatccttacattttaaagtagttcagcagataaactgtcaattttaacaccgctatcatatgggatttatcatcatctgtgccattcctctccactaattcagctaagtcaattaatcgcagctgtgctgtcttgacgattgacatttatgaagttcaactcctgcttaatttagcagtttattggttcatgaataacatgttaaaacagtagttcacttctgccttctgatatcttaatggcaggcaatatttaggggtgcgatgaaaggtaaactgattgtttcttgcccacttccaccagagaggatacccaaattccagctccttttcaaggatgtttgagcaaggaaagtgctcatcacatgcgcatgctaaaagagtgtcttggtcatggtaagcaaagtaaaaacatgcgacaattatttaagtataaacaaccacctttgctaactacctttgtgcttacttttgcacttatgtgcgacagatgacagaactatatgaagctatgttcaggcagaagagtttgtgaagatctcgtctctccaattggtttgtctcgactactttcatttatgtagtagtatatcacatgctgtgttgatatgtaccaggcatggtagcttttgttctgtacttctataggaggcaaactgaatcgatcaagaaaagtgcatatctgacatggtgccgcatagtaagcttttagtaattaacacaagttagaatgacactttgcatgtagtttgcattgcactctaaatacagagaagggtataaaatattattgctcgttaattgtgaggtggtaaatcaataatccattttacatgttccccagactatccatttcaaagataccgggagtctgggagacatttctggtctggaataatgtgtgagctatacctgaaaaggtgctaaacacatctcctggagcctagaaacctcagtttccgaggcaactgaatcataaccactgcaacaaataaattatacagtgaaagaattgcaccgtatgcaccacctgtaattccttccctccatctaaaactcaggcctcgaatctaatctctaactcatccttgtcaaccatgaggtagtgagaccctctgtcgatcaccttcttgccgtctttccttaccctgctgaagtgctcacatgggctgatgtcaaacctgatgttggccttctcccctaccttgagatgctggctcctgaaaccgatcagctgggttgtcgggcggccgcccttagcattcggccaccggaggtacatgagcacagagtgcttgccatccatggggccatggttctgcacctccacaaccgccgggaacttgagctgctcacagccgtcagtgccgatctcttcaatgtggtagctctcatcaccttctgatgttgttgttgtcctcagactagcaagtaggttggtgtaggactctgctggcttaccaccagagaccagctgacgtgagtagctggagtagctgagaccgtagccgaacttgtagacggtcttgccctggtagaagcgatagctccggccagggtagccggtggctgggtcggcacgcatccgcatgtccgtcatgggcaccttggtgaactcttctgggtaccatgtcactggcagcctcccaccggggttgtggtcaccgaagagcaccctggcgatggcgagaccaccagcttgccctgggtaaccagcccacaggatggcgccgatctttgggttcgtctgcgcgaacgtgacgtccaccgggccaccggtgaggagcaccaggatcacagggcgcttcgccgcgtcggctacggcggtgatgaggctttgctgctccccggggagcaacaggcttgtcctgtcgcgcccttcgctctcctgcttctggctgagccccatgaacaggaagacataatccgaagagctcgctaccgcagcagcttggtccgtggcggctacgtcgcaggccgccgaattgcaaccagcgaggaacctcacgttcttgatgtaccccagtatgccgttgagcggcgtcgtcgattcacacggcgggccgaaatagttgccgatgagggccaggccatcattggcattggggccaatgactgccgcggaggccaccgccgtccggtcgagcgggaggatgccggcgtcgttcttgagcaagacaatgccgtccatcgccgcctcgagcgcgaggctcctgtgctccggtgtgcagatgtcggcagccccgagcccgccgtacacgctgttgctcctgggatcgccgtcgaagtgcccgagccgcatccggatggcgaagaggttcttgagcgccttgtcgatgtcctcctccgtcagcttcccctgctggatcgccgccgtggcgtgctgctgcatgtaggtgccacagttcatgtccaatcctgaaattcccaaatcacttaaaattaatccaaatctgtccaagttatttttggaacaattaagcttctgatgaaccgaattgtttctctgtccaattggcgttggttaaatgaatcagtccagctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggtgca

SEQ ID NO: 42375 - DNA, 1931 bp, Oryza sativa
tatgccccgcatagataaacatcttatttagttgatagtcaaccattatatttgaatcaaagcgagtttgatttccctaatttgtatataaccaacacttaacagcgatgggtgcctcttcctccccctcccccttcctctcagtatccataaggaaatagcgtgggcgacaaggaggcaggcaagctatcggttctaatttagaaccgacacctatagggtatacccattattttgtaaatacacctaaaccctaagccctccactcaaagcctccctactatctcacctagctaacacttattgtcttggaagcaaacattattcttttgagactactcttatctaaaacttatattacatatttagcaccatatatgagctaaaatgaaaacattgttaactacaaaatttcagatctcatagagatctacaagtatcatatagatcttgtctccattcgtgatggcaatgaggtacccaatcttctatcaggtgaagataactagataactatcgatttggcgaaaacttgacaccaatgatccggcctctgatcaacacgatctgaaccatgcaatcgcaaaaccacatctcctctggttttcatgtatttcttacattcacagataaaatctacaagcgcacggatataccgctgtagcacttcacctgaaaatattccagggtatcgaatttccacagggaacttctgtgtgtagcttttctctatgttcatccaaagacacaatataaatgtaggccaaaggatagagatgatcttctaatatggttattagagagtcgtttagaaagcttaactttaataattcctatcgcttcaagcactggcttgctcgctattaccagaacgcgctctactccgtacacgggcatagaggactacggtgatctcgagggctgtcaccacctctataccaacctctaacgtactgtaggatacacaacaaacactagtaattaactatctagacaccacgtctatacaattaattactactctaatattagctaaacactgaagtaatcgctattaaaatgtgaaaacccggttttaaacgaagaagcaccaccgataaggacattaaggacgttacggacgtggtgctctgtactagtgcaacgatgggcacaagaagacgatgtaaaatattgtaatgttgaatgcaatcaattagcagcgcgcggatagaaattatgttctacattaaggctgtgttcgtgggaacctcactccctagcacgtaaaacaaaccagcatttatctcataattaatcaagtattagctaaaataaatttaaaaaatagattaatatgattttttaaagtaactttcgtatataaaatgtttgcaaaaaactcaccgtttagtagtttaaaaagcgtgcgtacggaaaacaagggaggtgagttgagaaaatggaaataagaactcagcctaattggtggatgaagaattgaaatttctttccatttgtgatagatttgtggtttaaaaggtgatatttgacgggtgggtgcgatatagtccaataactttagaattgaacgtttgagtgcaacaacttgataagtgggtgcgttctatgacaagaacatggcaatttagtattttggtgcatcaacttagctaagcatatgctaggtgagtttttctcgcgatgtcaatataccattacataacaatcctacggatattaccttataatattgaatttagagtaaagtccatcaccggtccctaaacttgtaccgatgtgtcatcccggtccccaaactcgcaaatcgaccattcaggtcgtcaaacttgttcgactgtgtcatcccggtccctaaacttgcagatcactcgtttttgtcctccaacttattcagttgtgtctccccggtccctaaataagacggtcta

SEQ ID NO: 42376 - DNA, 1488 bp, Oryza sativa
attcctgcagccctgggacaaaaaatgacttataataaaaaaaattcaactataaagttgtagatcgcgtcgagggctagaagtttgatataaagtttgtttcattagagttcacatgaaaaagttatgaattatttttaaatataaagtctttagaccgtcctatttgacccagataatattcaaatccaagtttagggaccagggtgacacaactgaacaagttggaggacctaaacaagtgatctgcaagtttagggaccggaatgacacagtcaaacaagtttgaggacctaaacggtcgatttgcgagtttagggaccgggatgacacaacggtagaagtttagggaccggtgatggactttactcttgaatttaatctttaagaattatactgcacatccaattacctttaagaatttttgttttcttcaccttcccgaatctcaaccaaaatataataattactacatccattttaattaactttcagttgttagttattaggataaaaatataaatatgcttatatacaaatccacactagtatattgctaaaataagtacatgaaaattgaatatgtataaaaaagtgatccaaataattaagttgtcgtataacttcttaacttattgtaccaaatcgtacgtatcttgcaaattgttgtatttatgcgatcacttataaagctcttgtactaaattgcacccatctgccaagttattgtactggaacgctcatttctcaagttcttgcaccaaattgcacccatctgctaagttgatgcaccgtgggtgcaatttactcaataaattagcttttcatctgcccaaaatgtgaatgcaggatgaatgccattatcccattgcccattattgccctactcaacgattttaatagcgcaatcagtgatcatgcatgaaatatatagttacagttagtcatcactacttttttccaggcagcccaatcatattctcgcaggcgggcaagccttccgcctgcacctcaacacctgtgaaaatagttgattttcgcaggcgcaaaacacgtccgcctgtgaaaatagcttcgggcgctaaaaaaaaaaggcagccaccgccgtttccggcggtagcttcccgttcccaattcagttcccacccattccctatccaatccagtgaatccaaattcaacagagaaatcgccagtttatccagttcatccaaaatcaccaaatcaatactagcaaagaaaaaaaataaaaacattcctaaaataaatcacggccccgccctgccatcatctgccgccgcacgtccgcgccgcgccatagtccgccgccgctgccgccctcccccggtctccctccagccggatctgggagaggaggggaggggaaccgcgccggtcgccgtcgtcgtcaccgccgccgccctcccgggcctccctccggctgaatctgggaggggagtggaggggaaccgcgccggtcgccgtcgt

SEQ ID NO: 42377 - DNA, 5392 bp, Oryza sativa
gtgggggctgggacggcctggtaggagagagagtgtgtgttgattgggaagtagtggggagggggtggaggccgagaagataagtactagtactacttaagatttttttggtaggaacaatttttgcagtcggaccacataaggttcgcctacaaaaatatattttcgtaagcgtcgcttaagtggtccgcctgcgaaaattattttcgcaggcgccgcttaagtggtccgtctgcgaaaatagaggaactttaccccgatttatatttttgtaggcggtcatttggctctaaaggtcatgtccgcctgcgaaaaaaagacccccacgtcaggaaaaatgctttttctagtagtgcatgataagttggatattcttccagaagaaaagggaaaaaaaagacagcaagtcatgcatgtattcatacctcctgggtcttacttttctgtacgaccattatacacacaattaatatttatactagacactatgttacgttaacctcactgcacgattcacgggaacatacttagctcctgcataaatactcctgattcatgcattattctactttcggtgattcgtgaattagttcctgggagaattagttttggtactagttgatatttttctttgcattgttctcggaggaaaaaaattgttgattttttatttgactacggaatgaaaaattttcactacatattctactttcggtggtctgatcgatcgtatggtaatcagctcagaactggccggtagtaccaatcgaagacaatatctatcggatctagtattagtccgagaataatttatactttacttacagacaaagttcttgaaacggtttgatatttttttccgagaaacactatagtttgatttgatttgaaaatgtactcagcaagctatgtcaacatttgtaagaattttgtaacaaaacttttgtatgtacatatcattttccttgtacttttgatcatgcatgcatgtagattaattggacggaaaaatatgtagtgcaaaccacatatgtagtggaaacttggaaaactaccactgatggagaacccatttttactctcggttggtaacccctttagtcccgattttctaacggggagtagcaatccgggactaaagatagacatctttagtcccggttgaaataaccgagactaaagagagggatctttagtcctagttgctgttagtaaccgggagtaaagaggaatagcggcagtaccagatggcccacttttcttttctttttccttttttttctcccgaatcaagtggcatgtaaatccccaaatcaaaccccaaatccctgaatcaaagtagcatcccaaattcacatcaccaaatccacatcacaaatcttaaagttatttatacacataaatcaaatatatcacaaatcctaaaaaattacacacaaatcaaatacatcacagatcttaaaaagttacacacaaatcaaatacatcacagatccatacaataaatctcaaatttatacatccatgtgaatcacaaattatttaaaaaaacaaacaaagcccctgccgccgctcgccacggccgccgcctgcggccccgctgccgccggccgtcgggcacggccccgccggcctccgaccgcctgcccgccacggccgccgtcgggcgcgaccccgccggccaccggcccgacagatgggaaggggaggagggggaggaggaggaaggggaggaggtggaggagaggggatgaggaatagagggtagatctgatttgtaggagtggaggaggagaagggggagagattcgatctgtgagttgtgattgtggaggagagaataagggatagggattatatactaaacgttcaattttagtcccggttggtaaagtggtgagatcctcagcctcctgacatacatctaacagggaatgaaccgggactaaagatcatctttaaatccagttgagaaccccaaccgggactaacgatcataaaatagcgatagggttttcaaccgggactaaagatcatttttagtcccggttctttttggaaccgggagtattgtggttttgggtcgacccagcaaagatcatttctccaccagtgtaccgttggatcgagaaatggacatccgagattcgtctacgtcaccatgagttaaaatttaactcgcagattcactcatgagttaaaattttactgggagttaaattttaactcatagtgacgtggacgaatctcggacatcatttctgaatccaacggtagttttcaagtttccactacatgtgtggtttgcactagatattttccctgaaccacacgtattcaagtaatctccaactgttaaaaaaaactgtttattttttcccacaaaaaaatgtttgatgttttattgtcactaatggttgcaaataccaaccattggaggaaacaagaaatctgtaacggttggtaataaaatcccgttaggccttgtttagttaattctatctcatggggattgaagtggattcaaagggtaattgaagtggattccaaggggaatatttcctcatctattaaggtttgagaagcaacggtgcttcactgaagcagtttaatgttacaccaaatctgctgttgaaccactactaattacgcatacacactactccctccggctccatattaatttacatttcggccaaggttaaggtcagtctctgatagattacacgatcaataactttaaaaatatttagtttaaaggaactagaacaacatatataggtttgtcttttaaagtactataataaaagtaaacatgcatttatttattatatatattataatagaaaaataaggcaaagatgtattttgtagaccgtgtcattgtctaaaacgtcaattaaaataattaaaatgaaaccggagggagtaattaatttgtgccggtatattagatcgcaatctggcctgaatttacgaactccttgcagtgtctaaattaatgcagctttaccaaatagcttcagcaagatagtatactccctgcgtccaaaaatacagtttgttttagtttaagaatttgtcttaaaaaccgcaattttaagtaaagtccagtagaactctttaatactacgtacttcatcattttcttatgattttaatcatccaactaagtaccccatccttctattcactttctccctctcctaatttttttatcacattaatattggatatagtagtattttaacctcatgcttaatatgtttttacttcatccgtttctaaatatttgacaccgttgactttttagcacgtatttaaccattcgtcttatcaaaaacttttgggaaatatataaaactatatataaacatataagtatatttaacaatgaatcaaatgataggaaaagaactaataattacttattttttttaataaaacgaacggtcaaacatattttaaaaagccaacggcgtcaaatatttagaaacagaaggagcattatctaagggtgttatcggttgccgaaaagcttattataaaccgtaacgacttattaacgatcagaaaataatttatgtgtaaaactttaatatatgtgttctgtgacttaaagtcaatggtaaaaaagaaattgcgttaaaaatatctcaaaatcaacatcaaaattaagttgtagaattcaaatttgggctttggctttacctttttagccaaccgatggggctctaaaggtgggttacatattttaaaggaagtcaatgcttgtcaaaatttccgggtaaaagagattttaaaagagtttatccataaggcccaaaacgtgccgccaatcttaaccctagcccccactaccctatttgtcgcccaaacctgaactctcctgcatcggtggatctactctgcaggtggcgatgactcaacttctcctagtgttgtgttctggaggcagcagcggtggggagcgagagttgagggagagaggggagataatgagagagatggtgggctcgagatagaacgcgactagtaaagtacccaattgaaaaaaataaaagtaagagagagagaacatggctcgacggctcggctttatcagtgcaaggtctcttaaaaacccgcattgatgtgcctctgttaacatcagtgttgggtttcttaatgaaccgtactgatatttatttcattggtgccgggtttttttcagaacatgccgtactgattgtatcgtgtggggtatgacggatgggaaaccactatcagttctagatgtagttaaatcggcagtaatgacgttgcactgatgtgctgttttctggtaggtagtgatatttattcttgctgttacattattcccattgttaaatattagattctactatttttaggagaaagttgatttatttgaattatagatactttgcactaaaaaaaaccttatagatatattttttctctcatactattatggcacttttcaaaatgcctcataagagagtaggggaaacaaaacactttacaggactgcagaggtattttcgaaaatacctcataagttcctcttgctgaattgtctctatgaataaagaaacattttgaatagaaaggcattacataaaatgtcttgccttgcatcatgtgttattttttatgtttataagagagcaaagacatattaaattgtggtacaaaaatgtaaaaaaaaaacaaagtgaaaagagagaaaaaaaattatcccctacttccttgaactcaagacctcttgagtaaatcttctttatcttcaatgcaataacaatcccaacctcatgttattgcttatatataagtaatacaagtcacacacacatatatatatagacatgtggttgtatattaagattgtgaaaagtgtctctaccaaagttgttgacggcatgttcgtgagggccttcggccgaccctgccgaaacacattgcttagcattgagacgaggcatcaaagaggcggagtgtcgaagtagcgtggcatcaagctgaagcggagccaagaccccctgttgaagggggcaaagcaaagaaccttcgcccgaaggcgaaggaggtcgaagcccaaccagactagacttcttgggaggatggcccattaggtggctcaggagggaaactatagggcgcagaaactgggtagatgggcgaattgtctatgattacccttgtaaacgtcccaattacaagggcggtcatgtatattccccagtacatgagaaccctagggttgtgtaaacttgtactgtgaaacctataaatagaccgcaaggttgtgaaacaggggatcgataaattttgagcattaatacatttaatccaccttcatacctttttgagtgaagcctgtcttccgaca

SEQ ID NO: 42378 - DNA, 2394 bp, Oryza sativa
ccacttatccaaaaatataaagcataacactttttaatcatgttccgtaatatataatattgggtgtgcatacataaatgtaattaactagcacttcctactctcttttattttattttttgaaatctttcgccttcaaaatctctaattctattaggtacctttaaccgtgaaattcggtaagcaccgaattcatcattggcctagagtcagtatcagcttcagagtcctgtaatcgaccgttggaaattatcaagttgccaatagtcggattcttgctatattcggttaaaaaaattaatctattcaaggaaacttatccagaaaagacaaagttcaaggaggatgcggtatggcaagttatctactaattatgaagagtatgttagtttccttttatcgttaggaaagcgtgtttagtgtccccaataaagactttatggttttcttttatcttgaggaaagtttctttcttgtccaataagaactcgtatctacccatcggtataaatatgtacacccgtggtcattgtaaactatctcaacgatcaatacaactactctcaccgcatcgccgccccctttaccgaggttttcacttatcatccggcaaaacttggcacctaacatgaggctgcatcggctttcgatctccggcgaagcggtaagtcctatgttttgctggcccttgcaattgtattggtttcatcggcgtcgttcaaggctgcatcagtacattcgacctcttggatcgctctggttcggttgatatatttacctacctatttatcacataactttgttaatttagtttggtagcttgatttacttgtatcggctgagattcgctttagggtttataccggtatcggctaaatcgctttgccagattaaattagctaaggtatccaccaccccaaaaatcagtcaaaggcttggttgcctagatattatgtttcttttcatacttagtgatgcatcagttaagtttgatctactaggtcaagtttagaaccataatctctagcatgtttcttgattgccaataagggtttcattggagtttcagctgatgagttatctggacattgcatcggcttataaggattacatacaagttggatttagccgatcgcgataaaggtttcactgtttattctatcgtggatttaatgacatcggacctccaaccgatatatgctttaccttcgaatcagtgcttattccattatatcattattagccgattggtttctactagattatatgattgttatattacattattatcagccgattgtctttgtatcattatctacattggatatataaccgattacttaaaaccctgtcactatcggctagtatcggcatcggctggaactactccatcggcttgtcagtcgatcggctcattgatctactatttgcatatcttgtcggttgcagaatcaaactgactggcacgcccgtatctcatcaacctttggacctgcactggagctaaacacatctcccaggccgttgtattcgtcaacttagttcgtgccaacacagtcccggcaccatcggccgagcgcggatttctcgtcaacaggtatatgcattgtatttattgaagtgatctaagtaagtaaggatgtgataataattgttttttagtctttgcgttggagatggatattccttatattttgggatggaggcaataatcgtcaatattgaccaacgatttggcaactataatcactaataaattttaaatgattagatgataaacaaagtttaatacttaatgtaatacacttcgataagatgaaatttatttaagtatttagtttttttttgaaaaaatatgaataataaagtttaaatttgaatagtgctaagtgacaagtataaggaaaggagggagtattagaacataaaagtcgagaattttctaatgcagcaagcaaaaatgacataatcagtacgccatgatcgtgagtcatgagaactttattacggaaaatgcggatcgaatttgcacgatattttgcaatagaagataactctcgtggagcaatccgatgaaaagcacacgcaataaaatgttgtgttgaatgaataaattggttggagtaatgcgaagaaccgtagcattcatgattaatatagaataaattagaagaaatatacgagataacctagattcaggagattcgaacgcggccagagcttcactcctgtcagcagcatttcagctgagccattcttaaatcaagttgcaggtagcagccttctttcagctaagccattcttaaatcagattgtgttgcactgtaacgattgatttttaagttgttgtagtgtattgcgccggcccgtcaaattattacacaaccataaaca

SEQ ID NO: 42379 - DNA, 4726 bp, Oryza sativa
tatcctagtacaagataagatatattgtggggatggtaaacaacaactacgagggtataagctttagggtataagctttattagcactttatgataggtcccatcttttttttaattgtggcatgacttatgttcgaagatgtttttagatgcgtcttactctattacctactctacacatacatacattatggtctctctaacctactattaccacctgacacgagcccaccttattactatacgtagttttgcaataaacattacggatgccctaagagttttgatgcaccgatcatctgatttaaatctgatataggttttaataggcaaacaatattatattgggagtgtcatatggtgacatatttattatgggagtgtcgattttatttggagctagtgctctatgttggtcaatttagcattgtcgtaatggtatagtttttaaccataaaaaatgcctaacatcatacaggttatcttcatgtgttccaattggcttcactcttggtgtatgatgctttcacaggaacaacaggaaactatgcgtaatggtgctacacgcttgaaattgatagccaaggaacttttattccagtttggatgacgtagtacctacaaaatttcacgatagaatctacatgattttaaaaacattattttagtagatcatattattggcagaagttgagggtttgtctcatctcgcctttttaagctcttttcttttcacttctggactttttggctgtgtgcttacggacagaggccagagatgtaacccatttccattatctaaaatatttattatgggattgctaaatcgcattcccaaaaacttgggagggggggatttctttcaggtttcgagccctacaattttctttgcaattcttgctcctacgaccctttctcccccacttccagcgatgccaacttagggttctaggttgcttataggggtaggaggggtgaggagagggggaagagagggagatcgtcatcgccaggcttagagggatgacgatgggaagtgtatacatgtgggcaatggggcgccaacaacggcatcggaaccatgaggatagaggagagtggtaggttagcattggtggtaggggcaaaacgaacttgtagttacaaggtgtcgaccaaggacagtggacccaacaggatagggcacctctctgtcaccggcttgaggaggaggaaggagaagagacggcaagggggcacttgccagcgccattggcaccttctagccagctgccaaggctgggcggtggtgtcctagggtgggaggttgtagaggtggtgacatcgatacccacattgagaagaggacgggaagggggaaataaggttcagttgttgtatagcatgagtctcaaacaaatctgtgacgtccaaaaagtgactgagatcagagaggtttttctatcatatatgatattcactccatcgtaaaaggaactaactgctggatctgaatctgcattattttcagctagaaatttgtttttacagaggatgcagatagtccttatttatttataattttcagtcaattttacactggccattctaaggctatgttcatcacgaactttttccaacttatattctctcgttgcccccacgcacacttctcgaactactaaaaggggtgttttttagaaaaaaaaatatctataaaatagtttctttaaaatcatatcaatatatttttaatgttctttttgttaatacttaattaatccatacgctaagaacataagagaatccacaatatgctaaatagtgttgttgtaattcgatatcgtagaggtaggtagtaaagtggatagtaataatatcaagtagtagtctaccaaacaataattactaaacaaatattaatctctcctctctcttctccatccattcatcatatcttactatataaagttgatgctcactaactactaaagtttaacatgcaagtgggccacatcatcacccatagcaattattatctagattatcttaaatcatatgcaagtatgccacatcatcacccactagcaactattttctagattattttaaagagtaaaataaatggcaggttcttaaacttgagctcacttagtccgtaaacttgaaaattgcacattaaggttcatgatcttgttttaataaaccatagccggtctaaagcgcgtttgaccagagctgaccatctatgtggctctccacataggcagcattttgcatctagccccctccgcatctcgacgtgcccgtaaatttgtacttactccctgttgcaatagtagtcgccgaaatccccccaaatcccttcgtccctttgcattccttatgatcgccatcatcatcctcgccctacttaggcctctccctcagaagtgcttggcggatgcaaagggacgaagggatttggaatattttgggggatttcaatgactactgtagcaatagggggtaatagggggtaaatacaaaattaccaccacgtcaagatgtggagggggctagatacaaaatgttatctacgtggagcaccacgtaggcggcaactatgatcaaacacactttggaccggctatgctttattaaagcaagttcatgggcctcaatgtacaattttcaagcttacggacctccccctcgctatgttaagcctccatgcgtggttacaacatgtccctctatttaagaggaatccgaggatagagtccgagtcttactctattttaaccgactttatacatatattcgatacaaactctaaccgcttgcgtaacatcttcctcatgtgtggatgcaagtccatagtgctgcaaattacatttacacagagaatgttgaagaaacaaacattttcaaacccgaaaagaaaaaatcagaattttgtactactgctactgctagtactgacccaggaattcgtatcgcacggatgagcttggagacgaggccatcggtgacgggaggtggcttgtggaccttgaggcgagtccccatccggacgaggtcaaccttgttgcagaactccctgacgaagtcctgcggcttcttgatgggcattgccgtcgtcctggcaatggcactgcctcctggcggccttctgctcccggctcttgacagcccagtcctcgttcaccttcctcttcctcagcactgtctcctgcacgtacagcagctgatgcgtccccttctctgccatcatcgctgagcgagcgaggaagccgggaagggtcgccggagccgaagtcgcagcgttgggcgtttggttagctcggtggttggagaggaagactgagcgatttaggtcgtgatttcctcttgggtcattggcctcttcacaaggccgcaaaaggcataactcaacccgaggtggggcaggaatctttgggttgctaacagatactgtctccataaagaatatctaatctaatctaatttagcctacttcgataaaatgagtaactttccgatcgtcactcttggctttttttttctctctgttcgcgagtccagccacgtagctggagacacgagagacatcatttttggatttcttaagagcaagatagtatagccaactgctggctgcaaatcatctataatcaacttaacagtcaattcatacaatagttacctataaacatatactacataattaatatctggtcctacctgtcatacatacatataacttgagtgtttagagctgtaaatctataacccgctgcccttctctcttctattttatctcctcgaaatgtgtttagagctggtttatagcctgctattgtacatgctctaatccggatagaaacctcttgatccatgtgtgctcctcagcaccatggcatgtcaaacacccatgcagcctattgttaatggtcgttaagtgcaaaccataaccataaaaaatacaaaatatacgatcaaagttagtggtagagatctagtactaaccatttccactagtattggtaaatattagtatcctaatcaatatcagctttataaaattaacattgcaagttattttatcatcgttcttacgaactagacaatttcgtgtactgtactaaatcgtatccacctaacaaatttgtataccaccaatacaagttactcataaatctgctgctgcgctttaggatcaaggggcaactatggacgaaggcaaggacaagacgaacggaatcaacccggatttatataatcttgccacgaagttaacaaatatcacacatggcatgcaactttgaggtataactatcgtgctaggtctgacttattaaatctactacaataaaattctatgtactccctccaaaatgtttctatgtactccctccaaaatatttaacgctgttaatttttaaaaaatatttgaccattcgtcttattaaaaaagtttaagtaattattaatttttttcctaccatttgatttattgttaaatatacttttatgtttacatatagttttacacatttcacaaaagtttttaaataaaacgaacggttaaatatgtttaaaaaaatcaatggcgtcaaacgtttagtaaatgagggagtattaaggaaatcgactacaatgccaacttttaggaagcaatttaacatattatgccatataaggtttctctttaaccaccacccatgggcatggattacaggtgagctcctgattgcacctgtaa

SEQ ID NO: 42380 - DNA, 1833 bp, Oryza sativa
cagctaactacatgtcgttgttgacatgaggtttctttttctgctagcactagtatacatatatgagctgcatcaggaagcacatcgatgagctcaatctgtcaaaactttgagacgtacatgccaacgtgcaagcacatatccatgaccctgatatgatcatatctggtagagctgttctggccatttggggtaagcgcgtttgtaaaggctcatgcacacggtatcatgctgctggacgctgctattgaatatgcatttcatagcacctgttaagcaagagcacggtgagtgaaggatcagcgatgtatcagacatgtcgaaatgggtctagcaaacgtaccatgagtgccaacagtctccttgattcggccacgtcgaccatgtttcgtccacaactctacaggctgcaaaacaatggtgttattgacgttgaatatatatggagcagtgtatgaattagctgtaaaacacttgccttaaaccacttgacatcttcaggattgtagaacatgtatcgcactactgctttcagttttgagacccgttgaggataactgcatgagatgtgaagtcagaaacatgaccggcataagaaaggacctaatcttttcctctttctcaaataatgtagtagaataacactcaaacaatcgacactttaagcatcaacattatgttcataacacaactttgagaactaacttcaattacatataaatatagaacattctaaaatcataatatgcaaaagaatttttcaagacaaatctacaccaatgatttttgtatgttcatcataaatatcaatagctaaatttgtacagattttgattggaaatcctgagtagttgatattttgttttcctagatattatataatctctgtcagaacaagaaaaaagagaaatcaaactggcacaaattgttgtagaaatccccactcccccactttggcaaatctgccaagtcagaacaacaaataccaccttacagagcacaagcacttgtcctcaatcctaagttctctcttttcattaattcaccaacacaaacaactggcaaacagctgtaagacaacaaacattttgttgcgaacagtattatattattccttcgaataacgaaacaacttttgaagactatacatgatgggatgttatagcacctatttgaagactgtgattggatgttatacataactttttcgatgcaaacagtattgtcatattttcttccaaataacaagatagattgtgtgaacattattataagaaatttttatccaccagcagtaattatttcctagaaaatatcgatagagcacatcaacataaatttattggaccaaaaaggcaaaatgaaaattgcagaactgtttgcctattaaaggataattcgaaacttacccagtcaaaacaattttcttaagaataatccggtccggatccacacttttcagtgaaccaacagcagcaatggcaggctgctccccatctctgctctttagaacaataagagggagtggaggaaagcaaattggagcatatacagaggcaacagaaaaccgcccatgatgtagaaacctctccatcttatgcttattgcaattgatgttgtcagttgaaaacaatggcctgtgatagattcataaataaccaatgagacatttctcaatgaaaagacgagcatctgttttttctgcattagcatgactgagcttccactacctacctagcagtaaactgccggaacccaacattgaaaattaaggagtcctttgatttgataggagcttcataggagtcatgtttctttatgctgcagcaaaaa

SEQ ID NO: 42381 - DNA, 16168 bp, Oryza sativa
attcctgcagcccagcactttcttttgcatacaacaaatgaaggaaacatctgacctagacaccacggctacgttatcgattagtactctagtcttagccaataattttcttctttatccagagtcttaatactagaacacttactagagcaatcattataaatactaagtgacaaacctacaatgacgagaagctatcttacttaaataagaaaagtaaacaccataaggaaatctcgaatacttactttgttgaagaaagcattcgccgaggtacacaaaatgaagtcaaccactaacctatacaccacgcctaagtgattctagcctcacgcaagaacttccttctttatctagaatattagtactagagcacttaataataatactaagtgatgtacccgcaacgatggcaatatatcacacttaagcaaataaattaaattccaaagggaaatctcgaacacttactttattaaagaagcatccaccgaggtagaagagataagagagtgccgatagctccggcactcctcaggaccttctcctcagtctctacttattttctccacactactaaagtgatgcctaaaatatgaaagtgaattgtactccactttgttgtgtgttgagaatgagagcttctccttgtttgatagggtggttatgactgttgtggaggtagattcatccacaaccatcattagggagcaatcaggagctgccacgtatggggtggagatgagagccggccatggcggttcagctgacccttgggtcccactcttctccaccccctttcaccaggggttgacaagtgggccctatggcggttgaagatgctttggccacacactaggtcggttttgactaacatgtggatcatctaatccttgtgctcgcatatgattggttggaggtacattttttttacggttaaagcaacaggagagctgttggaggtacattttgtcgcatggtagttgtgttttcatccagaattcatcctcacacctcccacgaccgcgtcgctcgccctggatgccgaggcccattcccccactctgcccacattttcccctcggactcaaattcgaatcgagcccacgaccgccactcatccccactaaccccacggtgctagtcgtttctacacttcacggccacacccgagcaccccgaggcttcaaaaccgctccctgagctcctctctttctttttcaacaaccactgccgctccgagccgctcttgcagcatcacacctagcaccgccaccactttactgctaacggttgccgctagccctgctagagtctctgccgggtagcaccgtcgcctccatcggcttcgcgaggtcgaggagcactgatgaggaaactaggtcccgatcttccgataggtattgataactcttgatttagtggaaacttgacacacacgatctagcttccaatcaacacgatccgaatgctgtgatcgcagcaccacgtctcctttggttatcaactgtgccgaaaccggttgaccttgcatagaaggctaatccttgcatgtgaatcaaagaacaaaagcaagaacaagatagattgcaacacaattacatatgaatgattaagctctcaaatttggggttccacaaaccaatctagcggtgaaactgcaatgttgttaacaacagaatttggcatcagatttggagaagaaggaagaaggtcgaagtggatctggtgttgaatctaactgaacttggagtcggattgcgcatcggctggataccgtatcggctgaaaacaaagtatggggttgatctaggttgatgaagctgatggccgatacaaccgatatgacatgacttgggctcggtatgggcctagatcaggataactatcattgccaataagagatagagctcgattaaggcaattgtatctattaattaggatattgagtcggtttgttagagatttggcaagaggctgccatatatggtcttatttgtatcttaattttagaaaggtttgagtcgtgtccatgatggactaagtttgtacttagggaataaatatgaaccccatagcattgtaataagggagccaatccaatacaacttcggcgcatcgccacccttttacttttctcgttttccggtgagttcttcgcaaaaggtaactcgtctcaatggcccgcgctaccgggctaacatgtcgctttagacgtgttaggctcgacatcgcgagtcattgctatcatatgtcttagttaatctattcttagcttctcaatttagctctatcggctgctgctcgctttagggtttatgctggtttcggttaaattgtcttgctagattagattagctaaggcatctaccgtcctaaaagtgcctaattgcttgattgtctagactgcatgtttcctttcatactttgagatgcatcatccctagtcatgcttagaaccatgcaaactagcctgcaattaggcataataaggatagtatcagggtttcagctgatcttacctaatatgcatatttcaccccctgtttcatgtatattcgctacttatatagatagatcattttatataagcatatcaagctttagtcagtatcggctagattcctacacctgcatgcttgatttttgtttaatatgtttatatggatcaatctatttatataagttgttactagagtattagctagtacgttatctttctttctctaaatactgtcacgtcagctactttcataatatcgttttaaatcaatctgttaaactacatagatagtattacatccgattggacgtgtttagggtttattattctttgatatatccagtccatagccgatttggtctaactccatcggctgagaccataaacgatacactatcagtcgactaattctacttttattctttcttgccgattgcaggaccaaatcagctggcacgcccttgacacactcggggctagcctaggacctgcactggagttaagcagatctcccagggcaccgtgttttcacatcaacaaatggcagaaataatctaagcaaaacccgactctaaactataacaactactgaataaatatgatttaggatgtcctagggttgccctagggcacacacccccttgggcttagcccatgacacaattacatggcccaagacccatatcagattcggactggatgagatacgtggtttgtttcgcagattcctgatagcttggtgggaattttgatgtggtaccaaaaccatctgaaactaaacttcataagctttccaacaagtactcatgggtcccgagattccttatagatcagcggctaggtccgtttgaagttgatgctgtcaggaggcctgaatccgaatccaaatccaaaatgtgtagatctttatttcttgtcttctatggaccaaaagtgacgtggtgaagtaggaattgacttggagaaggtcttggtttagtccccaatcaacctctgcaaatgaaaacacacgaaactcattgtgtagcaatgtttgttcaaagatataacaagtaaatataatatagaacatatgcacctttcgttgatgaatacataaggtagtcatggttatatttgagctagttgtatcctcatcaagcacctcggccaccggttggtcgccattcctcaacatgggaacccgcctccctcgttcgccagtgagctccaccattcccctctcctccggccagcaatgctcaccaccatgcaccctcattccctctccttccctaggtgccgccattgctgtccgcctcctcattcgctaggtaaccattgtcatcaccgtcctctcctgtattggccgctgtcaatccccttctagctcccttcccatgcgtgtcgttgcctctctggatgcatcgctgccttttgtgcgcactgccagtcgtcgtcgcgggtggctgcactgccccgtagccattggatcaacctcaggccaatctagattgtcgattcccgtggactatcccagtggtcccggtccatagtggaaaggcccacttgtgtcactgttgggtgggccccgcttgctggtgccggccttcccctcactaatgtcagcccttgggctttaatgtgcaataattcattaaggtttttttattaatagtaaaaacacaatgaatcttctaaaattcatagtaaattcattcgagcttcgtttaagtacatgcaaattacagtaaattcataaaaatgcctagaatcgactaaaaatgttgttgtctctattttagtagacttatagcctatttgctttatgtgctttgtttgttgcttatattcggtctatttcgaagctcccatttacttcgaagtggttgagaggttccaacatcactagagctaggcaagtcatggatcctaattgatcatgttgtacctattttacatatatctcgctttctattaaatactgcattattttacattgtcacgtgggatggtttcctatgcacttagccattgcttgttcaccttgtatcattgataacatgggaattaatatgactagatgttgttcaggaaatgcttaaccatgcttagatcaactagctcaccacgggaatctcacatataccttatatcttggattagtgataatgacattggacatggatcaccatggtattaattcaactaaaatatacctactggagggctatgggcacatagttttgatagacgcacccatgcaattaaggaccggttcgcagaaaatctgtggaagacttaccgtgtgtacaacataccaacgtgggtgatggttgggcttgttgtatagctccaccctctttgacgtacccaggtgagggtgggcgtgatggagttcggttggccctagatataagggttgatcaccttccatattcaccatggcacaagaggaggctacctactttagttttaagggtaggagcaaaacctgctgtgtggtgcacttgtttggggggagttatgtgaagggtcctgtcatagatcctttccggtatgttgtggggctgtgtcttgtgggtacatatgtacacttttggcaagagtaaaactattcgaatagccatgcccacggttatgggcgatcgaccagctttaccgtgattagtctcgtcattaataatttgacttaattgaattggtgtagttcaggtggatggttgggcctatctcaatgtggtttaacgttagacgatgatgattaatatttcttaatatacttcaacagttttaccgctttcgaccactgctttataactgctttatgcaaaagaacccctagcctcctttgaaatccttgcatcatacttcctcttggtatgacttgctgagtacagtgggtagtacttagtcttgctctattttctccacatcagagttggactactactcggatagaggtaactcagtggagtaaacttcgtcactaccgccaaggaaccttgtggagtggagtcaccgctttgctagcatcacttatccaagttttgctagttttaactttccactgcatttgtaagactttttgttatgttttgtaagatgtggatttgtatgtcaactttgtcatctatataccatgggcggtcctgaacaggggtttaatgcacattctgcttataattctggctcgtgaatttctgggcgtgacagttccccgccaaagcaagataccgatgagaaactactattggagaaggagtcggcagacaacgaggacgagaatgccattgaggatggcaacgacgatgaccgtttaagctggagcggtggaagaggaggccgaggtcgctgaggtggaggtggcagcttgcggggacgatgtgctaatgcgggcccaacaccgtctagacaaacattttgtatagtagtgtatgcatgtctggtgaagttgtgatctagaggatttcttggaatatatgccaattgttttgcatgattttttttccacctccgatgaatacaaatgcaatggtaaaacattctagctagcaaatactggatcatttattgtaactatacataaataagagtatttcacaaaactaaagatagttgtataaaattatcataaaactgcatatttagcaccaaattgattatgaaactataggttaagttggggtatagcaaaactacaattctactaatgaagttatctgtagttttttgggtacttatagcaaaactacaaatctaatctacaaatccttttttgcttgagttctgaatattgtacttctgtgattaaattgacataaatctatagctattgtgataccttcattactagatctgtaattatgtgatactccaccttgaatttgtagttttgtgataaatttggtatagaatctacaatttttcatacactgccttaaatatgtattgtttgatagtttatgatgtttcgaccaatttaaataaattatatggatgttttggtaatatgttgcaactaggtataaaaaattctccaatgtacttatttatagattaaattaaactaaaatttctgctaatgattgaaaacagatgaagattcaattccccatagatacagcaatgaacctcccgaaaattttataacttttaaagttcatttggcacctcgattagtttggtcaatgccgtagtcaacatattgagaatccaaaatccaaactggattgaaatgtgaatattcataattaaaatgcactacattggacgaccaaagcttatacaggaaattaattagattaacagtgaattttcataagttgcactactatacatgcgtataaattgttcgaatgatctaaaaattggtttgactcgtttgcactaaattatatttgcaatcaagtttccccctgtcattaaattctacttgcaatcatgcatgctaggataccgtaccatattgtttctctgctccatgccaggctaaaatatgcttagagtaaatttcatataaaactatacgttgttcatactgttaaaaaactatagatttaaggtaaagaatcataataacatatataaatttaacatcaaatttattagaaatcttcatattgaaggcgacgttattttgttcaaaattgaacatttcgatcggttacacgtacttgcgcccatccaatataatttatatatgagcaccgttcatttccttcagtttacattggtgtacaatatatcgatctttaattagttatttacatgcatatgatgtgacacgtagttaagcttaattaccatatcttattattattgaggcgtcctcaattgaaaggccggccatttctgtatagtagtgaagctggtttaaaattttggcccccaccggcaagcacacatctccctgaaattttcgggtttgtttgtcaaatatttgtaaatttggttaaaatttattcaaattcaataagatatgttaaaaattcaaataatttcagtcagaaaagtccagaaataacggaaatttcaaattttcggcaaccaccgaaatttcagtggcaaccgaaattgcaaaccctaatcaagagctcgaacttaatttggttagatgtttacttgttttgctctttaatttctcccccttgaatcttgatcgatccacgacatgaaatagtacaactatacaactgtaaaacatgcgtacagattacagatattaattagtggacgcttcaaatccctagcgtctgcagccactcgcctgcacgaatcgccgccatctgccacctccacgactccaaggtcgtcgtcgtcgccgacgccgccgcgccgccgtcgaggaggtgatttatgtaggcgtcgaggtcgtggacgcacgccgcgtggctggccttgaagaaatcgagggcgacttcgacgccgacgtgggtgtagcacgccttgctccacggcagctcgacccggaaaaccctagcggcggcctcgttgagcaccacgccgggcatcctcgtcaccgggtcgcgggcgttcgcgacgcggagcaccttgacgcggagctcatcgcaccgtctcttgaactcgaggttgccgacgcgcgggccgccgaaggagaagacggtgatcgggatggcgccgccgcggccgccgcggccgccgcggttgaggcccagctcggcgaggtcgtagccgaggaggatcgccagcgagctccccatgctgtgtccggcgagggtgatgctgacgtcgtcgtgcttgtacttgtcgatgaggcgggtcacctcggagaggagctggttccggcagctcccgcaggtgaacttgccggagaggtcgtcggaggtgtagagggagaggaacccggactcgacgcgcacgtcggggcgcgggtcggccgggtcgaaccgcgccggcgacagcgcgctcatgaagttggccagccactccgatccggtcaccgtgccgcggaaggagacgaggatgtcgcggcggccgaggcgggcggcctcgcggttggacgcgacggcgacgtagccgatccaccggctcttgccggcgcaggagcagcggccgccgacgccgaagggcagcgcgacgtcgggggcggcgtagatgtacctggtgaccgtgtacccggcgccggccatgccgaccgccggcagcatctgcttcttgccgtgcttgcagttgaggtagcgcttcgacgccgggtcgaggtcgaacgcccggtagcacgccgcgacgagctccccgtaccggaccacctcgtcccggagcagcgggtggagcggctccaccatgcccctccagtcgccggcgccctgcacctcccgccacgcgctcgccagcgccgccaccgccgccgcctcctccacctcctcctcctccgccgccgtcgccgccgccgctctcttctccaccaccacaggagaaccaccactactcgtcgtcgtcgtcgccgtggcggccgatcgcttctgctgtggcagatcacccagagtgacggtcaccggcgaggcagccgacgtcgtcgcggcagtgaccgggccactgacgcgcatccggcacgtcgtcgccgcagtgagccgcgccaccgccgctgccgccatcggccggcgatcgagcaggccagggttaggtgaggcggacgcggccgcagtggcgtgcgcagctagcgatcgatggatgagtacagtgagtggcggttggcggtaaggtgagcgcgcgtgcgtacatatttatagggaggcgacggcgacgcacgcggttggccacgtaagcaacttgaggagagagagagagaaagagagagatgtatggattatttgactagcgagacgaggaaaacgggtggagatgagatgagcagagcgttttcttaaatggaaaaagtggtcggttgcgggtctgaccgggggtacgggcatgcgcccgaatccggttagggtggagaccacctgtgttggatagacaagtactgcttgttttgtggggcagttagcatagcagatttgcacgtgtagtgtacatccggaatgatgcactgctgataggttatgagtgtctaccaagttgagacgatatcgttctcacgtatcctaatttttaaagtatcttaattttagtattaattttcacacgattctacaaaatcttatatatcatcatgatactaagattcggaggcggaccatggaaagttttcgaataagtaggcgaaattcgctatcatcgtaccaagggcttgtttggtagagctccaactactaaatttagctctagaagtttggtctggagtggagttatggagatgcctaaacccagctctatatctcttgttcattttgtgagagagctccacctaactccgctcctattctaggtagagctgaaattgttcggctgagttccagctccaggagaggtagagctagagctgaagctgtgtcaaacaggccccaaatattattttaacataaggtggattgaaaataatttaaataaatatgctgaagtttacataaaacaattaaatttatttaaatcaatgttatttgctttaatttatacaacatattatgtattttatataaaatatatattttctaaaatttcacaatattctgatcctatgttagtgtcatgatactataatattacaaataaaaaagggttaattggatcgatgccattgtaatttcttcagttttgaaatatgccattacaattcattaaattggaaccatgccattacaatttgtgaggtatttgagacatgccactacttaccctttcaaagcagtggcacatatctaatatatgttaaattgtaatggtatgtttctaacttcgtgaattgtaatggtatatttcaaaacaagcaaatttataatggtatggatccaattaacccaataaaaaagatcttacctaatatctccttgcaaccaactaggtactcagcttagtacaaagaaaaagtcacacatactctccaaggagagcgtaaacacatatctgaacatgcaagtttctaagcatatatctgaacaaatgtcaaatgtttatcctgattcaatccaataaattgatttttgaagtgtgtaataagtgggtatacatatataattacagctaattatgctttcggtagtagcacatcactagcaaaaatactcgtggtgtctttgccaatctcaacgtatgcgccggcgattttatcaatctcaaaatatatcggcttagtctttttgaagtgcttatacatacatggtgtataaatatatggtgtataagcttgagtgatcaagcacgcagacgatatcgtttgtgtttatatgtgttacgacaattaaagtccaccgtttaataatcagtaatgtgataattaagaaaattaatgtggttgttataaagtataaattcatacttgtgttttctaacctttgcaagttgacaacgttctacttactcttttttcatctgcacgcttccgaaacttcttcacaatacattttgaaaaaaaatagaaaagtttctttaaaaaattatataaatccattctcaagttttctctctaataattaattaattaattaattatgcagtgagataacttgttttccatgcgaggagaatgagtagccaatcatactcctgatcagccttttgactaccatataatggtaacatcattgttttccaaatcataacacatatatgtagttatctttcaattataatctctattacaaagctcaaaacattcggccacttcaactaatattagaattaaagtggcaatatatactccccagtcctaaaaatatataatcattttcagactttaacactcttttcaagatgctactttgactatcgatatctatgaaagtaagatgttttaaataaaaaaagttgcatattatgatagtttatttaatgataaatctagtaatattagttttacatgattgatcttttttttttctattaatagtctaaattaaaaatatttgacttgttactatatatgctaaaaatgcttatattttgggatggaggagtatattgcatgcatgtaaactttacatcttgtttatttatttggcaccagtagagctcgtacgttgtgctgtagtatcttgtacctcacgtcgactttggatgatgagtagtcgatgtttctgacccctcgtgattacttccacatttgtcttcgccctacgtggttgtgtgtgctatactccctccataaaaaaaaaaactcaacttctatagtttgaattttatcctataaaaaaccaacttctattatcctatatatccttagcacgtaaaataaaaagttttattccttcaatacctttacgtacctatcactattactactttttttattgattaatggtatttcagtcattctttatctccactaattccacctcaaaatgctaggaatgtatttttttgagatcgagggagtacgtatgtgtattaatttttggtttttattacgtggtatgctgttaagctagtgtggtaccacgaaagcttgcatttttccatgcatgacctacttgcagactacatctccatcgagcatatttataactaatttaacagaattcgtaaccgttgtgtcacagaaattgaaggagatttttctctcgaattttagactacgagagatccacactaagatttctgttggtctctttctcctccaacttggtctggtgagtcatcgcagctcgcggttaggattaattctagtaggttgagttccaggtgggaggggtaggcgagggagagattgggtttccccttgagagatagccgtaggcaacggaaggaccgacgatgtatagtggacttgagtgagtagggaggtggaggcagagccacctgaaactgcgagaataaagaaagacggtgggctggtgtcgccgacaacagcttgatgataaggaaagagaaaaatatgggatgaaacattcatacctcaattgccttgggggctggctaatgggcgatcgctcgagcgatcgatccccattcacccctatacacttctctcctcccttcctccttcccttcttctcttcctactacaccataaatttttaaaaaataaaaaaacaaaattgaaaaaaattatgtctagaaataaaaaatatttgaatttaaattcaaatttgaaatgggtatgtaaacttttgaattataaacttttggtctataaaataatatttgaattcaaatttaaatttgaatcgagtatgtaaactttggacttataaactttgggtcaataactttagatctataaactttagatgtatagaaatactatatataaaaaatatttgaattcaaactcaaatttgaatcatatataattcaaattcaaatttaaatcgggtatataaacttttgacttataaactttgggtctataaactttaggtgtataaactttagatgtatagaaatactatatatgaaaatatctgaattcaaattcaaatttgaatcggatatataaacttttgatttataaactttgggtctgtaaactttagatgtgtaaacttgaggtgtacaaactttaggtacataaatttactaaaataggaaagtaatacggtgccaaaaaaagaatggagggaggggggcattcggatctgatcgctaggggcgatcgatcgccccttagcaatctcgattgccttgtaccgttcatgtgtggtatacgtcttgccacacaaaaaagtttttaaattattaagtcgattggttcgtgtttatttctcaaattatatactactcaaaaaatattttaaaagtaccaaaattctctgtgtggtcaatcgttagcacggtgtgttaaaagtaagtagttcatgggtgcatccaaagatagtgggtatatatataaattattaagtcgatcggttcgtagtttattaatttctcaaattatatactactcaaaagtattttaaaagtaccaaaattatctgtgtggtcaatcgctaccacggtgtgttaaaaacaagtatttcatacgtgcttccaaaatagtgtgtatatatataaattattaagtcgatcggttcgcagcttatttctcaaattatatactactcaaaaatattttaaaagtatcaaaattctctgtatggtcaatcgttagcatggtgtgttaaaagtaagtagttcacaggtgcatccaaagatagtgtgtatatatacagtggcggagttgagtggcggacaactccgggcgcatgtggttgtgctcgttgcggtgaattcattgtaaaatttcatacaatacatgattgaacataaaacttttgtagcaaatacttactgtagatagatctgttcgaacttcaaaaattttctagcttaggcactgctatacatatatatggtgtagatcgtcattggtgtgtttgtactagtctcatcatagtgagaaacaaagcaacaactataaacaaataatgcgcaaaaggaacgctgcttcggttgacaaatactcatcgacacatcatcagtgcatgcaaaaccaatgatcagtgttagcaaattcattgacaaatatatacgactccaaaaatctaattggcacttctgttgttgaaacaatattttccactatcctgtatttttcaggcctcttagggaatccacaatgtaaatcaaaagtgggtgttatacactaaatgcacctatatgggttgcctctatacattgtagatgtggtctttatagcattaatggctaaagtagtccatatggctatgggctgcccacaagagaatacaatatattactttattactttttgagttcactatttggaaatgaatataaaaacaaaagcagttgattcatgactctgcgacaggtatccgttggttgaaggttgaacgttgaagttacttttgccttgagctctatgttggctacaaaacttgctcgatagcttgagctccatgttccctataaaaacaaaatagacagagcttcatattacacctcctcattttcatcacggattcatccaacagaagtttcaaaaacctcctaaatcaagaatctccaagcccagaaaattctaggcaccacaaccctcctccccaacaattccccaacagttttctcccatctcagttttcccaaagcttcaacccaaatttcttacatagtttctacccatttggtgccctaggcaaccacccacaatatggtcattctcctccaatctttcaagctactcaacatcaaggaaattggatgcaagctaactcaccaaatcaagtgtttggagctgcaagcaacaaagtactctttgcgcctcatcatttcacctcagttttttttaagaaccaggaaatatattaagtattataagcatagtacatagttgagcatacaattggaggatctgaaacagtcatttaactgcttggcataacagcttctttccggataggctaagtgagctatgttttgacaaatgtgagctaaacccctcctgggggaggatttagcttcctttgctagtttacctgccattttgttgatttcccttgggatccagcgaacctgtagcaagtcaattaatgggaaaaacattgatgatttgaacaaaaaaagggttttcaactccaatctcctaggtcttccatgaaatttctcttcatagtcgtgtctgcgatggtggcattgtccgttaggaaggtaacccctgcaaaattcagaaatatggcaatttccaaagacaactgaagggcaagcagttcagcttgaagagagctgtgagctttatcagaggtggccttaataaaaataacagtatgattgtgtggaaaatgaaagaagattccaatgccagttctaccattgtcccatgtagcatccaaataacacctgattccatttgggatactatccatctttcttttgcaagcctcagattggacatcatcctgcaacacaggttgagaaaggatttgggaataggaatttatcatagcatctgctagaaagcagacctgagagggttctttgaaaattccataaaacttgagatcatttctagctttccaaagttgccacataactatgaggagcctgctcagattagttttattaggatcgttattaatcacaaaagcaataatcagagccacatgagagttgatagggaatctgtcaaaatcagtcctgcaacctgaaatcatccaagtaagtctaatgaaagggcaagagaaaaacaagtgaaaatcactctcaggcatgccacatctgcaacaactttcagagatatctttaattctatggttgagcctaagcgcagagggaagagcccccctaagaagtctccaagcaaaaattttactttaggaggaatgcttttatctttctaagacactttatttaaagcaatggattgtgagtccacctgttgagtattctgatgctcacttttgtagacttccttgtaagcactttttgtgttgcattcaccattttttgtatgcttccaataaagtttatcttcagtgttagcctgcattactggtacctgcaagattttgtgaacaattttctctacaaacaaagagttcaacttttgaacatcccaattcggctgcaggaatt

SEQ ID NO: 42382 - DNA, 1255 bp, Oryza sativa
agctcctgtaccactgtgcgcgcgcgtgaggggagtactgtgcgcctgaggggagggatcagatcagatctatctgtgactatctatatttttctctgtctagaattgttaagtagtcgatttgagatatttttataaaaacggaacctacatgatgtgagcattccatttttaagatgatctaattttagttttgcattttacatttgagtccctgtaatattgatatttatattttgagtccatgttcgaggtcagtggtcggttcttgttgaataaaaagtaaaaaaataaataaagaaagaaaagggcggaaaggtgcaaagaaaaaaaagaaagaaaaagccgcacaaaaaaaagaaaaaaaaggcagaaaggtgcttaaaaaagccacaccaagaaagaaaaaccattcatccttggagtatgttttcagagtgcagagttgtgcattgattcatatctagtccttagtgttgtcgggtgcttgcttgagctagagttgagtctagactaggccagcacattgactaatactttgaactattattcaactttgcattttctgattagtacaattacgttcctttgctactatatattgtgcctcccaagctccatatatattcttctgaaactgatgaggaatgtaggtcccgatcttccgataggtattgacaaacagtcgatttgggcggagtcgcgatacaactcgatccggcttctgaacgaacacgctactgagccctggtatctttcaaagatagtatctttcctggtatctctgaaaatctcatcgattctatttttcgtcctttcaatactatctttgaaattttcctcgattccattcttcatcctttcaagattatcttcgaaaatttcaataaaactcatgggtaccaatttcattttccgaccattatgtctaaatgtgtatgtattagcaacaaaattatgcgatccattattatcatatacccatggttgaccaaacaacaaagaacatgcttgcatagggacaagatcaaaattggcagtatcatggtaatttctaatcgaaaagtttagcttcacaattctatttaccttaaacttaccacaagagttgaaccatttgatgtaatatggatgaggatgcggttgtgtaggcaactcaagtttctcaaccaaatctgaactcaccatgttattgcaactctcactatcgattatagtacgacatgctctatccttaaccataaactttgtttca

SEQ ID NO: 42383 - DNA, 9807 bp, Oryza sativa
tcctgcgccacgtgcatcttgttggtatcgctgatttcgagtgccactcatacctgtcattgcaaacacaaaaaaaacaaacaatgaaggttatccctaataatctgctacgcggtgtagtggtgcccctcaacaactcagcccaatggagcatcttaccaagctcttacaagtgtcttaccagcaatgctaaggacggtccaaccggtggctggttcgtgacaccttgaaggacgtgatgtggcgattgcaaggatcaaagcggtgctgaccagaagtatatgaaccctagtgcatggtcctgttacaacttaatccggcttctgaacgaacacgctactgagccccgcaatcgcagcaccacgtccctctggttatcaaccgtgtcgaaacctggttgacctcgccgagaaggctaatccctgcatgtgaatcgaagaacacaagcaagaacaagatagattgcaagcaaattgcatatgaatgattaagcacacgaatttagggttccacaaaccgatctagcagcgaaactgttctcaacagaataatctaagcaaaacccgactctaaacgatgacggctattgaataaaagtgattggggacatcctagggttgccctagggcgcacacccctttgggctaagcccacgacacaattacaaggcccaaaactcaaaatcagattcggactggatgaggtgacgtcatctaaccgttactcacaatttgaactggaaactagacaggaagttccagacctagaagacaggaacttctagactacacttaggaaaatctttttcaccaaactggaacttccggacctagaagacaggaagttccggacttgcatttttggacagatggagtatttgtaaaaataactcctagggaaacttgacacttggttcacactaagagtacttgacatatctcagagcatcacctggagcccctcttaatagtacggtttttcctaaaaactcgattgcaataaataaactatcccatgcacttctcgagttccggtccgctttgattttatacttttgggggggtctccaagcatccatcttccacaccttgggctaatgcacctgaaagtaactcaatgaactcattagtcccttaaccacatttgtcattaatcaccaaaacccactagggggatcaatgcactttcaatggttatatccgagctagttatgtcctcatcacccatcgtgaaagagtatctagatgtttttccggaggaactaccaggcatgccgcccaagagggacatcgagtttcgaatgacttagtgcccgagacagcgccaatctccaagagaccgtaccacatggctgccaaagagctagctgaagttaaaaagcagttggaagaactcaaagaaaaaggccacatccgaccaagcacttcaccctggggagctccagttatcttcgtggaaaagaaggacaaaactaagagaatgtgtgtggattaccgtgcactcaacgaggtcaccatcaagaataaatatcctcttccgaggatagatgacctctttgatcaattgaaaggagcaaccgtgttctcgaagattgatcttcgatccggctaccatcagctaaggatccgagaggaagacatccctaaaacggcattcacgaccagatatgggttatatgaatgcaaggttatgtcgttcggactgacgaatgcaccagtcttctttatgaatctgatgaataaagtgttcatggaatatttagacaggtttgtcatggtcttcatcgatgacatcttgatctattccaagacagcagaagagcatgagcaacaccttcgcctagcgctagagaagcttagagaacatcaattgtatgcaagttcaataaatgtgaattttggctttcagaagtgaaatttcttggacacgtaatttcagctcaaggagtggcagtggatccaactaacgtcgaattagtgaccaattggaatcaacccaaatcagtgacccaagttcgcagtttccttggacttgcaggctattatcgcaggttcatcgaaaacttctcaagaataacaaggccaatgactcagctactaaagaaagaagtgaaattcatatagacctcgcagtgtgaagaggcatttcaattgctcaaaaagaagctagtatctgccccagtgctggtattgcgaaatatccacaaggatttccaggtgtattgtgatgcctctaaacaaggactagggtgtgtcttaatgcaagacggacaagtggtagcctatgcttcccgccaacttcatcctcatgagagtaactacccaacgcacgacttggaactagctgccgtggtgcatgctttaaagatctggcggcactatcttatcggtaaccgttgtgagatatatacgggccataaaagtttgaagtatatattcactcaaccagatctaaatctccgtcagagaagatggttagagctcattaaagactacgatgtgggaatccactatcatccggggaaagttaacgttgtggttgatgctttgagtcggaagagttactgcaatgctatcatctatgaacagtgtcctcctggattgtgctgagagcttgaggccttgaatttgggaatagttagttatggctaaatagtgaccttaggggcgaaacctctactcctttaccaaattcgagaagcccaaaaaggtgattatggtatccaagagatcaagaagaatatgatgaggggaaaagcaattgggttttctgaagatgaacatgggaccatctggtacggcggacgtgtttgtgttcccaatgatcctgagatcaagaagcttattctgcaagaggctcacgagagtcaatactcaatacaccccggcagtacaaagatgtatcaagacttgaaaatgaaatattagtgggtcagtatgaaacgtgaagtagcagagtttgtgacactctgtgatttatgtcaacgggttaaagcccaacaccaaaggccaaccggattgctacaaccactcaagatcccaaaatggaagtgggaagagattgggatggatttcatcaccggtcttccaaggacccaatctggatatgactctatttgggttgttatcgaccgcctaaccaaagttgcacatttcatagtagtcaaaaccacttatcctggtagtaagttggccgaattatactttgccaggatagtttgtcttcatggggtaccaaagagaatcgtttccgatcggggcagccaattcacttctaagttctggtagaaattgcaggaagaaatgggaactcgtttgaacttcagcactgcttatcaccctcaaacggacggccagacagagcgagttaatcagattcttgaggatatgctcagggcatgtgccctggactttggcaaaagttgggataagagtctcccatatgctgaattttcgtacaacaatagctaccaagccagtcttcaaatggcaccttttgaagctctctatggccgaaaatgtcgaactccactcctttgggaccagaccggagaacgtcaagtttttgggactgacattctaaaagaagcagaggagaaggtcaaggttatccaagcgaacctgaaagttgcccagtcccgacagaaaagctacgcagatacgcgtcgaagggagttagcctttgaagaaggagactttgtgtatctcagagttacaccgcttcatggagttcgtcgtttccacaccaagggaaagttggcaccatgttttgtgggaccttacaaagttcttggtagaagagggaaagttgcttatcaattggaactactggcatctctgggaggagttcatgaagtattccacgtgtcacaactcaagaaatgcctccgagtcccgatagagcaagcagatccagaacagattgagattcaggaagacctgacttatgtggagaagcctataaggatcttagaaacatctgaaagacatacccgaagccgagtgatccgtttttgtaaggttcaatggagcaattatttagaagaggaagcaacatgggaaagagaagacgaactgaagtccacccatcctcacctcatcggaagcgtcttcgaatctcgagaacaagattctctgtaaggggggtggacattgttgattctctgtaagatccggcaacctttaccttgtcagggaccagcgggcggtgaaacctcagcgggttctcatgttttgggtagacctagatggatagtcttgtcacgacctttatccgagtaccgtggtggtacccggcgcgtggcaacgcgtgttgaggttgtgtcttgtgggtaaagttgtacacctctgattagagttaaaaactattcgaatagccgcgccctcggttatgggcaagctgagtaatgtaccaaaagttagttttgttttataaaaccttgggagggtgaaatcatgatggtgtagtcatgtggagattagcctgggctaaggcaggttcgcaggctcatgcgaccttggtgattaaaatattggcttagaacaggatcgtgttttaaaatgagctttaacctgattaaaatgtttaaactatggttttatgcaaaataaaccctattaggccatttccttgatttccctatgcattattgttgcatttccggtgtgacttgctaagtacggtggtggtactcactcttgctcacaaaaataatccagaggatggacctgaagaagatgaaggcttggatctctagttcgctccgttgtcgagtgcttgtggctgctgctgttccgtagtcttctgctgttttatttgtttatctttgagtgtgagggcctagagtcgcccatgtaataaagtactccctccatctacttttgataggcatatttccaaatctaaaaaatttatttttgataggcatattttaatccaacaacctaccctcttaatgactttctcggatttaatacgtgactttccattcttccacataagattggctgcatgggcatcgagaaatgtaaatattaatgaattgcttgtttacgaggaataactagtagcatgtttaaatggataataagtagaattatttatccttggtctgtgtgtcaagatgaaatataactatcaaaagtagatagatggagtatttcctttacgtttctgcaagtgtggcttgtaataatcaaaaatgtctatgtgtacctcgcctcctgggacgaggattaatgcactgagcgtttggaaatggtgtatatttccgggcgtgacccccgcccatgtctaaagtcagggccccgcccgacagacccgtgggagaaaatctgcatccgtccacaccctcgttgtggcagccccctgcggggacccagatccaacggggaaattgccactcttaattgtaagaggagaaagagaatctcgtgagggtgtggtgtgtatttgggagaagattgcgaaggttgacaccttacctcaagaagagaaaaggtaaatagtggaaatcgagcttcgccttgtcgaacgaaagttgtgtgacattcgagcttggaccggtgggggtcgcttggagcatgagcttgctcttggtggttgctttaagagaccaatgcatgattggttgcagttggttaagagagacttggcctttcggggccctcaacggagacgtaggatcgactgacttgaactgcaatgtctcctatctctcattactctgcacttaccgctttcttgttgagctatttggtgatcatattgttgcatgcttatctcttgttgatgcctcttggtcttgctcatatctagtgtgcaaagtgctccatctccctacggttttcactctctttataaggccaaggttgtccactcttagttggattgtacgggtctatattgtgcataggcgaattcctatattctctgtgtttggttgcactgtctagttgtgattagattttctgacactgtgtattgttagattatccgcaatgatacctgattaaccggtcaatactaattttcgctgcaagtgtttgtaattgcaggaaacacctattcatctccatctaggcgagatctatgatcctcaaattatgctccctttcaatttggatagcaaatatcacttgtaaccatatcaagaagcgacaacacttcatatggccataggaggtgttgtctattgataagatgtcatttaacattttttaaggtgtggaggaaaagaaagaacagagatgatattgttatccgtcaactaacaaacggtacaataaacatcttaattccaatgataccacaatacaattgaccattaagtttgcttgtaaggaccatttatgccctagcatatgttttgtaatgaaataacactttttttaacaaatgccacataatatgaaggaagcaattttcatttaaagatattaacttttcctgggaacataaaataagtgaattatgtgtggtttttctaaattgcatcgtgggaatgatttaatccttaaatgtttcacaaaataatttatgtcgagtcaatatacacaaggatattttgtattttttttctaattttgtgagtcataaaatattttttttcatttcaatatttcatttgagctacatgtagaaacattctaaaacatgtttagggaaggttctaatagctacagtttctcctagaattgaaagctcccctaaaatatccacctttttgtagattctataaagttgtagttgcggaatcttgaaaatgaactagaagacagaaagtggttttcccagcttttctagattttcactagttggattccaaccagctcttctcgaaatctaaacctcctctaaatatgccccctcgactaattgaaaagtttcgagaacattcttttacaacctttaaaagtttgattttatgaatttcttataccattttagttgtacaagtgcataatggtctttcggccggcaaatacggtcgtcaatgataggcacattacaagaatgaaatgaaataaaaataagctaaacaacctagacctaagtgcacctattagaacctagacctaagataacaagagggggacctaaggactcagggcattgaaaactaacggatcaggggggcctaaggactccgggtagaagctagaagcgactaaattcactacgtctaacacgatcaacttctaacggatcaagaaaaactttttaatgatagccatttatcttaaagatattacttttattgtatgacggctccatgtgatgaagtgtcgacggcgatatatgggcccatccatttatttcgaagttttccatgtccgaatagcttcacccgtgagttgaacagcagcaccttatcccctgctttgaactccttgtgcttgatctgtctatcatgccatcttttggttctgtccatacagatcttggcattgtgataggccttgtccctccattcctccagctcagagagctgcatcttcctgtgatgtccgtctccctttaggtccatgttccaagtccggatagcctagtgcgttgtcgtaggcacttcggaccttccattatatttgagagatgaagtgaataatttaagtcatcaaacaagcataatgaaacatccgacgcctcgagagaggaatattggagacattgctgagcccttagcctgccagtcaacttcagcctgagatgtgcccatcaaaccactcgaaggtggtgaccagatgtgttacacattcaggagacttgacaaaaatggctaaagatctacaacctctcaaatattcctaactcatactcatgtgaatctagttcccaggatgtgcactagatccacactttcatcttaagcatgattatacatagcaaacacaactaagattaaagaaacttaagacttacaacaacttaataactacataggccgaccggccaaatagacatattagagaacagcggaagcttgactacccaatcacaagcacaccgactaggggtttaccccattaagttctcatcctagaagaagcaatcggaacccacatcactcaaaagactaaatctaaacctgcaaacaaaatgttatatcaacagcaagagtcagtacattaaacaagttaatgtactggcaagcacaagtcaatcctaccatactacatgtaaggcatatattcaaagaaaggcaatatgtacttcaatttcagcataaagcaagttttgtttcgcaattcttttgtaaaggagttgatgcttcaattaacaaaacaaattttaagtttcaatattaagttcatcataattccatcataatcaatctcttgttgtcatcctttgacaacaagtcataatatatcacctcacacacacaacttaacacatttatcaatttcaaaccaatgtcacatgatcacattttaaaacataaagtctatactcatgacacatcaccaaagcgctcatgaccgtgagcacggctaatcgattagtttaaagaactctgcaaagtttgtacagctttacccacatgatatgaacgctctagtttgttttgagtttgcaagactccaccacactcttcatgttgaatgtgatctagaggtcataacgtagcctttacactacttagagcctagccttgcactagcacgatacgtgttcctccatcctaggcatacttggaatatgcctagaaccgttaagtggcgggcccacgccttaaacttaacgccgtggtggcggacacaacgagaacccacccacgtggcacaataccgttgtattggacagacttagtcacctaaactaccacgtcggcgcaaataggaagttcctctgaatcatcgactaattcctcagaattatcgactaactcatacataccggcctaacagaatgcaaggctagtcctaaatagattaatcagcttaggccatcccatactagcacatgtggatgtacgaataactttaaatgggtgacacaagttcggtccttatggacttgggcaaacactcccccctatcggtatgcaactaacaccatatgcacaccacttgccgcccaagtataaaatcacattttacacattttaattcgcaaatacccatcatattcattttattccagcaaaggttcaagtatcaaaaccacattttaattatagatggaatgagcatttgcatatttctaagcatggctaagcaagtagttgcacatagagcatatataaacccatttgagcacaaagagtgtactctaaccatttctaggggttcaaacagcaagaggatcaattattcaaggtggggtatgcagcaaatatgtcacaactaccttaacccaattttaaataccgatatagtctaagttcacatgcaactttacaaacaaatattttcattcctcaaatcatgggattcaatgtgttcaaaggatgggaggagaaaacttgccttgatcagagaaatgttagcacctaatccactccttcaccgattatgcaatcctatatacctataggagtcatccccactagctaatttgctgctttgtgagtaaaccacgtcatctcttttagtcctaaccatccgatatcagatgtgcgctctccatgttgatctccgacttcaatagccagagttgatctattcaccttctgatcggctgttgagctacccatcatctccctctaggagcaagagcatttatcaccaggaacggtcaccaacaatgagtggtccattagttgcgattaattccatttatttccctctttcagttcctctaaaa

SEQ ID NO: 42384 - DNA, 8645 bp, Oryza sativa
gttaagtttacgagcctacagatatctgacgacgttgttacaaaagttatcatcatgcatatattttcacttatgcttataatcaggttaatatgggtattatatatgtcctgatacattccattcttttgattgctatttgatatactttttgcccaagttctgttatagaacctgtcataaatcaaaaaagatattaaaaggttttcgtaggctttaacttttataaaccggacgcacatgcatttacttattgtcagtgcaaatacacccttagaaatcttggatgatcccatggtgttttagggaggaaattttatccactcattcctctatcccatggatccagtcagtgcccgctcaaatttgttcattgtacatacattggcccattctttgcatgaattgacaaaatactatattgattgtgggatatatctttgcttgctatttctatggattatccttagttttccgcagcaatacgctgggtttcgtctagttatctagataaaggacacgttatgcaattaaacaccgaaagagctgaaaatctaaaatgctctaaaatgcatgatttatgcacagtgattaggtactggtctaaaatgaatttaggtgaaagaatttttattttatcttgttccattagggagttataaattttagaagttttatcggtttatagtagtatagtcttaggtagtgttataaaatacttttgtaaagtgatttttattatattagacttcacagggtgtagaggtgtgttttataagaataactcatttggtttcacaatttttggagttataatgattttcttatagattttacaagttacaacgtgttttaggcatatagtgtttcatatgttcatgactttttagttgtaggttcagaatatgctacaatatgctacagtatgtttaagttgagcaaaagaagtagtttggttaactaaaacatttttagttcacatgtttatggtctttactactatggttcatattttataaactagagatgctctaatctaaactaacaatatattatattaacctagaaattgttatatgaactaagttcttctaagttttagtggatgaggatggaactatggcttcactggtcaatcaagtttttatttaggtttaattagacctaaagtgtatatatacttatacatgtttatgtattacttaaacaacactgtgtttaaattcttatttcactagattaaggttttgatctatgttctctacaaaaggtgccaaattttattttactatgttgaagctaactatttgctggttctatagaaactttgttcatttcatttggactaaaaatgaattttctacaagttttacaaattaaaggctgctctatgttagtaaatccttatatgaatatttagagacttttactacacagtaagtatataatcttatttcataacatggaaatacatgtttttgtgatcctatagaacttaagtttactcaaatttaagctaaattgggttctacatgaatttctaaagtttagcttatataaactaatcattctagagataatagttttagaggcatttgatgcaaagtaagtaattacttttatttcacctaatcagagagtgcatgatgatgaatctgtagaatttgattttgtttcaaaatgagttgagatgaattttctatgtattttataagtttgtacatgttttatgtatgacctatcttagataaattttagagacattatttgtagttttgtacagtgagtgtcaagttttatatttctaaaatagagttcataactttaagaatctacagcaactggaatcatctcaaaatgagttacatttgattttatatggattttacaagtttgggtgttttcctgttaaacatttaatgttttagttatttttcctttgcattttcagatttttatacacatgggtccactgatcggtggctgaaccaatatacaaaaagatccctaggctttatatgaactgcatttaggtccgtgggtccacatgtaaatctctgaagttttatagtttgaaccctatttttttgatcatttacaggacaaagtcctcatcttcaacctccagcagcccgatggactgggagcttggccatggctttggcgagctcgtcggcgacgattggtggctcgattgggaatgaggtcaaaagataaaatgaagagaatgctctcacgattccattcctctagttttcgtggctaggagacatcggagtagcgccgatggtgagggtgagcggaaggtatacatgagctgttactgcatgttgcctaggggctttgattttgctagatgcatccatgcatgtgtttcctaagaggtcaggaggctcaccaagctgtaggaagaaatcgccgaagcttggatagcagcggcttcggttggaacggttcaacggcggtgctcctcctcgggtgaacggcgacggctcgaacgggacgacgagctgctaaaggaaggcatgcacgagggttgtgaggtcaaggagatggtgtatgcgcgagaaatcgaacaatggctcactgaggcagtggtaatcgacgatgactgcggaggcgagttcggatcggcgcgaggaagaaaaggatgtgttctccgtgttcttgatgtttctcgaggcgatgaagaggtggtcgacgcgagattcttggctcaacggcctgcttcgggatggacgagaatggccggacgacaacgatgtcgaagcggcggcgctccggtgcgtgctctagggcatcgttggcgtggtcacattccggtggctgtgatgcacaaaatgggaggtggtcaacagagaagaggttcggcattgtgtgaagagatggaaacgcgaaagagatagatgtgaccttgactcaaacggagatggcgatggtcgtcacctccatggccagtggtgaggtcgctggtgacggagaggcagaggacctgctcccctcggcttcttcggctctgagtgatgagtgaggaatggcgactcagactggaggagaagagagcgagaaaaggaaagcccgaggtcgtcgacacgttgtggccacgcgtcggttcgctcgatctctccctctctgtgttcttggtcggctgagggtgaggcacagagaaagggcgagctggagaggctgccaagtgggcccaggacgaagtgctctaggtggaagagagaggtgtgggtaagattctaggtgaacacggttttagacgaatttttagattattttctttcccctaactttgtagattcataacttaatgtgtggaacaaattaattagtgttgatttttctggaggtaaatgattaacctagattccattttctttggtttcactcaaaaataatgggtagactgctcacagaaattaaacaaagatgggctattagaaaggtagattgaatttttaggaagcctaaacagaggaggaaaattctagaaaaattatatttaggcatgataaataatctagtatttgaataaattattttccatgttcacttatgtgcagttaaatgtactttttggatgaagtatggctttagccgattaaaatttaatttgatttcttttagttttctgctttgactgattaatttgtggtattaaacttagttattaacttgtaccaatattatagtgaattgcttatgctaaacatagtttacataaatttttccatgatttcatcttgcatagattattttaaagaattagaataacctttctttgtatatgtgttcctacttcataattgcacctaatattattataggaattacattaaacttcttttgggctgaaaaaatatatattagaatttaatatatattagaattcccgtagacaagttggtacggtgacataccgatgggtgtcttacaagcagtcctatatgcccaaagtgcatcaggtaacttgttcttccatgccttccccatctcgttgaccgtcttctacagaatattcttgatttgtttgttgctcgtttctgtctgtccacttgtttgggaatgataatggagtggcaatgatgtattgagccccaagctcttgcaaaaagctttagaaggtcttatcgatgaaatgagaccctccgtcacttatcaccatccgcggagttccaaaatgagggaaggtaatctcgtggaacatccagcgggcgtgcttggcgtcagcggccttgcatggtattgcctctacccacttggacacatagtcaacggccaccaggttatattcgcactcaaaggactttgggaaaggtcgcatgaagtcgatgcccaatacatcaaatagctcgacttgaaggttatatgttagtggcatcgcatcccgagcagtgatccctccatgcttctggcaccttgtgcatctccgaatgaattcctttgcatcatacattgttggccaaaagaatccactctgccagatctttgcgtgtgtcttgaatgctccatagtgatctccatatggggcaacatgacacttctcagtgatctttatgccttcggctactggaacgcatctccgtagtagaacgtctgaacagactctgtaaaggtaaggtaaatcccacaagtgcatgcggctctcgtagatcaccctcttcttattttctcctggtggtacatggcacgcgaccatgaagttgacgatggttgcataccacgggtcagagtctgtgactttcaacagcatgccgtcacgcagatagtcatttatcggtagctcctaatttttggagtagaagcatatttttttagtgagcaggtattttagtgcagcatggtcaatgtaaactattaccttagctcccactaaatatgacatgaacttatcaatggcaaacactacggctaggagctctttttaagttgtggcataattaagctgagctccagtcaaagttttactagcatatgcgatagctttgtgtttcctatccttagtttgcccaaggacagtacccactgcaaaatcactaggatcgcacatgatttcaaatggcggcgaccaatcagggggtcagatgattagtgctgagatgagtgattccttaaagattttaaatgattttagacactcatcatcaaagtcaaacggggcatctgttgacggtcgttatcgatcagtttcgaccatcaatattaccaaaataggggagaattagtgatgctagcaatacatatatttgttagaataataatattccactagtattaggtatactaaccttttgcagagaatgatcataaaatagaggagaatcgacatcgattcagacgataaatcaatcggacgatgtcgagaaccagacttgtgtgtgaataggccaagaacttagaattggtctgcggaggggagcaatagaggaggccaccagctgaaattgggctggattgggccatccccaggttcggctgaaccaatcctagcgccattggatccaggttttggcatggacgtccaggattgcatcccaatgacggttgaagggcacttcggacaattccccttccacaaccgtcataactacctctatataaggagctcactctcttcacttcaacacacctcaagcaagagatctctcatttctctcaagtttagtttagtagtatctagctggtggaatagaattagaataggaatcaggagtccagaagtcttcggaagagttcgggtatggctctagcagctttcctttcctcttttgtaagccttgtacttttattagaatactcttctatatacatttatggtattgaaatactttccgagtatataagtacctactttatattatgttcatgttatactgaatatacggctagcttatctgggagatgctttggtgcgggtatagtgtttgcttatgcaattactctatgtcatgacgatgatattagagtagtatctggtagtttagacgtggtgtctagattacgtgatatcattatttggggttatatattgcggtcgagaggtgggccgctgatggtgacagctcagtatgggtattcctccgcgcctatatataatcctaagttaatttcctagggagggtattcctccgtatttagccccggttgtatggtcatgacgggctgtcgtaaggaactcggcagtcagggtggcttctcgaagtaccaggagggcatcggatagagggtattagctagtatatcagttagctagaatgtatgtatactatgtatactagaaatataggaatagatttcctttctcttttctttccacttagcttagatgatatattatgaggatgagtagttaatgcttatgtgtcactctacccttggattatcttaacccatgcttagaatatgattgtcacaagtaatatataaattattagttgagttctctctacatgatctttccacgggataaaataaatacgatacccttggaatactctcgggtgaaatgctataatggtatatccgtgcgcttgcggatgaactctgtaaccataatataccataagtatttctgcgccattgctgggaattatatttctagtaatgtcgttaagaaataccaacaacatccttagctagcaaggcaattaggggtctagcaattttggagaaatcctttatgaaatgcctctagaatcccactgttggtaattcttacggtcgcagataaaatccgcaagcgcacagatataccgatgtagcacttccctacggagtattccaaagggtatcgaatccaagggaacgtgtgtggtcagattttcctccggttcatccaaggacaccaagcaaaggatagcctaggatatagatgatttactggtgagaaatagtgtctagtgaaagcttaagtttaatcctaacgcaatacttcaggcattgacaacctgttgttcccagatattgctctactacgtactcggacagggaggacttaagtgatctcgatggctgtcaccacctctacacctaccttaaacgtactgtgggatacgcagcaattactggataacaattacctaaacaccacgtctaagtaattaatatctactttagtgtttataactcaccaaagcaatcactatattttagttgattatagtgaacaataatcccgtatgctatttaggaactaaccaagagataattctcacaagataaatctaaattactcaggaagaatattatattgaaattagagtaataaacaaaataaaagaaatgagagaagattaccgacaactccggaattcattcgacttcttctactctactctcttcctattctagtatacaatatagtacgatagagcctcttataattcagctcaagcttgaaagtgtttgtgagagtgaataaagtgatgtctatttataggataggtatgacggttataggaaggggaattgtccgaactgccccgcaaccgtcatcagggggtgatctggagcgtccacgccaaaacctgggatcaacggcgatcaccagggttcgcccaaaccagggggttaggccgaacctgggctgggaccccttggcctggcctttggcctagctcctcttctggccctcctttatccatttctcgaagttttgggctgactctcgggtattttgatgaagtccacaatctatccttgtatggatacatattttctctcactttagtgtgattttcctcccaacttcggggttcatcacctacatacaaatatacaccaacacttgtggaatatgtgagattttaacacctatcactatgtttgatgctttattatcgggactttatatagatgttggcagtatagaatcggcatttaatatatgccaacacccacatatggggccggggatgaggctgttttttgccccatgggtgagtcgggtcagggctccgattgttactgggggcgggggtgggggcgggttgtgaaaattaacccacgggtgaccctatggggccccgaaagtgtatatcccattatatggcccaatcaaaataaaacccaataggcccaaattggtgaacatgtatacaactgtgaagaaatcccttgacatcaccgaccttatccactcgtgcagatcttctatcgagggactccggactactcggtgctccatgcgtccgcgtcgtcatatcccatcaacatctgcatcatcgcgtcccatccacctctgcaccgtcgccgacttcccatctcggcagcatcgcgcgcctgcgccgctgctggcgtggcctctctcccacggtatttttgtagtctctctcccacggcatgatgacgagagcaggtctcgcttccgctccacgctccagcttcttctccgtccaaagctcatcgacaacttctttccttccacaccatgttggccctctcccttacttgcggtcttttctctcttcgcacctcgctagcctctcccctcctcaacacgtcgccggtcatcaggctccctaccttcgggcccccgaccaagtttcgggggcccgacggggctacggacgagggcaactttggcttcgatttctgcttcggggccggggctgggtggaagagctagcgatcgggggtgg

SEQ ID NO: 42385 - DNA, 6352 bp, Oryza sativa
aaataaaaaataaagatacgaggatgacctagactcagataaattagcaaccgttccccggcaacgacgctagagatgcttgttggtatttcttacgaccattgataaatccgcaagcgcacggaataccgatgtagcacttcaccttcgggtgaccccaaaaggatatcaaactcagggaacatgtgtaatctacttaaggctaagactatccaaggacaacaactattggtaggctagctaggctagagatgactttctatgtgttttagttatccaacctaagttaaaggtaaattcctatctggtctgccagcgtggttccgctatagctctatgatgtaccctaacgtggagggttactaggacgggattcatggttgtcaccacctgtcgtttacctctgacaaattcatgggatacacaacaaataaaggtaacttagacaccacatttaagttattaattactactctaatacttgcctaggaacttccttctttatccggagtcctagtactagagtacttagtatgaatactaaacaatgaacccataaatatggaaatctatcttacttagactaaatctctactgttacaaaaattggagatgttttgtcggtattttggtacgtcatccgtgtatgagtcggtttttaagttcgtttgcttttggaaatatatatctgtatttgagtcggtttttaagatcgttcacttttagcaatacagaaggaatcatataagaaatctgtttaaaaaaactcgcatactaacttgagacgatcggactcctaactgcagctcatgattttctaaaaatagatatatccaagcgaactcccacagtgaatttcatcttaaccaaaccatataacaataataagattaaaatagacttcactcgttgcaacgcacggacatattttctagtaattaaataacatcagaaatgatcccgaatgcttactttatagaagaagtttctccgaacccagagtagagtgtatcgacaactccggtactcctctagaattcctcttagaaagctacactagccgaggtagaagtcagagagagcgccaaccttccggtcactcctccaaagcttcccttcactctacctattttataacatacaaaagatacaatagagtctcttgtaattcagctcaaagttgtgggtgttggaatgaagtgagctcctccttttataggctccaaatgatggttacacctattgggatgaaatcaggagcgtacatgtggaagatggcgatcagcggcctccggatgtgttcggccaaacccaaaaaccctccctttggctgggaggtagcttaatggccccccaacatcatgtattatgatttggcccaattctaagtggttttattgacatatgggccctccaattcatgcaaacgcgtcctaattgtccgaagttgcattttgtcgcatgacaggtgtgttttctctttaaaatacctgtatacacatattttaatccacactagtggaaatgattagtaataaaccctaccactaagttgaataccatattttattctattatatgtaggaattgacggtcatatattatgatttaaggatcgtcaacaaccaactaacgttagctgatgataatggcaacagagaaatgagtatagatgggacagtggtaaaaggacattatgattataaagttttataaatccccatccttataaatttgcaaatgttcagcgcatatttacttaaaattttaaaatatggagtgtagaagaaatttttaatcgtggatttcttgattaaagttgttggttaaaatcttcattattttgaaaaactaatatgatcaataaatttcacggttcataaaatatcttaaaatgacttcttaaaaataagaatcatgtgctataaatctgggtggacctatttaaaaatatcgacatatttatatgaagagaaaatcccttgtataccctcaaattttacctaatcgcttctatacccctaaattttgcttacttccttgtatacccctaaaatttgattttgatcccttccatacccctcccgtcagttgaccgttagttgaccgtctattttccataaaaatgaccattttacccttggatgaacaaagaaattcatgagttacattattaaaaatataaaagcttctcgcatgagactattatagttatgagtttgttattcgatgcattatttatcccaaaaaatattgttagataatgaaataaaaatacatatttatttttttaaaaaaaagtcataaaaatgaggagcattcatataaaaatagaactaccaatgttcacaacattcttttaatgaatgctcccgataaaaaaaatccattgtactattaaaatttcaaataaaaattttaatttattacatttattttattttcaaaatttatgtcaaaattttttgcactaattatttagtctctttatatttataaaatgcacatactgtacactcaaacaaaatttttaattattttttaagcttatatttgaacccaaagcatcaagggcaaaaaggacatttgcaaccaaatgtaacagtgaaatgatggaaaatgtaacggtaggggcatggaagggatcaaattgaaatttcaggggtatagaagagatcgggtaaatttcagaggtatgaaagggattgagtgagtttttagggtacgtaggaaatttactcttatatgaaattccctttgggaacgggacgaatttttgatctgccgccatgccgctcaaaaaggtcgtttcgaaatacgcacatattatacttgtaataaaatttggactcctttcccctccctcccctccttccctctgcgcacccaacccaacccatccgcagctttctcccacctccgcgcagccggtcatacccccattccaggccgctagggttcaccgctgccgcccgcgacggccgccgcgcgccgggcacacagcgcgctttcgccttcacgggctcccgttgccgtctcgcgtcgtgcccgcccccgcgcggaggcggagctatccaaagttatcgcgtccccctcgcatagatctgatattcgcgactggacccgctcctctcggctcgcaatgctttttggagttttgtttctctcccatcccaccacctcggcctcactgagatctccgactccgattacgccagccgccccctaaacctagccgcagcgcatccacccccgcgcgagactagcagcggcgggagtgcgcggccatggcgacggatcgggagaaggagcgggaagcggagctggagagcgccatgtacaccaactgcctcctcctcggcctcgatctcgccgtcctcggttccccctcgtcccccgccgccggccctcgcgtcggcctcttccgccactccaatccccgcctcggtgaacagctcctctacttcctcctctcttcgctccgcgggcccgcgcagtccgccaaggcacgtgcactgatgccctcttcttcttcttttttgattttgtttctaggttttctgtaaatcgtatttgatttatttcgttggactctcaggactttgataaggtgtggccgatcttcgactccgcacaatccagagagtttaggaaggtaagattttgcagatctagtttgcttctcggataatttactacgtgcagaagcatattgatgctttgaccttgacatctgttggttgtttagatcgtgcaaggaatcatcagcgagctggagcagcagggagctctgccacggagcaactccagggtatcttcactcgccacctgctgtgggccgaggttagtaccaagcacacagctgcattttcttgggttgaaccaccttttagtactatttttgcagctttcagcagcaatgcagcttaattgtattctggaaacgtatgaaacgtttcatttcataattgaaattgtggagagttcgtatcaatcactggttgatttgcccttctttagaccgtgttctacatcttttgcgttgatctcaaccttttatagtttaaaccctcgagctccctgaggtacatggcttggagccatcagcaaatacatatcccctcttgctggcctgatgtgcttctcaaggagctaagtaaggcatcttgctgggtattgcctcatccatgcaattaggcacatcttttgattgtgctgaactttatgcagctaggagaggaacagccatgctaggcccctggccagcaaggatgacgggcagcatactgatttgggtagctgcttccagctaccagacacaagacagaagaaccatggggtcgctctagttgaccaaaggagtagagggcaggagcagtgtggtgacattggcgaggctggacacatgagctgtggtggaatagtgcagaaggagcatactgttgttacgagtcgtgagaagcttagtgtgttatctgtgctgcaacgccttgagtcggttgatcagtcctggtggtttggggtattgacctaggatattctacatttgaaatgggttgtttcggaccatggagagcattaaattgaaatgacacataggaggtaggacaacacatagcgcctatttactgccactgtaggaagaaaatttcccgccctcaccccctgaattcgagtaatggagaaggggcataccattgtcacaagaagataaatgtggcgtcactcctgcagttgcttgaatcgatggttggtcctggtggcatgaggtattgatctagggttatgctagaattgctgggtgggaacattttaggtgggtcagaatggagcatgtagagtgtagcagtaaagtcaaatgagacatttgagataggaaaccacatagcataggactgttggggattgtgtccacccattttttgctcctgtaggaatagattttccttgccctcaccccctagtacgggaattctatgtcttgtacctgggtagggggtgccattgccattcctaatatcaagtgtttcaggttgttatatccttagtgtttctttgtttcaccaaacaagggcagagatcatatttgatgtgtaatgcattttcgcaatcaacacatgaaattcaatagtagttagttaacattagtgaagctgatgtggcttcaaaaaataataatcttgatttaaccttggaaaattgggtgttttatcagaaaaaatgatagctaatggccgaaggctgtgttcttttggaggggttgggaacccctcccctccacacagaaaacggagcgatagattaacatgtgattaattaagaattagctataaaaaaatgaaaatggattaatataattttttaaagcaactttcctatataaactttttacaaaacgtgcaccatttagcggtttgaaacgcatgcacgcggaaaatgagggaggtgggttgggaacccatggggaagagcacaacctaatactatatggtagcattctctttgtctctttattagattctgttttgtgattccacattcgtagcattctctttgtctctttattagattctgttttgtgattccacattctaagtccagatctctgtaataatctgcaatgtacccgaaaagtgactgcagttctattcaatagtttttttttctgctccagtatatcatataaattggaacattttcatcatcgtcgatgtaatgctaccctatatcggtgcagatttgttgagctattgtggcaactctctgtgcatgccttgagagaagtccacaggagaacatttgctgctgatgttgcatcaagcccgctgcctgcagcactcacagacgtctcttatctacatgccgctgcattactccctgtgactaaggcaaggatggctgactcttcaattttctgaaaactggttggttgtttagtctgtcttaagatgaccctgccgcagatgttcatcagtcttaaaataggttattcgtagagaacataatttcatagaggatatacttggtttgaggctttttatccctgtgagcatacttgtatactcctgcaatgctcaagacatttgacacctagcatagattatttgtagagaacataactgagactgaggtgttattttgttaggtgttacattatgaaaacaaaataacaccttagtctcagtttattgatatgtgtgcaatagctgaagcaagattctattgcttcatttcttgagaatggtgatccagtaggccccatatcaagtccaattcttagttgctcttgatttttttttttttgaaatgggtgttcttgatgacttgtttacttgtctataaggaaggttga

SEQ ID NO: 42386 - DNA, 1238 bp, Oryza sativa
caggagttagagaagctgcaagacatgcgaaacaaatccaaactggaaggggaactttgggatgaacgtatctcaagttcatctggacagaattcccatttggtgtctaaggcaactcgtttgtgggaaacaatattggctcgcaaaggtacgcttttattagaatatgcccctttgttgtctgatgaagttaattcaagcttaagattagtttgtgttagtaattgacacaatagtgtatagttccacatcatgtatgatgagttatcttgtacttgggttaagggacatgtagcatgaaagagttagatgcttcttctattcttttctctggcacaactaggtcattttacaatccaaacagtttggagagaatcaatgaactccttttctggagaaatccatacttcctgaatgcagcattccttctgcccttgaatattatttgtcattatgacattcccaaaaaaaccagtttcttttgagaaatcaactgaagcttggcttgtttatggtttggttttgtctgtggactattctggtgataaacctgagcaaatatgctaatagcaagccataccctggagatagcaccagtgctaccagggcacgtgtccaaaataattttcgcaggttgacacgcattggcttattgagtcacgtccaacagtgtgacacataccagtgtcgaagctgggggagggtcctttgctgtgctctttgttcaggatgtgttgaggctaaccattttaagcctatttgctttttatttctgaaggacatatagtattttaaattttaatgtgtttatgaatgcatgccaaactcatagtcttggttgtgtttctttatgcacgaggttcctctgcttctttgtgctttctctacctgttttatcagctccatgtttgtgcacttcacttctgcagcctgaggctttctgctgtccttattatactagcataatatgattaatgcttagttatctttatttgatgggagtatgtttagttcttactattttttatgataatataatttattttaggagaattctagaatcctatttttctatattttgccagatcaaacaccagattccgaatcagactctgactctcctatcgagtcctggtaaaactgagtccattttgcacttgaaaactgtttgttattaaaataaaatctataggtcttcattattatgccatccttggcaaacaatgttgtttctttac

SEQ ID NO: 42387 - DNA, 2826 bp, Oryza sativa
cagctgtaaactacaaaacttgcagtctgatcaccctcaactggctatgatgtgcaaaccatcatccttgtccaaaataatcgttgtttcaatgatgcgaaacataccctagctcttctattcacatgcttcaactaatgacttcctagtcaattattcctcatcttatttcatcaaagttatcagatccttttttcatcctcaaaatcaatgtcttcctcatcttattcctccatttatgccttcagtgttaccattaggagatccaattctggcgctcccttcacctatccgatgctcatattgtcacactctcgaatgccaccaatctcaacctgcctcctttgcagccccttgtggccatcttgccatagttaccaatccacttctggttcttgatctagctacccctgattctgtttcctgtctcccctggtgtttcagcagcaatgacacttgtatgctggccatactaatctcatcattcgtagacatttaaaacttcagcattgataatttgaatccccttattagtggttgaagtattatagcatttccaaaacattaaatgaagtatttacttgcaggtggttaatatgactgttttgtaataggtgccattcaatgcttagcgttgatatgtgttaaaagtgaagttatacatcatttttatgtttcacaactgatactattgtagatggctaagtatgcataaaactataattccatatgattatcgaactgattttttccataaattgtggaaaattaaacaataggaatttctaattgttttcttttccgtcctttgctgtattttttcagttctgatatcactatttcaggaaatactagagcactttaaatcaaggatataaaataatcttctgcatcacccatatttgttggttgcattgcatatttggcgccatattggtatctaatgcatattaagtactggtatggtgagtttttagaggattctatgttgtctgctggcggttaggcaagctcctgggcaatgatggggtcctggacttggtcaatacagctcttgtctgaaacctaggcacaacagacttgtgcagtatttatgcataatatcttccgttagctaacatgtagctgtgtactaatttgacaggccaaagcaaatgatggagatggaccagaactactccgaagtgcatctgatggtgaaactagtacccatgctgactcattaacggcaacattggctgaacatcgtcagcacttagtcagtatacaggtaaaaccaactatggttggaagctaagcttgcaaaactagtgtccaaaatttttgtggtgtcgactcgtgtccgcttgtctgacgcggggagacacgcatctgaccctgctaggcgtgtccaaattccaaactaaaggaagggatttggtgggggaggggggggagcgagggagatggacaaatggtagtattttcttgctttgtggtggtttcttgggagcagcaaaaggagagagaagcatcaaggagagagagagctcagctgcacccctaccctttagcctagcacacagttggcctgttaggtagtactaaggacctgtttggtagagctctaagcctctaactcctaaatttaactatgggagttggatctggagtggagttgtggagcagcatatacccaactccacctttctagttcattttatgaatgcgctccacccagctccactcacattttagatggagctaaaactgtttggctgggctccagctccaagagaggtggaggtggaggtggagccgtgccaaacatgccctaaagtattaatgtgtgtctgtgaaagctctactcacgagagtagctggctaggattatctatgcataaaggatcctctgcttggctctgtgggtgtctccagagtctttatccctatttctgctttttattttatttattagtgtataatacatgtgagtccccgaatcctattttttagagtttaccgagtcggactcctgagtttgagtaggacactggctcctgtgtccgagtcccagtaacacagcaacacccttggggtttgaatcacgtggattttactgatgattacttttatctgtcaactgactgattctctaaccattttctaggggcctaattaatcaactcaaggaagctatcccggcaatgcagcagtcaatagcagatctgtcagaggaagtaaatagcgtatctagtaatccaatggataaaatcatctccagattgtctccgtcagtgcaaaattcagggtttggaagagcagaagtaagaaaaagaaaaaaatattggattggttttttgttcgatgatgatataccatgttttgatcaatacagaaaatagtctcgttaaaaagaaaaatagtggggctatttggtttgtgaaatgtccatgctcgtttaatcagcttattgaggaatgtgtgtctgttttgatcagctgtccttgaatcattgggtccaagaggcatgcactttgtgtaatagggtgaattcatcctgcacaagctaataaactgtagcatgggtaagggtgtacagaaccagttgaacagggttggtaatctccataattcatgcatgagaagcagtccatgcatgcatacaagcccaataccaattattggcaaaatttgtttttatacacacctagctaattgtcatgttaatccaatccccattataatggacttcgcgtggcataggggtattcctcaaccaattggagtcttcttttctcttgtagttaccacaacagcttttggtgtaaagacattatatcacca

SEQ ID NO: 42388 - DNA, 811 bp, Oryza sativa
tgtctgaattgattaggcctcagtaacagtctgatatttaaggatctgtcgggttgaaggaatgtgacgaatgattgaccactcaatctgacatgacttatttggtttgagaaacatgatagttggaggatccgtaataccttaagccctcaaatgcatagctcagtaggaaaaaaaagaggaattagatttatatcccaccaaaattatggaatgacccattatggatcaactttgacaacttattttactaataatatttaaaataaaaagtataatattgatgtaaaaaatgtgtagcaattctaatgatgtcaactattacgataaatcaaaatttatttatatataatagcagtagaaatttaaaaagttatgacgacattttttgaaagtcatattgttttagagagggcagtactttgaaggcaagtttggtgcatccctttctgttttgattcacaggtttgcagttacagcacccaaaaaaaaaatcaaacttacctgtatgttatctgttatgcagctccattatctgaaaccgatacagctttaatggaacactagagctcacatgtacattgtgtaatactttgaccactgccgtaagcttcagtgcttgatcacagcctggaggttcttatggtttggttctgactgctgctgggacatttttggtgaatttcttgctggttgtgttgcttgccagttgccaccagcttgtgagggatgtctgcgtcagaagaaggggtattattagggaaagttggggtatttggttttggggagaggaaaagagtgttttagcggt

SEQ ID NO: 42389 - DNA, 961 bp, Oryza sativa
ccccccccaaaagtttctgttcgaagtaggtacaacaaataaaaacaactatggtttccatgtcacagtcaggtcagtagcagtttggtaggcctaaaaattaatgcgcacatttgacactgctgctgcaacttggacctctatgtttcccgttcatttctccaagaaaagtcggataaaaaaaaatttcgtgacacgttttttaaactgcgaaaattttctatatgaaagttgctttaaaatatcatattaatctattttttaaatatgtaataattaaaactcaatcaatcaaacgttaatatcaacttgttttacgtaaaataacttaatcttcatattcatcttcatcttcagtcctagatttctattactgagtatactagtactactacaaaataaagcttgattaatcaagtactagtactccctctgtctcattttaagtgcagtcgtggatttccgtacccaacgtttgacccatccgttttatttaaaaaatttataaaataaattttaaaaaataagtcacatataaagtactatttattttttatcatctaataacaacaaaaatacactaactataaaaaattttaaataagactaacggttaaacgttaggtacagaaacatttaaagtgggatggagggagtaggtgtgcacaaggcttggtcgctgtcatgtacgttggccacgaacactgacgcaacaagaaattagatcaatttgttttgcttgtgcctcactccataaatgatggttatgaacaaaaaaaaaacaaaatttaaggggattataaacgtgtagtatcggaaacatggcccctttaggatttagccttgtcaagtggagatgaacgtagatagttactaattacgcctaaatttgataccaagattcgaaatatgaaaacattgtcaaaattttgaaggcattgggtttccttcacggggccag

SEQ ID NO: 42390 - DNA, 1670 bp, Oryza sativa
aaaatgcaaaccaaagaaatagcaaaaaagggaactaaccagcacgcacacgcccaaagggaacaccagacataatgtcagaaaccatttcatcaagtttcattttaaaaaccctggcctggttcgaactgcaacgcatcttcaatttcttgccactttggattgcaggtaaaagttgtaaaaatatcaggtgcgccataggcacggcaaatagccactacatcctgataattctggtacatgtatcgcctaccaccagtgaagcttgcaggaagtattcgttgcttacctacgctcgcaccatctaaggaacccttagcaactgcatctgtaattccttgcatgtgttcgcatctaagttcacgttgctggtcagctatgaatgttaatctaccctcttcaacacaagcataaccatctacttggccttgagagaataaacgaccgcaacataaataaggattaaattgatctcgacgataatgcagcagtaacagtaatgctcttgcatagaagctctttgttcgtatatcggtacgattcaagtctacccctcttaaatttataaccaagctgaaagccacgctcaccataaggaaacagaagtggatactgcaaggccatataagcaggatgtaagctagaaacatggagtgggccaggaatgctttggacaattatatcgcgctttgcattctccaacgaaaaatcacctacaattaacccagcaagttcatcggctgttggcaattcgtactgaacaggcccattctcatctgaaccgactattctaattgcgaactgctcatcaccattatcagctaaacgatctctagcaatcctgaattgcttaaccaaaggattacaattgtccagcatatctagcaattcagcagcaatctgaggatctaaatcacagtcttcgacttcttcattaagaagagcacgcatcctattctcgatctcgttttgagtgtcataataaatatatagttgagcaaactttagtggggtttcttcgctaggtaaaagtgagcctatacgatgatgtacttgaccatttattttaaagacataaggaccgccaccgcgatttaagctatcgtcaatatttgcacccattgaagtgaaagcaaacagcgaattgtactgccttatgtgctgcaaacaatgcctgcttcgagcatccccatcgaacttcaaaagcgaatttaaaggttctggtggttgtgcaaatggaggaacaaaaattttgccgcctttgcaacaaagactataagacatacggcgctgagttatagctgaatctctcttgcatcgttcttggtaccagaactgagcaccacacatgcggcactgagttatatccttcgacgtctctatatgcacatgcaggtcaaaaacatatctatatttagatataatgtcggtgcacgataaactaaggcatggaaaggggtaaaataaagtggaaataactttttaaaaatttgccgtaatcactatcaaacctattggaagacagggacgatatacgagaaagccttttacctacaggaaaaatcaacagacaacctgcaaataagagaggctgacagggacatatgaagggaagtaaaaaaaataccaagcataaagacctgcagccaccagtcgtttgagagccaatt

SEQ ID NO: 42391 - DNA, 24869 bp, Oryza sativa
agcctaatcctacttgacttcaactgttgaatgtaagcctgaacaataaagcagtgtatatatatactcatcaatacaaatagtatataaagccacattaaattttagcagaacttatcaacttgtgctcgtatgtgtccataaaacaaacatatgaaatgaaataatatataattcatgtttcaaatagccagcaccctaataatataagactcaccgcataatacataagacccatgtttcaaatagccagtaccatcataagataagactcatgtttcaaatagccaggaccatcataatatataattcacacctgagaccataaagaaattggaaatgcacatatgaaaagtgataatgtttcttgcattggtaggccggtcaaattcacaataaagccagtaaaaataactatgtccttcagcacataagtcccaaagaaagagccaaaaacaaccgcatcacaaagtcggtcagcacatttaatcgcgagctagcactccatgcatgcatgtagcaaaacaaataaagttgataacaaaagcacatatgacagcacttgcgtgaacaacatgtacatgtcatatacactaacattattgttaggatatatgtttgtacttttcgtaaagtattgtacgtttctgcaagcacatatatatacaaaaacacacacacacagtacatgcaggagagattcctttctgctagcttgaattaataagctgttgagtttcttggttgaccgactaaccttcttactaaggctacttttccttggtgcctctctattctgtgcaagcctcctcagtgtctgcagaatgtgcatatatatacacacacatattcacacaatcaagctgtcagtctcaaaaaaaaagtcataaaatatgcaggttatttcctgcagacagggatcgttcaacctcctaattacttttttatgcacttttgtgtgctgttgaagtgctgcggagggagatcatcaaatgtatcaaaggtatggctggatggatgattgactcactaaccttagggtctagtgtcctccttccttctctttctagatcattagatgttgctgcacccttcccactgttgcttccttccttctgcaaggcacatttttttggccccttcagaagacacacagaggaaaaaatatatatacatatatacagcatatatagccggatttctatccactgtctaaaaaatataatatgagagagagagagagagagagagatgaataccttaatgaggctattattcttgttatccttgacagagttaggcaagggaacaatcgatcaaataggatccgccatacaacctgcaggcaatataaacgtgatctagatgctatagcatatagaacaaaaaagcacaccaaattgtagcgcacaggtaagcaaaaaagacaacaaagatgctggctcgaagaagataaatgggaaaggacctaacccgaacaacacacaatgacaaggatcgaacagaggttcttcaattactttgatagctcaaacaaagactctaccataggtagaacacaaattccctagctcaagaaaagctaaactgttattgtgtcctattttgcagcatatgcatcttggtaacctagcagtgcactcaactaaattctgttgggcctaatgtatgtgatacttataggcatcaacacaatgcactgaatttagtatgcaagtgaattatgatgaattttgtgcatataatctccagtaaaaaggactccaggatacacctaacatatactgcctcagaaagagcccgccgatcttcatgtaacacaagtttcttgaaatctccccatcgggaacacttgccttcaacaaaggctttgatctacctatctagatatttgctttaatctggaagcagtgtgccaaacaaatagtggaacccttacgcaaaggtgccatagcctttaaattgtaaactacattgactgtatagatgatgttacaaggcataaactttatattttcactgcactatatagaacaaccaaatccatacaagctgtagaaaatccaggccatgaattactgtatggtggaaggatatgggctgaataaaggtaattagccagagaatcacatgcaaaaaggaacagaacacatttaatttgtctaggacagtaaactatacgaaggattgaattagacagtttcatttatataaactcgcatgtaacaggaataagggccaccataaatcaactcaagtggtggttttcaacatgaaacagtgggagaattaactatcaaatctgtagttcagtgacctaatgatcaggaatacccacctcttgatgcatgaaaagcccaatagtacaaccttatacttccctttggcttcttgcatttaccatcctgctgtaatgatagaaggggaaacattcagaacaacagtaaagcatatataccgtctttcatagtagtcatcatgtaacaatctacctctaataaatcaatttcctggtgaatacattcagataacaagtgcatcccctaaatcaaaagaaggattggaggataagatagttaagcaaaacaaatctgcaatcacaaggatttttttcacacctacataactattctaatctaatagttaattaaaataaataagcaagctgatgaggaaaccaagataattaactgtagaattcccagaggataatctagcatgttatggcaactctatgctgtacatgtgaccacactgaagcactacatgcactgatgatcttgcataatgcagtatcattttattaagtatgcacctgccctcagcgacctgatcactaacccaaaaaaataaaaagtaaggtggtaacaatattcaatatatcactgcttatttttcttgtcaaatatctgataactgctcagtaacatgacataggaatagctcaaatgttttagtgatcatattcctcatgcagagcgcccaaaatagatattttgagctgtgtactgaccctgaagctatataatctgcagatataactgtgcctcaatgccacttgttgcaactaaatgggcacccacatgattggaagtaatcagtgcctatcaacaaagataatgcaggtatgaggtgaatttacagttgtggttggcgagggcacccattgcggaagacaaagggaaaaaaattagactatctagggtagcaaaaatctagctaatgagaatctgattttcctaacctctgacttttaatttattttattgatttaacaactacaacttcttgaaatctgaataaaaaaactaaattatttaagagaacttcaaattctaggaaaagttgtagctgacaaaaatttccccaagcatgacaacctcatgaatctactccaaaatctctatgtagaattgtcatttaatatcagaagtttcaaaatagaaaataatatgtaatcttatgtttcaaagtgatctatagaatattcttttctaatgggttggaatcatataaaactcctataatttccataaaaatcggaatgggcataaatttttactcgctctgatctaaaatgtagttaatcttatcaaatttatggtactacgcatcaatattctacgacgaaggcagcatagttttacttctgtataaatattcaggagtatcgtgcccgcactctacttttcaatgtaatatcttcgataagctgacccatttcaactaccacctttattaaaacctaataaaataaacatttcacacaatgtggtgcatacttgcttcatacattgacttgtacttgtactgtctacaatatagttcatattagcccttaaaatgtaaccaatgaatccgaaaaccagaagttccagaagggtatacaagcgcacaatatcagactatcaactggaaaatagcaacgccatatttaaatataatcaaatataattgccctgaatccacaagatgctgtcagaaatcacaaataggataatatgacatgaatatgccaacatggcaacaactaaaaaagaaatggtagtttagtgctaccagccctctggacaaacgcattgtgtttagtgtttactcataagtccggaagataaacgaaagaacgagggcaacctgctcatcaccgggaatgtccgtgccaccatctcgtccctgcctcccttgacctccacatctcgcacaccgccgtcaccttgacaccgcaaagccacacgagtcaacaagccaaaacgtgattcgaacaccaaggaaaacgaccaatggggttgcagggagatgcgcttacggattcgaagaggctgggatcggaggcggggttggcggcggcggcggagtccctggatgcggcggagagggcgctgaggtagaagtcggacggagacctacctcgaacggcctcggaacttagggcggcgaagcggatcggatcggcggcgcacgccctcgccctcccccgggacgcccccgcggcgctcgctcgcacgcacgcactgctaggctaggatagggttcccctcgagctccagcagcaagcaagggcgagatgggagggagagagagcagctagcgcaagcgaggagagagaaggaggtggacgcggcggcggcggagctggacggggccgccggggcggaggccaacgcggccgccgcaacggtggtggacgcggcggaacaagggcgagatgggagggagagagagcagcgagcgcggccgcgccggagcgagaaggaggcggccgccgcggcgggggagctggatgcggccgccgcggcggaggtgaacgcggcggcggacgcggcggcgcgagggggaggcggcggcaacggcggcgtgagagggagagtgacggcgcaggacgagagggaggagtcgaggagaggcgggggaggtggctagggctggggttagtgcgcggaactttttcgaaaaagaccctcgactttctatttttacagaacgctcctatttcgcgtttgtcccctcctgcgcatgtaatatccggattttagaagggcccttacgcacaatatcgcctcaggggcaccgttcggcagggacctactcggaattacgaacaaaccgaagggctttctcgcaaaaaaaccaacccgggcactgtaggactagcttttcgctgacgtggcacgccccctcgctcgccactcatgccccgcataatatttcccgatatggaaaaatgatagcaaaatgttggttgtgccgtgcgcttcctcgtgcaggaaaatatcatatatccatttcggccgagattaaggagtttagcagatcgtttgtcttttgatattaattttgttagtcaccatcattttttttcttttgatattaattttgttagtcaccattgtatacttaggctcatccttgtgcaaagcaggtttcacaaggtttgattgagtgcgcgcgccaagaaacaccgtagttgagattttgctcaaagacctactttaattaagttagtaaaatctccttttgctctaaatcccaatgaacaaggaactcaacaacttgtaatttggtgcaaagaattctttatgtggaaacccatactcactcaggccacgcagcatcacacggtgagagggatgaactggacctgatgcattggagtgcaatcagggcagcagccatgttcgagtgacctatcacaaaggaggctggatcgtacgaggatgcaatggtgctagtaacaggatactgggatagaactgattgcggcgtaaccgtaaatccatgagtattttggatacgtgattacacgaacatgtggccctgcttgtgattggagggctcgtagcatcgactactccaaaaatcatacaattgttgtaaaatatatacccgaaccattatgtcgaggggattcctccggatcgatctcacattgataacgcgcccttttccacctatcggtagtttgagagaagtttcctagctacattctcatcagccaaatagtaattagtagctacaaatcaaatactccccaaacaagcaaagtctacatatgtcccaaaatataaaggattttaatccattatagaagggaggtagtaaaaactgaaacaaacacagttgtccttgtccatgaggctatgtgaaccactcattttgatgcggacatcactccttcgggaattgaccgaacaatttgacgtttagaatctgttccggcgctacgacgtcgtatttgggcttgtgggccgtgtatcatgttggaacccattagggttgcatcaagggttgtttgcacaaccctaaactctatatatcaatacccgtcgtcatctctagggtttgggtttagcaatttgattgtaattcaattcatgatgatcataagtagaaagttcatgttcttcagtcattgataaacaggacagtactcaacacaattaccacaaaatatacaaactccgaaatcaatactataattaagcaattgtttccttttaatatccttttcaaatctccaatccacaagaggtagatctatagggcatacgcgaacacatacttcacaagcaatacatttatcaaattcaaagtggattcgcccccagaaacgctccgatgtaattgatttttcataggggtagtgaatcgttataggtaaacgatttgtgtgggataaggtaattatgaaactttgaccaatgtaccttgctgtgcgtattgtttgttgaccataactcatgaacccagttaccatagggaacatattcgaaatatctatgaaaaaggtatgtttctttctcttgtttgagagaacttttgtgttgaaaatattcttactgttattgtattatcttattttatagtgaaacaagttgggaagaagttgttaataagagattgcccagggaaataggtaaaagaaatttccatccaagatttaataactaatccattctcatcctgggtaaagtccatcttattgtgatagaaatgaagagaaataaataagctttagttaatgtaataaagatactcattgtcatttctaaaattccaaccattttattcatttggaaaaatccaaaaaaggatatatagggaatagacaaattccacccgcctaagcagagaactgttacaaataaagaggaaactaataaatttaggtaagaaacaagataaaataaaccatatttgatagcagaatattcggtttgataacctgctactaattcttcctccgattctggtaaatcaaagggtaatctttcacattccgccaaagaagaaattagaaaaatcagaaaacctataggctgacgccaaagattccatcaaaaaaaccatattttgactgtgcttcaactatatcaactgtacttgaactgttggataatcatagtcgacgataacatcccagttcccaccgctattccaaaaccgtacatgaaaccttagtttcatacagctcctctatgatcaggaaaaaaggaaagtattgtttcatttcgttattatcttcttgggcgtagttagaattatctaagataaaatcgatttcaacgtcctaaattagaccaaaggaattctatctgctagaataataaaaaacgcttcggaattcatctcatcctttataatataatggtactttttctttgttcaacaataacttaatcttggaataaaacactcgttataacaattaataaacgaaaagagttgggtattagttcatgaagaattctgtatgaatatggataaacgatggaaagaataaataaagatcttttttttattgcattccatatcttttgtcctattcttctttccccgaggagtatttaaaaagaaaaaaggaataaagggttaattcgttcttgatagccatttccttaacaagtgaatgggaacatactctggatcggaatccgaagaaagtactacttgctcatttccaccaatttcaagtccttattatgattccttttatgaggaaaaatatctaatgctttagattccctcattactaatcctttatgtactttagtgtttctaatccctcactaacttttgatggattcccttatgattacaactttctgtatcaggaatctcttattattgcccgcttcaagatatgatgactaatcaaaaaatctcaaccttggggtaaagaatttacaccgcttatgtttacttccattttttcttgtacataggaaatgagattttttctttttactacaaattaataagcagttttgtttcactcatatagctatctagtttaacttactaacctgaatatagaataagaaaaggaggataaatattcaatgaatttcagaggaaaaacatcctattttaacgaatcgcacgtagagatattgctagtacacaaaaagttaatgggatttcataactaatagattgagcggcagctcgtagaccacctgaaaaagaatatttattatttgagctatatcctgccataagaagaccaataggagcaatacttgaaatggcaatccataaaaaaacaccaatactaagatccgctaaaacaaagcgatatcccaaaggaataactaaaaaacttaataaaattgatatgactgctatagacggtccaatgctaaataagggaatatcccctcgggatggcaagatatcctctttaaaaagtagcttagttccatctgctatagcttgaagcagtcccagggggccagcatattcaggaccaatacgttgttgtatcgatgcggatatttctctttctaaccacacaattacgagtactattctattgtgattcccagtaagagggtcaaaatgggtagaatccatatcagtccatagacttcttttaataattccaagttcgaaaaagaattgatagcttctacatgtaccctgtctattatcatttcaacgatcaacttctcccataatgatatctatactacctaatatcgtcatgatatcagccaatttcattttttttactagctgaggaagaatttgcaaattaataaaaccgggtggacgaattttccatctccaggggaaaagactatcatctcctaccagataaattcctaattcaccttttagattaatctatcaagaatagtttcgccgctagatcggtttgtaagaccccaacttgtgagcttaatcattcatctgcaattttggttgtattctttcttgttcttgtttttgttcttcaattcataagcagggattagccttctcggcgaggtcaaccgggtttcggcactgttgataaccagaggagacgtggtgctgcgattgcggggctcaagaacgtgctcgttcaagaagccggatcgatttgtgtcatgactccaccaaatcgttgattatccgaacctttcgaaaaatcgggaacccttgtccacatcacatttcctcgtgaaaatcctgccaatctaagtacatatttatcgtgtagctacaaaagttgacatatcatctgttctagtaatataaacataaattgtaaggtatagatgccacactattaatatctagcacaccactctcccacaacttgttagggctcgtgttaagttgggctacaatttcactgttttaccatgccatctgaggtagggagacaaatctatactcaactctcctccctttgctagctgagcacaaatctaatgcgatattaatggtccgcttacatcgtcttactgtattcgctctaatacaactaagaatgatccgatagttgtatttttatatcggtaactggcaatggctattaccctgttgaagtcgctcaatgaggttagtcatgttctcttgccaataatacaagagccgaaatttagggcttagaaatatgatgattgctgtcatatttatgtaatattatgttgctgtactgtttttgatttcatataagagaaaatgttggaaaatagagaggaggatcaaaattagagaacttaggagtgaaagactattccagcttattcgtgagagtgatattgcttgtataagcgagctccgaatggacaggaggacatttcacattctatgtgacatgcttagagacgtcggagggatcggtagcttcattcttatatatactatctcaccatttaaagaatagaacaataggaaagttttttttaccgaaatggagagactgtaagtaggcatttcaatttatgactgctagctgttctgaagcttcatcaacttctacttaggccttgtttagttcgctaaaagaaaatttttggatgtcatatcggacgtttgaccgaatattggaaggggttttcggacacgaatgaaaaaactaatttcataactcgcctggaaaccgcgagacaaatttattaagcctaattaatccatcattagcacatgtaaattattgtggcactaatggctaataatggactaattaggctcaaaagatttgtctcgcgattttcatgcaaactatgcaattagtttttcattttatctatatttaatgctccatgcatatgtccaaagattcgatgtgacgtgtttgggaaaaaaaattggaaactaaacaaggccttaagaagccagaacctatacctgaggacaccaccgacgatagatggaagtatttcaatgcaacccattctaaaaaataaatcacatttcctttcaaaaaaaatcacatctcaccactattaattgtaccatattttattgatgtggtgttctagattgtagaattgcctaggtgcattggatggtacacacataaaagtaactgtcccaaccaggataaaaggaagatataggtcaagaaaaggagacattgttgcaaatgtattaggtgtttgtgcacccgatatgcagttcatttacttactacccagttgggagggttctgaacatgatggctgtgtccttcatgatgcaattcacaggtcggatgggcttcgtgtccctcaaggcgagttttttttccaataaatttattttgaagtgtgacactccacagcctgaattatactgatatttctttttttttaattttaaaggttgctatttttttagggaaacactgtaggggaagcccccatagtaaaattaattaaaatataaagaaatatttacaacaagttcaaccaacccaagagcagatgtctctctattacattcaatctatgaactaacaaagagagatcacttttaaaggttgctattactttgttgatgctggttatataaatgcaaatggttttttagccccttacggaggccaaagatatcatttaggtcgtttcacagcacttgaccgaccatgtagtgcagaggagtactttaacatgaggcacacaagtgctagaaatattatagagaggtcttttggaagactaaagggtcgttgagcgattttgaggtctccatcctattttcctatcaaaactcagtgttgaattataatggcatgtgctttattgcacaacttaattttgcaaaagatgtctagtgatccatttgaggatgaggatgagatactgtcggatatacttaagggagaactcgctgaacctgagtttatctcagctatttcgacatctgatgattggacgaattttcgcaacactcttgctcaagggatgtataatagctatagggctcattgaggtttgtgttttaaatggaatttctaattgattgcaaatcagaactaaaaacaaatgttggtacaactatggacgctcactgatgttagttttctgttgaatttctaatattgcagttatggagcatcttggaagctcaagcattgtgcgtgggagaggcaataacaagaggatttggacgtacttcgaggatgaggaactgatcaaggcactgttcgagattgctttagatccaagctggaaatcagaagggggtttcaaaaatggatactgccaagttctagagaacgtgcttgctaagaagttgccaaattctggccttactgctgttccgcacatcgagtcgagagtaagacactttaggaccaagtttggggcaattgaagtgatgctaaccaaaagtggcttttcttgggatgacaacagaaagatgatacaatgtgagaaacaacaatacgatgatcattgcagggtaagtcatcaaactaactatataattatatggaatacaaaatttatttattgattcattagtgcattgaattgaaatatgtgaaactaactgtaagatattttctgaaattttgttccaaataagaggctatgtaaaattcctttgaaatgtttgcgaagacaacattatggttttcttgtagtatgctctctcataaatatgttctcttgtgtttttcatgtaattgttgcatttttgatatgtcacagtagctgcataggtctctcttctgcttgctaaaccatgaccttaattttgtgtcattctttgtattttacagaaaaacaatgaggcaaagggtctgtatggtgtagcattccctcactatgatacactagctgcaatttatggtaaagacattgctactggagaaggtgcagagggttttggtgaggctgttgctaatatggagaaagaaattgttcgagatattcaagatgaagaggatgaggaggatgaagagagagtgtctagagaaacgcctcgacggagcgttgattcatcagcacctcgacggagcatcgattcagctgcacctcggcggatcatcgattcagctgcacctcggcggagcatcgattcaactgcttcaagctctaagaagcggaagaaagacagcaacaaactgaaacataccttgtcaagtgacccttttatggatgtctttgccaatgttcaaggtgatctgagggatgttacaaagcatgtgggagcaatggtggcatctatgcaacatgaagctgagatccaagagaaggcaatggttgaggaggacccactacaaaaaattcagaatgaagctattcttgagtgtcaaaagcttggattgactggtactgaagttgtcaatgatgcagctgcttttgtaaaagtgccggctcaaatgagtatgcttcttgctcttccagaatctctcaggagggagtacgtcctgaaaatacttgctggtaattccctatacacatttgcatgttgtattacatactttattttgaggtcattaattgtaagcatattgcattttactactttagcatttcatatatgcattcactgtgaacaaattcgcatcaaataccttttattgccttatatactatttgtctgaaaccatgaacaattataatgcatgtatgggtccagctgtccagctcaatgccataggaattaacctaaggaggcataattcactccaaactactcctagctggagtatgtgcctatgcctttcttgcttgcttgcacctataaaaaagtggttcaagaaaacaaagcttttctaccaattccttgtacatattctgtgatcaaagtactgtcctatttttaagacaaaagtactaccctagcttatttgttaactaatctggtagtttcactcatgtcaattgttcatccaatcctttatcgattgaattttgaaggtgtgccattgattatattttgcaaaatattatctcttgtcttgaattcttgctgtcaaaatttgcatccaaatagaagtgacagtgttgtgcttgttcactgcatttgcatccaaacagaagtctccatattatgtattttctcgttgtgtatcagtttcagaatttgatttctcaaccgacacatgttttgcttgcacctgttagtctgttacctggctgcctaaccaaacagcgcgaatgaattggtatccgttacagcaactatccagacaaagcacgtaatcggttaccggcggaagcattcccaattacgtttacgttaacattattgaaccaaacaccaccatgttctcttgccaataatacaagagccgaagagttgccaaatgttactctgctatttgcaagttccgcaagggaccgcataactgcaaataagcctggagctcaatgcttacatggcctgaaaaggtggccatactctgaagaatgattataatgtatacatatctatgtgctgagaaatataaaaaactataggacgagaacagctaaaatacaacagaaaaaagaacatcttgaggccaaaggaagcactgagctttacaggaggctcgccaatccttgctaatagttggtcaagattttatctggtgatacaccatctgctacaagggctgatgtgatctcctgtgaagcagaatacatcatcatcatcatatacaattaatgaacgggaataatggaactcatcagattttagttaacgatagaacttaatgagataactcgtaccaaactgccatccaaaagaacaagacaacaaagaccgataaattcatctgtacaatcgaaaatccgtacagtgcacgggcaaaccgcaaactaatttgtaactttgcaccacttgcacccatgtattggtagccaagagcaggctggccagtgttgtgtgttgaaccaaacaaactcatcgacaatgaaatcgacatcgcagtgctggccatcgtgttgaaacaccatggtggtttgagcctaccacagctgctgcaatctccaccagaaacttatcatgctattgaagatggccacaacccaagcaaaaccagcttcatagacatgaaggactagcaggtccttaccatagatgacccgaaatggagtggaatgcttagctgtctagaaatgagttgcaacgaatcttagcacagggcattcagtgaactcactgtgggccgatcatcagcgacgcagtaaaggtacatctgccaatgggattggggataaaaggcaaagctcatgtgtagcatgacatataccaactggaagagatcctcttaaaaggcactggtgaagatgggatcccttttgctcataatagataacgggatactctgtagctggacgatcgcattggacaaggcccttgcgatggagcttgctatattgggatggtcaagggcgatgaatcgctactgtgtagtttggatgatgttgtacaagaaagcacttggggcggagctatattaggacgttcaagggcaatgatgtgagcgcacttcaagaaccagtccttgacggtaggacggcatacataacattcacctttcggagaacctcaaaaaggggatatgcacctacattagagatgactcctgaaggggttgcatgagactaaaggggtggaggtgttctatattattgttttgccacatgatattcgcctatacaaaagtcctataacaaatgtcgcatgctggcagtggcgtatctaggtttttctatgggtggtccaaccaatatatatttttttaaaaaaccctaaatataacgaagctaggagtataaattgatcaaatgtgcatcaaaatgcattaataagggtgctttttttctttttcccccaaaaaaattcatttttgtatatatatgcattgggctaggattttttttaggtggtcccgggaccacccttggatctgcctgtgcatggtggacacatgcaaaagtgcaactgtagttggtgcaaggtcttttgggtgtcctcgtcataccatggtgtcggccaacaagttagcgaaattatcaatcgactggcacatggaactttccacggtgccgtaggagaccatcgaccgtgctctaatattacatgttccttgtatcacaatattgcatcgaggcctgcctatactctaccctaaaagcataacagcttacctaattatttggtgggatcgtggagaggcattgatcctagatgtacttcaagctaagaggtaggtgaaaactatggaaaacatcattgttgcttgatgtgtgacaattctcacatcataggtcaacgaggagacatcgagatcaagtcacacaacaatgctagattcaaacagttaccaaatgtgcatacgggctccttttcaggcccataagtacttggtggaaagctcttggagtcctctttccaacagatttaacatcatctctatattccatcaaagttggccacaattaaagaaagatggtgttgtgccacctgtcatgagcctttatgcttataattttgtgtggagactaggacctcggtccaagtggggcccatgtggagtgcccctcaatcatgtggagcacaaccctacacaccccaaggtcatcctcccatctccttaaatagctaggtaaccttcagtatttctcaggttttcttatattaaagttagtcattgctactttgccttgcagttgcacgtgtctgccagaccgcctaattactcgtcttcggaaccacaccttatcgagtgttcgatttatcgtgagcttgaattcctatttgtattatcaaattactttaatcttgttcttccttgtttcttcgatttacttgcagaaataaggttgatctgaccaggtaagatcaacaacagatggagaggtgtatagatcgctaaggtgcaatacaacgtctagtacaattgtagtcgggtcatcaacttctctcccaaattataggtatcatcaactaacagaaaaattggaccatccttgctcatatcgattggaattacagagttgtgagcgtttcactactaaagacaaccttaataagttggatcaactctcactcttaggacaataactttgtgttaaggtatgtctgccctgttgaagaaagcaaggagggaatcaacttgatggagaatctgactgaagtctagacccaaggtgtcacaatcgactgcagaaagtgtgttgatgttaggatctgcaagacaagctagtgatcaacaaaaaatttaagagcttggaatgtacgctcgcctttggtcctccaaaaaactccttcacaagcttggatagctaaacaaagtcgtaatcctagataaacgttttgtagtatccacacaaaaccaccataagatctatcgctgtagaggattaggtatttagctcacatggtgtggcctctaagccatgctaggtgatgagatgtcgagatggttctgccactagaaggacatgggcgagccatcaaatttccatacatgtgccaacattttaaacaactatacattgacgatgtcgaatcctccaagaggaattgtcacccttttgctaagccaggtgcttgtcacccaattgttattagtgatgccaagcttacacgcattgtctcatgcacatagttgtgtgagttgtagaccatgagtgcaacacattggaggtgcccttgatagagactagcaactattctacttgtgtggatgatgataacattaagtgatacctagatgtcctcggttggcttacaaggctcttccaactctctatagtacagcaccatgggcgatgtagtggtggatgagaccaaaattcctaggcaattctaacatagccgcctgggttcgattggtcattttcttgggttaattagatccatgccatcacaaatttcacgatttagaaaaataccattactattcacctatttttaactatgccactgcaatacatctgaaatcggatccatgccactctatacaactcaaacatgtttgaaacgtatttttgctactgtattttcgtagggaccaaaatacccctcgtcctatccccataggacccacctgtcaagttcatcttcctccacccttcccaatcttcctcttcccactctctccacaagctcttccgatggtttgcagggacggctcctgatagtggaggcagtgacaatagtagcatccgacgaagccgcgacctgaattgtgctctccgccaggctcgaggtgcagtggaaacgaagctccaaccagcggtatcttctgaagaaaacttaaaaaataataacggtagcttctgaagaaaactagaaaactgaaaaaatattaaggggaaagggacaaatcagatgacgggagctagcaaatctcctctcctgtccagggtgcttctgcaaaggcagacctcctcccatagcggccaggtcggtcagcttgtcggcctgatcctgctactactctcagccatggctccggcagcgcgcgcggacaagcctgcgaggggctggctggcagtgacggtcgaggtggacgagtcctccgctgtgtactacccccatgggtatggcttatccaaagaagagaggcagagtggaggaagatgatggatctgacatgtgggtcccatgtgagaaatgggaccaggggtattttggtcactatgaaaatacaatagcaaaagaacatttcaaaacgggcctgaagtgtacaaagtggcatgaatccaattttatatgtattgcaatggtatggctataaataggtaaatagtagtggtatttttccaaaccgtgaaatttgctatggcatgaatttaattaaccccattttctttgggtgagttgattggaccaagacataaggccttacattgggggtgagggtcgctagcgccctgttagggcattgctgtaagcattgaaggtggctcattggacgcagttggcttggcaactggtttggctgtgatgtcctctatcaaacgccattggaaagtgtgagtgaggcacatggccacatggaggttgtttggcatattcctccttaaacctcttaggtggagtaattccaatttgccaacagattgttacacattcgtggtccatgtgcatattatctaaaaagtgaggtcatgaaggactcctcatcacgctcaagcatatggtaacattattgtgctactccggagaagtggtgcaccgtggtgcaaccaaccacaaccctactctgaaaacaaatgttcacatcattaacacaggagaaggtcgtacttacgttagaaacttaagctatctgcgtagtgctgctttcttaaccaacaatactaacttgaactagatagaactaagggtggtagtttctccattgggtctagggcctaggcaattttctcacccacgagttgatcggggtgaggcacttactgcttccgaggggcggaggcgggttatatgtttcatccacggtgatcggcaaggccccgtatacataggagatgagaaaatacatactccacaaaagcccatcaagaaaaccctatcccgttatgtcaatctctcggtccccacaaatccatcccacaccaccatcgcagacctccccttcgacatcgtgtcccttgatctgcactagaacgcatgtagccaaaccactatgctacgttcgtcgttgcggacctatcccttgaccttgactctgcatcccgatgaagtagcggccagggctcctacgacactgcagctggcctcaacctcatattcctctatcctaaagcgtggtggtcgacggtggctgatggctggccttgacctcctattcctctgatgtgtcgcttcatcttccacttccgtcctcagagtggccagggactgatttcgccccactcttcaccctggggctggggttgttcttgtccaatccacacccgccccactccgttgccaacccctagttacatctattgtcaccaaagaagatgacatcaacttaccacaaatcgttttggacaatgacatggtctccaaaaaataactttaaccattgttttctattataatatatataaaaatatcaacaaatatttagctttgcttctcaataaataatattataattattatagttgaactaaattcaatcttcttaaaattttacttaccacatgcacattgatggtataatacttcctctatttcacaatataagacattttgggttttgaatagattcatgcatggatctaagtatgtgcttcatatatgtctaaattcataaggatgttagtaaatatagacgagtgatggagagaccaaaacatcttacattgtggaatggagagtagcattttgtacccaaatctgaattttatattgattaaacgtatgtattggacacttcatgatgtggattatactccaattcataagtgtgcaaactaacattactagctcctgactgcaacttgcagagttcaataaaatttcagggtgaatcaaattagctttatctcaagatgtaatacagatctgagcacacaaaataaagtgcaagagctagtggtggtttgatatagctatatttcttgcaacagacagcattgggtttatcacaattatgataagaatctaggaactacactaagcgcagggcaacatttgattgctacaaagtgcagggcaacatttgattgctacagtaagtgtaaattatttttctttttttgggaacaaatagctatcggcctagaaaaaaaaggttcacttttggagtatttactgcacagtattgaattatatccttaaggtttcagctctttggccagaagaaccaaacataatatttgtaacctgtagcacacataacaataggaatgtgcaaaagtaaaaaaaaaaaagagaggataaacatgcctcagacatttgtttttgtccacagagcactgccccagtagaaaaatgatttgctatgttctgggctttcaagaaagcatcctggaaaatgaaaatgatatgatataaggttgtatgtacctatgaacatataacaagattatagtaatgttggagttttcatatattacctgaacatatccccgttctcctttccaactatcatctgctcgtgacaataccggtattattttaagcccagttgactcccagtttgtaaacctatcctgccagagagaaaaggtttatgtgaagatattgtttacatagagcagaatgaaggaaagttccaagtctcaacctgatatgccattgtttggagatttctggcaccgtaataaagtcgtacatcagctctttgatccgcagcaaaaccaaactcaataagtgaccgaaccggactgcatgattaacatacaaattaacctgggtaggattccatcaaaaggatgccagactatacttgatcaccaaaaccagacagtcagcaacaatatggaatcagactaaattatcgtaaaagatgtatcagcattcaagacatatttagccctgtctttcctatccagcaaataagataacagcatgctgatctcccttagaagcaaggaaaccttttcctgctcttgggtagttacaaacaaaatacacgtccttgacaaacgccaactaacatcatgtacatgttagtgaaactatcatgaaactccaacatctttttttcgattgccctattgctaggttgatctggaacattgtcatgtgtgcttttaatttgggacctatcctgaacagtaatcagttatttggcacatggctttctgcgtttgggaaaaaacttaaaaatctggtagtcactggggtggctgcagtgttttgggctatttggaaaacaaggaacaaaaagcttgttttgacaaaaaatttcctaatgatccaactgatgtagttttctttgtttgccattggattgaatcttgggttcctttgcagaaagtggaggtagatcaaagaaggctgctattgggggccaaactcataagacaggtagcaaatgagatcttcaattccaagtatggattgagaggaggcgcaagaaggattggactgtgaagtcagcttagatttgaagacctgtggtggctgctgccttgctatggtctttggattcttaggtgtcttagctttactttaaaactgcagggagttgagtcctttgtgtcataggggagattttggttggagtcttctggaaaaccgtattttggatgtagtttcctcagaaaactagcttgctggtagtccttgtttcctttgtatgaaagaactctgtagtatgctcatttctagtaatggaaatgggggcttcatacccttggtcaaaaaaaaaaaataaaatcatgtacatgtccttgccaaacgctaactaagtttgctttgatggtgaggaaagggaactaaacattctcacaatattctaacaaatgtgaagcaatagttcattttaggtccagtaaattggtacaaccattcaaaaacatataggagcagaaagagaaagcagaacccttactactatagtacaaatgcatttatctatttaactttatgcattgttctctttactactacagtacaaatgcatttttctatttaatctctactattataaaaattgaagatgtttatgccggtcctttggtatgtcatccgtgtttgagtcggtttttaagttcgttcgcttttagaaatacagaaggagtcgtataagaaatctctttaaaaaaactcgcatgctaactaagacgatcgaactcctaattgcagctcatgattttgtaaaacaaatatccaagcgaattcccacaggcagctatgagacattaacattggcatctactccctccttcccaaattgatcatcacataatggaattcaaaatttctcaaattgatcatcatataaccgcatggacacagatttcatcagaatacaattaatacaacatgggagaatgtgtgcatgctaaggtgtaagagcaggtacaataacaggctataagccagctataaacatattttaatgagataaaggaagagagagaagagcagcgggctacagatctgtagccagctgcagcacagactccaagacatacagtgtgtaggatcatgtattaatagtgttgtaagcaactattgtatgaattggctattacattggctataaatgatatggagctagtagttagctatactattaaacttgctctaactggaatgatgttttaatcgatgcatgcattgtgggagaatgtgttcatgatgacttgattgatgtgatttaaattatcattggtcttgatgcataaaatatgatgatcaatttgggaaggagggagtaatgtttttctttaattttctttttctttgctttactttatgtttgcctctatggcttcttacgaataagagactactttgaatcttcaatactcttaaaatttcacatgaacagatattaaactggcaaattagtttaatgttcggttttacatgctttatatgtaaaaactattttttttttacttttcctaatcaatttcgagtagtgacatatgatataagttttcccttgaagaaaaagtattgctatattataagcttagctttcacagaatacgatatcttccatgataactgccatcgccattttgggcccatgggccatgagacaaagacatgaaaatcatgattcttttaaacccttgattacatgatattaagttagcttaagtcctactttcttacatgtttccctacaagaatatttggggctaaatggggggtgatggccaagcagatcaacaaaaccaagagtgctgattaacctatacaaatttcgtactaaaaattgagaaagccaaaggaaattgcccactatttggcttattaaaaaaattggcatgcgaaaggaaattagtaatactaagccaaaactagccaatctgcagaccattcgatgggaaacaaacagctcacaatcttttgctgcccaatcagcatgctggggcagctgggctgacatggaaggtggtgattggatgcatgaaatatgctattggtttatttagtactaatgcttaaaagatcatatattctaaactaaaagtatttattttgtaatccatttaggaaaaatctatttctcataacttagcccagtcagtccagtcatagaaaattcacttttttttacatagagagtaatagaaggaaggtagaaccaccaattcgtcatagtcatatacatattggcattttaccttgctcaagccaaaggctacccgctaccctacctatttgccaaaacagcatgctatctacccaatccttcaatgccaaacattttgtcatgcccagatatcggttgtaaccaaatcttgatatggtttatcaaggctagcaatcaaacagtcaacacaactaaggtttggctatttcttccgcctagccaccgctgcaaattttggcatgactactgaccagggatggtggccagagggtgtgtgccccaacaggcccaggatcacatgctgtttaacaagccatctcaacttgtgtcacattgcatatgctgtaaggcaaagtgcgttgcctcaccatactgctgtagtaaacatgccatttaaataaaagtatgtaatgcagtatagcgtaattgctaatcttcgtacacataccatccatttctcatgttaatttttcatataggtaattcttttgtgatctatttcatctgtaaggaatgtttgatccttagcaaaacaaaaacaaaaggcatttttttaggaaagaaccaaaggtgaggtactaattttctaggcttgatttatatgcataagtaatagataacacaattatgtcagcacctacggttattattagagatactgttgctcgacgatactgttattttctcatcttgcattcttccgctaagtcagcctttatttattttagcaaactggattatagtaagtaaatgagtcgtccgattaatgagatacatcaaaagaaacaagttgcattacagtgacaacatgttcaaaattactgaagaacattgcgatatctctaagcttatacatatgaaatttgttatagctcagaactattttaaaagcttcactatgtgtaaactgcaaaatgctactaataaagcaatatgtgtgaca

SEQ ID NO: 42392 - DNA, 8749 bp, Oryza sativa
ggggggggctatttgaaccgaattttttggtacagtgtttcaggttacagtacgttttgaatttggtcaaagtcaaactattttaaattttactacttttatagaaaaaaaatagtaatatttttaactcaagataaatttattataaaaatttattcaattgtatatttaataaaactatattgatgttataaatatataacatcccgaaaattaattattttctaattatgcatcatgttgattcttatattcttaataacctcctaaaccaaggacattataattataattagagggaactcctaaaactaagtcgcataaaacctctccttttatttaatttctttcgtatttttcatttaactagcaaaaatacccgtgcgttgcaatgggtaaaaacattctaatgaaaatatacgtttttcatgcataatcatgtcaatgacaatgttttattttaatgagcggcttgttttttataaacaatgtttttttcttgcgagattttctcaaaccatttttcagaaatggcgtatttctttctaacagttttttcctagcattttttttgctttttttactgacaaagaaaaccatatttttctcctttttttgcttttcttttctcgtttgtttttttgcctgttttctcgcacgtttttttgcttgttttttttcgaatgttctttttttcttttttctaatacaggagaatatatgacaaaataaaagccgtgtagtagatggcaaaaaatcgatgaatcctatccgactcaagtgtccatcaatttagcttttttctgatagtttttttagagcgatttattttttaatagacggtattttttcttgcgtggttttttaaaaccattttttagaaatggcatgttttttctgacagtttttcctcgcatgtttttttaaaatttttttaccgacgatggaaataatttttctcgcgtgtttttttatttttttattgaagatggaaaacctttttagcgtgtttttttgagctttttctgacttttgcctcacgcgtttttttaacctttttttctcgtgtattttctctttttttaatagttagattagattagagatagagaagagatatatacttgttagaaataggattttttccgccctttccaaattttttttcgcgtgcattttttattttatatgaaccagttttttattttttaagaaccatttttttcgccactttcttagggaatcggacgaacttttttagatgttttttcggatttttttcgcctttataggaattagacttttttttcctgtttttaaaggaatcggttctagccttttttttcaccacttttttttgccttttatatgaatcagatttttttttatttggatctacagtttttttggccacttaggggaaaaaaacttttgttatcgttgtttttctttattttcttttttgtgcggcttttctttttctttttatgcacctttctgcctttattttctctcttttattatttttttaacaaaaacgacctcaaataccttattgcaagattatagggactcaaatgtaaatataaaaattatagagactcaaatgcaaaagtacaaacccaaaaattaaaatcatataaaaatgaaatgatctcgacctgtaggttctattttttaaacagattttcagttcggctcatcaatttttttcaccaatccagagtcggactttttttcgtttctaaaagggaatggatataggagtcggacttttttattttttatttttcgctattgtttttgttttgacgggagtcggactttttttattttttttcgctattatttttgtttcgacgatgaagaaagcatctcttattttttttaagcagtagagaaatatatttggttaaattgaggtatttcttgatggaatcctacattaaaccttctttcgactaaaattcttttattgaaatttagtttgaaaaccctttctacttttatgaattatggtccaagaaaatcctccaattccaattttgaattaattgttgacccatcctttgattctaaacctatccttatccaaattcctcctttttatctagtcgccaatttaatttatgtggcttaatttcctcctcggttcaagaataacagtattataaatatcagaatgatttctcttgtgctaagaagaatagatttttattttattcctctcttccaaattaattccctattagccacaaatatttcttcaaatattcatactaccagtttccatctctcaaaattattgcactcaaataattaggaaatctctcttttgaaaactatttctaaaaataagttcatctcaaaagttagccacctaaatttcttccaaatattaatttggattcaaatttcatccttcaaatctaattcgaaaatacaaaaagattttttattcactgtgggccaaaaaatttcaatctagcccattccttttccccttcgcttggcccagagggcccaagaggcaggcgcctctctccctcctttgtgagcgcgcgtggtgcatgcaaacacgccgctgccttttcgccgagccgacgcgccatcgctgtgcggccttgttgctccttctccaccgctactgccaccgacgtcagccgccacctcacctcgctgacgtcaaccgctagccgaaccgactccatcgtccaatcggagacagagccgccgccgtgctcctcttctccacgccgccgtcgccatgtcgtccttctcctcctcctttacgaaccaacctctcgctgcctataaatagaaggcgagccctccccttttctccacacatcaacaaagcctcaagctcttcctctctctctctccccaccatggcaaccaccaccggccgccgtcgatctccttcaccagagacacgccggccaaaccctcgcgccataagctttgcctcgacgaggcaaatccattccccaaattcatctaaattcaaaatctacattttgatactaaatttactattttaatattttatttgaatatccaatttaaacatatatttacctttcaaatatttccctttatcccaaaatacctattagctactaaaaagccgccggttggaactttacgtcttccatggggacgttcatgcggtctacgggtcccgatgtcagatcattggttgtaaagcccggtagaaccaaacccaaggtttaagtgctgctcttggcaccccacgccttgatgcgtacagcggtcagagcttcactattcccttgacctccaccgcacgctgcacagttagctctcgggctctgtgtgatcctagccactccgccgccacccacggttgtcggagtaacacttccgccccgctaaacctgcaccaacctcctattcctctagccgatatgctatctgttgacaccaactagagaaaataccaaacctagtcgttatactgcccaactctagcaacgactagtaaacaaccaaaccctagccgatatgcttccctactccacaatcggcttaaatataaccaaaccccagacactatactacctaaacctatcaccagctaatactagccatatgcctacttagccagttcaattacctaatatactctgtatctccaaacaaccaaagcccatacataaaatgtaagcaacaatagttgcttaatcctctatccaacctagcctacaaccctttagaacctacatatgaaatataatccctatatcctatagaagagatagattataccctaaaccctagccctcctagttgtttatcgttctcttgttattttatggcttttattgaatttggttcttcctcttctttagtagaatctattatattttggatgacaacctgtgatatttcgaggatcggataatcaggttgcttatctcggatttatttgcgttggagcaaggcaagttattattccccccctttgagcataattgttgtcgtgacctaagggcatggacaaagttgggagatagaagggaaaatgtaatttcccgtctatcctaagagtgagctcaaaagacaaataccaaagtgaatgaatgtgctttttctatattcatctcctcccgtgcttacaggatcttggttggcttaaatagtgctcaaccgcatgtccaagatttacaagtttgtcattacaggcttacatgaagttaccattttacccctataaagtttatgacctataggggcattttggtacattctggtggtccctaaatgacatctggtgctagctggtgagagtggttgaggtggtccccatggtactttcccaaattagaccatttgctcaatggcacttttcctcaacttcatatgctcgagtgagatcacccgtgctaaggctcgaacacattctcccacctttcaggctccttgtcaccttaacctgcctgaaacacagcttcattaattagtgatgttagtttgagcaagtaactttactcgaatgctttttccttgggacagatcctttagggtgaatacatatatattcccatacctaaaactactttttgggtggaaacttcattcgagtcaataaataactcgaacacattttccttcttgacatatgttttcggccgggcatgggggatggtgtttaccacctgctacaacaagcccctcacgggtaagggcgaagtgttttcggccgaaaccgtgctagatcaaaaatgcaggggagtaaccgccgtccccctgttcggtcgaaaacatcattgagatagctgcggtggaactccgcatggcggggaatttgcatatttccatatcgctcggcactacacaaagcagaattctcagtttgaatgcatcaacttcatcgtcgcaattactttttagttttcgagctcgaatttgggtaaatgctttagagctttttttatgtcgtgttttcgagctaaggcaaaaattgctcgaaaaccgccgtccccctaacgtttcaaaggagtgacgaggtcgaacgtgtttccctcgtcgcaattactttttagttttctagctcgaatttgggtaaatactttcaagctttttttatgtcgtgttttcgagccaaggcaaacttgttcgaaaaacgccgtcccccttacgtttcaaaagaagtgacgaagtcaacgtgtttccctcgtcacaattactttttagttttcgagctcgaatttgggtaaatgctttcgagcttccttttatgtcgtgttttgtcacgcccggaaattcactaataatttccaaactaatttgtgcataaaatcctcgtccagaaatcagccgaggtacacaaactgacaatttaatatacaaatccatcataataataacgttacatacttacaaaagaaaagaaaaacagcagcggaattaacggtctagcgatggcttcagctccactcccacaggcaactcaactggggtataagccaaacgtcttctccttctggatcccttttcttcaactgaggttgattgattattgcaagaatgagcatatgatatactcaacaagccacacagcaaatatgcaagtgcacaaggataccaaaggatggcataatatagtctcatttgcgaaagcagcatttagcaaagagttaagagtagtaaaacagtagagtaattaatcagaaattttaatcaacactgaacaacacacccatgctgcacaggcccaaccatcctgaacaaccatacccggctgtacagatctaactccaaaccaggagctaaacaaattattaccagttatagcatcaataattattgtgagaggcgtgagactaatcacgaaaaacattgctcaactcgcccataaccgcgggcacgactattcgaatagttttactctagccagaggtgtaccactgtacctacaagacacagcctcaacatcatgtctaccatgcgtcgcgatactggaaagtacccgaatagaggctgtgacaataccctctgcacaacacaactcaccacagtacaccattcctggatcataatcaccccttataaaacaaggcatggactccccagcgacccccgtgggcttatctccgccacttctcagtctggtgctccacaatgaaccatgctatacaaaaggtaaagccgttgcccacgctggcttgtggttggcacggttaatgtttcacaacagtagctcgcgaaccggtccttaattgccatgagcacgaccttcaaaaccatgtgctcacaacccaccattaatcatattttaattaccaattaattatcataacacgattaaccatcgtgagctaccattaaatataaccataaataataatgtagtatatatgattcatcccattagtgagctaatgtttctaagcatggctaagcaattatatatataacatttagctgaaccaaaccaatacataaggttcaagctaatcaatttattacccaaggtatcaaggaatagggcattcaatgcagattggccataacaaaggaataggttcacaccacccagtgacattcgaaaataaatgcacagttaaaataaatagagaatttaaatataggatcaacatgctcaaatgattgtgtttaggatctgtgtgacttgccttgcaataatcggtctcaattaatcttctgaacactcccgacgcactcacgaaccttcgcaatgacggaaacgacaagctaacacgcaaaacgaggaaaaagactaataaaaaccaaataaacagtacaaagatcatgattttagatgaatttagcaacttgaaccactcaaaaccgagttacgatgatttagttatgaatttccgaagatttaatctattaaaaaaaactgaaaaagaggagatgatgacgtcatgacgtcatcgacggcagccacggcacgggtggcgacctcgccggagctagggtggtcggccggacttttggaggacacatacgcgtagaggacaacattgcgaactcaatggtgctcaccgatacgacaaacgacgacggacgacggccggcggagaggaagagcggcggcgacgacttcggtcggcggtggcgccggagctgcggtggtcggcggcttcgggggtcaggcggccgggcttctccaccctcccgcgcacctaacggtggtgacggcgaccggcggcgacgacggaggcggcggcgcgacgcggatggaactcggccggcgacgatggcggggtggagcacgtggcggcggcgctacgaggcacgggagatcacgggagagggggcaaacgaaagaggaggactagggggtcctatttatagccttgggttgaatagatcggactcctcccgcaagaaatcgctccgggaaatcaaaaactcggttttggagataaactcaaaacgagttcgattcggataaaatactcaacgatttgctccgatttttgggggtaaggatagaggaagatgagaggataaaaacccctcaaaaaaaaacggaagaaaaggggagagattggggcggattcggcgcggcaaggcggctcggcatggcagccgactcggctcggctggcggctggagcttgaagacgcactgtagcgacagggaggaaaagtagacttcttgccgggcttttcttttctcagcctgattagaagagggagtaaaaccggactttggctgagagaagaagagaggatgcaggctcgggttgggccggcggaagagagaggaaggaaaggaatgggccgattcagcctaagacaagggagaggagaattttattacttttccaattaaaataatcacttaaatgatctttgaattgttaaaaatacttccaatgctcaaataatttcaagaaaaatcctgaaaatacttggacactcaaagtaaataaaaaattataattagaccatttaattattaattaaatatgtgggtaattactgaaatgttctttgtatgattaaaattaggaattgagctccgaaaaaatccgagataattccaaagagtataattaaccatgaagaatttaataaaaattaaatccatccatcctttatatttaggaaattttatttcccacatttaacttcacttgaaaattaatgaacatttaatataaattctaataataatttattaaatactttaaaaatcctaaaacgaaattcaggatgtgacatgttttcgagctaaggcaaaaccttgttcgaaaaccgccgtcccccttacgtttcaaaggagtgacgaggtcgaaagtgtttccctcgtcgcaattactttttagttttcgagctcgaatttgggtaaatgctttcgagcttttttttatgtcctgttttcgagctaaggcaaaaccttggtcgaaaaccgctgtcccccttacgtttcaaaggagtgacaaggttgaacgtgtttccctcgtcgcaattactttttagttttcgagctcgaatttgggtaaatgctttcgagcttttttttatgtcgtgttttcgagctaaggcaaaaccttgttcgaaaaccgccgtcccctttacgtttcaaaggagtgacgaggtcgaacgtgtttccctcgtcgcaattactttttagttttcgagctcgaatttgggtaaatgctttcgagctttttttttatgtcgtgttttcgagctaaggcaaaaccttgttcgaaaaccgccgtcccccttacgtttcaaaggag

SEQ ID NO: 42393 - DNA, 11313 bp, Oryza sativa
ggtaaatgctttcgagcttttttttatgtcgtgttttcgagctaaggcaaaaccttgttcgaaaaccgccgtcccccttacgtttcaaaggagtgacgaggtcgaacgtgtttcctcgtcgcaattaatttttagttttcgagctcgaatttgggtaaatgctttcgagctttttttttatgtcgatcaacataagcactgccaagtacctgtgaagaacgaacgagtacgacagcaattctcggatgggtgtagacctagccaattaagttatctagcaaaggtggtacctctctctatagtggttctatatttaagtccttgcacaggaggcaaacttatgccgagtagggcaatggtgatatttactgaggtacaagtaaatatttgatataaactgtgatatcacgaattatttgtaaaccctgattgcgatgacatggtgtcatacaatcagtcctctctaaagaccccgggaatgccagaactcctctcgctgctgataacatacgttcagagtgcatggggactagagttcatggaacaggtaccactgatgttagaaaccgaaaagctgggccgtgactaagctaatgaatattggcatgtcatggattgcgggtaaagcatatatctactgtagtatgaatattcttgaaactattcgaatacctatgctcacggatattgagcatagggactaactatggcatcttggttagaaacataattcaagattttattaaatactgttgcattccaaatattacaggctttctacttctataatctcaactttctgcaagtaaacctagccctactcaattacttctatttcatgaattcatatttgatataatagcttgctgagtacattgtactcacctttactttaaccccctctttcagaatcaatttagagtttttgccgaagccgggagttcaatcatataatcatataagttagtctcattccaacttagctcccaagtctagcataggtagatggtttaattctatagcaaaacattagggttgggtcatcctatagcttctgctatgttagttagccacaagcttgtaaataccctattatttatgtaaagaagtcaccttcggagccttattcaaatgtatgcaatgaagatccagattgttgaacctgtaccaatctactgatcttgggcttgatacagtctaaacatgtcagtttccgaattattagttttgggacccgacaaaatattattacttttttctacagaattagtcaaacatagagtattttgactttgaccaaagtcaaaatgtcttataacctaaaatggagggagtaattattatttaatgaattaaataaatggtaaatcatagtactatattggatttagagaaataataaggacgcagactgaatcagcgtttgtgggtatcaacgtccacaaggggacgttgttcttgcccacgtccatggtatctggtgcaacctgttatgaaacctatcttattgtggacgaattaaattatgagtgggaagcttactacagaagaaagctaacaccagaagctagcttacagaagaagctagcttacggcgcaagccagcttacagaggaagccagcttacaggagaagctagcttacggcgtaagctggcttacgacacaagccagaaggttcaaggcttacgatgcaagcctctaccctcctccgcctataaatagggcccagaaggtccaaggcaaggacaaccgatcttcggtctcctgcttctcctcttgtagcttgtactcaaatccagaagaaataaagcttccactcgcttatattttctgtgttccacagctctgtgtttatctgcttgtgtgctgatcagtagaataaactggtttctcaacacgttatcagcacgagactctatcgagctaaaaaggtaaaccagtgagaaatcagtttctactgatcatcttgctcttgatatgcaaattatccttctgctatagttgaaataagcagaagaacatggtacctgaagtaccatcctccgatatcctctcagcaatacacgataacatgatggctgctctgccgccattatcgttcaattgctaaagttgatacatcctctcagcaacacccagtaacatgatggcggctctgccaccattaccgtccaaaggcttgagatggtacatccccttagcactattcgataacacgatggtggctctgctgccgttatcgcccaaatgctagaggtgatgtaggtgcctgaagcaccggcatggcaacttaatggacggctctgccgccgttgccaccaaatatcggaggcaaacgaaccttctgcacgaccctgaagtgtcgttatggatgtcctttgttttatggatatcacccatatgggcccttgacgcctctaaggtcagctctgccaccatgaagcgtgggcacaatatgcatgaagtgcccatgaatgctcttcattttgttttacatgcttactttgttgtttgcatgactttcataacatttattttattgttatgaaattgatttcctagcatgattgataatatttaatcaagcaatctgtaatcctgaagattacttaagttaatttgctaggaaagattctatgggaaattgtgtgataatcttgaagattacacacactagtaatcctgaagattacgcatgaccaattcatgttgaccctgcacatcgtatttacctgtcgtaaataccaaatgatgttgcaggacatgtcggacatagcaaagaaggaattcgccgagcttgccttggatggtagtaactacctcacttgggcattggacgttgagattaaactcgactccatgggtctcgatcatactattgtgctgcccgaagttggcactgtggagtctacgaaggccgagaaagcaaaggcattgcatttcttgcgccaccatctttacctagacctgaagtctgagtatatgatcgagaaagatccactggtattatggcaatccctgaaggatcgctttgaccagcaagggtcaattgtgctcccacaggcacaacatgactggatcaccctacgcttccaagactacaagtctgtggcggcgtataactctgcccaccataggatcatttctcagttgcatttatgtggcctgaagatcactgacgctgagatgatcgagaaaaccttatctacctttcatcccaacaacatagtgctgcaacagcaatacaggaactcaaagtacccgaagtactctgatcttatctcagtcctgttagttgcagaaaggcagaatgaggttcttctaaagaatcattctgctcgacccactaggtctatggtagtgcctgaagcacaagccaatgttgttggaaactcacatggccgtaaaagaggccatggtgagaagaaagggaaaggtaagggaagtatcatattcaagggcaagagtaagggtaacccagaggtaaaggcgaactcaagaaggttacaggtgaatcatctggggtaatgcaggataactgctatagatgtggaggcagagggcattggtcccgtaactgccatgtccccaagcacctggttgagctgtaccaacaaagcatgaatgagaaaaagagccaacatgagtcccacttcaccattgagcctgaagctcagattgaaaagcatgatgacatgcttatcaatgttaaggatggtggggacatccgtatggacgatgattgagacaaccttcttgaaaaagatgatgacatatttggagacctgaagtaatctcctatatgtcagtcatatgcagtgttcggcatgagtagcacatgtagaactttggtcatgaataatgctcctgaagagcacgcttagtcttttactgggcctgaagtccttgtaatgtttcccttaatagaataaacttactccatgtttaatcccttctttctatataattaagacccaaagctgatttgtggttaagccacgtcacctgtaaaatctcagccattcaatctaatctgcgatctaatctgggcgctcggtcttctcctttctcagccgccgccagatgcgcgctctttctccgcccagcatgcgcccacgcaagttgcactgtgggcccgccgtagatgcggattcccctcgcccaccgcgctcgcttctcttccacccccgtgcgtgtgcgcgagatgcggtgtggtcgattcccctcccccagcggctgcttcccccagcacgtgcaggcccaccagccggcttgctcgcttctcctccccgtgtcgcattgcctccgccgtcccccacgcgccagccacaccgcagcgttgcgcccctgtagccctagcctggcacggctgcaggtatcgcgcgtttgaagagccctagcaccatgccagcttcaaacgccccctccctcatcctcttcagcattagagacggtattcacttcctcccttaatcacccgcatttacaataaaaaccgccaaattaattgggtgaggaggcgtagtggttaatacaagttatgtgctctactccctgcaacaattttactcaagatcgtcgtatcgcctactcatggccctgtataaaacggccggcctctccagttctacatccgtcatggtctctctttgaattcctctcctctcatattcacaacaggcaagttaaatctggctctcagaaccataaacagatattcggatcatgcgagtgtgagaatgtcttgctgtttattctttgcagttgcatatgttgaggctgctatgataattttcttcttcttgatgcagcgttcacattgggaatttgggttaccgtaccatatcctgcacattgcttcttcttcagtatcaaggttggtccactcccactgtgtttcttccgttacttctgcatcacctttttgcttacatacatatatattatattgctgaaaatagttaacccccaatttttattgatccaataatggttaatggtttatggatatgtatttgggctatgtgcgaagggaatgaattcaggtacgtatctgatagtttcagagatttgatggttacgacttaggagcatggtgaaatctgaatcactatttttttttctaaacaagctgctctaggtttgttgacccccctgttcacaagtttgggttgcttagtgcagattgcaattgctgtcaggcaatgctaatttcagcttgaagttttgtttataactaatggccaagtaaagttgttggttgctgaattttcacactaatctttaagttttacatggttagataacatatacatgctcatctctttgttttgaatcatattgagtcaaataaatcttatgtttttggtgcttcctgtgtcatgagtgcaagtcactgaaacagctctgagaaattaaagtttatggtggaataaacatgataaaggtgagcctttttctaaaatcatattagcatttcatgaacgattcgacaaaaccaatttctaggggtctaagatgtgtccggaattggtccttcaaaattgtttgtacttttctgtgggcatgattttataagacttagagttgtttggtctgatcgaattccttggcacatttcagtagctaagtgtaatttgttattacgtgctttactctaattgtgtcctaacaaaaaaacatgtaagagcatgaatggctaattgtttttcagttgaaggtgatgtatccatcaaagaacaaaacgtccttcggtgaccaactaaatgttaaaaatatgctggccctatctctcggaggtgcctcatagagttagagtgtgcatatgtgcctttatagggataagtgtgtgtgtatatgagtttgtatctttttgttgttgtccaattttttttcttgatcctttgacaacaagatacatgttttagggactgttaggtttcactgaattaaaagatcggaatttcacttaccccaaatcaaacactgaatttgaggaggcgtgcagtagactccaacctaacctgaagcaggagagaggaatagtaagcaataagcgagtgaacaaaatatgcacaagggtttaacatttccctttattaagcagagaagatatttaattgttgtactagattacgagtgtgtacgtactgttgaaacatttggtagcgagtatttaagtttgctatatcgattctctctttttctctctacctatggaattagtttattttacatgtagcatattatcttctcttaaaacatcatccatacgaatttcatccaaattatttttacaaaatcccgcagcaacgcgcggggtattcatctagtttcatttatgtttatgttccataaacatacttgggtgggtatcccatggcagaagaggatatatgtctactagacagtgccaccactaatacaatcttaagggaaactagatatttccacaccttaactaagaaaactggaaatattatgaccattgccggaagcaatgctcatatagtaggcaccggaagtgctactctagttctccctatgggtacccatatctttgtaaaggatgctctattgtatcctgattcaaagcgtaccctcttaagctttaaagatatccgtgcaaacggtttccatatagaaaccgagattgagcaagatgttgaatatcttctcataaccaaaatagatggatatcaaaagcaagtggtggaaaggctcccttcatcgccattgggtttgtactacacgtacataaaacccactgaggaatatgttgcgatgaaaaccatatttagaagcccagagtcatttagagtttggcatgacagactgggtcatcctgggttgggtatgatgaggagaatcatcaataattctactggccacaatgttgaaaccaaagacttccctaatcctgaagattttatttgccctgcttgtgcaaaagggaagttgatcattaggccatccctcctgaagattagggatgtgtcacctgttttcctggaaaggatacagggtgacatatgtggacctatccagcccctgtcaggcccgtttaggtatttcatggtactgattgatgcttttaccaggtggagccatgtggacctgttgtccataaggaaccatgctttttcaaagctaattgcccaaatcatcaggctaaaagctagcttccctgatagccgcgtacaatccattcaaatggataatgctggtgagttcaggtcgaaggcttttgatgattattgtttagccatgggcattaaggtagaatattcagtaccacatatccacactcaaaatagcctagctgagtccttgatcaagaggatcaagttgattgcacggccactgttgcaggattgtaggctgccaaccaattgttggggccatgctgtgttgcatgcagcaacactaattcaactcaggccaactacatatcatagtacatccccccttcagctagtgcgtggaaaagaaccaagtatttcccatctgcgtaaattcggctgtgcagtatatgtgccgatcccaccaccacagcgtacttctatgggaccccaccggaagttggggatatacgttggttatgagactttgtccataatcaagtatcttgagcctatgactggggatcttcataaggctcggtacgctgattgtatctttgatgaggaccatttcccagcattagggggagaaaggcatccagaagaatgccaagatataatatggaatgcaactgcgatacagtccttagatccacgcactagtgaagctgaactggaagttcagagaatcataaatttgcaaaatcttgcaaataagttgccagatgccttcactgattacaagggagtgacaaggtcgctatacctgcagtaaatgctccaaaaagagtagaggtaacccataaggttactgactatgctcttacctcccatcctaggaagagggggagacctctgggtgctcgggacaaggttccgcggagacgtccgcggagacaaggatctgagccacttgttccactcaaagaatcagttgaagaagctcaacctgaagttgagaaagccccataagtggcaactcaacctgaaggacactatcctgaagatggaggacccagtgccttacgcgtgcaccttggcactggaagatcggaacaccccaactcggtcgttatgggaaatcacgacaagttggaggaaataaatgaggagatttccactaactatgctgatacaggagagttacatcatagaaagaccactattgtcgacattcactttgcctcaaaggttgccgtcataatggatccggatccagaactaaagtccatgattgagtgctagaagcgctcagattgggacaaatggaaagcatcaatagaggcaaggatgcgctcgctttataaaagagaggtttttgggcctgcagtcccaacacctccaagaatcatccctgtaggatgcaaatgggtcttcctccggaagaggaatggccaggtggtgaggtataaagcgaggctagtggcacaagggttcacgcagagaccggtattgactatgatgaaacttactctcctgtgatgagtggaatcacgtttcgatacttgatctcaatggcaactaatataaacttggatatgcagttgatggatgtagtgactgcatacttgtatggatcactagattcagaaatttatatgagggtccctgaaggactcaagattctgaatccgaaaagaaattgcaacatgtatagtgttcgcctgcagcgatcattatacggattgaaacaatgatgattgtccctgtgtgttcataaagaaatccctgaatggattttgtatcatctcagtctatgtcgatgatcttaatatcattggcaccacagaggacattaaagaagcaatggcttatcttaagaccgagtttgagatgaaggacttggggaaaaccaagttctacttgggctgctgctcgagcatctccctgaaggagtgtttatgcaccagtctacctataccaagagggtccttggtaagttcaatatggataaatgtcatcctttgaaaacccccatggtggtccaatccctggaagcagataaggacccatttaaacccaaggaagatgatgaggaaatgttgggacccgaagttccctacttaagcgccattggagcactaatgtatctagccaattgcacgagacctgatattgcttttgcagttaatctattggctagatatagtgcaaccccaaacagaagacattggattggcgtcaaaactatcctcaagtaccttcgaggtactcaagatcttgggttgtggttcccgaagaaccaagatccatccatggtgggatatgtggatgctggctatatgtctgatcctcataatgccagatcccaaactgggtttgtatttctttgtggtaatactaccatttcctgacggtctataaagcagaccctggttgcaacgtcaaccaaccactcagaaataattgctctatatgaggccacacgagaatgtgtgtggcttaggcggatgatcggttacatccagaagtcatgtggcctaaatattgataacacccccaccattatctatgaggataatgctgcttgtgttgcacaagtacatatgggctatgtgaaaagcaatttcacaaagcatattgctcccaaattcttttatccccatgagctccagaagagcggggagataaatgtcctacaaactaagtcatgcgaaaatctcgcagatttatttacgaagtctctgccagcatcaaatttttacaaatatgttcgtggcattggcatgagacgacttagtgaattgcaaggatcagggggagcaaacaattaagagaatagcccatgattgtgatcctgaagaatcacaaacaagtcctgaagacttgaccaactgttgtactctttttcccttggtgagtttttttttcccattgggtttttctcacaaaaggtttttaacgaggcaacaggtgcaacacaatattcagagtgccatgtactcttttctcctaccattttttcccactgggtttttgggaggagattttgatgaggcatgtgcataattcaaattcgtccaaggggtagtgttatgaaacctatcttattgtggacgaattaaattatgagtgggaagcttactacagaagaaagcttacaccagaggccagcttacaggagaagctagcttacggcgtaagccggcttacgacgcaagccagaaggttcaaggcttacgatgcaagcctctaccctcctccgcctataaatagggcccagaaggtccaaggcgaggacaaccgatcttcagtctcctgcctctcctcttgtagcttgtactcaaatacagaagaaataaagcttccactcgcttatattttctatgttccacagctctgtgtttatctgcttgtgtgttgatcagtagaataaactggtttctcaacacaacccaccatactagcccgagccaaaagggaaccaaacatacatagcgagacaccgccgtggcgcgtcgtcgtcaatctctcgcagtatcgctcccctcgactcccaccgtttcagcttataagatgttttgactttggtgaaagtcaaactacttcaagtttgaccaagtttatagaaaaaaatagtaatattttcgaaccaagataaatttattataaaaatatatttaattactaatttaataaaactaatttggtaatgtaaatatttcaatatttgtctataaatttcgtcgcacttaaagcaatttaacttttgtcatggttacggataagtcatacctcctatcctacgacttatggaatatacgagtatggtataccttcacgtgcacgggttgtgtaacatcctgacaacaataaaaataactaaaatttcgaactttttaaaacttttgcatcatgctagatgttatggttgctattgcttgccaaactataaattgtcacaatgaaacattaaattaaagatgtacaatttgcaagaatacgctatctatcgattccataaatattatgcacaaggcagaaagctaaatgaaggaaaagttaattattagttcctccatttcacaatgtaagtcattctagcatttcccacattcatattgatgttaatgaatctagctagattgatgttaatgaatctagacatatatatctagctatattcattaatatcaatatgaatgtgggaaatgctagaatgacttacattgtgaaatggaggaactaat

SEQ ID NO: 42394 - DNA, 8078 bp, Oryza sativa
  unsure (1)..(8078): unsure at all n locations
ataggcgctttgttttttgtgccggggaggagggttcccaacccctcctcccgaacacaactttagccgcgtcaacttccctaacctagaccgtagacagccatcgagtgcgccagccgccgattttatcctccatgccattctggcttatccctaagccaagccccataaaaaccccctttctctctgtcttttgccctcaaatacatttcatcgagcaccttctatgcatgatctcaccgctactagagaccaccattgaggggctccccggccggagctggaggttggaggaaatggaggcggagcgacgctgccgctgtcgccgttggggaggttggacgtcaaggaacgctgacgaacactttcgggcgccatcaacgctgtttgcctctgtgccgcgacacaccgagccctactccgccgcgtttcgccgtctcgccttctcacggtacaccctcgcgcacgtagcatcctctaaccctctaatagctagcgccagctccaattttgccaactagtacctgtggccgtgccggcctggccgccattgcgccgtcggtgaggtcgccgtgacaagccatcccgggaactcccctctccatctagctggtgaaatcgaatccccataccccgtagatgttcacgctcccatcaattttgttggatcctagccctagcaccctatccccttgcaacccgagctcgggccatggcgtgtccatgctgcgccactcgccctctctccgccacgcgccgctgccgcagtcggtgggtcgctcgagctcgccgcaccttcctcggccgccgccgtgccggcctcgcgccaacccggccgcgcccagccgcatcctccctcgctacttccgctcagtcgggaggttgaagacgacctccagccgagccactgacgagccgtctccactcctcctatttcctttggaaaattaattatatgaaaaagaaaatcaaagctttgaccccacatgtcagcagctgttagggataaggatatattttggattaaaaataaatgaattatgaacagtgcctttttacaatttctcggattaattcaaatttgaatctttacctagcataacttattcattttaactcggatttgagtgaaacttgaacctaaattcataagctttccaatggtatatactccctccgtttcacaatgtaagtcattctagcatttctcacattcatattgatactaatgaatctagacatatatatctatctagattcattaacatcaatacgaatatgggaaatgttagaatgacttacattgtgaaatggaggaagtaattcactatttaataaaatatatttataattataaataattaatatcatatgattaggttatggtcaacttaaaaatatgctaataaatagaattggtattgtacagtagagtaaatgtaataatatttgtttctagcatgttttgtcacagtagcaaccatgtaaattaagtataagtgatgtctcaaatgaatggatgtataggacaatattagtacttatttaatattcaatggccatataattaaacccatgacttataggttatttaaagcaagtttagccttgtgattatgtaaataaaatatgaatacacatagatgagtctttgacttgtttatgcgaaatgataacagagctagtgtgattaaatcatctataaggaattaattacttaatgtcacgccccatggagtagtatcttttaagttggtaatcaatctcaagttaataaacagtaccaactcgccaaatccacctacatcacatatactgtatagcttacagtaaatagctcatgctcagtaaatatctaatattagtatgtcattgcactcacaactactgtacagtccatttaaatcatacacaagaacaataactaaggagtctatgataaacgtgtatagtagataaatactaattataaatcttgacctcacacaattgtagttcaaccgtgacttagaattatttattgtaaaattatgcaatgagataatctttaactacactattatggaccacactaatctaacctgcggagcacggtaatttgttggccggtcagaccggctagggcatgccagtcagaccgccactatgtggccggtctgaccgcccctggtcaggctgatcacatacaagtgtatgaaagtgagttttagcactagtctaaatgcacaatgacctaatgtggcaatttaaatcatctctttgctaggtcattacccctcttaatagtacagtaaagctataaataaactagcataattttgatcgcccaacgccttgatcaaattaaaatgaaaacactagtttaccgtcttctcttccttttgctttgcgccgtcaattttaatccatcggtagacatccatgcgcacacataatgtgaacctaacttaaaatatatagctcaatagaacggttagtccagaattagcgcttgtcattaattaccaaaaattagcaccaggggcctagatgcttcacccctgttttgactctgacttatacaagtaatatataaactattagcatagttttctcttatcaatcttcccttgggattaaataaatacgatacattggaatactttcgggtgaaatgctacaatggtatatctatgcgcttgcggttcatatttgtaatcgtattatactaggaatatttctgtgccattgctgggaattatatttctagtaatatcgttaagaaatacttatccagggtctactggccgtggaagtctatgtcggtcttctttgtttaggacggtactaaacggtgggttatgccacgatcttgacttttccgggtacctttccggtacttctattcatggctaattgatattgtcaccacaacaagctgtttttgagaaacctgaaggcacagaggatcggcaccttaagccattatatgttaaggcttttgttaatgggaaacccatgtccaagatgctggttgatggaggagcagctgtaaacttggtgccatatacaactttcagaaaactgggtaaagctccagaggacttgatcaaaaaaatatggtgttgaaggactttgggggaattctttagaaacaaagggagttttgaatatggagttgaccatcggcagcaagacaatttcaaccacatttttttgtcattgataggaagggttcatatagcgtgttgctggggagagattggatccatgctaattgttgcattccttatactatgcaccagagtttgatttaatggcaggcagaccaaatagagattgtgccagccaacaggtcagtaactgttgctaatgttgatctatctgtttgggagatggaaggagttgatttcttgttaggaaagatttgggaaggagattatctaaaagtgtctggttgtggtatacaaccagttggagatggagagccccagcttttactttgaaggcatcgtggagggatcaaatttctacaccaaggacagaggagatgatttagatggcaagctaggttaagggtttatgttggccaatgagttagaggaagttcatattagaccaggtgataggcctaggccgacatatattagtgcaaaattattagatgtatttaaaaagaaatagtggaattattgaaagaatacagagattgttttgcttggtaataatatgagatgccagggtgatgagcaccaggctgtgaacgccctgatttttccctctctttcacggtaccaatcagcaaacaaaatataattcaagtggcaacaaaaattcaataatagataactggcttcagcttacaatgtattgcactccaaaccctagataaatattccatctacccgtgcttgaataaacacgatcagaaaggagaggaacctgtggtaccgagtagtgcaaccagggacgaaagaatcacctggactcgctcttcttccaaaccaaccagcggcaagatcttcagtaggaaacatatgggagcgctgtctataccttcagcaggggttaaaccctagaccaaccaaaacaataaccaatctaatctaaattacatgaccacttggcctatttatatgcacaagggcatactggactagtcctaatcgaagcccatgaacatgcactccgggcttgctcgatcaaagcccaaacaaaccaaaataaacccagtataattaatctaattaatgcaactaggtaatgatgccactaatgacagtaattagctaacacctaataggagcccacactgataagaaataaatatgaaacctatgccagctttatctcaaccagcatagagccaattttaacaattcgattcagcttcaactgtttactttcattattctctgttttatcttgcttcacaagaacagcatagaaccagcagtggtcttggttagggatggcaacgggtcgggtcaggcacgggcagagagaaaccaggcccggcccgagacccacgtgcccgtgcccgacccacgcccgcaaagcatatcgggcaaaatcccatacccatgcccatgcccgtcgggcacgggcatgcccgacggatacccactgggcttgcctgccatgctccgccgtgccgccggccgccgctcgtgcgccgccgcgtcgccggtcaccgctcgggccgccgcgttgctagccgccgcctgcgccgccgtccgcgctcgtgggccgctgcggagccagccgcgcgccagccgcctcccgccctcgtgcaccgcctcatcgccaaccactgccccgccacccgcctcaccccagccgccgcccgcgctcgtgcaccaccatgtcgctaggcactgcccagccgccagccacctcgtcgccagccatcgccgcaccgccacgccgcgctgccagccgcctcctggttatttcccctgcgccgccgccgcgtagaaccgatagaagattgagaggttgggtttgggagaaggataatgctagggttttgagtgaatgtatatattgttgtatgcaaatgggccaaacgggctattgggccatgaggggaggttaaactattgaggaataagttcatctgagatccctgaacttgtcaacgaggcatgaccgcatgaaggatatacatgggctaaaagattttcgggtcgggcatggattatccacggacgaaatataaaacccacacgtgcccactaagttcacgggtatcgggtcagacgtgcccacgggcaaaaaaaggtgcccatgcctgtgcccatcgggccgggtatctgcggatacccgaacccatgggcaatactgccatccctagtcttggtcacatcacaggacttagccgatctatagttgaacatcagttgtctattaaaccaggatatcgaccattcaaacaaccctagagacgatttgagtctgacatgtatgatcctattagggctgaaataacaagactttatgatgccaattcattaggccatgctgatatgctgaatagatttccaatatagtgccaatgatcaagaaaaatgggaaacttagggtatgtgttgatttcagagatttgaacaaagctactcctaaggatgaataccccatgccgattgcaaatttactagttgatgcagcttcaggatataagattataagttttatggatggtaatgcaggatataatcaaaattttatggcagaagaagacattcacaagactgctttcaggtgtcctggtgcaatcggcttgtatgagtgggttgtgatgacttttcgtctaaagagtgcaactgctgcgtatcaacgtgcaatgaattatatatttcatgttctgatcgacttgctggttgaaatttatatcgatgatgtggttgtgaaatcaaagtagattgttgcacatctagcccatttgcgccaagtgttggagagaacaaggaaatatggtttgaagatgaatcgaaataaatgtgcatttggtgtatcgtatggacaatttcttggatttttggttcatgggaggggaatagagataactcaaagaagcttgaaagctatcaaaaatatcgaacctccagtgaataaaaagaaactacaatccttgatcggcaagatcaattttgtaagaagattcatctccaatttatcaaggaaattagaaccatttactacattgttgaggattaaagccgatcaagaatttgtttggggggagaagcgcgacagagagctttagatagtattaaggaatatttgagttcttctctagtcttgattccaccatagaaaggagtaacctactagctgtatttatcagctgatgaaaaaacaatcggctcagtgttaatccaggagtttgaaggcaaggaaagagctatattttatcttagtagaaggattttggatgctgaaacaaggtataccccagtggaaaaattgtgcttaagtttgtatttttcatgtaaaaagtagaggcattatctacattcaaatgagtgcacggtgatttgcaaagccaatgttgtcatatatatgctatcggctcctgtgtggaagggaaggattggaaagtggattttagctttgacagaatttgatctaatatatgaatcggccaaagctgtaaaaggatgggcaatagccgatttcattgtggagcagtgaaatgattcaattggtacattaaattagtgccttcgactttatttcttgatagattagttcgcactcatggttgtgttatcgggttagtaattatactgcctcggggggggggggggggagggagggcaagttttgagtttgctttcacaattataccatattatactaacaatcaagcagaatatgaggcaattttgaagggattacagttgttgaaggaagttgaaggtgacgctattgaaattatgggtgattcattattggtgatcaatcaattatgagagtatgaatgcaagaatgatgtcttgagagtttataatgtgaaatatcacgagttgatgaaggagttcaagatggtttctatgaagcatattcccaaggaacataatgttgaagccaatgatctagctcaagtgcatctgcatacaagcgatgttaaaagatatagagattgaaattgctgctatacaagtcgatgattggaggtacggaatttttgagtatttaaaaaatccttctcaataagcttcaaggaaattgaaatacaaggctctcaaatatgtgatattggatgatgatttgttttatcagatgattgatggagttttgctcaagtgcttcaaattagaagccaaagttgttatgtgtgaggtacatgaaggaatttgtggaactcatcaatcggctcataagatgaagtggtcgattaggagagttgggtatttttgtccgacaatgctagaggattgtttcagatattacaaaggatgtcaagattatcaaaagtttgggtcaattcagaggacacctgcatcggctatgaactcaataatcaagccatggccgctcagaggatggggaattgatatgatcgtccagataaatccaccatcaagcaaaggacataaatttattttggtggctacagattacttaccaagtgggttgaagcaattccattaaagaaggttgattctagagatgtgtggacccccgtttttataacaggaatcaatcgtgtaaacagtaccattttcctggatcaagtagtctggtacacacgagttaatagctgaaataccaaatgcacatacacgaaagtctagtatgaattattacatcaaaagcccgcaggcatagtcttaaatcctcggaccgagcggtccggaatacattccaaaaacagaagtagataaggcagcggagttaaggcagtggcacgccattgccacaggcaacgaccataactaagacctactgagcgccatcgtcttcatcaccctcctagtagtaagagtagggatcctccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 42395 - DNA, 962 bp, Oryza sativa
agctcgaatttgggtaaatgctttcgagcttttttttatgtcgtgttttcgaggtaaggcaaaaccttgttcgaaaaccgccgtcccccttacgtttcaaaggagtgacgaggtcgaacgtgtttccctcgtcgcaattactttttagttttcgagctcgaatttgggtaaatgctttcgagcttctttttatgtcatgttttcgagctaaagcaaaaccttgttcgaaaaccgccgtcccccttacgtttcaaaggagtgacgaggtcgaacgtgtttccctcgtcgcaattactttttagttttcgagctcaaatttgggtaaatgctttcgagcattttttatgtcgtgttttcgagctatggcaaaaccttgttcggaaaccgccgtcccccttacgtttcaaaggagtgacgaggtcgaacgtgtttccctcgtcgcaattactttttagttttcgagctcgaatttgggtaaatgctttcaagcttttttttatgtcgtgttttcgagctaaggcaaaaccttgttcgaaaaccgccgtcccccttacgtttcaaaggagtgacgaggtcgaacgtgtttccctcgtcgcaattactttttagttttcgagctcaaatttgggtaaatgctttcgagctttttttatgtcgtgttttcgagctaaggcaaaaaattgctcgaaaaccaccgtcccccttacttttcaaaggagtgacgaggtcgaacgtgtttccctcgttgcaattactttttagttttcgagctcgaatttgggtaaatgctttcgagcttttttttatgtcatgttttcgagctaaggcaaaaccttgttcgaaaaccgccgtcccccatatgtttcaaaggagtgacgaggtcgaacgtgtttccctcgtcgcaattactttttagttttcgagctcgaatttgggtatatgctttcgagcttctttttatg

SEQ ID NO: 42396 - DNA, 706 bp, Oryza sativa
gtcgaacgtgtttccctcatcgcaactactttttagttttcgagctcgaatttgggtaaatgctttcgagcttctttttatgtcgtgttttcgagctaaggcaaaaccttgttcgaaaaccgccgtcccccttacgtttcaaaggagtgacgaggtcgaacgtgtttccctcatcgcaattactttttagttttcgagctcgaatttgggtaaatgctttcgagcttttttttatgtcgtgttttcgagctaaggcaaaaccttggtcgaaaaccgccgtcccccttacgtttcaaaggagtgacgaggtcgaacgtgtttccctcgtcgcaattactatttagttttcgagctcgaatttgggtaaatactttcgagcttttttttatgtcgtgttttcgagctaaggcaaaaccttgttcgaaaaacgccgtcccccttacgtttcaaaggagtgacgaggtcgaacgtgtttccctcgtcacaattactttttagttttcgagctcgaatttgggtaaatgctttcgagcttccttttatgtcgtgttttgtcacgcccggaaattcactaataatttccaaactaatttgtgcataaaatcctcgtccagaaatcagccgaggtacacaaactgacaatttaatatacaaatccatcataataataacgttacatacttacaaaagaaaagaaaaacagcag

SEQ ID NO: 42397 - DNA, 3683 bp, Oryza sativa
  unsure (1)..(3683): unsure at all n locations
caatcaatatatgcaacagaatcatacttctcatcgtagaatggtaacttagattcaactcgtgcaaaattataggcaggtacctcatatgcattgcgtggagaagtcgtcatatctcatcgaaggtgaagaagtcaatgttctcgtattcccttgtgcgatcttgtcatggttagtagcaaacaagaaagacatacaagaatgtgcacgctcctatcaactactaggtagtggcagcccaaatatcacacacactcaagcttttcaccgagctctgacaagttcttaccaatgcaagaagaatggcaacatacaacgactcaaccaagcactccaatggaggttggatgtatcgatgccttggcaaacacttgttgtacggctgcaatcaaatctgtggagctctgggtatacttaaatatgtggcaaagaaatagcaaatgctcaaatcagagaatgcaaagttgaatgatcgttcaaagtcaagtaccgtgctggtcctaggctaggacgtactagagatgcgagcctagacacaaacgataccacaagttagcaccacaaacaactcaggcacataatgatatatgaaagcaatctcaaacgaaacaagtaaatttcttttttcccttcttttttttgggtacagcttttctttctttgttttatgcacctttctgccttttttttctcttcttttttttgattttttaaaaaaaaccaactcaagggcctcaatgcaagattaaagggactcaaatgtaaatataaaaattatagggactcaactgtaaaagtccaaacccaaaattagatatacaaaaataaaatgctcatagattctgtatttgcaaacagatctccaatccgatactaaaattttttcatcaagctatatgggcaactcacagtatggattgaaaccgtgaggagaggagaccgtggatctaggaggtctcggacacgactcactaggtggagattgactcccgtcgaccttaggatcgaaaggccccacgtaaaaacagaaatagatctctcccttcctttttctcttctctgtgttggccaccaaacggaaaccaaaccaatctacacactaattcaggatcttttgctgaaaagaggctaggccacgtcattagataaaaaaggaaccgttggatgataactgtggcagattattcaccgttggattgcatatatgttatttaaggctctagataagtgtggaaagtagtactggtattagttcagtcaacatgcatgtaaaaagttaaataaaaaatggaataatccagaaatttgtggagcccttgggaaggggaacattccaatatattaatactgaattaatactgaataagggcgtgtttagttcacgtcaaaattaaaattttagttgaaattggaacgatgtgatggaaaagttagaagtttgtgtgtgtaggaaagtttcgatgtgatggaaaagttaaaagtttgaagaaaaaatttggaagagctaagaaatgagcttttcagtttcccatgcaagtatgcaactgagtcctctctacacaagcactcagtatggctttagctgaaacctttgcacttccatttcaaccttcacaaatcacaaacaccccaaacccagctttcatcgttttcttcttctccaaattgactgcatctggaggcctggtcgaagcttgccgacgtacggtgccggatacaagctccctccgcctctttgaggccatgtaatgaggtactacctcccctctgcttacatctcctccatttcttgcatctcaatctgaggtcgcatccacctgctgcaacgagacggagagcgcttcgatggtattatcatatcatgtttatgtcgtgtttgtattatctggggaggtcagaattgagatgctgggtttcattttctcattagacaggatatacttttgacagggcgcgcctgattttctagtctaatctacagaactctctcccatttccttcttcctcctctcagcgccggacacaagcacggcaaaagcaaacacacgggtaggatcagcaaacactagatgcaactcaacaacttcaaaactaaccgacataaacttctgaaaagtacaaaaatagaaccgtggcagtgagcctgtcggtgacatgggaccgggggtatcttgactagaggtttggggcagctgcagtcacccacgtggcctggccccctcgggggggggggggggtcgggcccgagggtgatgtggccgcccctccttctgtcttcccgaggggtcgggccgctcccgtttcggccccgagggctggggcgccccgaccccctgtgggtttggcgccacgtgtgtgggttaggtgagcacagcggcgctcacctaaccgcgtttattgcgggttggacgagcgccccacgccgcatttaatgcagcgcagcacactcgttcggtccgtgacaggtcacagtgtgtgaccggtcacagaccggtcagatcgcgggttaggtggcaacaggcggcctgacacacgcctcgccccgtcccgtcggaatgatgagagcctccaggcgctcgtccctagccggagccggcgtgggaactcctggagtcgcacgtcagccccggccagatacattccaggcttcatcgcaaccattgcaaggaaatcattgtatgaagaagggcagacgtgtagcatgctgaactgacacgtggtggacaagaatgaccggtctgtgactggtctgacgccggtcgcgtcatcggcagacaaccgtgctcccacgatgcatctgcctccggtggagtggaggtaggtatgacccatcttgtcggatggtcatttggaaagcagccatggcaaatctccgcccattaatgagggagtaacagggagatccccggtgtcaggcgagagacggcgctgagcctcactcaaggacaagttgtgatttagcttccaggcgaaggtgcaagccaagttttggtcaagatagggtaggtccccacccagaagaaaagtaggtagaagtggtgcatgtaatatccccttgagatataaaaggaggaccttgcccaccaaaagaaaaagaaagaagaaaagaaaagggggggcgagaggggttctggagcctgaactctctggctctccggctctctgtagatcttttacacacagatccaccagaacacaggagtagggtattacgcttctcagcggcccgaacctgtctacatcgcccgtgtctcgtgcacttgctctctcgcgaacattctccagatcgatcgagggcgaagaacctcacttagcgcccccggccgaaccggcaaaggggggcctgcgcggtctcccggtgaggagccccacgctccgtcatctggcgcgccaggtagggggcgcgtgtgtttttctaaggcctcgtcctctttcgtgtgcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 42398 - DNA, 12352 bp, Oryza sativa
ccgtgcatgaagtgcccaccgggcacctgccaccgcctctcatcggtaactttgcttatctagtccgaaccaaactggaacacttgtgttaactagtaatcgtgcacgtgcattgcacgtttcccacattagttatagtaatcatataaaaacacttcaaatttcttgcattttcctgtaatatatgtcaggcaaaatatacaacatactaaaaagtttaagaactatatgtactataatgtaacttaacatactcctttaaacaataaaaaaatgcaaagcagctaacaataccaaacatataatttgtcatagcttgataaacacttgaaaagctcaaagcaagatatttgtatttatggtattgaattaaaccccacagcctacaatatcttatcaggaaaaaagactcagatcttcaccaacaatacttcaaatatatccttcatggccagcaactaaaaatagcatttacatgatcaccaatgaggtgtatacagctcctgccgtgggtccacagaagttcatgtgatctgcaaaacacaaatttacatccatttcacttgtaagaaatggtcatcacatataattccaaaaagaatattgtctatagttgccttaattgaagtaaaaaagtagatagcaagtgtgaacattccagaaacactaacatttgtcaaaacgcctctatattttccttgaccacaatattaatctaaagtggtcatattgctaaactatgcacacacctgcagttgaagtggcagccacgaaaggatctaccaatcttaaaatctggagaccaatatctttcatggaattccctcaaggaaagggttccactattagactggaaaaagggaaacatatcaaatcatgaaaaaggcataatctgaaattggaatagcgtatatctttttaagatttaatttaatcctggagtccacacttttttcgtgaagctacaaataaataatatatccataatggtgatgaaaaggatttaaaacatggatagtagcactggattaaaaacatgaaaagcaccttacaatccaaaagcttgagaagacattagcatcaggcatcttcctaagaaaccaaatgctcttttagccacatcaaaattttcaagcaaactacgtatgtccaaataaaaagaaataacaaaccgtccaagcaagcatatgccgatggataaaatttatgaattacatcattagtaattagaagtcatcagcacaaagcaaatattcaaacttcccaaaaacaatgcaaattatcagaggagaaacatcaaattccatgcttataacttgtagaatatacactggattcaactgatgcactttttaaggaaatgaagccatagttccattgtcctgagctccaaaattgatcattggtatatacaaaggggatattcacttatatttaagtctgctagaataaaactctcttgacctatggagttatatgtgcatacatacaaactgaaagagacgcttacatttaagcttgaggacatttcaacctgataggctcatgtcaaaccaaccgttgaaacaattccgaaattaagtgattaccagctagagtgacagccaaaagcaagctcaacattgcaatggggaaattgcgattagggaaatcttgcccgtgattgcaatttcggaacaaaattttcaaaattttgcctccccccccaccggcaagcatatatctcacccgaaatttctccttttttcatgtttttgtgaatttggtcaaagtttattctaaatcattcaaaattcgtcaatttttcaaataaattcagtgattttggttctttcgccccctccccccacggaaaaaaccccaatttctagaatgcaaaccctgaatattgcagtaaaactacagtgaaatacttggtgcacaaatgtcattacgggtggcaccgcttcaggttttttttttcttttgcaaaaatttgagagcattacatcacctatggcaattgtagattgatgcatccttccgctgcttgtactcatggttctgttgaaccttagcttgctactgcttacaattgagcaaagcatacctcatccaagcttgctatcttctttaactcgagagcacttaaattagtggtattccctacggtgtttgccagtaaattagaattagttaactcaaacagtacatgatatatagtgaagaaatcacaagcttaaaagctgttacataccatcgatctgtataaattaatttcagagatatacaattagcaattaactggcagcggcataacagctttgcaaaagaagcgaacatgatgtgtattatttacttgtcactgcaagcaatggtgacgtaaagcttcctgcattaccgggccgagctgcaaaggtgagtcgtgataaactttattacattcagatcacaaatgttgattaaaatattttttttgagcattcaatcgatccagagtactacctgatgtagatcgaaccactatacatgaatatttgtcagaaccactatcaatgtttgtcgttgatgaaatcccactgatggatctgagcaaccaaaacatcacatcagcatttgcatgttcctagcaaggccgaggaaccaatcatgagtttgttctgcgtattgtattcatgcagaacatatgcgccaagcagaacctgaacccggacaggtcgccttcaatctcactcaaaatttgtaaagctagaaggaacaagaaaagggattgcgatgaacaagagttgtagccaatcgttgtacttacaggacagatcggtggaggaagaccttgggggtgcatgtagcgacgcaactgctcgcttgcggcggcaggaaagggaccacttgcgttccggtatttgcacgacgagcgcggccgcaacggcgaattgcctctcgctcgtggcggcaccaggggctccgacctcgccttcgtgtatcggtgtgcgactaaggatgaccgagctgcggtggagtgtacggtgaggcgctggagtggaggaaggctctcgccggcgcaagtggaggatgttggatcggttgagtgtattcaagcgctggcgggggcaggccgcggttggggaagacctcgacttcgtcgggggcagcggtggacttcggcggccaccacggatggggaagaactcggctccagcggcaactggggacgacgtcggctccggggaagaccacggctccggcggtggctggggatgacctaatctccggcgtgggcagcgggggtggcagcggaaggggacgacctcgttgccccgtcgcgaggaggagggaggatgcgcacggagcgaggagacggcggggattcgtgggtgtggaggagaagcgaggaggcgcggggattcgccgggcggcgaggaggagcgaggaggcagcggcgaggaggagcgaggaggcgggggcgattttgggggcgaagttgtcgcggcggggaggagcgagggggcggaggaggcggtggggatttgtgcggcgtagtcatcgcgtgatttctgaataggtggaatcgctcatcgctgcgcacagttaggaggatagcggacgtatgagattaaatcagatgacggatggacggtagagatttgattcgggtgatttccccagtaggattggagaggtacagctcctcttttttatattagtatatagatatagatatagaaattatactatgtataccaagaagggagggctagtagaatcaaggatgtagagcttttgtatttgtataggagtcttgacttagtctgcatcttagttgaaccattaatattgttacctgcacaatgttacgttggattggatttctcttaatttgattcactagcaaattgcatgtgccttgcacgggaaaaactaacttatgacagacattatataatttggattaactatttcttgtacacttaatacaattttttttgctgtgtcggtagtgaaggagcatcccgaccaattttgttagggtataaattgcatcttgggccgagtttagttaaaaactttttcttcaaacttctaatttttttatcacattaaaatttttctacacacacaaacttttaactttttcgtcacatcgttttaatttcgtcaaaactttcaattttaatgtgaactaaacacacaccctggaccatctttttttacctttgttccaagttagacttgggtaggacagttttcactagtctcgactagggaagtttgcataatatttcactttagaccagttcttctctatcctctgccattgcggtcctcaacgactttgcgcagctcctgacctgtcttcctggaactttgctcctccgccccagctccgttcattcccgagcttgaaagtccaaacgattatctccgtcagttcgcttgctccatgtcaccttcacccttgacatcccactcgtgcgacaagcacgagagagagaggatgaagaacttttgcctgagcaactcgaaatggccaacttctgctgctcttgcatcctctgcgtgggcggataccgaggcaaacgatctagttgacgcgcggcggcgtaaacctcggcgcactcgcggccaaagcttacatccaccatcttccgtgcgatctggtgcatgttcgcaactgaccctggcgaaagctcatcgatcaccacatcctagtctatcaccggcttggcaattgggatcggcttgccgccgtaggccgtagccttcctcatcaccaatcctgtggtcttgggctggttgcattgcttctacctaaaagtagtactctaggaggcaagcagaggagagaatgggccggcggcggctcgacgctcattggcgctcctgcagcccatggaagacgattaggagaaggaataagttcactttacatcccttaatttgttgccgagtttaaaattcatcccaaattgcaataccacatacgatgtgcccctcaacttcaaacaatacaaataaatttcaaggcggtttggatgacggttttggctgacatagcacctacgtgacaagtttgacttggtcctcctacgtggccgtgacgtgtcactaaaagcaaaaatataaaaattaattaattttcttagaactgtggggcccacatgaattcttttcttattctttctccacttagcttagtatttatttaatgagggaaacttagttctttcttctgtttgtcacctaccttttgaatcacttaacccctacatagactttgatatatacaagtaatatatagctattagcatagtactctcttatcatatcttccattgggattaaataaatacgatatattggaatactctcgagtgaaatgctacaatggtatatccgtgcgcttgcggattatatctgtgacactgatttcacgtagaaggcttgaaggagggagaggatgagagtgaagatctacttgtctctcgtgccaacctggtgatgagatccaagatccaagatactccctccatctatttttgatagtcatatttccaaatctgaaaaatttatttttgataggcatatttcaatccaacaatctatcctcttaatgactttattagatttaatgcgtgactctccattcttccacacatgattggctacataggcattgagaaatgtaaatattaatgaatcacttgcttacgagaaatgactagtagcatgtttaaatggatgataagtagaattatttatccttagtctgtgtgtcaagatgaaatatgactatcaaaaatagatggagggttccctgcaaaaaaaaaatggagggagtacatgttaaggactgagctaagagaaggtgaggaaggaagacctcatagacaatgcctctagggaggtcgtgccaccaatgcacaccaccatcgtccatctaaattctttacaactcctcatttcctatgttccaaacaaacgaaaaccatcacatatttttcttatgtctttcattactctattttgcatatacaatcatctcatagggattcctatattttcctataattttctccattcgtaaggggttataagggctcgaaaagcgcatttggaaatagctgattagctacacctgaaacatgggcgcatctgattaattcagtattaattattaaaaccatcaaattattttattttttcaaaacaactaattatataggatatgtttggggagtttttacggtccaagatcttcgtccatattctaagtagttctagaatctagaaaataaattctctagaatatcaaaagctgggtaccaaccagctcattctcagaatattaaactcccccaaatagaccaatagaaagtttgaaaaatgtgctaacagaaatcaatgaagtagtcaagctgaaacttttaggctgtgttcaagaggacgggttacgacacgtacaatgaagcactcattagcatataattaattaagtattaacttaaaaatggattaatattatttttaaaaataatttccctagagaacttttacaaaagacatatcacttagtagtttggaaagcgtacacgtggaaaatgagagagataagttgaaaaagtaaatagaagaacaggccataaaggtatacagacctacatgtagagtaaataaggccgtgtttagatctaaagtttttcttcaaactttcaatttttccatcacatcaaaacttttctacacacaaacttttaacttttctatcacatcggtccaattttaaccaaacttttaattctggtgtaaactaaacacattacatttagcctagctataccagattaccagtacatgaaaataaacttaaaaaatacgctctcaatgtccaactaataatacgtgtagacgaaaaaaagagccacattccctcgaaagaaagaaagagaaaaagagccacatgtaaaacactccggaggggagattaggtgagcagtccaagtgtctgcgcgtcctgtcccagttagtcaaaaaggaggaagcagtaccgctgctttcagttcctaccacacacacccccatcctcaccgatctctctaaacccaaatacgcaacaaatactcaatcgtcacatcttaaaaaacaaagaaaaaggaagagagagagagagggaaaacaaaaaagaaaagaaaaatcaattcccaaccttgctgctacaaatgcctcaggcttagcaactcgacctcctccccccttctccccttcctcccttctttgacttcccctttcctcctccgtgcgcacgctctcctgattcatacagcatttcgtcggggatgacgtcgacggcgtactcccggccgtcgaagctgccgggcggcggcaacggcagcgaccgcaggctgccgccgcggctgatgaggggcctcaccaccaagatcgagcccaagaagctcggcgtcggcctcctcgccggctgctgcctcgcgctcctcacctacgtctcccttgccaagctcttcgcaatctactcccctgtgttcggtgcgtgctcccctaatcccgatccgccctaggagcttacttttggttaaatcccctcccgcgttgtctctcgaatccaatccattttgatttagtctaatgggagctgttttgaatccgttttcagccagcacagccaacacatccgctctgatgcagaactcgccgccatcctcgccggagacgggacccattccgccccaagaaactgcagctggcgccggaaacaatgacagcactgtggaccccgtcgatctccctgaggacaagtcgctggtggaggcgcagcctcaagaacccggcttcccctcggcggaatctcaggagcctggcttgccggcggcgctctcgaggaaggaggatgatgcggagagggcggcggcggcggcggcctcggagataaagcaatgtaaggaaatcttgcctctttcttccgctcccttttatttgcgcacctttactggaaggcagagcaagctacagtagagcaagtccccagttgttgttgagcgcaagcaagcaatcaatctcgtttggatttggtagagacgcacgagatctgggcggtgttttattggggatttgatggtaattcagtctcgttggtttggttaattcagccgagaagaagaacggcgtggcggcgggtggtgataccaagataaagtgcgacgagaacggcgtggacgagggcttcccgtacgcgcggccgtcggtttgcgagctgtacggcgacgtccgcgtcagccccaagcagaagaccatttacgtcgtgaacccgtcgggcgccggcggcttcgacgagaacggcgagaagcggctccggccctacgcccgcaaggacgatttcctcctcccgggcgtggtggaggtgactatcaagtccgtgccctccgaggcggcggcccccaagtgcacgaagcagcacgccgtccccgccgtggtgttctccgtggccgggtacacggacaacttcttccacgacatgaccgatgccatgatcccgctattcctgacgacggcgcacctcaagggcgaggtccagatcctcatcaccaactacaagccgtggtgggtgcagaagtacacgccgctgctccgcaagctgtccaactacgacgtcatcaacttcgacgaggacgccggcgtgcactgcttcccgcaggggtacctcggtctgtaccgcgaccgcgacctcatcatctccccgcacccgacccgcaacccgcgcaactacaccatggtggactacaaccgcttcctccgcgacgctctggagctccggcgcgaccgcccgtcggtgctgggcgaggagcccgggatgcggccgcggatgctgatcatctcccgcgccggcacgcgcaagctgctgaacctcgaggaggtggccgcggccgcgacggagcttggtttcaacgtgacggtggcggaggccggtgctgacgtgcccgcgttcgcggcgctggtgaactcggcggacgtgctgctggccgtgcacggcgccgggctgacgaaccagatcttcctcccggcggaggccgtggtggtgcagatcgtgccgtgggggaacatggactggatggcgaccaacttttacgggcagccggcgagggacatgcagctccggtacgtggagtactacgtcggcgaggaggagacgagcctgaagcacaactactcgcgagatcacatggtgttcaaggaccccaaggcgctccacgcacagggatggcagacactcgccgcgactatcatgaagcaggacgtcgaggtcaacctcaccaggttccggccaatcctgctgcaggcgctcgacaggctgcagcagtaactcgtctatcccaataatcgcaggcagctcatggcacacatcaatgtatatgccgggacgagacgacacgacgaggaacaagaacggatactagtatattgtactgctgcttgaaagagatgatgatgatcttaaccggaggagaaccatcagttgttggcgaggcggtggaagcttttcgcatattggtaattggttgggttgtccattttgggtttgtaacaatttgcataggcattacacaccaaagatgttcgatttttttgttcttcttacacttcttcacttcgccagcccattcaacactatacattcttttctactaatacggagccaaactaaactatggtgtttaattattaaaacatcaaattggtcacccaaacaaaacaaagtggcgatgaaagaaagatccaaatctgagagttgtttcagacatgtgcaatctcctctaataaattgaacaaatggttgttaaacgaatctgcatcccgagcgttgaaggggcttagctggtgcggacgtgccagcatggaagtgttcgtggagaaggaaaatggattcgatgctctgtccaacactggtgaactgctgtatatgcacccgcctgctgcctgctttcagcttaaggaaaagatcactaataattgaaaagcacaggctaactaaccgggctctgcaagaaagctgtgacaggtaagtcgtaactagttttgggcaatcgaataccttctctcttttcttctcttttcttgagaggcagacagggagatatagagaaagaccttctccttttatctttattttttcttttttcctagaaccttcttgctgtcttttggtagggaaagagactagaaaatggaacgatgatgaatgcatgaatttcccataagaaattggcaagctagcctcaccttttcagtatcgtatgcatcacgcgaaaagattaatcacaagagggtgacccggcaacgagaagaggagatcagccaagacaatcttgtagccgttagtatgaaacacacgattaatcacaagccacgccatgctcttcatgccgtcacttggatggacgcatgcaaactaagtcccccttttatttatattaggaaaccataacaaatttagaggattttaattctacagaaaaaattcttacgaaaatacttgaaacaaaatattgattcatatactgaggaaagttaatatgagctccaacctttcaaaaaaaaaaatagtcattcattcttatcgattcatgtatttttctaccgtttattcgaacaataatttatgcatcttttttgtgttttgtacttatgtttctattaaaatcaagtgtattttttattctttgcttttttgggtcctgcaatagcccttatatgtaaaattgtttggagcacgtgtgtttgagtagtcatatttctcacgaacggagtggtagatcattatgctacattttttttcctccagaaacatatgtgcagatgctggcacatgtatcgggcataaatttatctggaatcaactcaggactcaaccagtatgtcagtgatgccgatttattggcggaattcgtagactttgtgtgcccttgatctggccactttgcgccagtcactacaaggtcaaccgtagctatcccataacctcttcccttagtttcctactctccataacataatcatgttcgtgtagacgtacactactgtttgtatcagatcgtgacgtttctggatgtgtgtgcgcgcgtgtgtacacaagtttctggatgtgtgtgcgcgcgtgtgtacacaaactagaaatacttacatttttttccttttcttcgccattacaaattcacaattagaatataagtattttagtttgtgcagtatagatcaaaggttaatataaaaaaacttcagcaccgctccaaaaataagggatggatggcgtgagaggaaggtgggataagattaggagaaatttcaagtggagaaaattgatgggacaactagtattatgaataatgttagaaatcttaagggtccctttgaattggaggaaaaacatagtaattttaggccccctttgattcagaattttagaggattttattcctataggaatttttcctacaaagccctttgaatcaaaggaatgaatcctatggaatcctatgaaatttctatggaatgcctcttcccatacaagttttagatgaattttaacaaggggtagtacctcatggaagaaatcctttgaggttcaatcaaacggtcattcctatgtttttcctgtattttgcaaatcctctgttttacatttacattcctgtcagaatcctatgtttttcctattcctccgttttttcattcctgtgattcaaaggggccctaggatttcaatcctataggaaaatttcctatgaagccctttgaaacaaaggattgaatcttatccaatcctttgaaattcctatagaatggacaattctatagagattttggaggaaatttagcaagagctttaatctcttggtaacttttctttaagtctatctctctcatccaattcctatgtttttcctgcggttcaatcaaacggtcattcctatgtttttcctgcgttttgcaattctctgttttacattcctatcaaaatcctatgttttttctattgttatgttttctcaatcttacgattcaaatgggcccttaatgtttaaaaattcaagattcaaatgctaaaacatctagtattttcaaagagaattctgtaaaagaaataggaaacgttgatggagtgtaggagaatgaagtaaaggcatgcccaacctttggcacgaagaatgctgtgtcattcttgcacaagggggaaacgaaaatcatgccactattgttggtccagagagaaagcatgcaagaaacgtctttgctttgaacatacgtgctgtctgcccaaggcatgccaagtactctggaatttatgaaatcctgcagctcacaa

SEQ ID NO: 42399 - DNA, 1819 bp, Oryza sativa
tggttttgatacctaaatcggctctgctagcctgtttaatctttaaaatccaccctgaattccactcgaaactcaacgctgttgttggtttgatctttcggtgagttcagataactaagatttggaagaaacattaacgacctgactacaactgtacgagatgttgtgttgcgcctttgcgatcgatacacctctccatgggttgttgatcttgccggtgcagatcaaccttattcctgcaaacaaatcgaagaaacaagcaataacaagataaaagtaatctgaattgcagatagaaatgaatacacacggtaagttggtgtttcgaatacaagcacacgaacggtctagcagacacgcgcactgcaagaaagtagcaatggctaaactttcatctaaacaaaacccaagaaaccctaaaggggtacctagctatttttaacggtgggaggacaacctaggagtccctagggtcatgctccacctggttgaggcgcaccccacatggctcggggtcccaaacgaagttacatgcccattggtccaatataggtgaggcaacaccttgtttctgcatttgtgtccctctgggaaggaatttcgcactgaggttggatcaattggaaagaggactctgagagctttccatcaagtactcacgggctgaaaacgaagctcgtatactgatttggcggccgtttgagcaatgtcgcagttggccgaatcagattccagcagttggtcaacttgatcttgatgtgagcgacggttgtatcaatagtagtcatggtcacatcatactccccttcttcacggaaaaccctcctctgtttttccatgtggtgctcttcacatagtcgattcaaaacaacctgtttcatccaatcaaaactagagaaactcgaagtagtgcgattaacaataacatgtttctctaaatccgaatagatgaaaactctaagcaccaaatatatttctctatcattatattcgtcaaaggtatgaaaaatagcattagttggacatgctaatcagacttagcaaataatttctccttcaaattatcgagctcacaaaaatcatcaaactgaacatagcgcaaagtatttaaagaagatagcaattcatgtgaataacatgtgaataacatgcttaaaatcagcgcagtaagatataacagtagaaatagcatgtccattcactagttgcggcatagatataagtgaagcattatcacacaactcttgtttatcacaataaacaacaagtaattcaacttgtgacaaaggcatctcagcaattggttaatggttgctctattatagcattaaaagtgaacatgtgtagcttagctcgagaatacccaccttcatttatttcagcaccatttaatttaccttacaaactttcttcagacatcacaggtgcttcaagcttctcatccgtcttctcaggaacatcattcttcttcttttgttgaatgatcggaactccctgcaaaacgttagtaacaggagacacaaaagtttgctcctcccatgtttgcatgtcatcattgcacaaggatatatgagattcagaaacatgaaataaatcacattgttcatgctttttcgcatttgatatgatctgactctcaatgctgcgagaaagcatgaataggtgtccgatatgattatatgtcacattagtaagcatgagctgaattttagaattaagccccatgaaaaatctgcacattgtgttttcattgcactcttttagatcactgtagatgatacaaactttaaatttatggatatactcccttacagttcta

SEQ ID NO: 42400 - DNA, 815 bp, Oryza sativa
aaaaccttgttcgaaaaccgccgtcccccttacgtttcaaaggagtgacgaggtcgaacgtgtttccctcgtcgcaattactttttagttttcgagctcgaatttgggtaaatgcttttgagcttttttttatgtcatgttttcgagctaaggcaaaaccttgttcgaaaaccgccgtcccccttacgtttcaaaggagtgacgaggtcgaacgtgtttccctcgtcgcaattactttttagttttcgagctcgaatttgggtaaatgctttcgagcttttttttatgtcgtgttttcgagctaaggcaaaaccttgttcgaaaaccgccgtcccccttacgtttcaaaggagtgacgaggtcgaacgtgtttccctcgtcgcaattactttttagttttcgagctcgaatttgggtaaatgctttcgagcttctttttatgtcgtgttttcgagctaaggcaaaaccttgttcgaaaaccgccgtcccccttacgtttcaaaggagtgacgaggtcgaacgtgtttccctcatcgcaattactttttagttttcgagctcgaatttgggtaaatgctttcgagcttttttttatgtcgtgttttcgagctaaggcaaaaccttgttcgaaaaccgccgtcccccttacgtttcaaaggagtgacgaggtcgaacgtgtttccctcgtcgcaattactttttagttttcgagctcgaatttgggtaaatgcgttcgagcttctttgtatgtcatgttttcgagctaaagcaaatccatgtttgaaaacagccgtcccccttacgtttcaaaggag

SEQ ID NO: 42401 - DNA, 12256 bp, Oryza sativa
atgtaggtcccgatcttccgatagatattgacaaacagtcgatttgggcggagtcgcgacacaactcgatccggcttctgaacgaacacgctactgagccccaaaatcgcagcaccacgtctcctctggttatcaccgtgccgaaacccggttgacctcgccgagaaggctaatccttacatgcgaatcgaagaacacaagcaagaacaagatagattgcaaccaaattgcatatgaatgattaagcacacgaatttgagattccacaaaccgatctagcggcgaaactgttctcaacagaataatctaagacgatgatggctactgaataaatgtgattagagacgtcctagggttgccctagggagcacacccctttggcctaagcccacgacacaattacaaggcccaaaactcaaaatcagattcggactggatgaggtgcgtggcttgttttgcagattcccggcaactcggtaggagttttgacgtgggaccaaaaccatctgaaggtagacttcataagctttgcaagaagtacttatgggccccgaaattccttctagatcagtgagtaggtccgtttgaagttgatgctgtcaggaggcccgaatccgaatccaaaacgtgtagaactttatctcttgtcttctatggaccaaaagtgacgtggtgatatgaaagaagacttaaagaaggtcttggtttggtccccaatcaacttcttcaatcatccatgtattccttacgctcggtctcttttctttcgcccaagcaagtacctctgcaaacaaaaacacacaaaactcattgtgtcgcaacgtttgttgaaatatataacaagtaaatctaatatagaacataagcacctttatttgattaatacataaggtagtcatggttatatccgagctagttatgtcctcatcaatgggtatttcatccatactgacgtggttcagaacttgcttacaaggaaatacaggcttggcatggaaagtgactcgctggccagtacccctagtcatagatgtggatcagctggcacaatctataataccactgtgcttggtcaaccagttcatgccaagaatgacatccagattcttagagcttagaaggatgagattagccagaaaagtgactccttggatctcaatggttaccaatgggctaaagagcttagcaggtagttggcttcctggggttgatactatcataggtttgctaagatcttctacccttatttggtgttttgccacaaaatctcttgatataaaggaatgcgtagctcctgaattaaaaagtacacatgcatgaacagaattaatcaggaacgtaccaagtatgacttctggcgcagcctgtgcctcctcagccgagacatgattcacacgtcccctcaccaggttgttgttgttgcagttgccattgttgttctagttggcattgcatgcagatgcaggagcttgcggacgctttggctttgggcacttgtcggcgaagtgtccaggctcatagctgttgtagcacacaagtatcttcccagagctatctctgcgtgtcgatccaacctgggcaggggcagaacgctgattgttgttccatcctgagttctgcagcttgttgttcatctgtggacggggtgcacgctgtgctaccgatgaagaaccaacttgagggggaaacgcataacgtggtttctgacttggtccttgaaacatcctagcattggccaacttacgcttcttgctttcaatctttcggtgcttgtcctcctggcggatcgccttgtcgactagcatttggaaatcttcgcagtcaccagagatgagctggactaacaactcgtcattcaacccttcaagaaatttctcctgctactcttcattggtgcgaacgtcctcaggagcatatcgagccaacatgttgaagtcgtgcaaaaattcagttacggtcctgccatcttgcttgagttcacgaaattctttctttttctgtgctacaactccaacaggtacgtgagctctacgaaaagcagtagagaaacgagcccaagtaataacttgtccaactggctgggtggcctggaagtggtcccaccactcggaagcaggtccatgcagttggtgagcggcgaaagcgactttctcctcatcagtacactggatgaggtccaacttcttattgaccgcgtgcaaccagtcatttgcttcgacagggttggttgtgcttgaaaaactaggaggtcggactcggaggaattccgacagctttgactgcggtggagcgtgtacgtgagcttgagcagcgggtgcttgcgggttttgcatttggtggagcaaagctgcgatgaattggttttggttggcgagcacttgtgctaagttggggtgatcatggattggcggaggtggcggcggtggtggtggaggggcgtggccttggtcctaattctggttctggttctgattctgattctgagctgaattcctagcacgagcattgttagcagcagtactccttgtgttcaccatctgtagtaaccaagataagagggaaaagaagaagggagagatcaggacaagaacacgagctattaaaccaacttatttaaattttattaatgtgatgttggttacatagagttcaagttgcttaagcaccacaaaggtatagctatatcacaacgggccgatatagtccataccaaaaagcacacaaggcaacaaactccagcagaagataaacgataaaaacatacgcgcactaagacttcgcgtctactcttgagaacgactcctagaggggctacggtccacaaatggctcatccacgttgctgatgccgtggcgaggacaggcgcttgatccaacaggtggtagggtcttgacgacggttccaggcatcccactcttcaagtccttcagctccttgcgtagagcgcgaagctcattctccttgtcacgattcttctgaagcactgcctcgaacatcctctccgtcatcctgtagtagaccatacggtacttgtccatcgcggccatcatcttggacatgtgcacaatggtggtgtccccttcattgcgggcatcgcggaagtcagcatcttctgcgaaacccaagcgagcagggtggtagtggaacagagtggtcttcaactggtcggagtgactctggcaaagggccccaatggcatggaatgcagcttcttggcaggcagattcacggctgtcaccttctcctgtgaaccagcaactttctagcatcatccggttggagatgatcatcaccttggcactccaaagtggttcaagtacaccctcgtcttcgaagttgagaaccacgcggtactccatagtgatacagtatccgacttcagcggccaaggcacgaagttgctccacaaaaccggccaagttgaagcagcgggtagtctcgaactcaggcatctacaacattttgaaataagagtcaatgaccagttttgtaaagagtggacaggtgaagatagaataacgaaggttttcacaattaaagaactagtttctaaaaaaaatatcatcctaaggcttagaccactggctcgtcctacggtcaaggtggctctgataccaacttgtcacgcccggaaatatacaccattgccaaacgctcagtgcattaatcctcgtcccaggaggcgaggtacacatagacattgttgattattacaagccacactagcggaaacgtaaaggaagaactttattacatgggcgactctaggccctcacactcaaagataaacaaataaaacagcggaagactacggaacaacagcagccacaggcactcgacggtggagtaaattagagatccaagccttcatcttcttcaggtccatcctctggattatttttgtgagcaagagtgagtaccaccaccatactcagcaagtcacaccggaaatgcaacaataatgcatagggaaaacatggaaatggcctaataggatttattttgcctaaagtcatagtttaaacattttaatcaggttaaagctcattttaaaacacgatcctgttctaagccaatattttaatatcaccaaggtcgcatgagcctgcgaacctgccttagcccaggctaatctccacatgactacaccatcatgatttcaccctcccaaggttttataaaacaaaactaactttgggtacattgctcagcttgcatataaccgagggcgcgactattcaaatagtttttaattctcatcagaggtgtacaactttacccagaagacacaacgtcaacacatgttgccacgcgccgggtaccaccacggtactcggatagaggtcgtgacaagactatccatctaggtctacccaaaacaggagaacccgctgaggtttcaccgcccgccggtccccgacaaggtaaaggttgccggatccccctggacgagacaggctccccttgcgccgggtaaaagaaacggcattaatcctggccccacacccttccaaccaatggtctttgttttgagaagatctaaactttcagtcgggccttacccactagacttgtggttgcacaaagaccggtccttatattagccggggtgcgactaccaaagtaactagcttgcaccctgagcccagcccaaaaatatattttagttgcacaaagcattttatcacccatccattgacaaaccagtcaatagtccataactaatcaagttttagttgttaaccaccatagtctagtttatccaaaagttctaggttggaactaagcaggactatgcatttacctaaagcaactagtcagtccatcatgtagggtactagactagtcaagttataattttactagggttcacaaagattatggatatcaaatcaacataatggccataaccaagagcataggaataaataataaaacaatattaataatgaacggtataatttataaagcaatgcaatataagtaaaacaacataattttcacaatatgggattcaacatgtttaaggtagatatgacttgccttgatcgctcacaaagtcttcaatgtcaatgacgatgaagagctgatcttccggaacggcacgatctacacgaccattgcgaagaaatacaaaaaggctaataaaatccatatgaacagaagcaataaagcacataaatgggttctactcattttaaggagaaattagagatttgaacggatcgataccgagttcaaacggtcaagatatggccatttgaagtttaggtgttgtttaaacggaaatttgtaattttgtgaattatttttctaaaggaaaacttgaattattgagagagagcgcacgcggactgggtccacgagcgggtcccacttgccagccgctcggtccactgtgagccgagcacaccgacgcacaggcacggcagcaaccgagccaggcggctcgccggcgacggccaatggcgtggcggcggtgcgacagagcacgggaagggaaaaacggaaagaggaggagacgacggttctcaccgagcagacgcggcagcgagaggttgacggtgttgccggcggtgaggaagaaacggaggggtcgttgtcattcccgccgtcttcgtgctcgacggaggggtggacggggaagaggaggaagcggcgaagcggatggtggcgactccgggctccgacgaggtcccaaccaccagcgaggggcggccggagttgcaacggcggcggcacaagaagagagcggcgcggcggctatggagagaggagggagagggcggcggtgtgtggggagagaggagggagtcggggtcccttttataggccggaggggagggagagagacgccggggagggagatcgatgccggccatggtggagctcaccattaaagaacatcatcgaaatccaccgcgaataatgctggatcgagtgggaaattatgggggaattggagaggatgaggtgggaattaattcccctcaattaatttgatgaaacggcgagtggaggaggcgaatcggaggttgccgtcgcttggaattcggacgaagagagagaggatggctggaggttagggatgacgagtgggacccacctatcatcgagaaggagcacacctgtctctgactgggcgcgcagagaaggcaaaacagacttcggtctgtgggagggggaatgagctgggctggcccaaggagagggagggggtggggagagaggaggaaaaagtacaccgaaggtccctcaacttgtcgtcgggatataaaatcgtactcgaaccacaaaagcagacatgcaagatcccttaactatacaaaaccgatcaccccaaatcctttgtgattttgaccccggttttagtctacgtggtggctgagtaaatgtgagacccacgtgggccccacatgtcaggtgtccacatcaccctctctctttcccctcttctctcccttccttatctctctctcacttctctacaagctagccggggcgaggcgggagggcggcgccgcgacggccgccggtggaggcggcgggcgaggggcgagctggagcggtgtcgcacatggagatggccgccagggtggatctgctcaaggcatggcttccagcaatcttcaaggtacaagaccccggatgcagaccagggcagccgcgcatcctcactgtccccgccgccatcgccattgccatcctgcgagctcggtccctcgtacttccagatcaagaagcatgccaggaccatgcaggagtagacccagaccgcgcagagcatgaacctccagttcagccaatactcaggagcagtggtgtcgacggccatggctgatgatggcattgctgcagtgacgaggcgttatgcagccagattcataatacaggatattactactcaaaccatgtctgttcttcaactgcaaattagattcttgcgccaagataaagagaggaattattattgccgacgaagggagaaatgatcagtactacgattcttatcatttcaagacacacaaaagaaaaagaaaatcgacgctagccagatgctatatatcctgataccctgcaacctggatccccacgcatgcagatggtaaagatgcaaatctttatttccatttccatgattccatgcacacaaaaaagaaacgaacaaatgccccacgcatgcagatggtaaagatgcaaatctttatttccatttccatgattccatccacacaaaaaagaaacgaacaatatagagaagaataccaagaaacacgcattggcgcagaggagggtggaaaactaacccaatctcaacggtgattgggttcttgtttcttgacttctccaatgcctccccttctccaaccttttctgccgccgcctctctctctccatcgattcctctccctctcgcgacctcgaacaaaccgagaagaagccaacgaaccaaccaaccacgtacgtgctgcaacgccgccgtgttaggagaccacggccggtacatctccgcgagcacccggcaccccaccaccgcgtcccaccgcgcgtacgcgtcgccggcgccgctgccagtgccgacgcgttcgccggcgcgcgcgacgacacgagcgcgcccacgtcggccgagcgggacgaggaggcggagaagccgcagcgctcgcacgccccctccgccggcggccgtcgcggcgccgccctcccgcctcaccccggccagcttgcagagaagtgagagagagattaggaagggagtgaagaggggaaagagtgagggtgacgtggacacctgacatgtggggctcacgcgggtcctacgctgactcagccaccacgtagatcaaaaccggagtcaaaaccaccgaaagattctagtgaccggttttgtatagataaaggaccccgtatatctagttttgtagttgaaggactttttttatcccgacgacaagttgagggaccttgggtgtactttttccgagagaagagaggggtggccgggctgggccaagagagggagagatgggctggaagcagcccaacaggaggaagatgatttcttttagcttttcctttttataaaattctttaattgtttttgttgccctaaaattatttaaaattcaagtaaaaattggttaaatatttttaagcatggggaatttattaaaaatgtccacaagccaattttatataaatcttggtgagttttaattgttggaggctcttttaggcttttaaaatttctagaaatacattaaagcacgatttaaatttagggcgattttcagggcgttacagtggggatggggacaggttgagatctccacccgcgggtccccgtggggccctggaagtactaaaatcgatgttgagttccattggtgagctctagcctcgactctagcatgtctgcctcctcttcttctccaaacatgtgggtcctcgacttgtaactaaccccagcccaagtagggtctatgtggggtgcaccctaatctggtggagcacggtcttagggacctcttggtcgtcctcccatctctttaaatagctaggtaccacttcaaggttccttagatttcattagattaatgttttagccattgctactttaccttgtagttacatgtgtcggctagaccacctaattactcgtctttagaaccccaacttattgtgagatttaattccttttcacaatttagattacttttatcttgttcttgcttatttctttgatttacttgtaaaaataagattgatctgcaccgatttgatcaacaacccacggagaggtatatcgatcgctaaggtgcaacacaataatggcctgtacggttatagtccgaccgtcaacttctcttccaaatcatagttatctcaactcactgaaagatcgagccaatcaaaaccgtgatcgtatcaaatggatctcaaggtttatcaataacactacctatttatagccccaactcctccatctttggtaccgttccttgagtctaccaaaagttgtatagggtcaaagaaaatctggtatcacactgaattgtctaactctttatgctttttgaacggtaaccgagcaactagctattatggtataaagaggtggacaatctagttgctactccctccgtatcttaatgtataacgccgttgacttttcgatcaacgttggaccattgttttattcaaaattttcgttcaaatatgaaaatatttatatcatgcttaaagaacatttgatgatgaatcaagtcacaataaaataaatgataattgtataaattttttgaataagacgaatggtcaaacgttggataaaaagtcaacagtgtcatacattaaaatatagagatagtgaggtagtatgtgattgtccaattgtgcttctcagaaacaatttggaatacggcagaggaccctaagcctaagggttttctttttatggcttggggttcatcttccaatccaaccatacaaaaaaaatttgacactaccaataagacggtttcatctagtttgtaggaggaacaaaaagtagtattgccaaaaaatttcaaaccaattctaataaaatcgcacattttttttaaaaaataaatggctaaaattttgttaaggttacattgttaacgaacaaaggacaaaccattagaatatactagagattggggcgcgcctttgcgcgccgcctgttcacacagtgtgctcgctatgcaagaattttttagggtgctgcatacacataaagataaaggtgaaacagaatatgatagcatggttgttcatacaggacagggtgaattgtctttggttgcatataagtacaagcaaaacaaccaaagacagtacgtaaggtaccgtcagctcctgttctgtaacagcacgctggcataatagtttgggcgtgatttttacatggaaattgagtacccatgcaaagcatacaaagaatgatactaacagctatagaagtagcagagtgaaaatatagcctacgatattaaaaggataacagcttgtgttgcatgagcatcttgctcacagcacatctattgttgcttgcagctgattagtctggtggaagtgaaagatgcagattgttccaacttgtatgccgttgcttgttggaaaatgggtccatcctgatttcaggttaaagcgcttttctgtggagtggtgaagaaccatggtggttgaggagtgccctggaatccgtacttcgatctgcgatgtcttcttccgcacgattagtgcaatgtatgtcatagagaattgctttgaaaagtgctgcatgataagtatatgttagtttttaaggtaagaggtatataaaggggtagtggtgcagttatcttaccaccttatcctgcttcatgaaagttggatttatggttgtgacatagaattcgtttgaggggtgcagaaattgcgcaatatctttgaagtagtctttgagttcagttgatagattgatgtccctccccggtgcagaagcacatttcattgatagtgcgtttggtgttgcctttcgaaagaggagtgaatgaatacatcaatgcacattaaaagagacgcaaatcaatggaactgaaaatagaaagagaagtatctgtacctgtacaagctgaccctatatcggcttttaatttctgttgcatggggtgttgcatgtgtggcttagtcttggttctttttttctgcaggtgaattggcgttgcaagcattaacggaaatcaaaagtagagagtggaatcagtaatgtaatagtttcagatatggtgccatagatgaaaatgatttgttgtcttgataggagacggaaagtgggttgaagatcatttacctggtggttttggtttctgaagcgcgtttttctttagctgtgagttgcttggtttgcttggcactggacatctaagataaccactcttggcttatatgatgacatgcatcttggagcgtgataagactttgaaaaccacatattctttaagctgcaaaccagtggcttctatgaactggggccatcctgtagtgatgtatattttgccagatgctctctttagttcaatgtagaccattaggttatgggttgttactaatttgagtctctggccatcctccagctgatatccttgtgcgattgcagctggtctgcgctgcagaattgaaatgatgtattaagactggcgtgtattaagctagactgtatatgttatatctgttggtaaggttaccacatagcgctggtttgctgtggttagtctaaccgtgaaaaacctaggtggattcatggctgtatctgcaaaaaaaaaaaggtagttaaaagaaatttataagtgcaaatttaacagtggtagggaagttgcaatgtacacagtgataaacaaagggacagataacagagctgagattgcagaggagagtgttaggtgcttgttatagtgtagtggtaatgagcactgatctttgttcttcggtggatttattcagatactaaacatgagttgtatattgtgatgtataatgggtcaaataggggatgagtaaaattatacagcagtcttcttattgttgaaaaaggctctgttttaagggctgctatatggctaataccatttttatttgttgccgaagtattattttctttcggtttgtatttgaaggaatggcaggttaccaatgatttaagggctgatatggttaggtttaaccagggcatgagccatgcgcaaagaatgttggagtttgcatggacatgtagtttgagctacagtgatctgtaaggtaggaggttatttatctggaaaacaaactttagcattgaaattaatccttgattatcctttagcgtatcatctctatgcatagcatatttatatgaacacacgaatggtgtttcttcatagcgcttatatattctgaagggtataaggcacggcctacattcgaaattgttactcaggctagctaacaatattttcaggtccatttggcacatatgacatcgcaccccaccagcatgtgtgaaatagaacaataatttacctccctggaagtatcagcaccaaaattcatctttgtggatcaggccatcgtcgatgatggagcagctgattttactccaactccaataccgtaaagtcagtgacctgcactgaaaaacaaataaatctagaagatgtaaaacagcatgctaaaatgtttaccagaaagagtctgtgacttgttaggtacaaacgca

SEQ ID NO: 42402 - DNA, 1531 bp, Oryza sativa
ttaaaactgaccttcgcgtgaacaagaatcacagaacaagagcagagcacataactaaggacttgattcaaacgcgtccattgcctgtaacacacagagagatgtagggttacatatatttaataaaaagctgtcaattgaacaccatagctaaggaaatgcaagagagcacagaccagtgaagaccgatggcgtgaaattgtagcttctatttcatataggaagctcttgtcctctgagcaccagcaggattgacggtgctacgaaataaaaaaaataaatgcggtgagcaaagcacactaacggtaatgtgactgaaaagaatacgtagataagaagtctataaagcatggcatcaagaatgctgtaccccttttttttcccatcaatggaggctaattctgcaccctgagaataacagcacaaaagttgttatatctatcaatgcttagtcaatagccgacgataaatagtatatttcatgtgcaggtaaggaagcactgcatagcggaaaaacataaaccacataagccctgcatacatatattatgcagcaaagaaatacaaaatcacctttctgaaacaacagctgtatctatatcctttccttcggacgcgcccacctcaaaagttagcttcttcgatgcacctagaggctgccacaataatgtataaatcagaaccttgaccgaataacaaaaaaaaaacaaatggtctgtctttcctaaggtaggagcagaacatacaaggcgcataatggggcgtcgtttcctgctatcagcatgggctttctccatatcacccacaggggtattagaagaagcaggcggtgtcgaagtatgatcaggacactcactttctctacatatacttgaaccaccagcaaaaggtgaaatgacagatgatgtgagttgcaatgtctgatccctaacctgtggaatagtgccttgtctgccaaagaagtttcaatgctattgacttgaaacgcgatgttcctctgcatcaagctcctttcggtgacagaaacgcagaaagtgaatttttgggacacaacactcgcaatctctcgaggaatattgtctgatcctcgttccaacctgacaagattcattccttgctattgttgcacagatcttccaattcttactcgtgggagatatatcacagaacagatcaaaaggcatctgaaaaaacaggaagaaacaattcgatgtacataaaacgggaaagtattaaacaaggaagtaaatgcgatgaattacctatgggagcactgcaacacaagacaggagaggaatcacagtatagctaactaagggttgctaattttaaaacagctgtacgactccaaaaatgtgaacaggacaatgatatctgtacagaacagctatagtataggcaaaaacatatattattactatctaacagcagaaaatatctcgcggtacacgatgttccaagtgcgagtagtgcaattgccattgtcatcttcaattaacacctttaagcctgcgcgagaagtgactcggga

SEQ ID NO: 42403 - DNA, 1244 bp, Oryza sativa
atcatcagacttttcatttgtttttgcaagacgatcaaagctcaagtactctcttgcttcaccaggaaaaagttgtaaaacccaagagtaatagcagcacacacatcattcgtaggagaaacaatagcacggtcttgcagatatactggatcattgtactgttcagcaaagttggtgtaaactgcagctacaatagctccaatcttttcatcattattcatgaccaaaagatcatgagggatttcaatccaagttggttcaacatcgctgccgtaactacacgctgctgctgtgccatcaccgatagaaaggatccaatcactgaattcagcgacttcgcgttgcatatcagaatctagagaggaacaacgtaaacgcatgttgatcgatagctctaaaacacatacatatgaccaaagaggagattttgatattgtagcatcaattgttttcgatctaacgcctccttcaacaacaggcaagatctggcgaaaatccccacccagcacaactaccataccaccaaaaggaattgatgcagctgaatgatcatcttcagaaagaatatcacgcaatgttctatctaaagcctcaaaacatcgccggtgcgtcattagagcctcatcccatataataagagaagtggatttaataaggtctgctaacattgtaccacgctttatatggcaaattgttgtttcatcaatttctatcgggattttgaatcgtgaatgagcagtcctaccacccggcaaaagcaagaggcaactccagatgatgcaacagcaagaacaagctttttttcagacctaaggtaggtaacaatacaattccagagaaatgttttcccagtaccaccaaagccagacacaaagtagaaagcaggtgattttgtcatgacactctgcacaatgcgttcatatgcatttcgctggtcagtattaagcttgctacataataacggagcattagcacacaaatcatctatatcataagacatttcatcatcgatcaatctatttgctgatccaaaggaaccatcgcaattcacagtaggtaaattaaaagatgacatagcaacaccattgcgaagaaaagcatgtgtaattctgcagaaccatatttctaagttcattatcagggacagaatatgcagcattatttaagctttgttgcaaatcaaagagaatatcatcagacatcgcatgccaatgtttattgaaaaatgcagctccatcagcaat

SEQ ID NO: 42404 - DNA, 1471 bp, Oryza sativa
actcaaatttgcctggtccaaatgtatcatatttactgcaaaaccaagaaaaccaggtgggaactctccactaggcaaccttggtttatgcaaaagaagtttcctctgaggatcatcgatcataaaatcaccagaaaatggcctgcaaagtgtaatagttataatgttaaggtgtccatccagtagagtccaaaatataacggcacaatgaaaacacaccttatattttcaagacaaaagacagtgaatcttccatctaaaaattttccaattgtgcgacctagtccatgaatgccactggttttatcaaccataccttccttgtcatatgtttcaagaccctcgacaccatcataagtcttgcagacgacaccaagcatattgtccaatcccaagtactctgagagtaccctataacaaattcatggtacctcaaaagtaaacaaataattctgcccattaactttgcaccagttggtgcaataaatcttattatatgtcaaaacaaagagagaataatgacctgctgaggttgtcattatttatttttcccaaggtagctacgacaccaaggacatctttcatcagtggcagctttgatgcatgctgataatgacgaatcttcagttggcatataatcccagctgctgtctcgtcctgtttgagtatactttgaatagtgcgttgttcagcttcttcaacagatgtgtcattatttgcaattgccgccatcgatgaataataattgcctattttaactgagaaaagttccagggttcagcatataaataggggcaataagataaagaaaaagtatatggaattatggaaatgagttaaagaaagagtatatggaattatagatagctttgatatctttatccaaatggtgttacttgcatgataaattcaaatttaccacagccatctaatgcaataatccaatggtgctaagaacattagataataggaatggtggatatgttaggctcatgcaaaaagattcaatttccaacgtgataataaaaagattttgcaatagcttgctagtcctaccactaatgcagagatgttgtctcaacaaccaacttccaatgttctactcaaagaggcctcaattgatttagatagatgcatatgtcatgcgaagtagtagcacactagcacctaaaggcacacacgcagaagcagcaaatgccacagttggcttgccatatggaccttaggataagcatgggtagtaagtaagacatgaattagaacgcaagtttttttggtctacctctaccaaggtatgtcagatttgcttgtcagcattagaattattgcattagggtgtatcagttcctacacatgttacagcttatcatatactccccctgttcttaaatagatgccgtctcagaatgtgtatagtcaacctcaaaatttaaatcatcaatatatacaaaaatattaagatatactaata

SEQ ID NO: 42405 - DNA, 963 bp, Oryza sativa
actccaaatttaagattacaattcaaattttagttgataagcataataatccaattatttacaaacagattatgacaaaaaaaaaccagggccatgtttgtcatctgccattttctagcactagctcctagctattgcaaccacagccctcagggatcccctcaacagaaactgccaaccagctccatgtatgacaagattgctaacagtcacaaggtagaaaaacatcaatggaccaccatatgagacaagttcacagcatctgagagggcataagatggtttatgattcatctctagtgaaattgtcattattctgcttgtgattgtaccttggtatcaggagaaatggagacttggagagcatacgagtactgaaaagtgaaaatggaattgggaaagcttatctgaacagcttagtagttgctgatggatacacttgcgcaatgccattagcaacactgatgataggccctcattgtatacacacatgaaaatgatagaaagataaggcgaaaatgcctccatttggacaaaaaagctaaaatctcaaatatcagataagtgaacaagtgagagttggttaacagtaacatttaagaaatcaatattcgtccaagtagctgtacaatgactcatcgttcctccaccgacgccttgtgagcaatgatttgaggaaccccctgcccttgcttgagcttttctcctgctctttgtgattgctccagtcagagtgtaactgcattgaagtttgtctctgcaagaaatactacatcagaagcaataaataaaatttcttctgaatatgattgaactccaggaaaacaaatgatgtaggctttcttaggatctagtaggataatgttatctccttaatgtaaatatataatttggtactatagtaaacatacaaaatgctttggatgaacaggtggccttcttgcaaccgtggccgatcgtgcaa

SEQ ID NO: 42406 - DNA, 8468 bp, Oryza sativa
aattcctgcagccctgatcgatgatgtgtgccacgagctgaaggagatggtgaacgcgcgctcctgtgacataagatgtattaaaatcaaatcccacagtatatctttaaaaatacagaacaatcagtggataagcttataaacaatttgactcaggagcaaatataaaacagggttctgagagctatctgtttacctcattgtagattgcctgccaactggcgtagagactgcaggaagaaaagcagtttcaaaatcaatgacagttttctctctaaaaattcagaaatgcagtaaacttactagattgtgacttgtgcattttacggctcatatgttgcctgctataccgtggaggttctgaaactggatgaatggctgattccactatatctgtgcctatacaacataaccacggtgataagtgattttacaagaaggcatcatataaaaagcataacaaaactgagtaggaatttgcctggcaatatgtaacgcctgtggtattttggtgctctaatgagaagagattgttgagatcttccctcctggtcgattgtctgttggcaaatccgtactctctgtaatcatattgagcaatgttccgaaggttagcagacattaaaccaagcattctgtaataaatgaggccatactcaagtactagaatataaataatgtatgtgatattcactccatgttaagaaaattacaaggtagttaacggaccacatacaaaatgacctttaaactcagtgcacatatgaattttgtacctgctcaactgaggatactcgaaattctgtctcattaacctcatcggatctttccttgacaaggttatccaccttgtatgacacaaagcccagatggtcgacagtgctaacaagggcctcaactgtgtaatctttcagacttgtcatcaccctacagcagcagatcagtgtagatttgttttacccttaatttaatgcagcaaggtaaacaaagaaacagagatccaaataaaacaaaagatcttacgtagatttctgagaattgtttctgtagaatacttcaaaatattccgccgctgagtatagctgtgaacgcagattcctcaggtcctacaaagaaatataatttaagcccagcacaggagatacagtactataagaaatgccagctcagctacatatgggagaaacattactaattaactcatgcgaaggcatgtggggtttcgttgtgaacaaggatcctaacttctttatcctgagcaccgaaaattttgacaaaggaatgcaactgtgcacgccattggttcacaccaatagactgatcaacttgctaaaggaaattaagccgtccaaaattcaaaatggacaaggagaccatgaatttacaagtaattttgctgctttctagtaaaagcccttggaactgggtttctgtcttctaggctccatttgctcaattagggagaaatcaattaaaaagattcagccagtgcagagttgcacagccaattatgcaagaaacagatgattatctacattacagagagtaatagtgtagtacactacaagatcagaaatttataaccacatagtaaaagtagaaggcatagtaagaactttcaaacattacaactacagtgaagcttggaaaggtgtacaagtagagagagcctatcatgttttgctaccaaactagggacaaaatcttgtgattgacatggacaaaacggcacacgagacacaactgagtgtgacccccagaacaagacccatcatcatcatcaggtttttacttttcttaaacctcgccaagaaatcaacaaatcgcagcccgatttctacctagatccatggcaaaaggaggtgggagaagaagaaggcaagaagcaaagattgcggcatcttgacggcttgaggaggccaagacacacacacacacggtgtgacacatcgcattcatcaccataccttgaggctgtccgagaagaggaggccttcctgcaacgacgacatgtcctcgctggtggaggcagcgtcgacgtcgaggtggtgtgaggagacggaggacggcgacatcgtgattgcctccatggccgccgccgccgccgcaccactcaccgaccgagcagaatcagacaaggaaacaaaagatttcccccctctctcgccaaatgccaagaatcctcctccctaccaagaacaccaaaaacccctcctcctaggccaaacccaagaaaagagcaggctctttggaagaaagaaagacgaggcaagcgccctcctcaccgtcaacaacagcgagtcgagcaaacctacgccaagatctgattcggggcctcctggttggctcccagaaaggcactagcggccggcggtggtgacatgagaagagcagcacgagggcccagagaagcagcagcagccagcagctagctaggggaagaaggaagaaatggtgatggaagtgtgaaggggttgggggaaggaaggggataggagtaggactactaggagtgaaaaaaaattggctccttttctgctacaaaaatgttggtggggggagcaaagagcaaatgagaaatgagaggggcggcagcagccagcaggcaaaggtttgcctgtggcagagggccattcattcacacaagtgacaccattggtggtagtctggtactagtactactaaattttagtactagtactagctaagagcatcccggagctcatctaaattttatcctccattttcacatttaggggcccctttaaatcgtatgattgaaaaaacgtaggaataagaaaaacatgagattttgatagaaatgtaagtgtaaaacaaaggattgcaaaacacagggaaaacacaagaatgaccgtttgattggaccacatgaaaaacgcaggaattagagaagaggtaaagactagaaggaaagtttccatgcggttctacctcatgttagaattcctccaaaacttgcatggtactatggaataacttgcatggtcctaggtattctataagaatttcataggattccataagatctattcctttaattcaaagagctatatagaaaaaattcctataggaatgagatcctctaaattttctatgaatttcctttgaatcaaaggggcctagatggtcatccaaaaagattctcactccgtatttttcttcactccaacagaccatccatattacatcatccatatatattttaatgtatatttcaactaccaaacatttacatttatatctttccctcatcctctcttctattctaccgttgcttcgacggggaggacaagggagggtgatgggtggtcgtcgggcagaggaacggtggggttgtaggcggtcaccgggcggaggaggaccggcggcgcggcggtcaccaagcggaggagccgcggcaccgacggcggggtcgcgggcggggagcggcgtgggcggtcggtcgccgggcggaggagccgcggcggcgcttcttctccaataaacctccctagcccagatccggttggtgccacctctctacctcccttcttccttcttccttcgatccagttgccgcgcctcatcctccatatctctcttcctctgcctgctttgcctgccacctctatgaattccggatgggggcgggagctcgaccctgagaggcggttgcgatttggcgtgaggagagaagaacgcaaaaattggcattcctctctcctgttttagcgcatccgctggtggccgatttttcacccccatccgctatttctcagatggaggattggatggaacatctgctagggatgctctaagggggctgtttagattgtaactaaaataaaccttatcaaattttgagtaatgccaaaattttgaaaatttgacaatattaccatgttttgacaggatttcttatgtatttatcaaagtttaataaaaaactaaatggatgcatatctttgactactttatttaaaaattgtatagtttgaaacaagatcaatttgaacaacccctattaaatgtttattgctccttccttggcttcggctagtgtacccttgcaatgtgaggctgatgtgtggggcccacaagcagagcaatggttaggggggtggggcccaggggcaaccgtgcatgtaggtgaagtgaagtgaaggaaggacagcatggatcgtgtaggattgtacagtaatagtagggttgtgtaatggaccggtgagatcatatggttggctaagagcatgtataatagcaggctataaaccagctataaccacacatcgagaagaaaagagaagagagaagaaagcgggctacagatttatagtcggctgcaacacggactccaatacgttatgagtgtatgagaggtaggaccgggtattaatgatgtagtatatttttataggtaactattgtataaatgggctattagattgactatagatgatttggagccagcagatggctatactattgaaacttgctctaaagggataaatgcacaggatcttgagatgaggtttttaatactgctacttcgtggctcacgtgatcctatgtatcatgtgtgggtgagaaagatgtgatcggttgaagctacaatgagctaagcaaataaaaatactttatgactaaaagctttatatttactagtactatgttattattaacagtttgaaaaaaataactacaaaatacacgacgagacgggtaaagtagaagtgtttttttattaaaaattattcgtaattaatagtctccttatctcacgatagaagcaaattttaccttacgaaaatattgttaaatacccctaaatgtagaagagtaaaaaacgcatggtaaaaacggcatgactcatctaagaggatacagtcacgccatccatacacctctaaggctatgatcggagtaaaaaacgcaggataaaaagggcatgactcacctacgaggatacagtcacgccatccatacacctctaataactacaaatattagtcaaaccattcatcaattaaatacatgttccaaagcggtttcatcactgatcgcaatagcaactcgaaaaacaaagaaaaccaataaaatcttaaaaaaaagctaaaaagatatatctcaatttgtttttttatacaacacaaacaaacgtagacactcgtatacaaatgctcacactcgttcctacaaacgccgagtcgaagacccgaactcagatgggcagatgtcacagtaaggaacctaacaaattttcgaatgttttttttttaatttcgccgattagaaaccggaatggttaccatttcagtcccaaaaaaaagttaaaaaaaatatggttaccgttaactgcgaaacctgccaactactaccccccgaacattgaacaggctgaccaacctttcgaggcaaacacgggttccagttgctgcgccacttcaaccgagcccagcagcagcaggtgcagggcccgaccacctacaagattgggaggagaccaccatactttgcagcagtttgcactgtcaaatccgccgggaccgcccgtggttgtggttgctgcgttgcgttgcgtctcgcgtggcctccccctcgcgtgggcaccggactacgggaggactagtagtagcttgctggtacaccgcacgcaggccgccgtgccggccgccccgccatcaatggggaggaggagtaaatatgcatgcacccccccggtttgtgcttccggttagagcaggtacacaagagattaaggaagagagagaagaacagcgctgcatgtagccagctacagcacggactttaaaacgtaatgggtgtatgatatatgggaccatgtattaatagtatagtaaacaattattgtatgaattcactattacactggctatagatgatttaaagttagtagttgattatactatttaacttgctcttagcggcaacggcaaccgccaacggcggcggcagtgcggcgcggccgcggtggttttttggcattggcagatgggcctgaatgcctgaatcggagcagtactactgatcaggcctgccaaaagcacgtgtgtttttttaggaaaaggtctgtttcatatccttataggccgaatttggttcgcgtacctgtaaatcggacatagacttcgagcctcattggttgtactaataagcaaaagccaaaatttaaattttagaacttaatattgaagttgatttaaagatattttcaacttagttttcttttagtattgacttttaaatagctacaaacatctctactattataaaaattgaagatgttttttgccggtattctggtacgccatacgggtttgagtaagtttttaagttcgttcgctttaaaaatacagattcgtgtttgagttggattttaagctcatttgtttttgaaaataaaaaggagtcgtataagaaatctatttaaagaaatccgtatgctaacttgagataaaatatggactcctaattgcagcttatgattttctaaaaaaaatttataagcgaattctcacagtgaattttaccctagttaaaccgtataacaacaataaatttaaaatagaattacccgttgcaacgcacaggtattttttctagtatatacaaaagtttaacctataaactaatttttattccctaataaatcattttatttcctgatggttaaaaccgtgtcaatttgtcctccctcgtccttgtcacgtaagcgccatatagacaccgcgccaactaaaattgctctccgaacaactgagagagggagcttctaaatagttgcaagatactactaatcactaaaggaatgttgaaactcacgcatcaaagcaagcaattgatcttacaatgtgcaagatgtcacagctgaactgtgcggtgtgccagggggaacacctgacttgtcttgcacaaaccaattttgcaatcgaggaacgcgcgcgaatcaaaaccccggctcatagtcgacctttttcttccgggtttctataggaggcccggcaaccacgtcgatggacgtacaacgcatggttggttggttggttgggctttccgcagatgatcgagctacatgcaggcgagctcggcctgcccgttaatttttgctccacaaacgatcgagggaggcagacgacgttggcatcgcgcgtgcgtgcgtgcgtgcgcggtggtggtggttgcgttgccggggcaggatccgacaggggacaaggccggcgccggacggcgacccctccctgccgcccccgcaccgcacgcacgcacgcacggtgcgcgcgcagatctgcacggaggcgtacgtaatcacccggtgctaaccctgtcgacggcgatcacgcgtccgtccatgccgtgcatctccttgcacgcgaggattttcttcttcttttttttaagggagatattttttctaggaactgatcaaacctactacgaagatactggaaaatttcatgcgtttcgaaggctattgaggaaaatttcatgcgtttcgaatgaacgtcttgacgttctgttggccaaaatcttgaattctctaggtctacgttcttatagcgatttcaaaatcaataagaaatatactatgataaaaaaaaatctgaaaatcaaagttaaaacaaacttccaaatctatatcccagctcgtttcttcaagccttccctccgtttggatcataagcatgttaggcatcgttttttttttccaaattgaatatctggaaccattatgcaggaagtttctttctctattgacaaggatgttcagtcaacaaacaaatccaaagagaacagaattcagaagtggaatagccacattcgccttgaattttagaatgttaaatcgcaatagtgaaaatattgagaaacatggttcagtacatctgatagcaaggtcagacgatcagactgatcaagaacaatgaaatctacatgtcaatatataccaataaattaaagggtgaaagctaatatcacaaaattataatctcccttataatatttacagaacttacacaccagttttatagcttcacgttattccttaagcaccattaaggttttgactaaacttgagcaaactactaaagagacattgtcaaatctttttttttcttgaaacctatgttacatcaatttgttcttcaaaatgcttgtgaagaaacagttttgacaccagcaacaaatctgttgcatcaatacgatgaactagccagtagccaccatttttcagctacgaccatctccaacgacaaaacgatagccaccaacgcttcaatggtgaaaggctaaaaaatccacctttcagccctagcctccctcctaaaacccagtcttctgatcctgctctggattagctgaagacagtaacttcgggtgaggctcgatcttcttctcgtcttcaatgggatagagcacaatctttctgaccatctggcaaaattccc

SEQ ID NO: 42407 - DNA, 8878 bp, Oryza sativa
aatatgcagaagcttacagccaaggatcatctccaacttccattgtgtcaccctcatcatcagtgaaagccaccttccatttttgtttgaggtcctttatattgaacatctcttccagctcattcatcagttgctcatatccgtctagattagctagatccacagctctgcccacagcatttccatgcatttgaacctagtagaaatgttgagtcagttacagtttaagaagcaggaggagactttctccggtactttgaaaccataacatccgttgatccaccccaatctaatggtttacatcaaaagatacctctgaaaaggtacttaagaagtgggccaggtattaatttaaagattaagtgggaggttagataggtaattttgtccttggtattatatcaatttactatcagataaggcaaatcggtgaagaaagttttggttcttctcgatcaaactgctcgtagtacagttctttttcaaaaactgttcgtagtatgaagatcctaatacagattacatggaatctgtgatagactactgagttattattttatatgataggtagtgtaatacggagtactactattttaaactttgatgctttgagagttcatcgataaatcaattataaaatgcgagccaccgccatggtcagccagagagaacagagaacaaacatgcctttgaaaggctaggcaacagagatgtgatacgctacaagtgaagatgaattacgtaaagaataatgaagtataagacgagcatatcaatggcagacaagaaagttcggggctagcagcaaatgatcaggaaaaagtcatggttcttatgacttaaaacaatctgtgcaaattaaattatctctatcccaaatctaccctttagcaatcaacggttgatactcaatagtttgagaggtaccctgggtacctcccaagcaccataaaaggtctcgagggggagacagataaatttatacctttatgcgagttctagcggtgtaattctgatggctttggatctcttgggggctttcatccgcagcaatatgctcttttgtcacttttgagaatgctgacagctgaccagagtcttcgtgagaaccagtacctttggctgaagcttctcctgctcccacacttgacttgtcatcagtggtagtagatatgctggtacatttcatcaaatccacaccaaacagacgaaacatggcaggttccttttttccttcaacaaccttggacgcatttggagcaacttcttcagttcggtaaccacaggcagcggtgttcgaagacaacttggaagtgggctcctcagcttggtaagcagaacgtgcaggccatgtagcaattcttgcttcattgctggtaacctgaaaaattttctgagaaatctctgacaaggtaggggagacacccttgtttgaagagttgaaatccttcaaccaactttcaagtactagcggattctgacaaactgaactactcacggcaccatatcctggatgctcgcctggccaaacaacttgatgtccagagatacaattaggttcactggaaccaatacctgtcttctcatgctgttgtggcattccagatagccaaaactcttgagctggttctgcaaacgaaaacaaaaggattaagagccaaataattccacaagttattggcaagttgagcaatgcacaaatgaatgtcatacccagtgattgaaggtcaatagtttcacttggctccctaggccgcttgtttttcgttgctgactgcaggggtacattgatggcaggtgcagtgccatcacatgtttcaatttcccaaggggaaaccctctcagggccattaacatttgtgacttcatcccattggacctacatcaagaacagttgagatggcaatcagcactttttaagaaaagaaatctaaaacaacaataaatgattttatcttaccttcaaggacttccattcagaacctgaccactgcagagaaagatcaccttcaccaactatagttccagaaaacctacagaaaattacatcgaccatttgaacatgagatgctacaacatatcaagaagaaagtgaaatagaaacacatgaaaccagaggtaaaaccattactttttaaccgggacgtcttccccttcaaaactcatcttgaacctcatgcccacattaaatccaaccttactagccgcaaggtacttattcacactaacaatatattggctttggcttaacctttaaaacaaacaaacaacagcacccattagcagagaataactacagttgtatcataacaaatgatggcagaaatggcccaaccttggcctgtagtacactaggaaaattgaattagtcttgatagcatgagatgcacttgcaagcacaccaagatgcatgctttggcttgatataacagatgccggcattgtgctctgtttctgcacaagacgcctcactccgacacgctgctctcctgtctcactcctacaaaagcaaaatatgcatgatcccttttgatacataaatcttgtgaacatctgcataaacttgtacaggtctgaagaataacaagcactgaaggtaagtggggatctaacctcaagtagacaaacgcgtcgccagaaatcagcttcttcgatgtcacaaacgtgctccatccagtagtcagaagatgcctacggggttggcctagggaaccgagaattgcacgaataagcgccagcatgcacataaagctactacaatcttgatcatggtgtggtggtcaaatgattagataacgatcgagctgataaccaagagaataaaaacaaaaatttgcatacccctgtagatgtgcttaaacctccactcagatccatgaaggtcctttgtgatgagctcttgggttggtgtcgccatggacatatcctgattagcaacaaacaagatatatgattttgacatacatagccgggaacatactactatcaccaaaaaccatgagaattacgcataccagtggcgggaggcactcgttggcatgccgtcggagcacggagaacccgccatgggtgctggtgtcggatggggtcaggatcttgcagaaggagtgcaccacaggcctcggctgctccggcaggggcgggtcaggtaatgttggcagattctcttgctgaaaaacagtggagccccaaatcactcccccttttttcacacaccaaacccaaaattgctgccttttccgggccaattcggcatataacacaatgtgatccaaagtacacatcaagtaaatttactttcagtaaaaaaagaccgctgttaaaacatgccaaaattcaggacatgaaagcagaatcatggctgtgtacatcccgttggatgtagaggccgggtttttaatccattatctaaaaaaaaagaaagcagaatcaaaattaaggggaacccaaaaggatcaccacgattgtagaacagggcagcagcacaaagtacattccaaaaccatcagaggaggcgacaagagcacaacaaaaaagaagaaaaaaaaacggtggtggtcaccactcacatccgggtcaggctgcagggtaatctgcgcgaacacctcgtcggtttccgtctcggcctgcagccacaaacaaacaaggaaacgtaagagaatttcacgggggccttttccttttctttttcctcctctctttgctcccccacaccggagagagagagagagagattaccttgagctcgacgttgacgaccttgcagaggatcttgtacggcacctggaacatcttgatttgctccgccagcagcgccgggtccgtcggctcttgcagctgcacaaacaacaacaacaacaacaagaagcgcgtcatcatcactcgctcgctcccggcgagaatggaaggacagaaaccaaagaattcggcggcggcgagaggcaaggcaagaacctgctcgaggtggccctggaggaagtagaacacccgctcgtcccgctgcggcacctccaccagcggccccgcgcaggcccgccacagctccgcgaacagctccgggtcccctacccctcctcctgctcctgcatgcgcccccccccccggcgcattaaacctcccggctaacaaggctctgcagaagctagaactggatcatcccgggaaccgtaggcagcgcgtcaccttgcgacgacatggcggccgagcgaccgagggagcgagcgaagtgaggagagaagaagaagaagaagagaggcggcaagagtgaggagggagggaggtgggggtggtggtgtttggggtggtttggtgtggtcaccgggtggtgctgctctgctctctctcgtgtcaggttagggggcgttggttaggctctctctcgtgtcacccccattaaagaaagccgcggtggtggagagcaagagagagcgaaggcagaagaggagggagggaggaagcataacggcggcgttacaattacagggctgcgctttatggctttaaacactctttgcctcacccccttgcctttcttcctatttcacatttttgtcctccccttctttggtgctccttttttttttgcagaggagccccctgtatattctatgaattggaggtcatactttgtgtttggtacactttctcatcacttgctagaagagtggttgtgtgtgtctcctatacattttctctgtgtatggctacacattttctatagagagcccccgtatattctataaattggatgctcttggtatggctgaaatttttttatgtgaaatggctgagtctttgccttagatagagatagataggggaaacatagtgttagcacgcctaagtgagaacaccgtgtgacggttggcctattcgtgaggagaagaagcgagggccaagtgaggagggatgaggtggaggtggtctttggctggtctctggtctagtcatcgggtggtgctttcccgtgtcaaagcgtttgttaggctcacccgtttaaaaaaagtcacggtggtagagtggtagagaaggcaaagagggggtgtaatgggatgatgattttgccggtgatgtaagttttaattgttagagatgaagtgatcaaatctttgactcgaagatagagtgactgaatcgctgaacccaactcgttaccgtgacgtcttttcggtggtcacatactaaatagctccatctctaaaacttaattgttatttgtcatatttgttgctatgacttttgtcaatgcaactatgtccacctgcaaagtaatagatagaataacatttggcctctctaggaaaacgagcaaagtgaggagaagaagcaagcaccgagtaaggagggaggaggtggaggtggtcttgactggtatttggtctgccacggttggtgctttcttgtgtcagagtgtttgttaggctcaccccattaaagaaagccgcggtggtgcaaagggatagaggagagaaaggaggtgattaggctgaagcggcagaagagttgctaaaggtagagagacaaatatgagataaaaattaagttttagagatggagctatttagtatgtgactacctaaacatatttcacggtagcaaagtcgggtcaaagacttggtcactctatcgcggagtcaaagatatttgacactccatttttaacaatacattctcacttatgtaacctatgtattcatcatcccattatcaccgcaatcgtctacccgaaaaataataatagatagtacaccagttgtgcaagttctctggtaaaaactaaatcattgtcccaacagaagttataaaccatccctggtgtttgtacactttctctacaattgctagagaaatggttgtgtgagttgctatgctttcttccctagctagagaaatggttgtgtagaaataggacacttcagtagggccgcttcctagcttaaagacatgggggtagcatagtgaagtccaaataatgagatgatgatttcaccggagttgcaagtgataattaattgctggagatagagtgatcaaatctttgacccaccaacttaatattgtgacatatttcaagttattgcataccaaatagatccatatataaaatgtaattattatatctctttttttctataactttgatcgacgcaataatccacccaccaaataatatattactatagcatctctgcaagttctttagtaaaaactgaatcatcgccccctccaaaaaaaggaaccacccctgatgttgatacaattctcttctcttgccagatgcatggttctatgagagatgctacactttgtctttcatcactagaaaaatggttatgcagagatatgtgtagcctagtgtagcacacttacatgagaacataatgtagaggttgacatatcgaagtccaattagcgaagatgattcacctgtgtcataagtgagaatttattgctagcgatagaacgatcaaatctttgacccgacttgttttcttgatgtattttaggtggctgcatactaaataactccatctccaaaatttaattatctttcgtcatatttgttgtgatgactttgaccagcgcaaaacgtccacccccaaaccaatatatattatacatcatttgtgaaagttccttggtaaaaacgaaaccattgtcccaataataattggaaaccatcatcggtgttgctaaagtttctcttccatcgctagagaaatggttgtgtatagatgagatacttgatagggtcgcttcctgccttagagagatagaggtagcctagtgatagcacgcctacgtgagaacatcctgtggaggatgacctattcaataaaagtccaactaatgagatgatgatttcacttgtgttgtaagcaagaatttgttgttggagacataatgatcaaatctttgacctaaaaatagagtgaccgaatctttgacccaacttgctaccatgagtattttaggtggcctcatactaaatatctccgtttctaaaatttaattattagttgtcatatttgttaccacaaatttgatcagtacaattgtccacccgcaaaataatagaaaatacaacattggtgcaagttctctaggagaaaccgaatcattgtctcaattggaaaccatccctaatgttaccacattttttcttcccttatagcatttatgtaagttctttggtaaaaacttaccgtaaatgatttcactattgtcaaacctttccctatcgatgatttcataaatgcttctaatggtttcactttcgatgatttcactattggcaaaaacttgcagtcaataatttcactatcaataaaaagttttgatgtatttatcaatgatttcactgttgtcaaaagtgacatttttttctctagagatagagtaagggagattttagcatattaatgaaactattgcccttatttgtgttctcgatatgatgacatttttttatgacaaccacccaacttgatctatcaccaaaactacttactgttatcaaaattattgttaaaggttgtgtagtcctcaactcccgagtaatggatattacgacaagtgtgtgcaagttttctagtaaaattcatttatcttcccttgataaaaaaaacatcaattcatccaccatcacaataagaaatcatgtgttcttgcttgtgcttacctcggaacctttccttcgtaaatttggaacaatgaaagtctcgaccgcgttgaagcccctatatatatttcatattagaaaccattaccgatgtagtccatgttttctcacttccttgctagagaaatgattgagtagagatgggatgtctgattggacagtgttctcatattagagagattgaggctaacttagcgatggcatggtacacgagaagatcgtgtggaggttgacctattcaatcaaaaactaacacgacaagatgatctcacccaggattctaagcgagaatacgctcttagagatggagcaatcaaatctttgacgcgacgatagagcgataaaatctttttccgtaaaacgaaaaattctaaaaaacaaacacgcatacatgcataaaacacgggattattatgccctaactgtgaacctactgcagatcagccaacgcgtcatgcatgcatgaaccctctttcttttcttctccctacgaagaactttgatggagcgacgcacaaagcaatcatgcagccagcagcaaagtccatttggccatgcgacgacatgcatgcacgggtttagcttggagatcgatcgatcgatctgaaagccaaaattaagctgtgcacggcgaaaaggacgcagaggattacatgctacacgtgcagcagcagcagcggatgccgtgggggccggacgatctgccgatcgatctcctgtcctgcccatgggctccatggatggccaaaggcctagttccaaagtttttttttctaaattttcaacttttcatcacattaaacatttcatacgcacataaatttttttatcacattataccaatttcaaccaaactttcatacttcagtgtgaactaaacacagcccttttaagtccagggccaccacctgatgagatgagatgagagatgagatgacattgctgccaatctagcttagaccggtcaagctagagccaacagtgagatgcaatctgtgtgtacatggcccaccacccagccacacccaataatttccctgcagggactacgtactgtgtgaggtttaagtttgtgtgattcataagcacacgctctggttctggccggtgtgtgtagcatacacattctctgaacgtagtgctgacctttctgtgcagcgaagaaaatgtgcggtgcaaattagggctgcaggaatt

SEQ ID NO: 42408 - DNA, 10789 bp, Oryza sativa
tactttttatctcttataatatataatatgttgaacgcacagacctttagctagttttttataataattggtgacccatatatcaacagtactgagagaaaaatgtgacaaacaatatgtctcttatccttccttatcatcatgcacgctattattatggtcatcattgaggccgggggtgtcaggcttacagggactcagggaggcaggagtcgacctggtagagagtggagatgctagattcgggctcctccttactatatacggtagttctcccgcaatcaaagggaagaataaaaagaggagagagagttagtgtgtgaagcggtggcagattcattggatttggaggtggagtgacgatagagccaccgaacttggagatggatataatgggatggtccaagttgaaacaaaattgtaaagttagttgttgtcaaagaaaataatggttaaagatgatataatatgaaaacttttaagaatacatagtacaaaatataatttactttttttctctggcataattaaagatgagttgttcgttagccgatagttccatgctatgctaagcccactataattttattgtctctacataatatgattggtcggtttacttagctactactaataatctcatgatatgttggcgtgtgatgatatgggcttctgctaacacgggctgattaattatggttggatagatttggctaaaaaataaaaaacaataacatcaattttgcttaatagtacaacattcaattgtggtctcctttttctcactacatgatatatgattattctctcttatcaatatgtgcataactatattagtatttcccctaattctttcatattgttttttacatatatgttaatttgaactaatatttttttctcacaattaaatagataataaatcgtttttccatatttatcgtacataaaatgagtatagtacattgtataatttggaaattatattacaagtgtatgtaatttaatgtataagatatgaatttatatactacaagttttgactctttcaaaaatgctgcaccacattagataggtagttaagtgaaaaaatattaaaaaaaacatagtcaaagccgtttctttatttcattcaaaacaagacattttggaacctcgagagaatgtaaggaaaaagagaggtggtgagcttgacagcttaaaaaaaaataacacgttgacgtgaggtgagagtgagattgttgcccagctagcgttttcaacgttcggtagttggccgctaaattaatgccaccagatataggtctttttttctttcggtttcattctatgcaaaacttattgtaaatctctaaaatcttagagtaaattttacaaaactatatatatattgaccaaattattgtaaaactatagatgtaagatggtatatcacaaaactacaaacttaacaataaatttatcataaaactacagttttattgtcttgtagttttattgtccatatattttattataaaattatcttaaaatatattttggggttgaaatttttagcattaacgttatctttgagttataatgtccaaactttgtgattgaattgatataaaacctgtagatatccttttgtaataatccaccttatatttgtacttatgtgataaatttagtgttataaatttgtagtttgtgatacatcatattaaatttgtagttttgtgatgatttaactaaagtacctgtagtattatgaaatttactcaaaatcttaatacaaagatacatacaacttatacatattctccaaaatcagttaacccggtgaaaataaccaaatcatcacgttatgctaataattcgatacaatgaaataacctgcgttttttcttcttctcaaacatacccctccttaaaaaaatatattctagcaacgaacctacatgtatgtatccagaatcgtagccagagttagctatcactgtaaccacgcatgaaaggcgcaacaatagactttcaacgagacaaatagctggttagcacggtacatgagacacaccaccacacccatgagatgacgagcccatgacgtgtaaaacgaaacggacaacaacagaaaagaagcagataattcccaattgccgtgcaccaccggagcctcgacggcggcggcggcgcgcgccggcgtggtggggcgggcggtcatgaggtgcacgcccatcacgttggcccccacatctaaatccccgcacgccttttctcgtgtcgcctactcgccccccccccccactttgttttcggagggttaacacatgcattaggtgctaataaatcatcatccagtataagagcaagtttaatagcatagcccaatacttagttccaattcacttataactaatctaatagccagttcatataatatttgcttactatattattaagagcacccgcaatggtaaagtaagttgctctctataaaacatgtacatctcagtaatagactagattaatagtaaaccacctcaatagtatgtctacatgggtatctatagctctctcttctattgcctcgtttttctctacagactatctccatgttagtagatagctttactctctctctttatttaatttattccaagtagaaaaatatgctgacatagatctcttttagagagcctatagataaccattacgggtgccctaatatatggtctcacatatcatatacatattgcgttttagagtccatgctgtagctggctacaaatctgtagcccgcagcttttctctcttatcttttatcttattaaaatatgtttatagcgctgatagtctgctattgtagctgctctaatcacccggggtgggggccagccgcgtcatggcgcacccacgaacctacccgcctgagtcacgcctacatggcccccaccaccccgccccctcgttggccccacacgtcagcctcccgtggcggacacggcacgagtgagggaagggcagagtcattagcattagcgccggggataggggggtgccctgaaaacgtgtcacgtttttccttaaatagagttcacgtttcccaccacctcgtcacgccacgcgcacacgcgcccgatgggccccccagctcacccggcgaccctaccccgcctccgcgtgactgcgaggtggggcccacctaaccgtggtcccctcacgtcagcgtcgcgtgcgatctgggggtggacggggacgtggtgcagcacaaacggggggctcctcctcctcgggcgggggcgcacgggtcacgtggcgtcacgagccccccctgagtcgccttcccgatcccccagcgacacgcgccgcgcacgtgctcgctcacgcggaggaggaggggggccagagccgaggcttccccggctgacggctggagccgatctgagctgagccgagccggtgtgggttcacgtgaaggcggagacgagaggggtcgacttgcgtagcggccaggatcttctgcggtgatcaggcaaagggaaaaaaaagaaagaaaaaggaggtgtatttgttttaagtgaaaccgaaagagcatatagccgtagtttggtgatgtgtatacagatgtaaagttagaagtttagtgtcggctggagcaaagccgtgaaggtaagagagaagcgtatatgagcatatgagattttttgtacgctaccaaccacattatgctactactagaagatatgcttttcatacagggcaaatgtattttttttataaaaaattttctaaccacaaccgtcagccatgtcacatgtgatgttttattataaagctactaattcctagattaatattttggtagttcatctaaaacttgtcgaacaggtgccgatgaattttgaacacatatgttgtggattatttttgtgatattaggtattgtttgatattgacgacgcatatttctgcctcttaccatgagtcggtcggcctaggtaaccgtccctagtggccgggtcttggctttgacactaacacaactaatgttttcgtttcctatacacatatagttttttaagaacaaaatcttgctattaacagttaccttccatgtgcatgaagatttgtgccccttctcaccttcgtcgagttaccaaaatttggttccatgatagtaccacgcccaacttcactagcaaccctcgccaccaccccctagaggcaggggaggttgaggtgacgagcacaaacgacttaaacatgtgtaacaagggcataacaatcttattgtcgctagtctcctatgaaaagtatgagggctagagagaggattggcagtaacgaaggaagccgataggactcgtcggtatatatggtggagtttgaaggcatcgcacgaaataggggaggcaatgaaggaagaagggggaagcggcaagagggagtattatggttagtctgggtcgacaagcgatgctttatacagtgaagtgtcaagatccaaaccactcagcagagatcatgctagtggaggggaaatacttgattcaagtttttatcttaggtgtagcacaagacccccaacgtgtgtaaatcttattcgtcaaggtattgagatttcattacactatagaattattgtaggttccttgattaaatccttagagcaacactaagagactcactagatggctctccaagctaaattttagcaaatatcaaaaaatcaacctccaaaatacttgccaaccagttggccaaatgcctccctttgatgttcaaaattgccagccataatcaatggccattcatgggtcccatgctgatcctctctttctctctcctttatcacctttgcgagaagacgtgactcacacgcacttcctctagctcgccttgtcccagcgccaccgttgttgtagtccatcatcatcgctaactcaagcgccacatcccccgggcacctagtgccaccttacccaccctcccctagcccaagtatgccttgctccaaactactacatcgtcatcttccgtcatcgtccattatcaccaccgacttaaggcgatgcctctcctagcctcctagtgtggccttctttcatagtttcccacccgttgttaagaaggacggagcgaggtcaatagggccgatgacgtcctccaaatcccaagctctacatccccgtctcctcctttgcaaggctgtctatgtagacgatgtcttctcattggtgatagaaggctagaagtagtcattggagagggtagatcgagaaatggcatggaggagaactaggcagaggggaagtatgcgagagagactaacatgtgggtcccactatcatagtggaaactatagatggagagcttgttggagcacacataaaatatggagaattgaagagggatctttttggctagctagccagccaaatgggcaaacaaagagcacaatttgaaaagagagtttagagttgttcctataaatgcatttctctccaagtttacaattgagggggaagaaactctagtttggcttgcttattctacctttacaaccatgattcaattgcatcttaatcagatttaatcttaatagctaaaattacttgcattgctcaatcctattaatgtgttaattcatctttgtccctgcccaaataaatgtcacgaatgccacatccgtcgtggtaaaagaaagcaatatgtcccaaacaaatgtataccaaaatggcttggagcgagtttcccccttcccccaaagccccaaaccgctattgaatggcttaggcatactatatccgccacattgccatatccgggaaagtccaaaaatatcttacgaagtacaaaatctttcttatatccattagtgccaaccgagcaagagggtggggaagggcataagaccccatggttttgaaatttaataaatatcacaaattctacttccattggtgaaagtaagcaagaggtaagctatggcttgtagcgagccggtcctctatgctctatgaagtggtttgggttattaggtatcctacatccatcaacacttataaacatagggaagtttaaatacaacctttttatacacattagtgcctaaggggaggaagaactgaagaaggtagacatggatacgaaaacccctggttttgaaatttcataaactaaatttatttaaaacattgtcatttacccaccagtaaattttacaatttctagctccttcaatattaacataagattgaagaatccatctaattaggatacaaatattaataaaccaaagtcattctagtaaaaaaaactacattataaatcacttatctcctcttgtggcttaacctgattaacaaatagaccaatccctcctcaacctccgtctcctcgaatgatcaaagagcacgtggccactatatgagcaaaccaattgtcctgagctgacaagagtccaaggcttgaattgagctagtttctccacccccacgagccacggatccatcggctcaggttccagtcccaccgggggtagagaaagcaaggcaccctcttcgtcctcctctcacaccttccctcttcacacatcacgcgttgtctcctcctccccttccccttcctcaaaatctcctcaacacgccgccttagcctcagccccagctcctcagccctgcgcatgcttcgatcttggtgaattcagggagctcgtgaggttacaattaaggggaataaacactagtttggcttgctcattcaacactttgcagcagggtccaattgcatctaaattatctgcagtggtcaattctactcattaattcatttatgtccctgcctgaatgaatatcacaaataccatatccatcggtgaaagaaaacatgcggacccaaacaaatataaacaatggcttgaagcgagccggctctcccatacgccacaaagcggctcgatatcctatatctgcaacatcgctacttttaggaatgttcgtaaatatcttatacatgctagtgccaatgggagtatgatggtgtgttggaataggggaaccagccccatgattttgaaattcaacagactaaatttgttgaaactcatgagatataaatgttaccatttctagctcctcaattattaacaagcgaataaagaatccattaataataataataataaccatattataaatcaattatcccctattttaacttaacccgattaacaaatcaacccatatgcttcccactctccatcgactcgacttgaatgctcgtagagcacgcaaccacactgtgtatgaacaaaccaccagcgcgcaaagccgagaagagcccatgggtcggcgatcgagccggctcccccgcccctaacgagccgcggaccggctcggctcggctcggctcgggatccaatcccaccggtgtagaaaaggcaaaggcaccctcgttctcctttcacacctctccccccctcttcttctctctctccacatcacaagtcgccttcctcctccgcccccgaaatcccctcgcgaaccagagaaacctgaggcaccaccatcaccaccaccgcctccgcctccgcctccgcctcctgcgcgcgcggcgaattcgggggaccctcgcgctcgcgtggggtgtgggtggggggagagccgggcgtcgccgtcgccgggggggggggagggtgctcggattcagccagcggcgggtgggggggcccgcctctttcttcttgggggggcgcggaggagaccccgcccgtcctggattccgtggccgcggcgccgattcgggcgcgggagccccagcacggtgagattttcccccgctgccttgctgcactgtgagaattgccgtatctatactgtactagtttgttgttgttgttgttgttgatgatgtggctgctcgctgttgcggaaacagtggaatggatgggggtttgggatggttggggtttgacgagctgggcgggttgaggcgggaggagggtttgcttagggtggaatctgattggccgcgatcggcacgggtgttttggctgtatcctatagcgtgaaaaagataggaaaattactggttgtatcactttttgctgggtcaggtttggatagaattcaatcgtgttttccctccatgtcttttatccgttgaaatggtgccatatgaaatgtcaggattagttataaattctggttgcacactttgtggacgatttctgttatttgagtgggttatttagcgattatgtgtccgcgaatataatctgtactgacgtaagagcagtgaattttttttatcactcatcacagtgtgtttttagctggatgataactgagagttttgttcctgttattctgagttcagcacccgattattcataagtccaaatgatattttgttgcttgtgtatttgtctaaaactgtgcttgtggcgtccagccagtcaattcttgtgagtattacgcatttttagtgctatatttggcctgatatatatactatcttgagtaggtattatggtgatgaagatggaggctgatgaggatggtgccaatggcggaactggtgggacatggactgacgaggaccgagcgctcaccgccagtgtgcttggaacggatgcttttgcttacttgacaaaaggaggtggtgccatatccgagggccttgttgctgcatctttgccagtggacttgcaaaatagactccaggagcttgtcgaatcagatcgtcctggtgctggttggaactatgccatattctggcagctgtcgcgcacaaagtccggtgaccttgtccttggatggggggatggctcttgccgtgagcctcatgatggtgagatgggacctgctgcttctgcaggtagtgacgaggccaaacagaggatgcgcaagcgtgtgctgcagcgattgcactcagcattcggaggtgttgacgaggaggattatgccccaggcattgatcaggtgacagacacagagatgttttttctagcatctatgtactttgcatttccacgccgtgctggtggccctggtcaagtatttgcagcaggcgtgcccctgtggattcccaacactgaacgtaacgtatttcctgccaattactgttaccggggataccttgcaaatgctgcaggatttagaactattgtgctagttccatttgagaccggtgtacttgaactgggttcgatgcaacaggtagcggagagttctgacactctccagaccataagatctgtgtttgctggggcaattggcaataaagctggagttcagagacacgaggggagtggccctacagataagtcaccaggtttggcaaagatttttgggaaggaccttaaccttggccggccttcagcaggcccaggaactggcgtgtcagaggcagatgaaaggtcgtgggaacaaaggactggtggtgggagctcattgctccccaatgtccaaagaggtttgcagaatttcacttggagtcaggctcggggcctgaattctcatcagcagaagtttggcaacggtatattgattgtgagcaatgaagccacaccgcgcaacaatggaggagttgacagctctactgcaacacagtttcagcttcagaaagcaccaccacttcagaaactaccacagctccagaaatcacatcagctagtaaagccacagcaactagtgagtcagcaacagttgcagcctcaagctcccaggcaaatagatttcagtgctgggaccagttccaaacctggtgttttgactaaaaaaccagctggtattgatggggatggtgcagaggtggatggcttgtgtaaagacgaaggtccgccacctgcattagaagaccggcggcctagaaagaggggaagaaagcctgcaaacgggagggaagagccactaaatcatgttgaggccgagcgccagaggagggagaagctcaaccagcgattctatgcactgagagccgttgtacccaatatatcaaaaatggacaaggcatccctccttggtgacgccataacatacatcactgacctacagaagaagctcaaagagatggaggtagagcgagaaaggcttatcgagtctggaatgatcgatccgagggatcggacgcctcgacctgaggtggacattcaggtggttcaggatgaggttctagtccgagtgatgagccccatggaaagccaccctgtcagggccatcttccaagctttcgaagaggcagaagtccatgcaggggagtcgaagatcacaagcaacaacggcacggccgtgcattctttcatcatcaagtgccctggcgccgaacagcaaacgagggagaaggtgattgccgccatgtctcgcgtgatgaactcagggtagaatcagttggggagtgggcgccaccggtagaggcagctttacttcgttcgctggttgcagacaagcagcaagcagtcggttggacggacacccatccacccacctttcagcgctgttgatagaagaagtttgtaggcagagaaagaaagctcagattctgacttagcgatccaaggggaagacaaagctctcaagttaaaactgccattgttgtatggtaggcttttgtggtcggtgtagtttttctctttttgttgtttattggggagaataccatgttcttagtttattgcttgtggcagaaccataaacagtacatctcgtcaaatgcatgagttgggaaagaagtcacctgcttttctgctaattctgtgtttttgtttgtatctcaagtgagttggtgtttatacttcggcatg

SEQ ID NO: 42409 - DNA, 8393 bp, Oryza sativa
ttgggacaaaatcgtttgtacgatggcatttcttggaactcacatttgtcaatggcatttctaggacttagacgcttgtcaatggcatttcatggattatctcttttttaaatacactgttgatcagtttggaaagcggtatatgcaataaatgagggagttttttttccttttaacgtgggcgagatatcaatagaaactgtctacgtaacatagcacaagaaacagatataattgagtaatgctcctattaaatttaactctggaccatgtttttagaaagccattttgcacacttttattgatatgaaaacacagaacgttcagtaaaataaggggctcatcaatacaagaactcttcaaatcaaattagatgtatgtttagatagaacatgtgccaaaaaatttggcttcccggcgaagcgctcaacagagacttgcaaaatcacgtcaaaatattgcattcatataaatttgttgacgaaaagccgcattgtttccaccacttggaagtgtggctgcgttctttcaagggagagatagggaagattgtgactcgttttccacgcgcatgcttttcaaattactccctccgtcccagtatgtaacaagttttaagctcgtggacaagtattaaattttaaactggtaggcggcaaaagcacatacggcaatacaaactagtactctattcttttcttctctttcactgataactatgctgaggggtagaattggtagatttctggtaaaagttgtactaggttgtaacatttgggacaaattttgaatgccaaaacttgttacatattgggacggagggagtactaaacagtgtgttttctgcaaaaaatttctataagaaagttgttttaaaatatcatattgatccatttttaaaatttaaaatagttaatacttaattaatcatatgctaatggctcacctcgttttacgtattttctcaatcttctcttttcctctccttccttgagggcgtaggcttatctccccatcaacaacatggggtaagtacctgaaagaaccaattacaaaatttccttgcgcatctcgtatgctctggctcctctgtactcgaaagaatgtcaaaaacaaagcatctacatttaccttgagagtttcttcctgtaggaggtggtttatgccatccttcatgtggttttgtatctgttttttgcttgccattttataatttagtgcaagagtaataatagatatagctgatctagtagccatttgaatcatttcaacattcaccatttgcctcctttcccaccaaatataccgtattcccctatcgaaacaatttcagcaaatttcaaatcattgaggtgtggttacctcctctcatgattgtcttctagtaaaacgattgtcttctagtaaaacaaaacccgattgatcaatattggcaatattctcaattttgtttcaaattcacatatttatccacacttctatatagctctatcacattgaaaataatatgtttaatatcctcacatatacggtccaatcgtttggtttattcatcatcatgaaataaaccaaacaacatatttgcaaagaaaaaataatttgtaaattttatgatcgttaatagaatattataaaataagttagcgagaatgtgtattatgagagacggagtaacaaattaagttaatatgcaaggacgagccgggggagtatgtaatactagtattatcaccatcagtcatcaaccattcttactctttcgttagatatgataaggttggaaggttcattttgcctctaatatagtctgtattaatgaaactaatcactagattaagtctactaagtgattattagactaaacaacatcttctggtggcttggtgcttacgccacacggaagcttattagtagctactccctccgtcccaatatgtaacaagttttggcattcaaaatttgtcccaaatgttacaacctagtacaacttttaccagaaatctatcgattctacccctcagcatagttatcagtgaaaaagaagaaaagaatagagtactagtttgtattgccgtatgtgcttttgccgcctaccagtttaaaatttaatttgcgtgtgagtgggtttttactgtgtttaaccagctttctggcgccaatgtgtttgaaatgcacgtgtgagtttgatggcagcaaacagaccgccaccactgagttttagtacaggaataatcattgagggtagtatggtctttttgcaccttttcttaatacttgtgaacaagcttaaacccccgcctcgtttctggaagattctctcctcccccgctctctcagaaacaactcaaatcacgattcgctcctgcaacgctgcacgcgcgcggcacgaggagtaggatgccggcggcggcggcggcggaggggaaggcggcgcgcgcccgatcgacggcggcgacagcggacgccgcggccgacgacgtcctgtacgtcttcgctctccttcgtcgacgtcgtcgtcttctctgtctatgagaatctagttctcgcggtttgatcggcatatccacaggatgccgcggggcgcggaggcgaacaagggagcagcgggcgggcgcgcacccccgcccccgccgcggcggcggcgaccgcggggcgggacgacagccagtacgattccccctctccttcaccttctcttcctgagaatattgcgttctcgcgagtaatgacatctagcattgcaggactcgtcgcgtcgatggaagcgcggctggagtttgcgcgcgtcagccggcgaccgcagcgcgggaggtgggcacagcagcagcaggaggcgtggctctctggttagttcgtcgtcgtcttctctgcggccggtttttcggttgagagtttgtgaagcaaggtggtttgtgtgtgggggtggggggtggtatccggatcggtgtgtccttttttttttttgaatcgcaaattcaatttaattgtcgggattgggggtggtaatggcaatctatttctgtggctggttcttagcgtttcgatgtgtgctgtgtgatgagttcttgatgcggtaggctattgcgtcacttcggtctctagaagcgaggaagattctgtagtgtttgctttcaaatgctttggcaagttcgattcggctgtagatttcctgcaccaaacttatgttgggcttgcaagttcaggaatcttcagtttgctgattgcatatatctgaaggctgtttgcacaattttcttgctgataatgtttattcacgttggtaatctgtcttttttgcaagcagacacgcaaaaaaattcttattcgggatggggttttgtttcaccaaatgaatggcattcgtcacaactcttcatcttctctttgttttcccagcctggtgcacattctatcgtctcatctggcattgtctataagggtcaactaattagatgatgtcttgcaattcttttgtttgttcttcagcttgcattgggagtttaggtactaggaaacggttttctgcgtttagattgcttgctagtttcgatgtgtgttgggaaaaagagctcggaagcgagctgcatgctagcggtccatcatattcaggtgtagtttggccatcaccaatgtgcagtaaaagtttcacaatcacccaattaagcatgttgatgaagccactttgacaagcagcgaccaaacattgcgtacctgtgcaccgttcctaatttctgctgtctcttgtgtaaggaactaagccagcttagttggtcgatagctagtgtgggtgtacacctagaccaaaagttttatcaagttgaatttgggtgcctattttcttgttaaactagatgaatatcccgccgcgttgctgcgaaaaattacgttgcataatatgtacaaatgtaatttgattatcaaaatgaaaataatttgatacaattttgagtctaaaaataattaagattgcatgttttaagatagaagaaagaagagacaatttggaccatagctctatcatccaaaggctagaaataattaggggaatatagcttaatgagagaagagataaataatgtattaactacacttaataagaataaactatagtatataagattacaaagtcgatcctaatattttctttatcttcttaaaataaacacaatgaactcgcatgtttttgtcttttctgtttgaatgatgtatcacagaatgccctgcaaatttgctgacctttttaacctgatacgtcactgatcggactttgaatcatcttttattattgttggaaggaaaaagtatatatgaggtcctcatcttgtcatcgaattacaaaatcatcctccaaccgcaaaatagatatatatcatccctaacttacaaaaccggatcactctaggtccttaggtggttttgcccctagttttgtctaatgtggcagttgagtcagcgtgggacccacgtgggccccacatgtcagtatttccacatcaacaccctctctttcccttcttctctcccctcttatctcccttcctcctctcagtctctctctcacttctctgggcaagtcggccgcggggagaggcaggagaggaggagggcgtcggtggccggcgacaggcgatgcagcggcgacgcggaagaaagggagacatcggttgcagaggccgtaggcatggaggagggtgtcggcggccggcgacggcaatacggcggtggcaacaacttgggagaagggtcgacgatgtcgtggtccaagatggctctagcatgggcggtggtgtccccgggacggcaagtcggtggggagccatgagcctctcctccgaccttaccttcttgcctcttccggcggtcatggcggtgtcagcggcagggatagggctgacgggaggggccctgagtcgttgtcgtgcagcagcggcaggggtagggccgggcggcgtgcagagttgtcgtcgcagtggcgcttcgggtcccagtcccctctcctccacgaatcccgccgccgccaccatgaatcgcaccgctgatggcatggagatacccaagttccatcaagccatagtcaccgatcagcgctgctccaccctcgacttgctccacgtgatcctccgcccctcccctatccaaccctcctcgcgaatcgtgactcctcctcccaccacagggactcctcggaagttgactgcgatcaggagtgccgccgcgacgaagactctgcacgaggcgcctgctcccgcgctgccgccgctacgtgactgcgtcgcccgtcgccaaccgccagacctcctcctctcccgcctcgagccctcgccctgccggccgacttgcctataagacgagaagtgagagagagagaaaggaagaagggagagaagaggggaaagagagagggtgctataatatttataatactaaattagtttcatcaaatcaataattgaatacgtcgacttttgaggtctcgactagacgaatacggtatttgcatggtatggggatcgtcagtaccagggtatatgcgagattgagtcaaaagcgacagagacaaggattttatacatgttcggaccccttcacaggaaggttacaaccctactcctgttggccgaagccggtgttactctatattcatcagaatcatacaagtacaatatttgggataacccatctagatgtcgttgacttggcggcatagataaccaacacatagtcgacgacaggatagttttcctcctcgaatataaactcgccgagatcagagatggcgctagatccctcttgtcgacctccgcaggcaccagatagggtttatttaggcttatctctgatatcgatgtttggcttgtcttggcttgtgcgttgatatgttgtcccttctctcctcctatggggtcttgtacttatacccatagatatctccttgtccaagtagaactagggagaccaatatagataaaatccaaatattccttgtagtttccatatggaactctactcatcctcccttatccggaactccttctatatatgaggtatgatttcgtataggacttggtatatggttggccccgcctagcttagtcaattactattgggtatatggtatccataaccctgacagaatatattttcataataaatttgtcttgggtctaaaatgttactacttttttctacaaatttggtcaaacttaaagtagtttgactttgactaaagtcaaaacgtattacaacctgaaacggagggagtaataatctaaagctagctcttttgctagcttttgattggtccacgtggcacctcttactttgaagaaaaatcataaatttatagtagagaaaaaaaaaacctaacaatcatatgtgagaaaaatctagagaaaagtatcacatatggatttcagaggctttcagaggcttccgaaactatctttcctttccaatcacacgaacttgtactcctttgccttgtataaatataccacgcctactcgatattactcctataactttagaatatatagtaatcccaaaattattaagaaacaaacaaatctaaaacaactaatttacattcattttcttctttaaatatactacgcctactcggtactactcatataactatagaatatataagtaaactcgacattattatgcaaaaaaaaatcgaaaacaaacaaagaaagaaggcaaccttgtcttcttatgtcatgaaataagatcattaatacctcagccaaaaaaacgattgtgtttttttgttagacaagatattttttaaaaaaactctgaatatactaaatgattgatctttcaaatattcaaatccacaaacaaatatattggaactaattaattttgacaaatctcaaaatttacttgtttagattttattaaaacttatgtataaaatgacagattaaattttgtacttttacttgacatgacatacaagttctatatttttatattttttatgacaaatatatttttcacttctatacataataaatattgtcaaactaaaatagtggttcgcaattttctttttaaaatattttataaaaactctaaaatttcaaataagaaaagaagtatatacatattttaaatagtgagcacaccaattttatcatttagtattttctagtggtaagtatatataggttgagtagcaagcatgccaacggcatgccgatgttttagtgatatgtaaaatatgtgtcaaacgcataaacgactggctgcatcagcgcgaccaaagaaaaaggctagtgtgtactactactaatatattttttcctgtttagttgtatgatgctgatgagtatatgatttcaaattttgccatacttcactaatcctatttggtacatgccaccattccaaaattataatacttatttttacactattttcaatgatatattttgaccattaatttattgtatgttatgtttccaaatgatataaaattagcattacatgatatgattaatatgatcattagttaaaatttattgagtttgatttttctaaaaaaaattgggttcattataatttgacagagaaagtatttagcaaagtttaaggtttattacagtttaagatttagtaaggaataaatcagtgcccctattaaataatgtaggattgtatgtgagagggtgggtagttagtggtatgatgaagaaaattttgaattaaagttaattgatggtaaaaaaatataaagtgacaagtttttgagaataaattttgaatcctaaaaatggagggagaactagcatatgactataggagtactagcggataatatttgcattgatgtaaaattttgccctttcattttttgttgtcagtactgcagtagatgtcaatatagttgagatatcactaacctattaaaaattcgacagtattaaaacttatttaagatttagtactataaaaattttggcacgacattaatccaaacaagcctaactgtaactatttttctccgtcagtactacgtcctgtctttagtatagtagtatactctgtttttctagaattccacctgtgaaggtatgaccggaaagaactgtgaagatgcagaagatatgactggaaaggactgtgaaaaaggtgcaggcaaaaaaagacagcgaaagaattgatgtaagttatgcatgtgtttctcgtaattgcatttttactgtaatcttattgttttgactgattgtaacatgttgatgcacagtctaccatggatagatgggatgggcagctacgtgccactgcacccagctggtgaaaaaaaaggacactgcatagtctgctacgataaagtcagtatcagcacactacactgcatttgcttaaagttcatacta

SEQ ID NO: 42410 - DNA, 4404 bp, Oryza sativa
ttgatgatggatgattcaatgcaacaagaagtagctaacctaggttgatgagctgcttgctattatgaaagtgggatgtgattgctttaaatagtgtaaggcgatggcctaggaccgcaggagctttgtggtcaaaaattagttggttgcatgcatatgtgccaagtctttgggccaccacgcatttctcccaatcacatgtcattagcgagaagccaggtgtcgggtgcatagtcatggtaactggttgcttttttttgacaatggaatcttttattgaactcggtcaattatatcaaggtgatattactacgctaagtaacactcccagcctctgcatcccaaggatccacacaactaaacacatatgaaccaatttaaaagaaattaagtacaagaagcatcaaggaccatcatcctaagactagatcaccacctatgtccctagttaaaacactcattgaccacccgctccaagtgtagacacgtcgcaataaccaaatcccacgagctcggctttttaagaataacctaggtgtgcatccaatggatagttacaaatatgacatgtatgtgtgataaataacttttctatcaaaaactatatagttcttacgtaaccaaagcaactagcatgtggcagtcgcccctaacaggacatatggttacatatctttttgaaaacccgaaagccaactagtgaccacttgtgaaacactatcgggtggagtaattcttgacgccacaaaaatgatggaccaaactaaatgggctaagaggcattcaaagaaaatgtgtttaattgtatccttattattacataaacaacagttttgatcgccttgctaattatgtttagctagattgtcttgggttaacacaactttacgatgaaggtaccaaaggaaaatcttaaccttcaatggcatatttagtttccaagggcgtctatttatattcgagatgtcactataaactagagatgataatgagactccatatggagctgtccattaggggtcatcttccatggaaactcatcttgctcctaaattaaaccaatattagcgatgtgtggtgataaggtgttccatgtgactaacttcgatccaatttgatcccttctccatgaaaattgggatatccattttgaaagacatcttcgatagttgcatgtttgtgcctgacaatgttgtagaggaacgagtactgttctcgcagggttacatttcccaaccatttgtcttcgcagaacctaaggataatacggataatatgccatatggcatattagcaaaataataatacagtaaattgttggtaaaatttttatatatatgttcttagcgacttaaatgccaatgctaaaaaataaactttgatgaagaaacttcaaattcatcttcaaaattaagctttaaaatttaaattttggcattggctgatgatgaatagagaaaaagatgggggcctaatcagggccggtcctaccattttgggggcctagggcgagagggaagtaaatgccctttttatcttggattttttttgaaaaaaagttgtttaatttaattttctgattgcaaagtgattgatatgcaatacatcaatatatacatactttatttaattttttttaaaaaattataaattatacttcattttatataaaatgagctaattatatatgttgatatttatttctattagaagttgagttggttttcgtgttccgagaaaaaaatgtttccgtattcgtgcccgatcatattcgatttttgttcgtatttgagataatccgtattgtttctgtattcgagctatccgtatttgtttttatatcggtaaagaatatgaacacaaatatgatacgagcattatctatctatatcccctccgttttcatcccacatcgcgcaatcgatccccgtgccgatgctgcctccgacggtgcgtccccaacgagtggcggtgagccgtcacaactcacaagacctcactgagatgggctagcaagcttggtgggctgggcccaggatcccaggggcccacaggcccagcctttttccttctccaagaagggcggcccaaatccaacggctcagctctctcctctttccccatctcttcctcgcatcgaccgaccaagcaaaagcattttcttcttcttcttctctctcctctctctctccttccccacgagaaatttcaaaaaccctacctccactcccgatctccacgaaaccctagccgccttctgctagatcgccgcggcggcgggaatggaggtggcgccggagacgctcgacaccctgtcggggtggttcgcgcagtcgctctccccggacgccgccgcgcgccgcgccgccgagcagagcatcgagtcggccaagtgctcgccggggttcgggctcgcgctcctcggcctcgcctcctccccgcgccacgacccgcagtcgcggctcgccgcctccgtccagttcaagaacctcctccgccgccgctggcccaagccctcccccgacggcggcggcgacgacgacgccgaccacctcccgccctccgactgcgccatcatcaaggcgaacctcctccagctcctcctcaccgcgccgcccctcatccaggcgcagctctccgaggccctcgccgccgccgcggcctccgacttccctgccaggtgggagtcgctcctcccttccatcgtctcctccctcggcaccgccctctccgccggggacatcccggcgaccaactccctcctcgccgccgcggcctccctcttctcccgcttccgcaatgccttcgacagcaacaccatccgcctcgacctcaagtactgcctcgagaacttcgccgctgccctactcgaggtcttcctctccacctcccgccgccttcaggctgccgcacccacggtcaccccgcctgaatcccgcccggtgtttgagtgccttcgcctatgctgcgagatcttctattcgctcaactccatcgacctgcccgagttcttcgaggaccacatgcgtgagtggatgacggagttccgtgcgttcctcaccacctcctacccgccagcgatagaggcagacggcgccccggatgcgctccgcgccgccgtgtgtgacaacttgcagctgtacatggagaagtatgaagaggagttcaggggatatctgaaggagttcgttgaggcggtctggggcctcctcatggcaccatctgtctcaccatcccgcgggcagcttgcggtgaccgcaataagatttttgacaacggttgctgagagcgtgcaccacgcgctgtttgggagccctgatgcaatgaagcagatatgcgatagtgttgtaattcctaacctgcggttacgggatgatgatgaggagctgtttgaggggaactgggtggaatatgttaggcgtgatgccgaggggagtgatgcggatacactgaggcgggctgcatgccggttgctgcgggggcttgcggcaaactaccgggagcaggtggctgcacttgtgtcagcacaggtccagcagatgttggctgcatatgcagctgatcggacgaacaactggaaagagaaggatgctgcaatataccttgttatttctcttatgcagaagcctggtgccacaggaggtgggacaccggtggttgatatggagagcttctttacatctgtgatcgtgcctgagctgcaggcccctgattgggaatctgaaccaatgctgaaggcaactgtgctgaggttcttgaaggaattcaaggatcaaatccccaaagccactgcactggcactgcttccaagtgtaataaggttcctgatacacgagtcaaatgttgtccattcatatgctgcgacctttattgagaaccttctgatcatcaaggatatggtaccagtaccaagtgcaaatgtgattaccagggctccacgctatgttgctgctgatatcaacccatatgcccagccgattgttcagaacctgtccaaggcactaagttttcctgaatcatatgagaacccctatctgatgaagtgcctgatgagagtgcttgggattgctaatattgctgggcaaattgttcatgagattactgctcgccttgtgggtattcttatggaagtgtgcaataaccccaagaaccctgattttaaccattacttgtttgaagccctggcagcagtgattggtcgggctggtgagcaggacccagcactacttcctgtgtttgaggcaagcctcttcccggtgcttcagaggatattggttgaggacatctcagagttctggccatatgctttccagatatttgcacaacttgtcaatttgagccgaccacctctctcgcagaactacatgcagctgtttggtgtcctgctcagtaatgctacctggg

SEQ ID NO: 42411 - DNA, 5844 bp, Oryza sativa
ttggtggtggttaaatatggaccaggtgttcttgtcagttctgtcgatgcaattcagccaaatattttcatgacaatccttcagcgcttttggattcccaatcttaaattcatcaaagggactgttgaagttaagctgacatcagttgcatcaacgaagttgatctgtgaatctgcactgctgttggatggtgcagcagcccaaacttggggcaaattgcttgacagtattgttgcattgctgtccagaacggatcaagatggggcacaacaagatcagaatgatggtgctgatgcagatagtcagaggacatcaggttattctgtctcatttgtacgtcttcaatatgctggaaagagtgaagatgatctgttgaaagaggtaaatgatccaaagcagtttctggtcacctccttggctactctttctgcgcaatctccagggagatttggtcctatcattgagcagaacgtggatcctgcaaacaaaggcgctcttattcaactttgtgcagcttacaataccaacattgtctaggtaaacaacctctcagttccttcccatttattgcatcgagtcaatccaatgcattttcatttgttgtcttgaaaacatggaagtttttcatctataaattctaatattagctgtaagtgaactttccattggacacatgcaacaaaatctcagtttgatgatcctataaactgcaatgttgtcctttgtacaacttttttttcttagtttggtgcttcaactgtataatagagatgcctcttgttctgtgtagaaaaggatattattatgcacattgtggctaggcccattaatagcttctgtcttacctattcattcaatagattatgttatcttagtatcccatgatttatgttgcaccaaagtgtttttttttttgagtcacaaagtagaattggtcacatattggattaaatacccagatagtatcagaattcacaataactgacaactatgtaggtgggagttcctgtgagttaaactatgagtttgttatccctggcataccccttccacacaggacacctgggcccacacttaacaattctttttggttagggtgtaaagaactctttatcaagttttctgtatcatcttggagcataactaaagccataaacgttctattattacttcacattttaaactgcactgacattaggccttgcatccaaatttttatgtttagtttagttgcctcaataatcaaaattttgtatgaaaattgagtgctatgtgttcagacatgggttgggaaatatagtactaaattgccattaggatttaattaaatggcagtctgaaacataatgtgaaatattatttagttattatgcttcatgtcacttgcaggcagaagtacatccataatttgttgataggaactttttttcctgagaaatatggtgatgcaaaaataaaacaacccctccaagcctgacatatgtcttagtgatgaacattggaacttattctagtatgttctagtttttgtccattattattgtggtgtcaatcatgagccttaggaaacaccgtccaaatgtgaatcagaatccaaatattgcaaattcaagatcatgttctaaactctcctagcgagaatcttactcatgattgttctgcaagtacatattccatgacttgggatggatgtaacttactgaaaagcatatggacacagttcaatgcaagcaattatctaggatgtaagcgagttgcaataaccaaagtatagaggctactatttaataaaattgagaacatattttccattcgtgattcctttatatgcagattgcagggaaatgcttgtttggtgggtcttgtattagctagaatcatgataagcagttatcttgatcctgaatgctttgctttgttgtagtgcagacatgccaattacttatttgttccttgaatatctccttttggtagtaccttgtctagaatatttgcaaaactgctatattatttgtttatttcagtttctctaaacctcctctgaatgtttcaggagccaatggctttgctgtaaggcatttgcattgtttccatggggttttgtcaaaggatgtctcaggggagtctatcggtcggtcggtctatcgggtcaagctggtcttcggtttcatccttgcaatatttctggcatgtgtaggttggtcttgggagaggaaggatgtcgaaatcatatagtggtggaaaaacatgaacattgtggtggaggatgtctctttgattggaatttggaattttcttttttggtgtggaagaggtttgtttcccccggaaaacatgaacattgtggaggataccccgagaatattgccagcgtaggcatgtgccatcctggtggaactttgctgtaatttttttgcccttgttggctgaatgccttgctctggcgtaggaaatggtatatggcgtgggagtatattgtcatcggtcatcaccctttgttaggtcgggttacaaaaaatattgcgaacctcgattggagctcgcgatcctgctgccatttgctctgttttttgaatgcattgagccgttgcaagctactactatagcatctgcccatttctaccgtttcgtaatttcgtttgctttgcactaagattatagcttcatcaagctgttttggatgggttactgtcaccccaacattatcgtgggaactgcacggttactatgcaaactgtgatctactctcttcgtcttttaccgcacggtgttgcaaatccttatatattttctctatcttaaaataaataaatataatacagagcgtgatatatgctaataatataaatctaaataaatctagatttgtaatattacggtggatcgttgtaatattacggtggatcgtattttcttatagatttatttattttgaacgaaggttacacagtgttgaatggaatcgtgaggttcgtcatttttacgtttctgttacgtattccctctgtcaaaaaaaaaaactcaacctcttcttctagaacaatgaatatggataaaggcatcctcacgtttccgttacgtactcctttaaaaaaaacttagagaacaaaacgtttccgttacggactccctttctaaaaaaaaactcagagaacaattaatatggacaaagatatcccgttgagttttttttactaagcaccaaaatcgtagacggaacctttttcatcttttgtcgtggcgatgccacctgtgctgcttgcgtggccgaccggcctctgcccaacccacgccggccacatcaccacctcgtggctcgtggcgctgctccgcctccgcctccgccacacggccccgctcccgacgaatcagcgagaaacggtaaccaaaaccttcgcctccagcctcgcctcgctctcgcacaaatcaatcccgcaaaatccctcgaccctcgatccccccccttctccctctctctctctctctctctctctcccggtgatcgcgacgccaacccgcgctcgcgccgggtaaggatcctcctcgattccccgctcctcccatctcccgccctacctagctcacgatcggtcgccgccaccgccgccgagtggtcggtctgtgtggctcgcccgagctgcgcgttgtgatgatggcgatgcgcgtggttcgagttctcgatgcactgggggctaacgacgaatttgctcctccgagtttcccttttttttttctttcatttcctacttcccttttgagttctttccatctattccatttcatacgtgtctctcattttttatcatgttttctcccttgtttcttcgcttacacgatgtgcaaacaggcaacattgaagaccaaaaagaaagcaagaatcatatggataccgagagcatccaggatggtgatgacatcctgctgtcaggtggagacgacgacaggaatggagggagtatcgcggagattcagacaacggtggacctcggggtcgcatttggctcggagaagctgctgaatttggagatgctgctgatggagatcgcccatcgcgcaactgagatcgagcccctcgtgctggatgcagagtcgatatcggccgagtcggttcagagggtttctgaattcgacctcttgcattgtatcctagattcagaggtcaaggagttggagaaattagttgattccattgaagtggatatcgggaatggtggaaagatgatggcttctgatgaagatccggtgagtgaggtgaacagcaagctccgagatgcagccgtgtctttgaaccagatgcaggaccttatttctgctattagaagacaatcggcaaactttgtgaatgtcatagacccttctcaggacaactctggtatgctcatgttagtctggtgctactagtgctagctgtttgctgtatgtttttttttcctgacaattgcatttgtacaggaactagtgaagatggtggatacgaaaatggtcatggttcatctcgctcagccatgcctgccgaggaacaaagaaatactctgcagctgttaaatcagtcaatagcaagtgaactggatctcggaaagaagttacatgattcggagtccgttgtggaagagctcaagcttaagctgcatcatgtagaacatgaatcgtatttcttggaggaatctgttgaagcgatctctgaaagaatgtttgcagctgaaaatgcatctgaattgtttcttggagcgtcaaaggaacttatcggtaaagttaatacaatacagttccacctaagtgcatcaattcgtcgggaaggtgaccttaaatcaaagttagagcaaagcttgacagaatcgaatggttctaatagcactctagagaagatgaaacaagacagtgaaaaggaagtgatgccgactcaagcccaaccggactctgagttcttgactttgcaggataaaattcagcaactagaggaatggctgagggaatctaagtctggattgccattgacaattgcatcaacaggagaaaatgaagtcggcgaagatgagatgagcacattcgaaaatattgttaatgatattaaagatgctgttttcagagcagaaagtagaacacagaatgctgaagcaaagtgcaaacaactttctcacgctaatatacaactcgatgaggagctaaaatccctcaaaagtcaggggtcagatagggctggcttactggaggagaagcttaaggagtcagaaactcagttactgcatgcaaaagcatcgattgaggctattgtcgaacggcacagtatatttaagtcttcaatgtctgatatggagcaggtgattgatgatctaaaggaaaaatatttgaaagctgaaaccagagctgagaatgctgaatcaaaatgtacattgctgacagacactaacttagagcttagtgaagagttgtcatttctgagaggtcgagtagacactttagagaattcactgtgcaaagccaaccaactgaagatgtccgcagcaaaagatattggcattaaaactaaaactatcactgacttagttgcaaaacttgcattggaaagagagtgccttcatttacaggtataaattttattattcaagaaaaaaatactgtggtcagtattttaactttgtcctgtgtatttatgttctttgtatgttatgtaactgtacttcgtatgatttttaccaaaagtactttgtatgatttttaccaaaaaaaattgatgcttatgattcacattgttcaaataatatctttggggttctggacttccggttcaaacagaagcgccaaaagataaaaagaatgaaggctattcttggagccaggcaatca

SEQ ID NO: 42412 - DNA, 1955 bp, Oryza sativa
gaagacaatcatcagtgtagaaaacaactctttacattgaaattgcccacccaccatgctctctcttccatgagtaatcacctgatagcgcaaagctctactagcagaactcagattttataagcattcacagctggggttcttgtctcaggaccaaaacttgcaacggttaagggttaacatatttatttcttttaagcaaactttgttcttttggaacttatgtcaagcacaattactatgttcttattggtaattcaccctacgatgtttattaatgtggtaaaaggtgaagagagttgctgacactcttggagaggaggaagatgagattactgctccaccagaggataattccggtgcctgcagcacacctaacacggtgaggtccattgaaccaaaaatcctgaactggaagtggatttttgcggcattcctagtcttgctggttgctgttctcgtctgcctaccgtaccaatgaggtgaccatgtcctatgatctattaacgcagcttgtaggaccagatagaaagcaggtaattttcctgtaatgattcttctaaatcattgtaggaatagtcaattttggtagtggtcgttgttgcaagtgtcagttcttgcatgaactgtctatgtgtcaaataatctctggggtagaagagattgtagatctgaactgagcaagtatgctccatgccttctctgaactagcagatccaagcaaatcaaattggcaacagagaattcatgcagtatctacttgtatatatatttcgagtacttgactaatatcgagtagcatttgttctagacaaagtgatcttcactattttacagaatcacagatacaattagcctgacagatgatggtttagtaggttcagctcatctgtacaaaatccatttgtgtatttgtgagcagttatgttatacaagtacaattttgtttacttactctttagttaaactgtaagctttcttcgttcgtaagttgggaatcagggctgtgacaactgataattgcagtggaaacatcacattagccacacaatgacatgcaagatcagtctgaatcgagcactcgagcttgcaagatgtgagtacatagtggatcattacaattgacatctgctgtgtcatttcatcactgatggattgacacaccacaaacaccccccagctttatcatcagaattcatcaccatgaacacatatatacaaagatgtacatggcttatgtggtactaacacacaataagccttttttttttttggggtgatggtgcacagtaaaaccttcgttttagtatgcctcaacaccagtagacttgcaatcaacatcgaaccatacctcgttgagacggccaatgatgcgaaaggggttgttatactgcgcaattgagtaggcgctcttgctagggtagtttgtggaattagcccatggtgaccggctcaaactcaacgcaagtttctccgcttcctcgacgacattgttgtcccgtgcataacccgagaagctcctcactgcaatgcagtggcttggccacctatccgggtggaggttcagttcggggagaggcacaggaggggaagcctggaacttcgctggtaagtagagccgcacaaagtaggcagacgagtgtagcggccctgcacctgggacgatgctagttaggatgggagttgtcatcctgatcctggaggagttaaggttcgcgcccatcaggtactggaacaatctggcaggaataacatcaagagttagtgcttgtaggatctggtaaaataaattctaccgacagggaaactgaatttcagaaaggtgtaaatgagagtgaattatgaatgaagatcaatgtagtagtgaatctgatgaactcacaggctaccatgttgttaattgttgtcttaggaatcaaaataatcacaaaagtgctaatatattcaattagctc

SEQ ID NO: 42413 - DNA, 1062 bp, Oryza sativa
gaaggagtagatgtatttaaagaaagtgataataaagatgggtcgttgatgttaataaagagtactaaaaagtagaacatgcatggtgggaaatttaagctcaattggtcctaaggtttgttctccgttcggtatggtggcttgggggttccaaacttagaaaaatttaccatagcttttcagctaaggtggctatggtttgaatggagcacgtcagaaaagccttggattggaactaaaactccttgcgatgaattggataaggatacgtttgatgcatcgatgaaagtccaaattggtgatgggcaaaaggcgagcttctaagaatctaattgatttggtacctaaagtgtaaaatgtcaagtgccgaacctctataggcattcgaagaggaaaaacagcaccatccaggaagctctgcaacaaagaagatggatcaatgacatccgccacaacctcactatccccctccttgatgaattcttatgggaagttctagcccgtgacaccccacaactaacagaggaggtacaagatttgattgtcttgcgatggacaaccgatggggaatatagtgcaaaatctgcatatcaattccaattcaacggaatggtactatcgccatcaacaaagttgtcctgggaggaatgggcttcagcaaattgcaagattttcagctggctagtgcttcaaaaccgggtgtggacagctaaccagttgcagatcaggagatgaccaaataattatttctgtcagttatgcttccggaatcttgaaactgtcaaccattgttcgaatgcccgatctcgaagcaaatctggtttgacgttctcacacagctacgtcaagggcacaacatcctgaaatgtaataacaatagaaacctattgggttggtagacacaagaaacaagcgacccataagtaacaaaactaaaaggactcgtatctctcttattgctcattacttgggaaatctggaaggaacggaacacaagaatcttcagagaaaaggaggcgacagtacactagatgatcgcatccaagaggagttgggttggtg

SEQ ID NO: 42414 - DNA, 17078 bp, Oryza sativa
ttaatgcttaatctaatcttaatgatgctagtttatggacatcacaacagttgtttaagtccatgtatgtactatgctcactgacccatgacactagtcctagctcaactaaatggactagttcagttgtcacctattatagctgaaggcatcaaagtagcagcatctgggaaacaattttgctcttctaatggtattctacaagaagacaaaaatgggaagatattgactaacaagcacttagcattagattgtaagaaacaaagattattttggcactaagctcactgtttaattgctagtagttgacagtgccatctcacagggcattggaccatccaaagtagtagatagaattgtataatatacatgacttgacaatctgaataatacaaggtgcggtgtacattttagagggaacacagtattttcagaataactgtgaatgatttactgtatgttagcttcaccaactgtccatgtaatcttgagaaaagatcacaatgtacagcatctaggttaattactagtttaatgacttcttagcaactatgagttagattgacttcaagtcttggcaggaaagatgtcagtgttatcaaactttttctaagctttgaggcaaagcataccctagacaatctactggcttcttctaagccatgaatagacaggcaataacattaacaatttgagcctaatagtgaagagaagaggccctatatatataggattggaagagaatatgccgcaagttgttgcacctatcttgaccatatttcatagcaaatcatgctccactctgcagaacagaaaatattttctcctcagctccggtgcaccgtgaattttcgcatgatgcttccccaattcatcctaatctgttgctatatatcttagactgcatatctcatatatagttatgataacaaagatcacattcttgattcaaagcagccaagcacttagcctcaactgccattaaactaatcttgctcgcaatcccgacagaataacatggcaagctttcatactgtcgatcgattctcccatccaatgaactctggtttgtgatgcttcttcggtgatgcgttcatgtgagcattaagcaaagtgtttggcgtggtacgagataattatatggcctaaaagctggctagtggaaaggacttagaaaattaaagaagcattagcaaggggttaggctctagtatggaaggcaggcatttgcatctctgaccattaaaggacggcttaaggccattgatatggatccacttgtcggctcacagttgcatcctctgcctgtatttttcatcactggaatgttatttcttcgcgctgcgagaataaagcgattttcgcctttcctccgcgcctccttcttccctgtttctgctaatatatttttatgtccttgattcctgatgttttgagctcaagtttatcataatcatcatccgtagaccccctgaagtggatgctgataagcatggaaaaatccattggctgctgagacacactgcaatcctgttaattgccactgccagcaatctgaatgttggatccaacactgtctgcacatacaagcattgcacttggcctcagctctcattccctcctggcctatctcctgcttgattgccaggggccatacatatcaaaatggctcatcacctggggttctttctgtgacaccaacttctgctgatgacccctttttatgccggttaccgcacccgaagatcggcgacggagacggcacagggagataccctgctgaaatttcagtgtcaagaattagatgattctatcatagatcagtagatcacactgttatcacactgttactgcatgtgcatgagcacgagtgcagattagggagtgaaagctttctgtccaggatcttggaatgcactgcagcctgttggagtgaaatgggccaacagcatgtgcattccagcgttaggtgatagaatgacctgatgcgatgcagagaaatgacgcgggaaaaataaaaaggatccagacaattatctgatgcagtgatgcagccgctgaattggtgcagaggggtttatgcagctggggacatggtttgctttctgcaatgtgcgttgtctatctagttttggccttctgaaatgaccatgggggactgactggtgatgaagagaaaaagaaactgaagaatttctgccctgtccatgcatgggctttttcatggagagatttgagtccagatgttgtaagatgcaccatggataagtttgctgcaaaaatctcaaatgtctcagattacccaggacaggatggttactgcgtcattgcacaagatttgatggcattggagtctcagactctcagtggtggctctgacagacatttgggaaacagctcaacacaggttcagcatatgggtgtagtttgtacagttcaattgatgttcagatgattggaatgcactgttgaaaacaaaatgtccaacgccacaacgtccaagaagagtacgagagatgtgagtgaaaaatcagcaaagctccataggctaagatgaggatgatggaagcaatcaatcacatgaactaacaaattcaaaattatgaagtctatcaagaccaactgggattcatttttccaaagatgtttcagatattaacaggaggtaacagttgccgctgagtacctgttccctttgcctctacttcttggcagacatctcacttcccaaatttctattgcatcatgcataaggtgaaactgcagcataaatagtatccatgcatcctgacaaaaaacaaagggggcaatgggttcatcagaaaattcaatataacaacttatcactggcaaaaacaagacacccagtttccattctgcagaaatgtttgcataattctcatcatagagagaccaatagaaatgaaaagagagagaaatttcgtgaagtagagaagcttcgttgttagcctacttaccgggccttaccggccaatgcagctgaatcccctgcacacgggcgagccaggcaacgaagaggacgcggcggcgacctcgccggcgaacgggagtcggcagggggagcgccagcctccgcatctccgtctcacatcctggcctcggggaagcatcgcatcgccatgccatcgccgctgacggaggaaaaaagcagctggtggtgggacgccgggagctgcgggcgcgagcagcactgcggtgcgcccgcgccgccgcggtgtgcccgacatgccggtggtgtgcggccgcgagattcgggtggccctcgccggcgccgccgtcggggcctcgggcggccctgtgcctgtgaatgagtaggtgggccaaattcattttgtgggcccaattcattggtgagatatcgataggccaaattcagttgtgggccgaatttaccgacgagtgttaagtgggccaaattctggggtgggttgaatacgtcgacgagatagcatggcccaaattgatctgtggtctcaaattgttgaggggatttacttgggctgaattcctttgtggcctaaaaccgtttgatgggaatggaatatgatcacttgactccctcaactgaccaccgaatctaaatcgtatccctcaaccgcaataccagaaatcttgacccccgaacttacaaaaccggtgcaatttgactccctcggtggttttggagagtggtttcgctgacgtggcgcacacgtggcagtgttgacctagtctttgtaccacgtggcattgccgtggcgctgatgtggaattaaaataaaaaaaatatgcgggcccatttgtcattcacaaaaaaaaaattatgggacccacttgtcccacatgtcatcctcccttatcccttcttcctcctccctctcctcccttctctatctctccctctttcgcttcatgcgagagcggcgtccggatcggcagcggcgacggcgggcgatggacggagcggcgacggcggaccgagcggcgacggcgtatagtggggatcaaaccaccccacaaactttggcgagattcggaacacggcggaggagttcgccgtcgccgagatgccgcagccgccgccgtcggtgcgcacgaggagcgtcacctccgtcgcgctcccgacgcatggagatggcggcggctgccgcctcgtgccgctctccccattcgacgcgtactgggtcgcgctgctgcccgtccaccacgtcttcctcttcccgtccccgccgccgccgccaccaccaccgttcgaagacgtcgtccgcgcgctcagggactccctcgacgcctgaagctactccctcgtcggtgtgctggtctactcgccggaggaggaggaggaggaggaggggtcgctgtccatcgtcattgtggccaccgggatgcggcactcctccctcctcggtgtgtcccaccccttcagctcctcctccatcgccgccgcctcctcgccgtgctccatctccacctccattaaacttctctcccccggcctctcgacgcctgaagctattgccgctgccgcttcaactcgccgtgaaccctcgctggatttggaagaggaggagatggccaaggacggggaggggggaagaagggataagggaggatgacatgtgggaccagtgggtcccacatttttttttgtgaataacaaatgggcccgcatatttttttttattttaattccacatcagcgccacgtcaatgccacgtggtacaaagactaggtcaacactgccacgtgtgcaccacgtcagtgaaaccaccctccaaaaccaccgagggagtcaaattgcaccagttttgtaagttcgggggtcaagatttctggtattacgcttgagggatacgatttagattcggtggtcagttgagggagtcaaagtgatcttattccgatgggaattacgtaggccgaatagagaagtgggccggattggttgatgggaattatgtgggccaaatgttctaacgagaattcagtaggacaaattcagtggtgggccgagtcattggatagagggtcaaattaagtaagtgggcctaattccatgatagaatttagtgggctgtattcactcgtgggcagaatatgtcgacgaaaattacctgggcctatttcattgtcatgaaataattgggctgaatttgtctgtggtagggccgaatgagtttacgagaaatcagtaggcaaacctaagtagtgggtcgactttgtggaataagttcacttcatgaccctcaactgtgattgaaatctaatccataaccctaaaccacaaaaccagatatctcgacccccaaactcctaaaaccggtgtaattcgactccctgcgcggttttgggaggcggttttgctgacgtggcgccacgtagcgcctacgtggcaatattgaccgaatcttcgatccacgtggcgttgacgtggcacttacatggcattacaattgtgggacccgtttgtcattcacacacataaaaaaaattgtgggtcccactgacatgtggaccccacatgtcatcctccttccttcttcctcctccctctctcccttctctctctccccccttcttcccctacgtctcccacaggcggcgatgggcgatggtgccgggcgacggggaggccaaacggcggcggccacccggctagagcagcggcggcgctagaggcaggtcgagcggaggcgacggcgtcgggcgacggggcggcgcaaacgacggaggcctccaggcgccgtgcaacagcctcgacctcgacgccaacctgctccgcggcgacatccagattgagccggcctctagcgccctcgcgcgccccaggccgtccgcgccaccctccgaggccgacacgccgcgcgcctcatgggcggaggctgctcggctcaagcggaggcgacggcgccgggcgacggggcagcccaaacggcagcggccgcccggctcgagcggcggtggcgctagaggaggatcgagcggtggcgacagcgatgggcgccagggaggcccgagcggaggcggcggcgacgacggcgggcgggccttcctccgtgccgtcctctccttgttagctgccggcgcccgaagctccgccttcaccgccccccggccgcccgctctcgctgtccccgcgtgccaccggccgaaggggaagaaggggagagaaagagagaagggagagagggaggaaggaggagtacggcggcggcggctgctgcacggttcgccgctcctgccctcgcccgtcctgtcgtcgtcgctccggccctcacttgcgcgccgccgccgctcgttctcgtcgcccgccgcccactgaaggggaagaagggaagagaaagagagagaagggagagagggaggaggaagaagggctgacatgtggaccccacatgtcagtgggcccacatttcttttttgtgtgaatgactaatgggccccacgcatatttttatttctaccgccacgtaggtgccacgtcaacgccacgtggaacaaagactcggtcaatattgccacgtaggtgcgacgtggcgccacgtcagcaaaaccgcctcccaaaaccgcccagagagtcaaattgcaccggttttaggagtttgggggtcgagatatctggttttgtggtttagagtcatgtgcaccggttttaggagtttgggggtcgagatatctggttttgtggtttagagtcatggattagatttcgatcacagttgagggtcacaaagtgaacttattcccgaatttgttgaagggaaataggacaaactgagggacctgaattgaacatattccgggataaactcattggtgaaacattggtgggcctaaatcactcgtaggccgaattcatttgtacgccgatgtcgttgacaggaattaggcggacctaattgattcctggccttcgtggtctcaattggtttatggtaaaagatgggttgaattcgttgacatgaattgattgggttgaattcgttcgtggtcgttggtggcccgaatttgttgacatgaactaatcgggttgaattcgttcgagggcctctgttccagctacaatactcctattttgagctttttttatcatcatcagtaagctcatgataaggcatggagtaatccggtggctgctgaaacacattgaaatcctgttaattgccagcaatctgaatgttggatccaacaccggttacacatacgagcattgcacctggcctcaagccctcaactctcattccttcctaacctatctgctggagccataaatatcaaatagttcttcatctggagatcttgaaactgaattatcaaattgtttagatgggagaaataaatcttcatggatgtaacactttcaacagaacagagaccacttgctttgtattgcgtatggtaatgacagtaggattcagatatatctgggtctgtcctgaacaacataggggggaaacaagatcaatgaggcaaaatttcaacatttgctttgtatagtaaatgaacgaaaaaattacactactgggtttacagatgtcctcaaccaaaccaacaaattcaaacttatgaagtctaggcaagaccattgggcttcatttttcaaagatgtcatatgacagggaagtccctaacagttgccgctgagtgcctgtaaggctaacatttgcctttactttgtaatcctggcagataacatggtcatcactttccaatttccattgcgtcatgcataaggagaaactactgcataaataatctccacactttttttgtcttgaaacctagcaccctgcatcatgacaaaaaatggcaagggatcatcagaaacaattcaatataatcgctgagcactttcaataaacttttccattttgaactgattaatacccttaattcatgcttctctcaaaatcagaaacatttgcacatttctcactcgcagaaaaacattaatcaaataaggatccatttttcctcctcaaagtcataatattagcactgacatcaacaggaaaaggaaacaaagattgcacacttttgcatgctcgcaagcatcgttatagggggatatgtacacacatggcacttatgacccaaaatgaagaagaagaatgtgagcacaaaccattactattttgtttggaatacctgcccgtacatgcaaactgtaatgtaaagggtaaaaatcaatatctgctcaatagatcgattcagcctgatcaaatataaacaaacctattgattatattttagagtataaagattataaacagcttttacacagggagagggactatgggatagcatattttcttttcatctagttagctcactgaatcgtgggttgcacaaactggaaactccacatgaagtagttaacatagccattctaccaaatgagctctgctcgttttcagaagctgcattgtcattatgaagagggggtctgcttctacccttgagttggctatatatcatatatatgatacatgaacaaggaaagcagtaaagatttagcaggcgttaaagcaccatttttttttatcactgaaaagtaaggcaccttacagtactagatctaagaaagagccaaaacccaaagaactttacaagtgctcctctagaactggtccatgactttgggtcagccaattagggtattttacttttgtgtgtgtgcatgggagggtgctgggtgatatctagctccatttgtggggtttattgagtagctctaattgttagtatggcgtgcggtagtcaagcgacaaccacagacaatgtggagggctgccacactatcatgggcataacagatgaggggattcaatctcccaagcttctgcaacaaaactcaaatgcaaattcttcccatggcttctagttgaaaacaagattctaacagtggataacttggtgattcgaagatggtattatcaacaaaattgtgtccttttcagtacacaccaagaaaccgtagtacacatatattgcaaattgcaatgtccctcagtccctccacgatggaagtctagttcttagccctgatttgggcattttgagatcatccatcaagtggacccgatccacttaacaaatagcaagtgacccaactaatgaccatagacatgcagagggaacttaaggggatcatcatctacatcatgtggaacatgtggaaggaactcaacagacagatcttccaacacatatcagccactgcccaggacattgccagcatacaagaggaatggaaggcatcgagcaacagcatatgctgtgctccatcagaaggacaaacgaacttgttctctgtatttctgctgttttgtacctcacccctcttacgagttagctcaaggagggcctcttggcagtggagttgtaccctgcatcactgtatttttcctcacctcaataattgattggcagaggtcctgcctttctgttccatcagaaaaggaggagcacataaaaatatacgtacaataaaagatctgaaatttgttcggtgccacttctagagaaaaaaaaattgtgtcttctgatttgagttgctaatactaaattgtaaatagaaaaaaaaattgttcaattctcttttcaactgtgttcccctaacacgaaattctggatcttccatcagcagatggtatctgcacaatcaaactgccgattacgaaaaggaagctgagaatggtgcgagaatatagggactacaatattcctgattgtgctagttaagaaatctctcaaggaaaaacagaggcttgtgacaatcatagatcacctgcagtttatgatattaatggcaacaataagacaaactaaattagtatgagtgattcctagatattggggctggtcagatccagcatctaatgcttaaaagtaggaatcatcagcctagtttccaaatatcctatttaaccttcagcctcaaattaaccagcattttttgctcttctaccatatccagtgtcatcgtatccagccatgagaatgccatcaaaagcacagatcttggtcaggtctgtacccagatcaaaagcacagagcttgtggacaacatccagatgaatggttgacgtttagttagagattcccttttccagtcgggccatcatcattttcgcagcttacgggggcacggtgacagcaggacagatgcactcaacctttttgttctagttcactcaaagaacttgggcacaatatccggtttagccatattgtcatgattgcagtggattatagggtacgaggatcccaggaagcacactcaatttgaatcagtcaatgaatcagaattttagaagtgtttgtaaaatggtcataactcacaacttccttcagaatcacaatcctatgcatattatatgaaggattgaatgtaaaatcaatttgtcttaatttaaataaaattgattagttcaactaattttcttttttaaaaatcttgttttgttgcttggagttataacatgttatactgatcatattggctgcaaaagatgagtaagatttgcaatgttaaattgaaataattggaggaaagttgaattcagtactgtaggcttgtgtaaaaatgccttttgaaaattaaattttgaacatggagagttatacaaagatatttgaaaattaattaatgttccgcagactaggcagtaggcacccatattaaaaattgtctgattcatgtgtatgatactatgatggatatgaaatgtatgatgcatttggtatgtttattgtaaatgagttttgaactaagttcagagatcagactgaaactagctcaaattagtttaattaagatgaattcaaattagtttgatatctcaaacacagggtttgaataaagggagatatgtaacattcttttgcaaatcccatgctgcatagaattaaggcaggacaaggttcaccaactactggatcagccattgccactttctcctctgacttgcacatcatcctttcaggtaatctccatctaaaccctgaccctccagatcagattatcgtgcttgttacttacttgaaggtaacatttcccagttacagactacaaatgctattcaactacttgaatgcaatgagcgatcgtgttaagaagttgaatgccactgaaacaaccatgatgttccagttcctttactcttcatccaaccaaatgggtgtaattaacaccaacaactaacccattcagtggtaggaaactaggaattatgaagtttggtcggtctgtagtctgcaattctacctcacaaccgttgttgttagagtactaactatgttttctgcctttccaccgccgaatcaaaaatttagacaattgaagtgaacgcgagatcaattccgtgaagtagagaagttgtaattacctttttacctatttaccggccaatgcagctgaatcccttgcacactgcgagccaggcagcgaagaggacgaagaggagcacgagatccgcgaggacgatgagccacagcttccgcctccacgtccacccggcgccgccgctgcgggcgcggcgctccctcttgggcgtcctccgcgcgagctcaccttccctccgctccgcctcctcggcctcggcctccgctgcggccacctccccggcctcccgcgcgagcgcctcctcgtcggggaacggcaggcgcagcgccagccgcggcatctcgtcccgcatccggttcccgggtaggcatcggagccgccggaggaagagcagcaggtgcgacgagggcagctgcggggcccgcgagaccgccgcgagcacgagcggcggcgcgaggagcaccgcgtgcgcccgccccgacgccgtgtgggtgacgtgccggtggtgcgcgggcgccccggcgacgagcgcggccgcgaccgccggggcgtcgtcctcggcggcgccgccgtcgtggggcgggggggcgtgggcgaggtcggcgacgagggcgctgtcccggtaggcgcaggcgtagagcagcgggtgcgaggccgggagcatccgaggcagcgtcgtggtggtcgtcgtcgtcggcggcggcggcggcggcgagagagcgagagattcacgaggatttcgggggggaagagaagaggaggtggcggtggctggcggtgtcgttggtacagcaacggaatggagacgaagggagccagactggacacactggactagttctctattactagttcacatttgagtttttaggaaaaaaagaaagataatgaaatgtgtatatttttttaaaaaaattgatttcctttaacttttttcactcttttttttattttcttattttttaagtttactaaaaagcaaatgatctaatgcggatttacggaataaaactaatagtgattatctgataaattagcagacggaaaaataactatggtgttccattaattattcgtacctgatcggctataacccctagaaacaaaagttttcattgggcgaattttaaacgcttatgtgacagagattataaacaagtactagcatacacatctcaattaaagaaaaataacgttcctgaatttagtagtttagctttggtggcatggcatgaactgttggttatgtaggagtattaggttgtagtttgttgagttgaccttactcactcactttgtgatccatcaacttgaaaatttgaaacccttttggtgttttaatgtggtacatgatcgagatttgacatttttcataatcttctgctaatgtttgtttttcttttggctagggaccgtttcagctgcaagcttgcaacacatatccatactaaataattatgtcggcctaatagattactagatccacgaaggaaaaaatagaaattaattcaaattcataacgggcatccatgtgggagcagttggcgtttggatctcaacgctctcccttccactagtactagtccttgacagcgtgtttagattgacctgctcaaattatttactatatttatttatttaattttattattcactataacactatcagatgtaacagatgtagtacagagctgggatggttgactggttaagatagattactaattttgaacaattaagacgaaactattagcatttgttccaataattaatcaaaaaagatttacaaaaaatacactgctatacaatactattacaagcactatataccatttcaattctcatttataaaccactaatagagtgtagtttaaactcacaattatacgagtatattatggataaatatacatgggcgcggattaaacgctagaaggattcgcggcggtggagcacaatcagtggcagatggggcacagcatgaggccgttctcgttgcacttggcgcaccgctcgacgtcggcggcggcggcggtggcgccggcggcgaccaccttgcagctgccgccgcactcccagcacgggacgaaccgcgcgccgccgcagccctcgcagccgcggccgtccttggcggcgcaggcctcgccgcgcgccctggcccagcgcatcatctcgcgcagcttgccgctctcggcgagctcggcgcacgcgtcggcgccgccgaggtagcggcccatgacgaagaggcgcggcggcgcgtcgccggcgccggctagcccgcggagctcgcgcaggtactcgccgtggagcgacacgtcgcgctcgtccacgacgacgggggatccgcccgccgccgacacggcctcggcgcacgcctccaccgccttccgcgcgcgctcgcagtcctcgaacgtgcgccgcacgccgcggagcgtcgtggtgtacagcaccaccccgccgccggatgcccccgggggccgccgctcggggtacccctcgaacgggtccctccgccgccacctcgccgccgcggcggcggcaccgccgtcgttccccttgttctcgcggtcgcgcatcaggaaagggttgtccttaacgacgcgccgcccggtgagctccggcggcggaggcctcctgtcaacctcctcgttagcgccacgcgcggacggcgccgccgccgccttcttggcagctgcctcgatcgccttcaccggctcaggcagcaccgtcgtcgtcgtcgtcggtggctgcggcggcggcgcaggctgcttcttcttcttcttcttggtcttcttcttggcgttctccgtcgtcgtggtgttggagctgagcgcaggcttgatgtcctccagggccttgctgacctccgaccacgacgccggcgcgaggtcgtagccgtcgagcttgtcgagcagcgggagcggcatcacggtggtggtcggcttcttgccttcctcctcctcctcctcctcctcctcttcttcatcctcctcctcctcctcctcgtcgttcttcttgccggtggcgatgagccagggctcctcgatggcgctgatgtcgaacagcgagacgctcgtcggcggcgggcggtagacgtcggccaccgtgacgtccttggagcccgcgcaccccatggctaagctcagctcagctcagcttggagctaagtgagagctagtgatggcgtctcactctcactctctctctctctctctctctctcttgtgttcaagttgtggagggaaaggcaaattaaggatggtttttgagtggctgagtagcgataagatgatcaagtgagagctgcacggctcatgccgggttaacgtcaatgctctccttggcgagttttgcttctgcacctctgcgccactggaattagatttcatttcatatttgaattcctctcgttctcgaaaaatcagtggtagtggttaagccaaaaaaaaaaaaagagcgtgcatttgaccaaacaggatatcaatcttagccacagtggcaggactaaattgcatctaatcagccaaatcacggtgaaaaccgaagaatcgtacaccctgcattccaaagaaaatctaatcctgactattctatatttctatatattgagatcatctattgtaaatatttacagtgactttaggctcactaacatgtgagcacgtaacaaagagggtccatatgtcaataactgaaagtcatgtgatttaagttaaaggatcacaatccgtacatgtatatgtttagaatcattgctagaattggattttccttttaggatgaaagaagtatggactaagctagagcctatagtggcacaaacaaccaaacacccaatgtattttttggaagggcttacaagatatgatgttgtcttgtactgttattgtttcgcttacaatgattacaagttgtttgtaacgacttatcaataatcaaagaataatttgtaaataaaacttatatatacatgtgtgtttagcaatctaaacacaaatgtcggaaaaaataaactacgttgaaattgtttgtaacaaactatcgataattaaagaataatttgtaaataaaacttgtatatatgtgtgagtgtttagcaatctaaacacaaacgttggaaaataaactatgttgaaaaatcccaaaatttttagaatttaaattttggctacaacttacataagctaaaagctcaaaaggtaaacgatgggataattggctataatactacgtacttgtggaacatctcaaatactccctccgcattttaatgtatgacgccgttgactttttgaccaacgtttgactttttgtcttattcaaaaaatttatgtaattataatttattttattgagacttgatttatatcaaatgttctttaagcattgacataagtatttttatatttgtataaaatttttaaataagacgagtggtcaaacgtttattaaaaagtcaacggtgtcatacattaaaatacggagagagtagttcatagtccttttctctctctcaaaaaaaaaggttcatagtcattggataaaggtgtctctggtaaccatctgaaccataaagcaaaatcatattccaaagccggaactagatacgttgattaactcaatactccatccttctctatatataagaaattttgattggatatgacacattctaatacaataaatctggacatgaagcctatctagattcattatactaggatgtgtcacatccaataaaatttattatatttagagacggatggagtagttagttagagtgcaaacaactggttattactgcataactaaggataagaacagggagatcacagatcagagacctttacatcctgaatgcccgaaagataacaggggcaagaaacgtgattcacagctagttgcagactcacgatatcgaagtatcgtcacagtgcatctcagctgtgaaactgcagaagtaaaaaaaaaaaaagcagcattaaattcacggaaaacccatgaactgatgcagtacaggttgtttgacagcgaagtagaaacctgaggctgaaagttaacaggatagtcccaactcccaactggtaaaactatgttgctagttcgtccttcctttcctgagaattatcagggtttacaaaactacggttatcacgtgcaataacattttcagtttttaaaaccataatatacctcacagtaaccttacagtttacatgataaccacacggttaccgtcaaaccttagagtggcgataacggtttagtaaacctttaccactactcgtattttaccaacacaagctgctgcattcagaatttcagacgtcactgtgcaggtgggcccaccttactaatgacgtttcttggcatgtcatgagagtatgagaccccatgtagtcaactggaaacagttgggcgtaaactgtaactagccaacgtagtttcatctttggctgcattgtgcatgtcattttcgtgcagttctttgccacaagctctttctgcaacaatgcttgacaattctgtagtatgcatagctggaagctggatcaccagaataaatggggttgcttgaggccaatgtacatgtagtgtgtacagaagagtacagatattattgtccaaaatctgcaaacatcagcctaaatattttttgaggtgctgtttctactgccttgaaggccatccaaacatggcatggtttgattgttgatttccttttaaaga

SEQ ID NO: 42415 - DNA, 934 bp, Oryza sativa
tcctgcagccctctccaatcatataccgactgttgtacgtatattttactccgatccaccgccgatcgcctccccaagcaagcaagcagccgctcggagcgaagactgaggcggcggcgaccatggcggggctcgcgcacctcgtcctcgccctcctcctccccctcgcgctgctcccgccggccgcgcgcggcacggaggagacgccgcagtacacgacggtgcacgccgagtccgacttcgaggtgcgccgctaccgcgacaccgtctggatgtccgccccctccgacgacatctccttccacgtcgccaccaagctcggcttccaccggtaagcaaagcccgccccaccccgatcagatccgagaccctcgtcgctacgatttggtccgggggatgggggatcagccgcgcttgatttggagcctgtctgtaatcatgtgcggtgggtggtggagtaggtaggagatgatgattttttttggtgagcacagctcttcgatttgctcgttttgggtgttggttgctctgcaggaatggaaaagatcggtgaattgtagaagagattgatgagtgaaatcgatggctattgtcggttgactttagcaagatgcttgttcatttcagttgagaatcgggaagaatgtggtcttgaattgagacagtattgtgatgttaaataatactccatccgtattttaatgtatgatgccgttgattttttaaccaacgtttaaccaaacgtcttattcaaaatttttatgcaaatataaaaacacttatatcatgcttaaagaatatttgatgataaatcaagtcacaataaaataaattataattatataaattttttaaataagacgaaaggttaaacgtttgtcaaaaagtcaacggcgtcatatattaaaatacggatggagtagtactgattttt

SEQ ID NO: 42416 - DNA, 7824 bp, Oryza sativa
  unsure (1)..(7824): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncactacgcctgaccattcgttccaaacctagagctattgcgacaaacaaatccatgtttcagtaatgatacactatgtttcttatcaagtttgataactgtaattgcttcatgttatttttcaatgaagtgaagcgaatcaacaatgctgcaaatcccatcaccgatccaaaaccatttcttgagtcaccaattaatgaaatggagtagtcctaaattgtcctggtattaaatactagtataatataatgagacaagcaaagcgttatccaactgcttcaactatacaatctagctagtactgtccatggcgtcataatccaccacttaatccacgctttagaggcaccacaccattagagacacacaggaaagcagtgctatgcattgctataaagtaaaatgagtcaggcaacaatagcacttcaaaagggtcatcttttttttgtatgcacagttaatttagtacagcaaatactccccctacctcctatagtggaatccaattaaccatcaaccgatcttggcaatcatttgcattaaaaaaacgcgcactaccaccacgaagtcagacagaaagaaacataaaaattaacacataaaaactagtagatagaaagaaagcacacaaattaaacaaaacgagcatatcattgaaacaaaacacataccaactaactttacaacattttatccattctgttgcaagagcgagtgcaaagattctgtcttgttccataaatcaacagggcaaatctttatacagccaagaaatatgccaaaaagaaggcaaggaagtcaaacataaagctcggaaacttcatggatcatgcactggaggtaaaaggttagcgtcccaacgacaggaataacagcaagattccagctgcccctctgcttcaactttggagcagccagaaagattcccaaggaacgaacaaatctacaaacccgagccaaagatgagaacaaaatcccagtgaaggtcaatttcgatctttcttttttctcccttattcgttccaaattgtatgatccagcaacaagaaaagaaacgcacgaccaatacgaagcaaggaggctcaccggagcgggtccgatggacttcctcgaccacggcggcggcctcggcgggcggagcggtggcgggggcagcgggggcgcccatgtcgagcgggagcagctggcgctcgtcgaacagccacagcggcgagggcggcgtgagccacgacgacgacgaggccggcagcggctgcggtgaggccgacaccgacgagaacagcagcgacgtggtgagcgagtcgaacggccacaaatccccacccccgccgccgattcctcctcctcctccttcccccgcgcccggcaaagacgacgatgggtcaacctccatccttaatcctctctctctctctctctctctctctatctatctatcttctccttcgcttccacccaagaacctcacttcactcagaccgcgctgcggcggcggcggcggcggtggaggaggaggcgacgcggcggctgaggaggaggaggaggaggagaggcgggagcaggagtggggagcgggaggggagcttggccattatggtgggagaggaggaggagagaatggagtggagggggatcaaatgtggctggtggtggtgtggcgggtagtggaccggaataacaataagataatggcgacgattgcgtggacatgtgggggcagatccgatccgctcatgtcgctgccatgtggggcccaccaccctcacctggtgtgtttgggtctgattggaggaggttaaagatcgtgagaagcaattgatttgcagccatctttcggaaatcttctcatttcacgtaatctagacgagaagttggattgtatgaagtagtttcgaattatgagagaaaatgtgtagctgccagaaactcccgcccttttttgcctctttccctttttcctgccaaataattggaggagccttggagttggagctggtgttgcattattgtttgcttggcggttttctgaatctacacgaattatgagggtacccgtggttatcgtcttaccgaaatgaaatctctcggcaaatcggtaactgaattttaaaaaataagtttatttgaatttcactagttttcgtcgtaattgaataataaccacggtttatcaataaaaatgctcatctaggtattaagtgatatataaagtcttatcaagcgtgtatgaataaagaacggataagtcatttcacaattcgcacaagttcaaaaagaaagtcaaactaaacctcaaattttaagaaaatttgtctaagtttcactcattttcatcaataaatgaatggcactcacggttattgataaaatcgcttagtagtggcgttcaatgactaagcatttttataaacctgagaggtggacactatataccactattttgcccttttatctatactttctataaatttataatacactaaatacctaaaactacacatacaagcatagtatttgttaatacttctaagttattaaaccattcaacgaccaacaacaaagttgaatctgtgcattcatccatagcaagactattaaatatattcatgttgaaaggcactttatatacttttttttaacccactgatgatgtcaaggttccattttcgtaggagagggactcaaatagtatgtaaatgcaactgccataatcgaacaaccccagttaatcacacataacacatacacacaacttttattacaaaagtcgcaagtggccgatgccatcatttgtttacaaagttacaaaacaattttataaaaaaccatgttagattcatttgtacatgtgtacatgtacgtagtgagaaaatctttaacaagcacaagtgtgtaatgtaatataatcgtaccggatagaatcacggcaccctcatgaaaaccgcgagcactaggttggctcacagcacgggagagttaggtcttgtttagtttctaactttttctttaaacttctaattttttccatcacatcaaaattttcctacacacatgaacttttaactttttttctttgaactttcaattttagcgtgcaactaaacctacccttagtattataataagagcaaagttgtcgccactgcacgaaactcgaccgcgcaccacgccgccccctcctccaccagatgcaaccccaacacaggcacataataaatttataaataaacaagggtggcagccaactccccgggtggtgcactccagcgtggcaataatcgatcgcgctgcgctgcgcacccccgagaccgagaccaccaccaccaccaacaacgacgacaacgtgcgcgtccacactccacgggcaacgcagccacaccacgtgtagcgccatcagtgggtgggcgtgcccgcgcgcggggagttgcaaactgcaagcaaacgcgggcgttttctcgcggcaaccgcgtccggaggccggcggccgcgtcgcccaccaggtgagctctcgcgagtcgcgatcggtgcagcgcatgcacgcacgcagcggtagcgcggcgtttttgcggtattctagcgggcaatcagcgggggggaaataaaccgggggtgcagcgcagcgcgtgcgatcccgcggcgcgcgggcgggcgggcggagacggggatgcatcgaagagggtttgattttagagcatcacttgcgacttgcgaggggtcgcggcgtgagcacatgcgggatgcgtggacgctgcctgccctgcccaggcgcgctcgggtggcacggggaccacctgggctggatggatggccgattggttggcggccaggacggccgggatccgagactgccaggtcggctggagatcgcatctgcctgcctggagtagtggtgggaagtggctactggttagctcccctccagtccctgctgcacggaattgcacggagcctctcttaccaacataccgagatcatcgcgtgctccctctgtcctaacatatagcaacatatttaagacatatcgtttgagctactgtgcaaaagtaaacgaataaaataaataaaaatatttatatgtaaaacttttatattctgccgttagtggcaccaaaaccattattactaaataatgaaatatgattaagttcaaactttacttttgcccttttgcaatctgggtgttactacatttcacggtgttagagtgtcgaacacgtattagagtttgtgtataaagtcggttataatttagaacttggatttgtactgagcaagagtcggactctatcatagattctctcttaaatagagagacgtacatgttttaaccgcatgacgatttagcataggcgagtggtagactgacaaaggcatccgatcgagagtcgttgtaactctgatatattgcaatatgttaatctaggggcggatccacccattagacagggtgggtcgaccgactcagctatgactcgtgtcgcctcacatccttaagacccatttacccccttataatagtcatgggtcatcaaaattatatataataaggtgtgaacatctaacatattatggcagctatgcgaatggactattaatataatatgtgatgtgtttgattgctcttattgagtaaaaatctccgttctccgtctgtcggatatatgggcccgggggtatgcgaagtgaggggaatctaccttcccatcctgccacgtgtccctacaacctggtcctgcccccgcattccgcaaaccgcaggagcggccggggggtcggggcctcggggtaccacgtcatacccctcgggcccttgcactgctttgccccgaggccctcgcccagccgctgtttggcgggaggagcaagcgaggagggggcccaggctgaacttcctttaatgcgcgcagcgccccaactgccccctgtcgcatttaatgcagtggggcggacgtgcggcgtgctgaactgacgcgcaatggtcaagaatgaccggtctgcgaccggcctgacgccggtcacgtccgactggacggacaaccgtgctcccacgttgcatctgcttccggcggagtggaggtaggtatgacccgtctcatcggggagtcattcggacggtggccaccacaagtcttcacctattaatgagggaatgacagggttgtcccccgtgtcaggcaagggacggcgctgggccccgcttaaggacaagctgtggtttagcttccaggtgaaggcacgggtcgagttccagtcaagatagggtgggtccccacccgaaagaagagtaggtagaggcggtgcatgtggtatccccttgaggtataaaaggaggaccttgcccaccgagaagaggaggactctgagaaaacatgaactcgtggaggagggaacaaagagtgttctcccgagtttaggaacccttgtaactctcagtctaaatcccacaggagtaggatattacgcttcatagcggcccgaacctgtataatttggtggtttgcgagctagctgggagccttgggaacggatacgtaatttctagaggcgagctttttcccccggccgaactcacgaaaggggggtctcacgatctcccgctagagaggatcactcctcgacaccatcccatctatattttaaagctgcgttcgtcagttaatcaataacctagagatgtagtcttcgactgaaatccgtgatcaaatattatctcgggtctcagagtcgtcatcagttttatatctcccatagtgtttcttccatgattggatcttgatgtactatcggggcctttttttaccacactcagccattgtttgcccggtgttttaggtagtacgtgtacgtactaataccctaccaatctaccatacatccaatacccttactgtggccgcgctgcgtccatccaccgatgactgatccacggcgtctctggtttggccacatggcgacgatcccgcaaacactgcttgccctgattgatactcctcttgctacagtaatatactccctccgttttaaaatatttgacgccgttgactttttaagtacgtgtttgaccattcgtcttattaaaaaaattaagtaattatttattttttttcatataatttgattcattgttaaatatactttcatgtatatatatagttttacatatttcataaatttttttaataagacgaacagtcaaacatgtgctaaaaaatcaatggtgtcaaacatttggaaacggagggagtactcagcaattcaccatataaacaaatcacaacatgggccatcaaccttgcctaacaaaggtgcgtacggaatcgggacgcctcttgccgcctcccatccgatacgcaccagggggtactctgcttctactactcttacgcgaggctgcgacgtggtgactcgaacagttctggggccttgttgtcgcctgcccgcgacttgacactttgcctcaccatttttgattaattattaatggctacgagaaaaaaaataaggcaaagggagaaaacgaacgaacaaacaaacaatatatatccagacactgcttgtatgtttgcgtatataattgcgtgtgccacattatatcaggattgatggatgagatcttcgcgacaggtactttgacagggaaatcatgctgatcaacgggaataggtgattttttctgtgctcatgtttagcttcttctcgatttttctgcagtcaaatccaattgtatatatatgcagctactattacacaagtccatgtcgacctcgatcggtcgacctgcaactgcaacttagctaaaaaagaaaaaaaaaagaagaggaccacgagattgaatgaccgattattggttgcatgccgaccacggaattatgagaaaacgacggtgaaattatatggtacgttctcatctcatctccttccttaccttcgatagggagcggaatttaaagtggcggagcttactggttgtctagtggcggagcttcaacaagagccaggagaggcttcagcttatgctgaatccgaatggctttggatacgatttgcggaaggcggtgtgtatatgctctgtagatactcaattagatccctttgtttcaaagaaaaattatagaaattttagaggattccattcatataggattttttccctatagccctttaaattaaagtaatgaacctcatgacctatgaaaaattaacataaggtggaatctcatgtctcaaattattgtgttttttttgtattttgtaattttctgttatacacttgtatttctgtcaaaatcttgtgtttttttctattcatctatttttccactctattttagaaattagggatcaattggtcgtcaacaagtattgcacaatctattgttaatggtattactagcaatgaaaatagtcacggaaattcctgatggccgaggtattatttctgtgtaagtcatatcggttttttcaaaacgtaaaatttgattactttttttagtttcttacagcat

SEQ ID NO: 42417 - DNA, 6826 bp, Oryza sativa
  unsure (1)..(6826): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacatttgttcagcttggaacgtggaattggtactggagttattgtacactgctccttggttgtcattttattccgtgcaaaagttaagtggacaacaaatatcagagggactacaaagaattggaaagattttatcatagctcaagattaattgttcacttccgcgctaaaatggaattggattcaaaacttaagaagcgtggatccctcaaatttgccataattttattttgtcattttttttagagacatttcttcttccttttttttcttgaaaacattttttttcaaaatttttattgttcaccaaattttcggtaagcaaaaactcatacggggcttaagataaaattacacgatcataacaaaagagaagtatacttactgtgcaccttgaaaggtgatgtgttacttctttgcttgttgcaatttatcgattagtttcctgggccctgacttaccttcagtgtgaattgaacttgaggactcacccatgaatttgaaaaccttcctgcaggggttagtccacagaagatatatatccaatgtccatgaacatattaactctaaaagttcattaatcaaactcgactcagttctaattcaatgaattgtaatggtatatttcaaaatgggtaaatttataatggcatggatccaattaaccctaatatatatgtgtttgataggcataggatacctaacaatttttattttttccctcgcactggacacacacgtcacgcaacacacgcaaatagagccacacatttgcccacgacatgaggagtagcacatagtggttgttgatactggtcaatatttttgcgctagagatgtggagtggatcaagtgcgcttcatactgtactacagtggcataacatacgcctccataaatccataatatattggcatagaggatcgatttcttcaaagatttataggccagctggccagggaacatgattagtggaagaaaattatacaggactgaggtccttccctcacatgaaatactttgtcttcctgcacgacacctgtccagcacaaattacaaagcatgcagcatctttcttttctccaatccccattctgttcttcaatatgctcggcaagacggaactaccactgtaggcatggcagcggctgccggcttcgagctaccaccaggaacgtgcttggccagtagacaagtaggagtagatggttaaatgttagaatggttagatgttgctcttgttactttaatttcaatctccattacagataatcattggtggttattgaatttatccaatcctttgaggattctttccgataacaagctttgctcgattacaagctgacagcccttctcaacaagaggcttggtgctgcaaatgataattagattgtattatcactgttatgtgaactcttgaataagatgacacattgtgaccagatgacgaatggagtacccacgttgcggtaaggcatggcgcatgcccttgatgtcgcactctcccagcggccgtccataagcccgatttctgctcaccgccgtggccacgttggtcggctcaagctatgccttgttggttgtcgctgctgagcacgaaggacggaaggatgaagaatggggattgggaggggagcgcctgcttgcgttgagattcgtattggacagatgtcatgtagggagacgaagtctttcggatgaaggaaggacttgggtcctatgcaattttctgtggaatactttattccgtatgcttgcttatgggtctaggaggcactgggaatacatatattactggcaaattgttgatatttcttaatgaaattactagaaatataattcccaacaataacgtagaaatattcatgctatatttatggtcacagatatgacccgcaagcacacggatataccattgtagcatttcatccggagtattccaaggtatcgtatttatttaatcctaaggtaagatatgataagagagtactatgctaatagtttatatttcacccgggagtattccaaggtatcgtatttatttaattctaaggtaagatatgataagaaagtactatgctaatagtttatatattacttgcatatattaaggtctaagcaggggttaagtgattcaaagggtagatgacacacagaagaaagaactatgatactctcactaaatataatctaagctaagtggagaaagaataggaaaagaattcatttctatacttctagtatacatacatctttagtctaaacttgttagtatatagtcatgcacccaataccccctaacagtgccctcctggtgtttcgagagaccaccccggattgtcgagttctttacgacaacctatcatggccatccaaccggaactaaatacgcaggagtaccgtccccaggaaagtgtcttaggaatatatactaacgcggaggaatacctgtactgagctatcaccatcagcagcccacctctactctcccacatcatatacttaataatctagacaccacgtagtgatacttaataatctagacaccacgtccatattattaaatactactctatatcccccgagatgacatagagcaaccgagtattcggacactaaacccacacaattgcacctctctgataggctagctacacaactatattgatacaagtataaagtaaagtcggtactcagataatataaatggaataaaataccgaagatgtataaataagaatattctattaattcaataaatcttacaaaagaagagaggaatgctactagagccatacccgaattctcttgaagacccgaggactcataatacaattctaattcctactccactagcactaggatactactaaacttgagagagggagagatctcttcttcttgagtgtgttgttgaagtggagggagtgaagtccttatatagggcggttatggcggttataagtatgcggaatgtccattctgcccctgcaaccgccatcaggatatcatctggagcgtccacgccaaaacctggaatcaagggcgcaaatgggggttcggccgaaccaaccagaggctggcccaaacggcccaattttcagcaggccgtctccctgttggctcctcagtccagaaggcctagtggatcgcgtgaattctgtttattggcccatttatccataagtttggatctcgacaatgtccgattgattgatcatttattttctgtcaattctcctccatttatatgtgcttcttttgtatacatgatagtagcatagtacatagtggaagtagatattttatttgaaaattatgcattgcaagcatagctagttttcattaattaggtaatattgtcgaaattggtcgataatgaccttcaacacaaactcagaaggtttaggatccctagtattgtagaggattactgtatctgtgtcgcctataataaatgaatccatagagcaccagcattttaaagtagcaacagtgctcaaagcgacatggcagccaaaacttggctttcctgttttcactgtagcggtctaatctgagctgttggcccaatccaatcagtaaagaatgtgccctaatgcacccgaccctaatgttatctgtagcaatcctcttttatcttatttggtggtgtatgcacgtactgaaaggttgccgccaagacaaatagttctcacttcagcgtgtacttcttcactcttacaagtccattagctgtgaatcgaaactgcaaactcaagctacagaagttgcttcttatttcgtattaacaaattcattatccaaacccagagtttctgccctgttgttcttattgttttatatatgctattgttctataataaagtatagatatcactgtatcggagttatcgaactctatgaatttccctctaggatgttttgttttccgataccatcaatacaccagatgaatggttttccatgagttgttagtcacttttgtccaaagtccaattgagaaacaacaattcattgacattgttttctatagctctgttttattttgagctcctggtgacccttacttttcacaaataatttatgaatagtactacaagaaagaacattcattccactccaacccttttttatcgaacctacaacccatgcatttttactaagcctcgtcttaccaaatggtataagtattaaaatattaaaactgagtatgttaaaataaagacttgatggagtgatcaaacaatgcttggattatcaattccgcagcaagacattcttggtggtagttgcagttcatgcatgcttctatcaaacatgtcaatgacctcactcatggaaggccggtcttcaggtgtacattggatgcaccaaaaccctattgtcaccaacttgcgagcaacctctgatatgcaagtgtttctactatcaatgccttcggtagcagcaccacaaaattgattcaagttgtcatataaccattcagggaaatacttgcttacggtctgcatgcttgcattggtattttcccttgctccaaccatttgaagaattagcatcccatagctatatacatcagacttggtggtcacggctccatggtgtctccaaaacacttcgggtgccatatagccaattgttccccttgcaccaccaatagagattttgctctcttttggcttacacaactttgctaatccaaaatcggatatttttggacggaaatcttggtctagcaagatgttttgtggtttgatgtcaaggtggacaacacgatgattacaccaacggtggaggtaatcaagcccttgtgcaattccaaccaaaatctcgtataacttctcccagcttagggatttctctccttgcacggtgtcaactacaccaactgcgtatttatcgagggaaccattgggcatgtactcatagacgagagctctttttgatctatgcaagcacaatcctaacagagtgacaacattgatgtgtgatgttctgccaatgctgaccacctcattgatgaagtcctctgcatcatccttcgtgtcctccagcatcttcactgctatctcactgccatcagacaagctgcctttataaactgtaccatatccaccctttccgagggtgtgggcaaaagatttagtcatctttcgaacttcagagtaagtgtaactttttatttgtgtccgtaggagggactcaattcttggtgaatttgttgatctccattgccaaggggacaaatgcatgtgtttcttataaacttggaagaccgcaagaaccaatatgcttatccccagaagacttgacgtagaagctattatgtctgaaaaggaattggagcttcaaggcataagaacataacatatggcatgtttacaatgttggtattaagagtcctcttatgtagttgtaaccaatcaacaccaagaggtacgtttatcaatcaatatctcctaattaatgaacacttaacagataccatggcaaatttacctttctgtcccttttatttccaaatctacctctccacaattttaacttttcatagtaccatgcatagtataaataaatcttattcattggaatttgatcacatggacgatccataatatccaaaggtactttgcaaaatctattatgctgtttaatttcggactgactgagagtttcaggtagtagacagaaggtgtcgtaatttctttgcatccttgtccacaatgtaaattagaaaagcaagggtgtggaaattttcattattagtgtatctcttgcaaaatatttcataaagggtataataaaacttacagtatatttaaacttaaaatatataaataattgtagtttttgcattaagtagatcctatctaaatattgtaaaattcatgcattctgcagaagccgtgtatgaacttgagatggatgggccagtgtgtgttggtgaaagtctataccaccatgaagaaaaatataaatatttgacagaatcaggatatatgaattgtaactacttgaatggtactctcttcatcaacaaatataaacattctggttatttgaattttgtttagaaatatatgtaacaactcttacaatactacctgtactatcaaccactacatatttaaatttttgctcatcttatcccaacctttctcccaccaccaaccattcctcgtttattgagcggcatttaatatgtccaaaaaacttcttacatttaaggatgacaaaataaactttacatacacatgcaaaaagttttgtataacacacaaataaagaagttttgtgtcctacagttcaaaattatttaacaatataaccataaattataatttgagctgtatgatatcaaagcagcgaagcacgaagggttgggatgaatcattccttacatgtttttgtcctcttcttttttgattctggaacaacgggaggatctgatgaagagattgaaccatcagctgaaaaattccaagca

SEQ ID NO: 42418 - DNA, 20447 bp, Oryza sativa
ggaatatagttgcaaggtgtttcaaaaaggctataatcttattttggttggagcaagtgctatgtgttgagcaatatagataagttgtaatgacgtagtttttgagaaacaaatgttcattcacctatgaaagtaatcttcaggggcacccattgcactcggttttgggatttgcttaaaaggaggaacaacactgtcacaccccaatctgataccgccatacaacggcacctgacaggagcgtgtcgtagggaaaacggcgcgaaccgcttcctacgaaaccgcgatctcggtaccagtcccaggacatagtgctggtacccacggtgacaaatatgaatcatagcaatccttaaaataaatagaggacttatttaccttaacttaggttgcagctcagacagcccgagaatacaaccgacgacacggacgaggcgaacaccaacaacggcagcagcagcggaaccaacggtctaacacccaacaccacaggcgatggctgggaaccaggacgaaaccctaatcttcacttcactttatcttttcttcagggcggaggaactatatatatatatttatttagagcaagagtgagtactttcgtactcagcaagtcacgggaacttaggtgtttaatgcaagcttggaagagaggcaaggttgttttgcaaatcttttatttgaagactttttgaaatcactaggtgatttacttctttctaagtttgggccgaaaagagacttgcgtctcgattcgactttaagagatgtttttcaacagctcatttagtaatgtaccgacctcccgggtcagatcattacttttcggctcccagagccattccacttgattaatcggctcccagagcctttttcattttctcggactcccagagtccagctgcccagcagcaaagcaatccgcttccactcgggaaacctagtctatgatgcccacagacatcccgaatcacacagattcgtttctgaccactcaggtcatccatctgccacataggctgattctggttacgattcccacaccacaacaacttttcacaaagcacaggcaaacaaatctacgcaacgggaaccacctcacatccgcccatgaccgtgggcacggctgttcgaacagttagttaacctctgcagaggggtacactttacccacaagatacgaacttattccgaacacccgtcggtatcggaggttcgcaacaaagcctttcccaagccgacccagggttatctcatgccacatagaaggatcaaatcctcacataaacataggccattttaggcgttcacaaatcaaactccaaccacctcgatcggtaattcagcaagcttctcgttcttgcattaccaggaacccggtttggctccaaccgaccccgccccggcgttcccaactattggcatgcgaggtttccctgaaccgactagcttcttagccagggtgtcccattccaccttgtggttgcactttgattatgtgtcgaaactagatttcggcaataataaaagggggtggctatcaagctaggaaagtgtatgggtttggagacaaaggatttatacaggttcaggccttcttataaaagaagtaataccctactcctgtccggggatgaatccgccgagtgtattattgattgtatgattcaggagaaatcagcatatgcccctagaggcgcccggaccccccttatatatgggaaggagtccgggttacaaaagataatctatattcctaacggaatatgaagatacaggtaaaatacagtcgtaaccgactaagtctcagggtgtttccttgatacacaagttaagaaacaaacccgagatacagataagatattctatctacattaggtatcctgtacccagttcgaataccatcgccgtgtagatatgggatacccataatctccacagtagcccccgagtcctttgcagtcgaccatcgtagccctctcaaagatgataatccgagtacttcaaactcttcaagccaaaacctgccgagtggactgtaaagggcgaaaagataaagagtatggtgcatcgaatagatgcacctaattaggtgtagcccccaactatgtgattagttaacaaactaaacatatagttgaaagacaaaataacaacactattgtgcattatatgacaaaagcgtacgcggcgcctaaataggcatgctagccgactgctttttatccacaataaaagaaatccgagtggtttacactctaaaaggttcacgaatgaacacactggacaggcatccgaatataaaactctaaagattacccaccaagtattataaaaattatggtaatgaataagtctaaatagcctaggctatgactatttaccataacaaaaataggtatataacataccaaggaagtgactatgataaaaacaagtcatcccaaattaacccagacagcttttgtagcctaataaagctaacaaaaagcagtataacacctttctgtcgggcaccttttaatttgcattgcaataattccaaagaattatatgaccgcataaaaaggatttttatcagcattgggcaacactgttgtgcgcataatattgccaaagcaaaatatgcctaagtccctaaggaacacaatgggccacgctgttaaaagtattgggctgaagtactgttcaggcctaggcccattagcacctccgatacccttaactgaaaaaatccgatatccaagcgacgcttcgtcttccccgccggaactctcgccattttccccactccctgctacagtgtaaagctgccgccggcgaactagggttctcaactccggccaaatccacctccgaaaagtgcatcaaaatccctcccgtgatccaccgcctcaatccctcacctctcccaagccatccctcaaatcaaatcaacacatttgagtgaaaccaatggcggaagagagagaaagcttcgaaggtcaatgggcgccatccgacgtaacggaagagaacttgaaggagatggtggcgcacggcgttctccctgccaaggagatcatcgggtggcgaccagcgcacggtgaggctttcccgtctccggatactcatgagattgtggtcttctcgcatttcttctacggcggctttgctcttccgacctcaaaattcttccgcgggatcttgaatttctatggaatcagcttgcatcacctaaacccgaattccatagtgcatatcgccaatttcgtccatgcttgtgaagcctttttggggatcaaacctcactttgccctattccgccggatcttcttcctcaagccccaaccaaacaagaacaaaccgtgtgtagtcgggggggcaggattccaactaaggggaactctgagccaaaaatatttctcgatgcccttcaagacttcgaacaaaggatggcatgcaaactggttctatgttcagaatcccgagcctgctcttcccgggtactcttgtcttcctccagtgtaccaagatacttggaattctcttccgatcggagatgaagcagtacaagccttggagttgttggatcgtatgttaaatcttaaagaacaaggcttacagggagagcagatcactcggcacttcattaaatgccgactggcgccaatcaaggaaagatcccgcacagcattcgagttcgacggcaaacatgatcccaaccgtgaagaaccagactccctggatttcaaaatcatgaaggagaggatgtataaaatcttctcaaatgcaattgtagtcagctactctcatcaactgccagtcgtgccatataatgcattcaatctgcctccacaggtatgcatcggaaaccctcaaaccgtgatcagaacataattttatcttcaggctgagttgactaactatggaagcatcttgttcaggaatatgcattgatgaagtcagatccaccagtctctcagcgccggtctcctcgccaacacaccgctcagggaggtggagggccaacgatcagaccagatccgcaacctcagacctccaaattggctggtcaaacaggtcctcgcaagagaaaactggtacttgatgatgatgaaggcgacgatgataaatctggggataatggctcgccaaataaacccccaaagcgtaccatgcccaggaaaaaactggctggccgcgcaataccaaagatcagaacatcttccaggtattagacctctcggtatgattccgcttcggcatgttttccgatgaaaataatgctaaatactgaaagaacactctgcaggaaaccatctgatatagatccatctggaaaagaccctgatccggctatgacagagcaaaatatatccaaggaccccgagccgactactgaaaaccagccgactgctgaaagccagccgactggcgcccatgcttcgggaggtaaggccaatccgagtgacctgccgccgactggaaaccagtcggcaacgactgaaacggcaacaactcaagagcccccgactggaaaccagtcggacgcaggccctgatccagagattcccgaagtagaagcgcagacgacgacttcgcaaggaccagaggttggtaacgactcgatagctgggtcttcaggtaaagaacaaagatctcctcacgctcagctaggtacatcttcaggttagttgtcttctcaaacaatggcgacttaaataacctcagtttatccgtctaatatcttggaaacacaccaggaccatcagatgatgacggggaagaaattcctcgcataaaggcgaccgacgactctcgtcctcctatcttgatcaaatggtgggatgagaactcacaagccgccggtatagtcataaaccgtcaaaaagaagatgaagaagtgtgccagctaaagaaagcgcttggagaagccactcgtattgtaaatgtaagtcttccgggtgacagccttcaataactttgttctctttttagcagaaactaaaccatgatccatcatgcagagaatccatcttcgcaatgaggccaagactacaactctggaaaagctggttcctcatttgggaactctagaagcagtcagggaccagctgcatgaggccaagggtgcgccaaaaagacagagaaagagttaagggaccgaatcgcccagctccaggatgcaaacttcgaactaagtggttcttcaaaaggtaatcatcccgatctgttccattgatttatgctgtcataattgcatcctcaaccatctggatttcaaacagcgcaagccgccaggatggaacagatggcgaggcaaattgaagccctggagagagacaagacagaactggctgcgcaaagggactcagccttgaaggaagtcgaaggtagcgccagctaacagtctgagcttctctccttataatgcaacagatgctcatcatgaatgtgttttgtagatcgcaagatcaaatcccaagctcagtttgacgtcctggttggcaagatcaagaggcttgaaggagcaagggatggcgtcgccaacgccgctgcaccaattatccaagccatgttcctcaataatggtggtccgagtgcactcgacgcaaccgaaatatttgacaagctgagtgttgctccggaagtatatttcaagaatatcaagaaagctggaagtatgggagctggcatggccttggcgatgacaaaatccttgtacccgagaattgaagtcgacaccattgatggatttgcagacgggacaagtgaagaagctgcccttgatcttatcagcagtgcgcaaaatgcggctgacaaaattgcgagcgatgttgtagagcaatttcgcaacaacgacctccagccgagtaatgaagactctgatgatgaaagaactgattctgactgatcatgaatgtaatgtatggaggctcaatttgtacaatactggtgtatttatgctgtgcttgatgattcttgcaaagtttttgatttcttaaaagtttttgctaagctttgttgagcctaaaacccaaagaagctattaaaaaccttcagtcctcgcaaactaagtagaaaaaccaaacaaggcaatgataaaccaagtaagcaaactgaattgataaaaaatcacactccattattatgatgatagcccccgactgacaacttcaaggagaaaacttgacgtttgacagtcaaaatagggaaatacaatgataaggttaagcgtagaaacgacgaagatgttcaatgttccaagagttgtcgacgagagtgccgtcttcgcgcttgagtcgatatgaacctggccgggtaacttcagagataataaatggcccttcccatagaggagataacttgtgccgatctcgtgtggtttgaattttccgtaaaaccaggtcgccgactagaaaggcacgagatcgaacattgcgattatgataacgtcgcaacccttgtaagtaccgagctgactgaatcaaagctgcttcgcggacctcttccagtcgatgcaagtcgtccactcgatcttcttcatagcgttcttcacggaaattacggaagcgcaaagactcaaattcgacttcactcggcaacattgcttctgccccatagacaaggaaaaaaggtgactggcctgtggcccgactgggtgtagttcgcaaagaccaaagtactgatggcagctgttgcacccatttgccggcatagggttttagccggtcaaaaacacgcgctttaatcccttgaagtatcatgccattggctcgctccacctgtccattgctcatgggatgtgccactgaagcgtagcaaatcttaattccaaaatcttcacaaaagtctttaaaaactccgccagtgaattgtgtgccattatcggtgatgatccgattgggcactccaaatctatgcacaatgttgatgaagaagtctcgagcattgtccgctgtgattgtgacaaccggtttagcttcgatccacttggagaatttatcaatggccacaaagagatgcgtgtaaccaccgactgcctttttaaacgggccaaccatgtcgagcccccaaaccgcaaacggccaagacagcgggattgtttgcaactcttgagctggtagatgaatttgtctggcaaaaaattggcaaccttcacatgtgcgcacaattttgtcggcgtcggacactgcagtaggccagaaaaaaccctgccggtaagctttgccaacaatggtgcgcgcagcagcatggtttccgcatatcccagaatgtatgtctttcagcaattgtctcccttcctctaaagatatacagcgttgcagaattcctgaagggcttttcttgtataactcggattcgtgcataacataaagtttgctccgccttgaaatccgctcggcttcatctttatcttgagggagctcttgagaagttaaaaatcgcatgaagggctctcgccagtcggcttcaaccatagcgacatcatgagtgcccgcaacttgagtggtatctttgtgaggtacagtcggtgtataaaggtgttcgacgaaaacatctgagggcgccgcctcacgcttggatccaaaattggcaagtctgtcggcggcttcattgttgtgtcgaagaacgtgactgagttcgagtccatcaaatttgtcttccaacttgcgtacctcttgtcgatatgccatcatgttgtcgtcgaggcaggaccactgtttcataacttggttaacaaccagctgtgaatcgcctcgaactattaaacgctttatccctagggaaattgcaatccgtagcccatgaaggagggcttcatactcggcgacattgtgggacgccgaaaaatgtatccaaagcacatagctcaatctttctccagttggggaaatcaaaaccactcctgctccagtgcccgaaagtcgtttggatccgtcaaaatgcatggtccagtgctccatgttctccgcgggggtatcctcttggcactcggtccactcggcgacaaaatcagctaacgcttgagacttgattgaagtgcggggcttgaatgatatgtccaaagacatcaactccaaagcccacttagcaatccgcccatttgcttcgcggttgtgcagtacatcgccgagtggaaacgatgtgaccaccgttaccgggtgaccttgaaagtaatgagacagcttcctggtagtaattaaaataccatataacagcttctgaacctgagggtacctcgttttggagtcggccaggacctcgctgacgaagtagattggtcgctgaactttctggacatggccttcttcctcacgctcgacaaccaagactgtgctcacgacctgggaggtggctgatacatacagcaacaacggctcctgcgggtgtggtgaagctaagaccggtggcttggtgaggagttgtttgaaatcttcgaaggccttctgtgcttcgggtccccattggaaattatctgttttcttcagtagtttgaagaagggcatcccccgctcgccaagtcttgaaacgaatcggctgagcgccgccatgcatccagtcagcttctgaacatctttctgggtgcttggtggtttcatgttgaggatagcagtaactttctccgggttggcttggatgcccctatgagacaccataaaaccaagcagcttccctgacggtactccgaaggtgcacttttcagggttcaatttcatcctgaaagcacggatgctcgcaaaggtttcttctagatccgaaatcaaatcatccttttgtttggtcttgacaactacatcatctacataggcttcaacgttgcggccaatttgtgttgagaagcatctctgaatcatacgttgataagttgctcctgcattttttaatccaaacggcatggtgacgtagcagtatgcaccaaaaggcgtgatgaatgaagtcttcaagcagtcggattccttcagtcggatctgatgataccccgagtagcaatccaaaaaactgagaagctcacagccggcggttgagtcaactacctggtcaatgcgaggcaacccaaaaggatctttgggacaagacttgttgaggtcggtataatcaacacacatgcgccattgccctgttttcttccgaactagaaccgggtttgccagccagtcgggatgaaggacttctttgatgaagcctgctgctaacagcttggttaactcctccttgatcgcgtccttcctgtcttgtgcaaatcggcggagtcgttgtttaataggcttggcgtcttctttgacatgtaaggagtgctcaatcacctctctgggaataccgggcatatccgaaggtttccacgcaaagatatctttattattttgaagaaaggtgatgagcgcgctttcctatttacaatctaactcggcgcctattacagcagttttggtaggatcagaaggatctaagggaatctttttggtctcggcttcggtttccccactttttgaaattttggcagcgggcacttctccttcgctcaccgtggttgcagccagtcggatttcctctcgggcagacgccatctcgcgggtttgggccatgtcgcaactctccttgtcgcatgtgacagcttgcttgatgtcgctccgtagggttaggactcctcggggaccaggcatcttcatcatcatgtatgtgtagtgcggaacggccatgaacttggctaacgccgggcgtccgagtatggcatggtatgctgtctcgaaatcggcaacttcaaagctgatattctctgtgcggaagttttcccgagtgccaaaagtgaccgggagagtgatctggccgagtggagttgcggataatcctggaattactccatgaaaaggcgcattgcttggttttaactcggagcgagggatctgcatatcatccaaagtcttggcgaagaggatattgagtgcactgccgccatcaatgagggttctgcgaagcttgacgttacggaccactgggtctagtaccagggggtaccgccccgggtggaccactcggtcaggatgatccgagcggtcaaacctgattgcgatctctgaccatcgaagatattggggcgtgtcgggctgaacagcattgatctcccgttcggtcagcttttgcttccttttagactcataagccatggggccgccaaaaatatggttgagctccttgcggtggtcctgaaatccagccggggtgtcgccgtcgtccttcttccttgacgtgctttgttcctcgtcggagttcttccgagtagacttggtgtactgctccgcgaactgcttgtagatgaagcactctttggccacgtggttggaatttggatgatgcgggcattgggagttcatgatcttgtcgaaggtgttgacgcgcgaacgctgtcgagaagagtgagtagtggttgcaacaagttcctcaggcttacgcttgcggtccttatgattgttacttccacctcctcccgtagccggcgtatttttcggcttccaactggggcccgactgctttgatgcggtgacggcgtcttcagctttggcgtactcgttggctttttcaaacatgagcttgactgttctgggaggtttgcgcccaaatttgccgaccaattcttcgtggcgaatccctttggtgaatgcggcgatgatgacgtcgtcagtgatgtcggagatcttgttacgttgttcagaaaatcgtcggatatactctcgaagggattctccggatttctggataacgttgtaaagatcatattgtgtgccaggacgctcgaaggtgccttggaagttggcgatgaagtggtcgcgtaattcggcccaagatccgatcgtaccacggggcagtccatggagccaagatcgggcggaatctgctaaagccaccggtagatagttcgccatggccttgttgtctcctcctgctgcgcggattgcgagaccgtagacggtaagccacgattctggattagtggtaccgtcatacttctctattccagtcggtttgaagccggctggccaatccactcgacgcagatcgtcggtaaaggctgctactccgtcaaggtcgtcgtcgtggcggtccggcgagtgatggtagcctcgagctgctcggcgctgtatgattgtgtcgcgaagatcgatggggcggcgacgaggtggtgagcgaggccgttccactcggcgctccctatgaaggtcgggaggtgagtgaacagatcgctcgtcgtgacccctgctcctgcggttggatcctgcgccggtgatgctgaggcttggatgacggtagtcatgagatcggaagtgggggactcggctgccagtcggcgtgtggacgctttcggagttaactggaaccgaggccgcaatcatggtctttgtctgattcaagatgttgacgacgtggtcggaacgattgagctcgttttggttgagaagggtgtcgaggagggtgatcgcggcaaccgcattgtgttgaggggtgcggaaaaccggtgtcccttcgacgtcttgttgaccgatgagatcacgcgctcggcgccctgcttccaaagctcgctgacgtcggtcctcagcctccttcgcagtccgctcgcggtcctgctgctcgcgccgtagccgttcttgttcttgtgcttgatgctcctcctccagtcggcgacgttcttcggtctcccgggcttggcgttgctcctccgtctcattattggccatgaaaacgccaaagtagagaggggtatagttgtcatctaggcttccgtcgaagtcgtcgaagtcgttgaagtcgttgtagcgagagctaaattcgtcgtactccacgatgtcagtaggacgtgagtcgacggtgggagagctattgtagtcatccagctggtccgttgaaaccgtgccgagtggttggaggatgacgccgacttccctgaagctaggcgaaatcggtgttgaagccgacttccgcctaggcctacgggatgaagacgctgtcgtggtgaagacggccgctaaatcgtcggggagcttcatcaggaccgatgggtaagccccatcatcttgatctggtgacgttgaagaagatgcgatctcagccgagtggtttgaagccgactcgattgagatggtcttgaagtaggtttcagccgcgtttgggaatccaaacgggactgagatccggttctctcccgactggtccgattccgagtcaaggagagaaatcttgccgaagttgtcggtgatgaagtcgaggctgccgaaccgaaacgtctgcccgggagggaagacgaggtcgtcgatgccggagatgggacccattgcactgatcggcgaaaagcttgacgcaacccctacctggcgcgccaactgtcgaaactagatttcggcaataataaaagggggtggctatcaagctaggaaagtgtatgggtttggagacaaaggatttatacaggttcaggccttcttataaaagaagtaataccctactcctgtccggggatgaatccgccgagtgtattattgattgtatgattcaggagaaatcagcatatgcccctagaggcgcccggaccccccttatatatgggaaggagtccgggttacaaaagataatctatattcctaacggaatatgaagatacaggtaaaatacagtcgtaaccgactaagtctcagggtgtttccttgatacacaagttaagaaacaaacccgagatacagataagatattctatctacattaggtatcctgtacccagttcgaataccatcgccgtgtagatatgggatacccataatctccacattatgttcgatgagtttctcacaggaatcggtccttatatgcgaatacgggacagtgccacataggcacaaccccccgcatcgcgagttttcacaattcattttattttcaaacacaccgacaccacatgtcgggttttgaaggcttcacaaacccatttcccaagttttcgacaaacaacggtgtatgtgggatatttggtatacgcgctcagagagcacgaataccgaggtaccacaagggtggagcgacaaggaatcagggtagtatgacctacggaaattagtgcgactactggataggtccgtcggtttggcacgcaaaccgaggccaagcaagttaagtgtgagattctaataatgcaagttgcaaacaaaataataatgacttttcaattataggggcaattgatcaaagggtgacttgccttgctcaaggtcttcacgaagcttcacgaatcttcgagaaaacccgcgatcgacgaaaatccgataaccgcaactatacgcaaacaatcgaaaacctaaacaaaagaccaaaagaaagatcctatttagactaattagtagtgccattagatagatcttaattttacggaattactggaagttgaacggagtcaaacgaagctatggatcgagagatatgaattttggaagtttaaatggattttctggacgagaaatgatttatcggaatttatagaaataatattctcaagaatattattggcattcgttgatgtgcgggaccaacggaaatgatttatggaatcttggaatagagaattgatttatggaaaaagggaaaaaggatttatcaattcctttggaaaaggaaaggaaggaggggtgcgaattggacttcctcgggcgtcttaggcgcggcccaaggaaaggcgcgcggctcggccgagctactgggccggagcgggcccattagggttcgaggggggggggaaacggccgggtggacgcggtccacctcgcgggttctgggtggggcccatgtgtcggtcgacacggtgcatggtgcggagggtgcacgcggcgcgggggggctagggttagggtcggagtggcgcatggtttggtgcaccgggtggaccgaagggcggcggtgtcgcgaccgggaaaattgccttttcccgaacgctagtgtattaatccccgtcccaggaaaagccggggtacaccacacaaacatgatataaaagacacatctttattatatcgataatatttacattattacaaaggcgcttcaggcctgacaatcaaaaataaacagcagcggactagcgggcctacggctccatcttcacaggcgctcaattggggtataagccaggactccacctaagacatcttctccaaagcttctcttactggagggggaaaagacttcttttagggttttctttttataaaacctttttaactttgtttatttcttttcacttattatttgtgctctgaaaattccactaaaatttgagggctccttttagaccaaggagaatttaacaaaaattctccgggtcacatttgaatttttcttgtacgtattttagggtttgccaatttcttttcgaattttaattaattctattattccttttagaagatgatttttatttcgggataaatttatcaggacgtgacaggcgggccaacgcgcagccgctaggctctccgtggattgcgcgcaccgagagggaggagagagcggacccgccttgactcggtctttgccgaggtggcgctgacgtggcgcctccgttgcatgccacgcaggccggcgagaggaggaagaaggaggccggccgagatggacggcgggcggcgggggtctcaccggagcacggatcgacggtcttcggtcatgggggagcacaccgggacaaagaggcggacgagaggggacgatcccatggctcggatgcgacggaggaggtccgacggcggcggattgcggcggcgaccgttggcggcggcaaaagaggggaatcgccggtggtcatcgggggttcgattcgaggcggcgggagcatatccggggctcggtgaactcatttccggcgccggatggggcaatggacctccgagggaggccggcgacggtgagctacctctaggagcgggcggcaacggcggcaagcctatggcgggcggcggcgagacctggggcagcgtccatgcgtgttcggggggggctagccgagctaccacgcgaactagggagggagaggacgagcgagaagggagaacgggggggtggcactaccgagccgagacgggcgcagtgacgagcggccgacggctcgggagcgagctctccggcctcgggccggggaagggaagaagagggatggccggagtcctcgtctcgcgtccacgcacgcaccggcctccgacgcgtgcgaaggcaagaggtgggagcggcggcaaggcgtcaacaatggtgcggtgagtgtgtggcgagcgaaaacgagagaagaaggggggtttggggcggcttgggttttatagtggaggcgatgtcggtttggggagggagggaaaccgaccttggtggcggtcaaggagaggagctggcggtcgcacccgtggtccaggcggtggcaggcggtgacgccgatggtggtcgggcaaaaggaaaaaggagggggagaaagggagctctgcacttgccgaaacgggaaaggaggagggagaggggagcgaggccgagggctctgcctccatccctgggacgcatgcgcacaggcagcagcgggccgggaggcagcgcgggcacaggcggtgctagggcttgacgcggcgggatgccaggcggtcggccacgcgcgagcgcgcgcgcgggcgcgagggcgcggcgaaattcaaaaggcggcggcgggagatcaacgccgggagggcgagaacgagaggggagaggaagagaagaacgagagagagagagactctcggcttggcgtcggcgcacgcgcgtgcgccacacgtgcggagcgagggaggaggacggctgaggggggggtgggcagaggggaggggatccggcccatccaaaatatgaggaggcaaaatagactttcacagagaaattgaattgggagggatttggattttggatttcgaatttgatgcttggtctttgggacacaaggtggagtcaaggaagggaacaatattcggaggcgagtcaaagggagatggataatttagagaaagagagtgtaacttgggagtttgagtttgactactcaacgagatatgtgggtaaggattttggagagaagtctgaatagaagggttcggactttgagattatttcggaacggaaatcattttggggagaactcaaggcgaaagagattgaatcttggggtttagagttcaagggtggaagtgatctcgatttgcatattcagacttgggtcagaagttcgagaaataaaacaagggtagattgacgaaccgataaagagagaaagatagatgaatcaaaacctgagaggttgaattcgaatttgagaatcggtttgaacgaaccaaggagagagtttatgacgtgaaggtgaatccctggacggagttagggttcgggcattcgacaaagttcacggatggggttccaggagggtatttcgaatagaaggaatcgagcttcgggactatattgggatggaaattttgaggagacgatcgttgataacagggtatcgagacaagggagggatttaaattgagatctttggcacaacttagactcaacactcaaagaacgaaaattttcgcaattagaattttgccgaattagtttttaacgtctcacgaaaagcggagcgttacaaacaccatataaaagtggcgtgtcgtcttttggagaatactttgttggagatattcaccaagcatggatggaagttcactaataggatatgtgcttgattttccacatatttaagtttatttcctttatagtgtttactactttatggtgcagataacaagtagcacattattttaatagttaacggctgtgtgcatcacatgatgcagaggctgggatttttattccattatctaaaaaataccccaaattgtttttgtgctcaaaactataatgtttggaatctactcttcatgcaattattgatctgtttattgtgagggcacagttgttattctcaaacttatgataatgttggtttccgaatgtataaattggttttcaaatacaaatttaggctaatgagtatcactatcggttcgtcctggttatcactagcttggtgtgagaaccgatagtgatacccttgggtgtgtgggagtctaattcgtgcagttttgttcacggcgcacagttccagcccacaccatctcctcctgcactaacttgagtcgcggattcgagcgtcacatgttttgcatgcaccacgcgctctcacgatgatttccatgttagtatttttgtttctttttttaattcgttagcacttttttcaatgtaaagtgttgactgaaattaaaaaatcaacaaaaatataaacccttccaattacattttgagaacattcaattcaaatttgaaaaatttcaattgaaacttcaaacttccaattccaattttttttaaaaaaatattccccaaaatttgaaactttcaattaaaattttttaaaactctacccccaaaatttcaaactttgaattaaaacttttgaaccttcgtctcaaatctaaaagtaaaaatggaaactcatattttttaagacattcaatcaactatttagttattattttatttttgcgaatgtcaaaaaaggctaagcattgcccctatcattaattagttgtagaggtgaaaacggatcgaaaaatatctggtcttatccactccgaatcgattcgaaacaaggatatggtttgagcttatagaaatatggcagatatgaatacaaatgtggataatatggtgcaaattaggatatggatgtggtatctctaagatctatcgggtgtagattatatgaaattttgtatcatattatttgataagtcgtttaccagacaatccaaaattgttgaaccaatgttaccactttatttgttccatacaacataagatggcccatttatagactacttaatttgaggcactcaccgtcttatctcatacttatctagatgtattttcatattatggatgtcatgtatcaatgttgtttagcacttaagcatatagttattaccggtttgttaattgattgttatattgttttccattgtattgctaacttgatgttatattgatcacatatacacgtaacattcattaattttaacatgtttccgaatcaaatccacaccaactccttaccatttccgatatttgaaacaatccactcttcatccgcatcggcaccggctccaaatgcatttaaaaaatatggtatgcctactatccatccaaatttagtccgtttttcactgctagttaggtgagagatcagctttatcacgtcgatctataagctatgcgagatagcaatttcggggtatcatgttcagatccaagatttgaatttctatcatctcggagccccccccccccctcgcgcaagaacaaatctcctccaaatttttcagattttttttcaaatatttgtgtatttggttaaaatttattcaaattcagttaaatatattaaaattgcaaataatttcggtaaaacattgaaactcacgaatttttcaaaatttcgcaagaaatttcggtggttaccgaaattgcaaatactgcttcagataacctacgcggctatacgccggtttaagtgaccggtgtacaccctccggttttataataattgatgttttggataaggttgaggtcaaaattttataacttcgacgatcaataactttaaaaatattttgtttaaagaaactataacaacatatatagatttgtcttacaaaacactataataaaagtaaacatgtatttatttattgtatatattataatagaaaagtaagggtcaaaggtatatattttaaactgtgtcattattcaaaacgtcagttaaaatgaaaccggagtactagtgaaatacagtttgatagcacggaccgtatggcacgtgtccaagagaaaattttcgtcgcgtggaaaacatggtatactagtaaaatatgctgatgaaaagccacatacctgtacttgagttgaaggaccaagagaggagctggtgcgactcgacaagttccccggtggccgccgagaatcccacggccgcgtcctgcggcaagccggcggctctcaggtccaccgccgcctccacgccgtagttcgacccgttggccgtcaggttgacgaccatcttcctcgcggcggcgtcgtacctgatctccgcccgcatgacgccggcgagggtcaaggtcggcagagcggtgaagttctgggacacaatctggttgacgtcgacgccgatgtggtcgatgacgccgtcctgtggatcccaggggttcctgcaggtgtcgaactctacgccgacggtgcgcggcgaggcttcgccggtgttggggatgaggccgaggaaccctccggtcatgtccggcgcgagcgtgtccgccggtggcccgacgtagaacgccatgccgtccgcctggttcgtggagttgcggccgatggcgaaggagaaggcggtggtgaagctggtgaccgacccgccggcgccgtcgtcccagagccgcacgagctgccggtgcgccacgcgcccggtgctccacgtgcccagcctcgtgaggttgatccggtcgccggcgtaggaggcgttgcccatgaacacgaggtttgcggcggcgacgtcccgccccacggctgcgaagtcgtagtcgaaggagagcgccgccgcggcgcggagggtggtgcagcagaggaagaggtggaggaggacatggctggccatgttcatctgctttgctggccaccttacattgttattgctgcggctacttagcgtgggcgtcgtggtggcagaattgcagatagaataagctagtgtacatcattatcgttgttgactttgactacatgcgacgaccaaatcgcagccggcgggccagccggctgcgcctcgattagatgatgcttaattaaatattaattatttttaatttaaaaataaatttattttagttttttaaatattacatatgaaacttttttagaaaaacaaccgtttagcgactaagacttgagaagcatgctgcgcacccataataatcttagtagctggtagcctaaaagaactaagccagtccggtaacattttcgtcaaaaatgaaacggatttgctataattgtgtcgacagatttttttcgttgattatagtcggttctctggccgttggatctgtgtttaagatccgtgcttccatactgactttttcctctcgaagagaccttgttgagggaagatccacaatagcggggagtcgtgagaccccccatttgtgagttcggccgggggcggaggctcgtctctcggaaatcactcgctcgtccctaagattaccggcaagcttgcacgcagtcggattatacaggttcgggccgctatagagcgtaacacccta

SEQ ID NO: 42419 - DNA, 26036 bp, Oryza sativa
taacttgcagagtcacatggccggagggaaaataattcccctctacttcacatacccccgggtccatatctccgacgtagcccccggcgctatatcagatatcgatttcctgagatcgttctgacatggcgcctcacgactcctcgagctggggttgtgggcccggcaggaatccaaaaggatatcgccgcgtggccaggttggcgtgctaaccataacagcggtttgaccgccactgaccgcgctcatgatgaagatgcttgaggcgtgataaccgagagggggggtcagtcagaccacgcctcgattctctcgctcgctactcctgcggcggtagttgtgacggtttgctcaacttgcgctcatggccgttgcgcacttcaccttgagtgtgccactgacagacgcactaaaggcgggagcggatacaacgggcgacgtgatgagtgggcgcaggatgcgaagagacaaatgcgggcgcgaggatcgtgggagcaagtatgggagcgcgaaacgaggaggcgagcgcggatgaggggaggcggaggcggagactctgtccccttcctttcgccaaccgcccactcgtcctttcgcttctcgaaccctaacattctcgccacctcatactgtctcgcgctccacgctctccgccatttctccgccggttgccatggcccaagacaccggcgacacagtgttcccttcctcccgcatcacagcagacaggcaccttagccttccccgcaagatcatgccggacggtgccgtcgtgcgggcgggacagtcgcggccgtggccacgatatccggagcgatccgtgcacctcttgtccttcgccatggcgggcttgattccgccgttctccagattcttccatgaggttctggatttgtacgaaattcatgccttgcatctcgcacccaatgccgtgatgacgctggccatcttcgcgcatttgtgcgagatgttcattggggtgtgaccgacgatgtggttgttccaggccttcttcatcccacagctgctacaaagcgcggtggtggggggatgctacttccagccccggccaggcacagcgggtcagtacatcgagagccatctccgcaagaaatgggaggactggaagaaggactggttctacattgcgttgccggaccattcgcgacttcgagttcccgctggccctcctgaaaggtctgccgcatggctggcgacttcggagctgggcgaggaatacgacgcggtgtgggatcgcctcaggggcctgcggagccttggcctcacgggggcgatggtctttggcgattacttccgccgccgcatcgcacctcttcaggaacgatcccgtagagcgtgggaatacaccggtcccaacgaccccatgcagacgcatgtgggcgagcgctgggactggggtgaggaggacgcgaagagggtgattcgccgggtgcttggcctagactctgccaagccaacactaatcccagatgggattcttcccctctgctgcgaccgcgaccgggagagcatcctggccgtgatgtcagccgttggcgccggtaggagccggtccagcggaggcggcgccagctgtagcgccgtcggcacgggtggcggtggtgcgaccttgagcgggagccgggccggcagtccaggcggcggtggctcaagggcgcctggatcgagcagcggacccagagacgattccgccggcgacccaaaggggaagcgaaaggtggcctatccccggccgccctctcccccgcatggaggaggtgccgagcgcgcaacggatcattcgccagcgggccacaagcgacctgccgggcccgaggctggtcagaaaaagaagcggctccggaagatagggcaaacggagccatgccgggggggtttcatcgagcccccaaagtggaccttcaaccaccctccccgtaggtacgattgttggcgctcacttcggtgcccttacccaacccattctcttgtttcttctttttcttttgttaacatatctaggttctcttgtagcgagattccttcttagggaatctcagggtcagaccccttgcaagggacgaaatccgaacggtcggggcagtgtgggcccggccagtccaaggccgtggggttttcgcagcctcgcggcgggacccagaggacacgcaccgggcctgatcccgagcgaccctcaggcgggacccgtcttgctgcgggcgacaggggtggcgacgctcctcccgggggcggctccgggaccagggtccacgcggagcaccaccctggatcggggggtgagggaggtcgcggcctgggagccgaagccggaggtggtcccgagcctgaggccgaggccgaggccggggacggtcccgagcccgaggccgaggccgaggctgaatccactcgaggacccgaagcgggggggtgagagggacagccgttccctcttgggcgcttggggcgccctcgaggctggtctcgcagaaggggggccgagagcagctcccagtctcgcgagggatccagcagtaccccgtcgtcccggggacggaccacggccttttcctccccgactccgacgagtatggagccacttctgcaggtgctcgccgccgccgactccactgtacgagaggggctgaacacccaagttcaagccctggcggaagagcggacggccttggatgcagagtgggcacagctcgccgcggaccgcgcgcgagtcgacgaggggcgtcgcgccgtagacgacatggtaagggtggggcgcaaaatgcgtcaaacccaactaaccaaaatctaggcgcgcgaggaggcactggactccgtcatgcgggaggcggaggaggagcggcaggcggcgctgatcgcctcgagcgtcctggatgaagcgctgggcgatatccaccttcagtacgaggctcacgccgaggacttggcgaagaggatcagggacgcacgcggcatcctcgacgcagccgctgcccacgggcggcgggcatcggaggccgacgcctcgctgcgggcctggacgacggcactcgaggctgaacgcagggccttggatgatcgtgcccgctccgcacaggagttcgaagccacaatccgtcggcggatctaggtcctcgatcgaaaccagcgcgagcaaaatgcgcgcggtgaagaacaggcgcagcgggcccgggagctggaggagcgagtgcgcctgcaagatcagcgggagtccaccttggccacccatgagagaacggcggcagaggtggaggcttcccttcggctccgtgaagaggccgcggccgagcgtgatcggatcaccctcgccgcgaaagcttccgcggaccgccgcgcggaagagctacggctgcgggaagaggcatgccgggaactggatgccgcactcgccgagcgcgaagccaaggtgaatcgccgcgaggtagcctcgcgccagttaggcgagcaactcgcgaaacgcgaggaggccgttgtcgggcgcgaggctcgtcatctggagagcgcccgcgccgagcgtgcggcaatatcagcgaaggcctccgagctggaggcccgggagaaggacttggcagcgggcgggccgcccggcggcgcggggttggcgagccagctcaccatggctcagagtacccttgccgacctggaatgcctggtgcaggatcaggctaggaaaattgcggccctccacctcaccaacgagctcgggcccgggcaactctccgacgccgtcgaccagctggagcgcgcggggtgccgagtcggcatctctttgcgtcgggacagcaaactcctgcccacacagccagcactcgcgcttcggctggacgggctggcggtggacctggagaggctggaggaggaggtcggcgagaccataaagtctccgtcagtttctttggcacgggctacggtggagctggtcctcgcgagccaccaagcgcgtgaccccgaattcatgccatggcatgcgctcgaagattttcccccgggtaccgaggcaagggcccgggagcaagtccgggaggcggctgacacgatggtctcgagctttgaggggtcggccccccggttcacctccgggcttacctcagacgaggaaaacggaagcgggggtaatgacggtgacgacgactgggacgacatcgtctgtggtgccgacctcggggggccgggcactcgatgaccactcgcgcctttaattcccttttgctgtgtgcccatagcaggcacttgtatttaggccattgtgccatcctatcttgttctgcaactgaaacttctttaaccccttttactcttttgctttttccattggatgcctgtgacatagagagaagaaaaaactagggcaaaaggggataattagactgcctgcgattgatatgtcgttttgaccccatccccccctggggcttgttctagcgagaagataaatccgcgctcggtccatggaatctaagtggtgataggcaagaccatcaccccgagggagccgcccagcgggactggccagaccgaggctgcgacgacgggggtcggggacgactgtgtgtaggcccttcggatcccccggggttcggcacaacccgtgccgcggcctgcgttcgtgctccctttcggcggttttcaggccgccttatggcacttagggtttagagtaaacgcggacccatgtcgtcacagtaatcgccaaaaagctcactggtgaactgggtgccgttgtctgtaatgatacagttgggcactccgaatcgagacgtgatgcccctgatggacttaagagcagaatgcttgtcgattttgacaaccgggaaggcctcgggccacttggtgaatttgtcgatggcgacgtacgagtgctgatacccgcctcgagccgccttgaatggcccaaggatgtccagcccccaaactgcgaaaggccaagatagcgggatgacctgtaaggcttgggccggctggtgggtctgcttggcatggaactggcatgccttgcaccactggacccattcttgggcatcttgtaatgcagtcggccaataaaaaccttgccggaaggcttttccgaccaaagttcgtgaggccgaatgtgctccgcactcaccctgatgggcgtcggctatgagctcgatgccctgctctcgagaaatacactttaagagtatcccgttggcggcacgccggtatagggtcccttctacaaggacgtaccgtttggagatgcgcgtgagcttttcagcttctgcgcgatcctcaggatgagtattgccttcgacatacgcccggatgtcagtcatccacacgacctgatgaggggggtcggggttgaccccctcgggccccgaggggcgcgggtcgcccggagtcgggtcggagggcgtgtcattggggtccctcaaagggctcggtcgcgccgatggttgcgcgagcctttcctcgaaggtccctggggggagtggggctcgtgctgacgcaacacgcgacaactcgtcagcaattgtgttgtcgcgtcggggcacatgccggagctcaagtccgtcgaagtggcgttccatgcgccgtacctcgcggacgtacgcttccatttgcgattatgccgcacgccgttccggaatgcatatacaaccgcgtgtgttgggatgcacggaatggtgttgcggacctgacagaagcgctgtatgtacgaacggagggactcatcatcattccgccgtacagcgtgtaggtccgcctcttcccccgggcggggatatgtgccctggaagttcgtaatgaactgctggcacagatcctcccaggagtgaatggagccggggggctgggtcatcaaccagccacgcgcctaacccttgagggccatgggaaagtaattcgccatgacccggtcgtcaccccctgccgccacgataaccgtggtgtagatctggaggaactcggaggcattgatgctaccatcatacttctccgtaaggttggggcgaaacttcggaggccaccggacattccggagactcgccacaaaggccctacaacccgtccccccaggggtgagtgtggggggagggccgcctcgtgaagaggagcgtggcgctccagatgaggaggtgccttcccccatacgggcagctcggcgctcgtctcggcgtcgctcgatgttgattcgagtgtcctgcgtcccgtagaggccgtcatgacgcctccggcttcccgaggcccccgacgatgttggaaccgtggaccgcctcgagatcgtggctgatcgacgagcccttctcctcgccgacgaggagagggtgaccgaggtacgtgatgtaccagcggcagtggatcggccacccgtggccaactgccggccacccgtggccaactgccgctgggcagtagtaaccaagttggccacatcgtccaaccagcgctgaacaggagtctccggctccgggtttaccgggggatgccgcagaagggcgcctgctgcctgaagcgcgccttggggcgaaccgtcgtctccatagtcgagacggcggcatgccccgacgcgtcgtggcctccctccgccagggggtggagagagagccgaaccatccgaacgagtgggatcctccttccgcgaaggttcgcggtggggaggagttggagaaccattgtcacgcccggaatttctatccaaaattccaaacgcttacatgtgtgttaaaccctcgtccaagaatcaaccgaggcacccaatgacaaattgataatagagtacaaataaataactatttaatattcgcaaataataaaagattacagaggtagatagttcctctcaagaataacattttacgcagcggaaatataaaactataacaaactacggaacagctatggcgactccactccacaggcatcttaaccaagaacaagcctaatcctccagatcatcaccttcactgagatactcgtcttctgatgaatgaatattgcaagaatgagcatatgacatactcaacaagtcacacagcaaatatgcaagtgcacaggataacaaaggatggcataatatagctcatttgcagaaacaacatttaataaatattgaagagaatggtaaaaacagttgaataattaatcaatattaaataacaccatacaacacaaccatgttgcataggcccaaccacatttgaacaaccaaccccagttgaacaaattaaacctccaaaccaggaattatccattccaaaccaggagtcaaattaattatcacattattaacattgatgagtagtgtgagactaatcacgaaaaacattgctcaactcacccataaccgcgggtacggctattcgaatagattaaactctgatcagaggtgtaccactgtacccacaagacacaatcccacaacatgttaccatgcgccttagtaccaccacgatacctcggaaaggaactgtgacaataccccttgcacaacacaactcaccacagtgcaccgtacctggatcataatcaccccctctacaaccagaggcatggactccccagcgaccccacggacttctcgccgcttctcagtctggcactccgtaatgaatcatgctatacaaaaggtaaagccgttgcccacgctggcttgtggttggcacggtaaaagtttcacaacagtagctcgcgaaccggtccttaattgtcatgagcacaaccatcaaaaccatatgctcacaacccaccttaactaggttttaattatcaattaattatcatcacacgattaaccatcgtgagctaccatttaatgtaaccatagttaaaaataataatgtgacatagtttataattaatccctttagttagctaatgtttctaagcatggctaagcaaacttacatatagcatttagctgaaccaatccaacatataaggttcatgctatccaaattataacccataggaaaataagatcatcttcggccattaattaattgggaaaggttcaccacccgatgacattcgaaaacaatgcatagttgaaataaaataatagctttaaacgggttcaacatgctcaaagggttgtttgggatctgtgtgacttgccttgggcttccgcaaacgcttcggaaccttcctcaacggaaacgctctcctccggaacgtcggaaactaaagcaattaaacaaaaatcaacaaaacagtacaaaaacaagcataaacagtacatgtggatatttttaacatgtagatcttgattttagaaaaatttagcaacttgaaccacctgaaacggatctacggttatttagttatgattttccgaagatttaatctattagaaaatcgggaaaaagaaaaaccgatgacgtcatgatgacgtcatcaatggcggccggctcggatggcaagctcgccggagattgaatgatcggccgcgaatttggagagcatgtacacgtagaggacgacgaggcgaacccaacggtactcaccctcgtgccaaacgacaaacgacgacggccggcgacgaaggggcggtggcgacggctcggcttgaccgacgacggcgagctacggcggccgacgacgaagggggaggtgcggctgaggttcctcacctccgtgcgcacctaacggcggcgagaaaaggcggcggcgacgacgcaagtggcggcgcggcgcggctggtggttggccggcgacggcggcggctaaagcgacgcggcggcgactctacggcgcactagagagctcgggaaagggggcaaacgaaagaggaggactagagggtcctatttatagccttggattgaagagatcggactcctcccgcaagaaatcgattcgggaaaaatctaaactcggttttggagataaactcgaaaacaaattcgattcggataaaatacccaatgatttgctccgattcttgaggggaaagatagaggaggatgtggggataaaaacccctcaaacaatcggaagaaaaagggccggattgggtgcggatttgaggggagaaggcggcggctcgggcgggcagctcggccggcttgggctcggccggaggtaggagaaggctccgacaggtgggtcccacctgtcggtggctagaggaggaggggcgggcggcggctgggtgggccggttttgggccggctcggccgcgcgggaaagagggagtgttgggccgaattcggcccaacgacttaagggagggcttttggaactttttaaataaaataatttgtgaaatgttgtttcaattattaaaaatacttcccttgctcaaataattcccagaaaattctagaaaatagaagagcaagcatagtatttaataaaattttatctagctcatttttatgttgaaaattttcctagataattagggtttagcttgtaggcttttaaaatattttctaaaaatgatttaaaatatgcatttttaatttagtcgatttttagggcgtgacaaccatggcaacggtgacgaggacctcggctctcgccggaatccccactcccggacggggtgggagtaaacgccaccgcctcctcctctacttccaggacctcgaccatggtcagctaaggcctggagaaaattgggacggaagaaagcgacttcctctcggaatgcgcaaccgcccctacctggcgcgccagctgtcgagggaagatcctcaatagcggggagtcgtgagaccccccatttgtgagttctgccgggggcggaggctcgtctctcggaaatcactcgctcgtccctaagattaccggcaagcttgcacgtagtcggattatataggttcgggccgctatgaagcgtaacaccctactcctgtgtttgggattatggatgagttttacaaaggtttcttcactctagaaagcgcgctcgcttcctctcttctggagttcaggttttctgggcgtcgtccccttatctcagtgggcagggtcctccttttatagctcaaggggataccacatgcgccgcctccacctaccctctatcggagggggatcccactccacttttcctgggctttaaaccgtgccttctcccggaagctaggcaacaaccggttctcgagtggaacccggcgccgccccccgcctgacacgggggacagccctgtcattccctcataaatgaacgatgacttgcgacagcccttcctcgagtgacgctcggatgtgacgggtcatacccacccccactccgccgggtacaagggcgacgtgaggacatggttgccctatccatcggatgtgacggtgacaggccgttcacagaccggtcacatccgttggacagaggttagctaggcgcgccgcacgtctgcccttaccgcattaaatgcggtgagggacagttggggcgtcgcacatttatggctgttcagcctgtgctcccctctcgctctctccctccgccgcgtggcagccgggtgagggcctcggggcgaagccgcgggatagcccgagggggtgacgccatgccccgaggcccccccccctccccgccgcttccacgagtcgcgtgacgcgtgaatggggctaacttgcagagtcacatggccggaggaaaagtaattcccctctactccacatacccccgggtccatatctccgacagacctgaaagcatatgctattgctagctaatctctaaagtcatgcaaatccaagtgaaacgtcacctaatttcgttctatatgtatgcatccttttctttaacacaaatttacaccccacttacatcttacttacacatataattactatgtaattttgagacttacatatgtaattttaaaacttacattataaatacactaaatttacatatgtaatttagagacttacaatgtaaatacaagctgactatttttgggtgaaaaatatggcgccataaatatagctacacccaaatgaaaacatgaattcagtatttgttatacgggatttcggatacatgatattgttataatgatgtttgacatcccaacatctcatattattcagtgtcccaacagactttctcacgagtcgcgagaattgtgacccctcgacttcacgagtgccctaaggacaattattttgtgaccgtatgattgaaggcctgaagtatatatgagtgtaggacgccatgccatcaggttcgtggagttgcggccgatggcaaatgagaaggcggcggtgaagcgcccatcggtgccgcatcgtcccagatgttcaataatataggggagagagtaccgtgcctactcaacatgttttattgtattgacatatattggtagaaataagaaatgattacatataaggaagcataatcataccaagatataactctaactagcatatgtttttacatcctgacaaaatccaagcgtgagcaacgcgaatggagaaagctcaacaaatatgttgaatagcctttgtgcaatagccaatatagccgaagcaaagggtgtgagaaagcgtggttgaagaagccatacgtagaataagcgtggtcgatgtcgtgtgccgatgatgagcgaggatgctaagccgcgatgtgcaaggagcgccaaggaccaaggtgcacacatggtcgccagcgctgaacgtatggatgtgcgctatgagggggcatgttactgaatatttgcctatatgcatgtgtggttatatttgttagttggaccgactgggatgtcaggttctttgagggggtgtgtgacatactagcccaattaggatttggcatgtgtggtccatgagatctgtgtgcgcatgttaagtaccaccttactaatttagcaaggttggaaccaacttataagagtctatccctccaaccatatcactcatgggttaactcttttacacaaagcaagtacgaaagagtaagtgcgtatgcccgttcgatgggttggctacgtggttctggagggtaggctgttacaacgatgaggctattgccgcagtcgttgaggaagatgacgctgaagagctaatgctatcgaactgtcgagaacaagacgtcgtgccgggtttgccaggctcaaggacgactcaggttgaatgcacacagtggtgttgttaataccacgccggcggaagtagacaaagacgaatgcgaggtagcaggaccaacaacctggaacagtgatgtcggtagcttgagctacagcagctaaaccactggcctagagcggcgatagtggctgcatgaagacgtggtggtgcgcgtagtagtcaaagaaaatccagacagctgtgttaacaccaaaatttggtaagattctttagtggattcggttaaggaaagagcacaatcaaccattaaaaagcttatctagaagagtccgagttcaaaaaagaatcatggagaccatggcataacaatgtaatttatctattaattaggcaagttttgtatttagaaagtttgagtcatgtccgatgaggactttatgctttttcttttatctttaggaaagtttctttggtgtccaatcaagactagtatccgccgataggtataaatatgtacacccaggatccttgtaatgtatctctcggtcaacacaatttcggcacatcgccatcctttttattttcgtctttctcgactagttcttgtttcgagtttggctgcatcaacttcgatctccaacgaggggtaaggcttattatggctggttgtatcggcgaggctagggcctcgacactctaatcttgtcaatgtaaacacctagtatttatcttatatcttagttaatctaggtagattctcaatttacttgtatcggccaaatctattttaggttttgttagtatcatttaaattgttttaatgatctagattagctaagatatctgttggtatttcttaaccttacagataaaatccgcaagcacacggagaataccgatgtagcacttcacccgggagtattccaatgtatcaatttccacaaggaacatgtgttttcagctccttgtccggttcatccaaggacacgaagcaaatgtaggcaaagggtagagaggatttactagtgagaaacagtttctacggaaagcttaatttaatcctaacgcgatacttcaggcactagccagcttgctgctcccatatgtcgctctactgtgtacccgaaaagggaggactttagtgtaattgagggatgtcaccacctctacacccacctcaaacctactgtgggatatgaagtaatcaccggaaattaactacccagacaccacgtctacgcaattaataactactttagcgctagctaaacactaaagaagccactatactttactgggttatagtgatcaatgatcccgcacgctaattaggaactaaccgagaggtaattctcacttgaataaatcttaattactcagaatgataattctattaaagcagtgtaattaaaaaagtaaaagaaataagaagaggattaccggcaactcaggaattcctctgacttcttctactctactctctctctctctctacctaactctagtatacaataaagtataatagagcctcttataatttagcttaagtttggagtgtgtgaaagaagtgaaatgaagagctccttctataggcaggtatgatggatctaaagcatgtgaaatgtctgaaatgacccgcaaccgccatcaggacgtcatctggagcgtccatgccaaacccagcctgaacggctgagattgagcttcagccgaaccccttcggctgaaccctggcctaaccaaacaggcccaggatttggcctgcacctctccctcagcctgccttatccatttccaggagagttgggcctgctttctgatgtttcgatgtagtttaagacccactcttgtatggatagaattcttctttcacttaagtctggatttcatcccaactttggcggtttattgcctgcgtccaaatatacaccaacactcgtgaaatatgttagaactaagccttaccagtatgttagatgttttattagctgtcaacaaacccctcacacttagctctttactcgtccctgagtaaatgttaagatgatagtgtagaataaaattctctaagacataatacaagcacataaattattcaaaaccattcacgtacctgtgaacttcaatggtggctaacttaccatctttggcaattgataaatggagttgtgtgtgcatgtttagtaccaccttgctaattagcaaggttggaaccaacttataagggtatatccctccaatcatatcacttacaggttaactcttttacacgaagcgagtatgaaaaagtgggtatgtccgttagatgggctaggttgcgtgattctggagggtaggttgttatagcgatgaagacgaagacgataaggcgatcgtagtagtcgttgaggaagatgatgccgaagagccaatgctatcgaactcgggatgaatgcgcacagcagtgttgccaataccacgtgggcgaaagtagacgaatacgaatgcgaagtagtgggaccaacaacttggaacgacaacgttggtagcttgagctacgtcagctaaaccactggcctagagcggcgatagtggtagcctaaagacgtggtggtgcccgaagtagtcaaagaaaagttggacagctgtgttaacgctaaaatttggtaatattttttagtggattcggttaagaaaaaagcacaattagccgatggaaagcttatccaaaataatctgagttcaagaagaaatcatagagaccacggcatagtaacttaatttatctaataattaagcaagttttgtatttaggaaagtttgagtcatgtctgatgaggactttatgtttttccttttatctttaggaaagtttgtttaatgtccgatcaggactagtatccgcccatgggtataaatatgtacacctagggtcctagtaatctatctctcgaccaatacaacttcgggacatcgccatccttttcattttcgtcttctcgacgagttcttatttcaagttgggctgcatcggcttcgatctccaatgagggataaggcttgctctggctatttgtatcgggtggggatagggcctgcacactctaatcttgtcaatgtaaatacttatttatcatatatcttagttaatataggtcgatgtctcaatttagaagcaaatagaagtacgtgagtatgtctttaattagataaagaggtcatattactatataattgaaatagaaaatttattaaattaatatatctttataaattcatctttagtatacaagaaaaatattacttaaaagtttaaattaagatgctaaatatttttaataaagaaacccatgtagtataaataatagtttcatatgaaccaggtctattgttgcaacatatttttttcataaatttaagacgacatgattcaagtaattttagtttacaatttgtaacatcccatcctccagaacaccgtagtccaacccatccaactgacgcgcccatttacaaagatcaccttactcacacttacgttgtcgcttcgtgtaaaatagacaaatggttggagggacgatgccttaggacatgagcaatgtatattgcacaatcagtccttattgtgggccctaggtgggtcccactgagatatatttcatcttcacaatgtatattggagaaaggaggttttaaggtggaccccacaattattaccattccaaccatcctactctccctcagtcaccagaattttccccaccccactgaggcatcgatgaaaatagcggtagctcgcgcgagtggagccatggcgacggtggtggcactcgcttgtggcaacggcggcagtggtcgcgtgcagcggcccatagaattcgcagcagaggccgcggagctcgcgggtatacacggagtcgacaacggcgtttgcgggcacggatggatccggcggcggcaatgatgaagctcgcgggtagatctagctacgagactcatgggcgtggatggatccggcggcggcacacatgggcacaggtggatccgacggcggcggagctcgtgagaggacttcggctgcaacggtgctcgtgggtgggcgtgagtggatccggcgacgacgctcgcgggcgcgggtgtatccggcggcagcaggaattgggcacaggtggatccgacggcggcggagctcgtgagaggacttcggctgcaacggtgctcgtgggtgggcgtgagtggatccggcgacgacgctcgcgggcgcgggtgtatccggcggcagcaggaatactcgccaccatctcccggcggttcttcagcaaatctatccaggtgtattcttcccttctcccatggaggcaagcaactgaattagagagagatgggctagcagtaccatagcagagagaagaacgaatgttttattgcttatagccggtccttagccaataaacaatcccgaacaaattatttataaacgcagatttataagagtaaaaaatagttttcttgaaaaatccaatacataaatattcgtaacaaaatgtcaaacaccaaataaatttagttaccttcctactttacatagaatgagcgatcatattcgacgaccaaaatgcaaccggccggctgccggcacgcgcctagtctcgtgacgtacgttgtcgtcacacgtggtcatgtagaatttttattgttggatttattatggggtattttgagtttcttgccggcactcataacctctggtagacttactattggataatttgaatatccttgatacattgatgttgctacaaggatgtcgacgtctcaacatgatcttattatatactagcgcgccggtagtctctatgaccaacaaattaccccactcctcggccattgacctctccctagtcttcctctcgactcgcgagaattatgacgcctccacttcaccagcacagtatccgtgagttgaaagctcaatctgtgaccaagctcaatccgtgagttgatttcaatttttgtcaaaatgctgccgaaattttatcaaaattccgtcaaattcaaattttgtccaaattgtaatgtcaaaatctgtccaaatctgtcatttaattttaaacatattcaaaaaataaaaagtaaattgcatattggtcctggttttcttacctgtgttgcacaatggactggatgctatcccatgttttcattttaatacatatatgaagttaccaaaactttcatcttggactagtggcccacatgtcatgtagaaagtgttttcttccatctctccgtcttcaccgacgaatgcatcaatctcatcttgggcccgtggtcagtggccagcagtccagcacgagtgaagctttgctggtgtgatttgcttggcgttgattccaatcgaagtccgatcttgaggaacgcaggttggccaatggatggaccgagatcgatcgagcgccaagctgaacgcgaggagattaagctcctacccgaggatggatcgacggttgtacgtgccttcaccagtcaagctcgaggggcgcccgcactcgtctcccagtggcaacgccaatgacagagcccattccatcttgcacatcgcgtcagccggtggagcggtcgtcgacggtggcgccatttcatcccacgcagcgggcacagccaatggaacggacgagcggtcatcttcaagagagagggatgcggggaagagctgcagaggacatgccggcggccactcaatgttcgtgcagcctgccaggctgctactgctgcattactggggaagagatgagctctgcccgatcaggatagggactaataaaagaggaagatgaatggctgaggctgacatgtgggtcaactagtccaaattgcatagtttagtaacaaaacctggttcaaagtgaaaatggttgtacgttcctagtccagtatgcaacttaggtaattaaaactagtccaaagtgtaattcactcaataaaaaaaatttccaaagtcattgcataatggggaaaaacacaattgatgaatagttatgggagagggcataaatatcctatttaacaccgttaactcctccatccaaaacaggggcaaaagtatctttcggttcaaaaaaaagtgggggcaaaaacgaaaaccctaaaaagtaggggcaaaattaatattagaaatcaaagtgggggcaaaaacgaaattatcccaataatgccataaaaagttgctattgctttatatgtcactgctttatctttttctttccctatatgtcatccacattatcatctttgtaataggaatgcaaaagtacaacataatcctttaattcctcgagagatgtccactcgttttttttcatgtcctccaaataattattaaaaaatatttttaataagatagaataatatgtgatatattagtccccaaatatgcaagtttaaatttcaattttacaagttttctttcaaaaaaaatcaaatttagttgtaagcacacgtatactaatttcaaaattttgagagattgtcatgcggaagaagacaaagaacaagttggatgatgtggaatttttgagttacatcacttttagttatgagaaaatttatatatctctactattattataaaataacagtcgtccccctcctgtttccacccacaacatccagagaaatcgctcagtttatgcccattccacactctagaaaaaaaaccacatcgataacaaaaagctgaaagaaaaaacacgttccagatccaaaacattcatatgtactactccctccatctctaaatatttgacgccgttaacttttttaagcatgttcggctgttcgtcttattcaaaagatttaagcaattattaattcttttcctaccattaattcattgttaaatatacttttgtgtatacatatagttttacatatttcacaaatttttttaaataagatgaaggttcaaacatatttaaaaaagtcaacggcgtcaaacatttagaaaaggagggaggactgtaaaagacatcgtcctctagttcccactcatgacatcctagaaaaactgctcagttttccatatcctaggaaaaaccgcttagaaaaataaaggaaagaaaaaaacacgttctcatatctaaaccactaaaaaaacaaaagaaagaaaaaaaaaacacttcaccagatcccattacaatacatgcgcctgtgagtatatgactagtatccaggtatccttaaaattccagccaatccattctatgcctcctgctcattccctcgcatatagtccaaaatttttgtttggctcccttccttatcatttctactggttgatcatttaattccaatgataaggtctattttggctttagacatagaagaaatgtagaaaagctctatgttgaaagggtacaactttgttgtacttgtacgagaccatatatcatataaaatctattgtttttgcctacaacttttgccctggtactgtattactgttttcttaccagttgattgatgctatctgcaacgtccgatctagtttatggaaaattttactgcaggacactgctactgtgtggttttagccttaggacaccgcaaaaactaacttttgagggaaaacacttcataatcgtggtattttgccagtggataccacgccgactagaataataattttcgtttgaacaggagagagaaatcgtgtgaaatgtcaaaaacgtccttgggcccacatgttagctctcctatcttgtatgtggggtccacatgacagtgactagggcgagcggcggtggcctgcagccgagcagcgaggtcgggcagccatggtggacgagatgtggcgtgggcgatgcggccaatgcctgcggtggcgcgacctggcggaggagggtggcccgcacagcgcagcctctggtggtgcgatgtggaggaggagggcggcccttgcggaggccgagcggagcagcagcttggtgcagtgcggcggcgctgccccgcggcctgattggcagagctgcagccggcaagatcggcggcgaggtggccagccagcgccggcatacggtcgccggcgtggtcggcttgcggcaagcggcgacggcgctgcaaatgttgttgtccacttcccctccccctttttcattttgttttctttggtttcttctttctttgcatctacctttcctgccattgccatgtggaccccacatttcctgccattgccatgtggaccccacatatacaagatagaagagctaacatgttggcctaagggaatttttgacatttcatacgatttctctcttctcttcaaacgaaaattattattatagtctgcttggtgtccactggcaaaataacacaattatagagtgctttctcccaaaaaagttagttttgcggtgtcatagggaaacgactacgcgtcgggcgtctgattggggtgggaaaaatcgggtgcccacgttagcatgacgttagcaagcatacatgcatgcaaaactactttaaactattttttctcttaaattatttatccaaatcatgatctgaatacaccgttaaattcgttacaattaaatctttaaaacaagaccacatatggatatattccaatgaaaaaaattagcttattattaaattatttttaaatgttttacaatattccaccaagtagatcggaattgtttcactaattagatcgaaaatatttcaatcgtttaaatcgagtgttgttttactttatataaaaacaatgtttcatcaaataggaaagaatgtttcaagtcgctgcaattgatccatacatagtgaaacattataagtaccctggatgaaactttttagtggaacaaaaaataaaatgaattcctttaattgagagtttccataatatgtgggtgatttgttacaaaagaattttctgtcgacgtttgatgtcgcaattctggtatttgcatggtatggggatcgtcggtgctaggatatacgcaagactgaggtaaaagagatggagacaaggatttttatacaggttcgggcccctgagttatcaggtaataaccctacaacctgttggccgaagccggtattgctcttattcaccataatcacacaagtacaatatttggggtagccaatctaactgttgtcgacatggcggtttgacgatctgactcgtagtcgacaacggagtagcctttctcctcgaatccgtgcccggcgagatcagagatagcgctttcgtttctcctgacagtatccggagacaccgtagggttttagccgtgcttatccatgaagtcgatatccggcggtgtgtcttggcgtatgtaggcttctatgttgattgtgttgggtgttgatcctatcgtgtcggtgacatgggaccgggagtatcatgactagaggcttgaggcagacacaatcgcccacgtggcctggcaccctcgggggacgtcgggcccgagggtgatgtgttcgccctcctcttagtctccccgagggggtcggaccactccagcctcggccccgagggccgaggcgccccgacccctcgtgggttttgctccgcgtgtatgggttaggagagcacagtggggctcacctaaccacatttattgcggtttggttgagcgtgtcacgccgcatgtaacgcagtgcagtgcactcttttatccggtctgtgatcagtcacagaccggtcaaatcacgggttaggtggcgacaggcgatctgacgcacgcctcgccccatcccgtcaggacgagggcttctaggcgcttgtccccagctggagctagcgtgttacctcccagagatggcacgttagtcctggttagatatatgccaggcttcatcctaaccattacaggcgagatgttgtgtgaagaagggccaacatgtagattgctaaactgacacgtggtggacaagaatgaccgatttgtgaccagtctggcactggtcatgtcttcagcagacagccatcctcccacgtcacacctgtttccagcggaagtggaggtaggtatgggctatcccatcagaaggtcatttcggacagcaaccatacaaatctccgtccgtttatgaagagaagaaaagtccagtttggaaagagagaggagaagtctccacacaaaagagagagaggggtgcatgtggtatccccttgagatataaaaggaggaccttgcccacttagagaagggactggatttttccagattcgaaacccagaacaagggagaagctggctcatactttgtagctccttcatacacagatccaccaaaacacaggagtagggtattacgcttctcagcggcccgaacctgtatacatcgcccgtgtcttgtgctctttcgattgtcgcgatccttccatatacagagagcttagaatttcacccttagtccccggccgaaccggcaaaggggggcctgcgcggtctcccggtgaggagccacaagctccgtcatatcgggtgttgatcccgttgggtgttgattgtcttgtccccctctcctcctagggggccctatatttatacccataggtgtccccttgtccaagtagaactagggaaaccaatatggatacaatccgagtagtacttgtcgtttccatgtagaactctggttgtctttctttatccggaactcccccgaggtcagtttccgtataagacatggtatgtagtggatcctgccgagatttagtcaactactattaggtatgtggtattcataaccctgacagtagcccccgacttcgatgcaaatgaacgagttcatattctcaaccgtagactttggaggaactgttatcgagctcacgtgaccgttctcggtgagtttagagataacgttagagttcctttatcagcctcgtgcgagcaccgaaagggtttgtctaagccaatctctgatgtcgaccgagaaagtacagagcgtacgactaagtctcccgtcttgctgtaatcgagaatttggattgaagtcaagaaattttatctcggcgagtacaccatttcttcattccgtattccttgtcgagatccagcaaccgttctccagtgatcgagaaggcgtagagtctgcgatggagccttgtcgacatttgtcgtactcgccttagttgatcttggtgtagaaccatagagacatggagtcttcgataatgtcgaatagaattttcctgaaatcaatactcagaaaagaatattagatagaaatagcccccgagcgaatgctcaaagggtgaaatgttataatatgacagactggtgaattgaatgtacagactagtgctttgtatatgagcgtcttctctcttatcgactctgatcagtcagtttgtagagtcatacactctccctagcccccagccttgtcgtcggagaatcgttctcagaagataaggctcttggacctttgacctgcctcggttgaacaagcactgatcctagcccccagccgtgaagctggaaaatccattttcgattacacggcttggttaatacgcacggcgagaactcttacacgaccagatcttacatggtctttcgtctctgaaggatccgacaaggccttatcggctctgggcgtccccagccgaagttccctcaggttcctcggaggccttgtcaagacggcattaagggatagtaggataggtttcaacgctaggtgtcatctgggtaagggatctctgggtaaaacacttggcgatcttgtgcacctgatatcagctttgttgaagcaagggtaataggagaatcgctacatcactggtcgaggactaggcagtagtcgtaactcgaccacttgaagtggaaatagtgggagaaacgctacatcgctggtcgcagaccaggcagtagtcgtaactcgaccacttgaagtggaagtagtgggagaaacgctacatcgctagtcgaggaccaggcagtagtcgtaactcgaccacttaaagtggaaatagtgggagaaacgctacatcgctggtcgaggaccaggcagtagtcgtgactcgaccacttaaagtttggcgagagagatcactgcgttttactagttcgagaaccagaagtaggagtcttttaatcacctataggggtgctgaagttggtttattacatgtgcatatcatgtggccagcatgactcacatacccaacttatagcatatccggatgtccgctcgcaatcatgtcgggtgatcaaaccgacgccgtttgcgaggaatcatccgttaacaaccttttcttgagtagtccagcaatggccggtgctataagataggtcgtcggtcttcgttggtaagttgggtgcgacgactccgcatttgtcgagaatgttctcgatagtggggtgtactcaaccacaacctactcgagtgctcaaatgttctcgaaaaatattttctagaaggcaagacatgcagtagagaatatcgagtatgtactcaaaaactgcatggatcttctagtattatcaggacataacgagcagatgtaaatgtcagggcattatgtaaaccgtaaacaagaatgatttatacagaagaagacagaacgagcccccagcgttagatcgtagtcgatttaacatcggggacacccgcgcaacagatattattgtataaagaacatgctctgggtaaatataataaattatagatctaacaatactgtgtgatctgaatatgtacgataaattgcagataaaatattgcgtacctttgtagatacatgccggatgtatttacgaaattagtagatcaatttaaaaaaccaatctaccaattaccttgttgcgtactcgttcgatatcatgcgatctgacatcttttggtacgccacggagcttgaggcttggatgatctcgatagaccaagttgtcgatgacgatgatggttccgatctggttaggttggatctccccctcagctgaagtcatcgagtagctcgttgtcggagaatccatcttttgaacccatctcgtcgaaatcctgaagcaccaaaatccccctacctggcgcgccactgtcgacgtttgatgtcgtaattctggtatttgtatggtatggggatcgtcggtgctaggatatacgcaagactgaggtaaaagagatggagacatggatttttatacaggttcgggcccctgagttgtcaggtaataaccctacatcctgttggccgaagccggtattgctcttattcactataatcacacaagtacaatatttggggtagccaatttaactgttgtcgtcttggcggtcagacgatctgactcgtagtcgacaacaggggagccttcctcctcgaatccgtgcccggcgagatcagagattttctcctgacagtatccggagacaccgtagggtattagccgtgcttttccctgaagtcgatatccggcggcgtgtcttggcgtatgtaggcttctatgttgattatgttgggtgttgatcccgttgggtgttgattgtcttgtccccctctcctcctagggggccctgtatttatacccataggtatccctttgtccaagttgaactagggaaacaaatatggatacaatccgagtagtacttgtcgtttccatgtagaactctggttgtctttccttatccggaactcccccaaggtcagtttccgtgtaagacatggtatgtagtggatcctgtcgagatttagtcaactactattaggtatgtggtatccataactctgacagtttcaattcactgcaacactagatctatacatagtgaaatattgcgagtacattaggtgaaacatttttggtggaacaaaaaatgaaacgaattcccttaatagtgggttttcaaaatatatgggtgattcgaattccgttaataatggattttcaaaatatatgggtgatttgttgcaatggagtatgtggtggagatacgtggcaggtggggacagggacatgtggtggggcccagggggcagcgcgcgtcgtgggggga

SEQ ID NO: 42420 - DNA, 14222 bp, Oryza sativa
  unsure (1)..(14222): unsure at all n locations
cccccccccaaagagactgattctgagaattcccggtgtcttagggctaaaaccagacaatagtagtgtcctgtagcaaaatttccgtatatttattgggttgttgtgctaaggtgcttggtgatacctgcgcgttacggctgaaatttgtagaaattgatgtattcagatatgttgttgaacaacagctaaagagagcaggagactatgcacttcgatcattttgtcagacaacgttaatttagagcaaagtggtaaaattataaaatgcactaattgtgtcctgagagtacgagactaaccggaccaaacagctcattcccttcttcagttggtgtgttctgaacattgagatatcatgcatcggctctagatcaaattgttctttcttttgcaggagaactcatatagaatcaagcatatttagtgccaacaatcaggggcggattcaatgtatccctctagacccaccagacccatggataccccctaagtccccccttcaacttttttgttatagttaataagataggaggtgctaaagatctcttaatagtattttatcatagtttaatactgagacgatgtgttcataccggtgtacttggtatgttgagtccctccaaccttttgttcctggatccgcccctgccaacaatatggataaattgagaatatcaatagaaaaatagaagcaccagtgtatcactacctcactttaccttgcagtacaaagttgcaaatggaaatctcctaaagaaaagaaggttatgaaaacaattaagaaaatcgaaagaatagttttcatggtcggagctttttgccacagcttttgcgaaaattcttccaaccgggcaaccggcgggggagcaaaaatcgagcactccccctggcccaccacgtgtccatacacacaactttattgcaacaaattatccacatattttaaaaaacctttgttaagggaattcgtttcattattggttccaccaaaaatgtttcacctaatgtactcataatgtttcagtatgtatagatctaatgttgcagtgaacggaacattcttttgcaacaaatcacccacatattttggaaaccctctattaagagaatttgttttattttttgttccacaaaaaatgtttcacctggtgtactcagaatcagaatgtttcactatgtatagatataatgttgtagtggactgaaacattctttcgctatttgctgaaaagctaaaaatttttttgtcggaatatatctatgtatggtcttgttttgaagatttaattgcagcgaatttaatggtgcaatcgaatcatgatttggataaataacttaagagaaaaattaatttaaagtggttttgcatgcatacgtggtgctgacgtcagcgcccgatttttgccaatccggatcgggcgcccgatggatagtccatttccggcttttgccaatcctttagcaataagtcaccaaattttagagtccgattaggcccaacaaattacacatcacatgggctcaatgttgtcgtcacatgggcccaactgtctaaaacaacagccaacttgtttagcatacacaaaggactgtggactgaggtgcccaagagaaatactcctatatgcagagatatgattgcttgtattacctacacccaaaaacaaatgtgacacacaaaacaagagcccattacaatataactgtattttgctaaaccgcatagctaaaaagagctactaggcaagctctgcccaaaatagaaatgtacatacatatattactaaacttaattacatatgtaactgcaatgtaactcacatataactaccatatagctgctgttcaatcatgacgtaagtgcattttaaccctgactttatgatttatcaccacctcgtgcattgaccaaagaaaagaacaggagaaagaaacagagtggcagccagttactgttcaaatacgagtatctcccgcacttaacaggtcgcagccacgccattcaacaagagagcaggttcgaaacgagctcataggcgtgtgacagcactgaaccacagatctgactgtaaccagcaaaaaaaaattgtgacgacataaatctagcaattccgttgttatatttatcatttttaaaatgctgcacatacattttgaatatatattaaattttctacctataatacttatttatacaataaacttatgaatattacagtcacacaataaataactatatctcgataaaaaatccatcaattgatactacctttgtttcaaaatataagagtaggttgttttggagatgacaaggagaaaggaaaaagaatatgtaatatgttgccccattaaatgagttgtttgtgggtagtggaaaggtatgtaaggtcaaggtggggagaaaaaattgaatgaagggttaggaaaagtagtactactcaatcccttacattttggtacaaatttgaattcttaaatctcttatattatgatatgaatgtagtgaatttgttccatgttcaagggtaaacccacatattttttacagccattaaacggtcgactaatgtaaaggatattgaatgaataaaatcaaaacttgggtgtataaaaaaagtaagagaaaattagaacggactgatgatttcaacagctggccaggacctattccctacaaagctgcacccatgcggctaaggccctgcttgattcaacttaggattattataatctgaattattagaaataagttggaacaaacagatagcttattatgatagattattataatctataaaccagattactataataatctagtaatccacctctaaaggtgcttactttagattgttaggtgactaaccgctaacaaacagcttataatatagagaaacaaacatctcacaacttattatatatcggtttattataattcaggttacagtaatctggctcaataatttaaattacaataattttaaactgaaacaaaccgggtctaagccgcttgcatatacagcctgtccgatcgatgctctcaagcatcgccatcggagcagtgcccgcacaaggcgaggttttgatgggcgcttgggcatgctatgctgctgaaaggatcgtggtggggggaacctaaacacgaaagcgtgaagcatgagctgttggatatttcgatattggttacagtccaatgcctaacgaaatgtccgagctaatatcggatatttcaatgcactaagtgtaacagctcatctttctgttgtccataaaaatgttttccagatgcaatacaaatgcatttcatgttgcgctcaagaaaattcccatccaaatgtattaaagttcataccatcactatataaacagttcccgccgcccaaaccaaccctcaattttcaacctcccccaaaaatcgtgattaaattattcctacagattctacacattgctggcagcctcgccttcaagtttcatttgattttgaccaagtttgcggaaattagaaattcaaggtactgttcacccggaggagctctccctctgctcatcacgttttctcttgtttccttgacctatctatccgatctattgactaggcaagctaagtaatctcgtgggacacagttttaatgttaggctccacctccaactcagaccccactgcctagtcaagcctaggctaagttgggtaggccctattctacaccgcccatgtgaaagtgagggtttcgcgtgtgcgatgtgttgggatacgcgcaggctacgatagcataaattaaaattttctaccatgtaaatcaggaaccaagcaagtattagatcatagatcgttaccgctcgacgcactgtgcagtggaagtaggcactaagtagccgaagaaacgtcgagggcgtagcacgcgtcagtgtagaggaagtagttgatcgcagcaactcgacgttctccttctcgtgcgttctcatcgccgtactctcaaactgatcagcaccgcaaactagcagcacctctaccaatatccacatgtacagggacagaacaccatgcgcagacgtgctagcatccgcacgcggctagggttttgctcggggaggggagtggcggctagggtttctcacgtgatacgatcacaccgtcagtcacacccctcacgaatatataggatccatgactcggcctccaaggtccataggactcctattcagatccctatccgaattaagctcatattcgatctccatccaatccttttattctggcccattaagcgtgcgaccctgtaggttcatgtacactcggatgtaatccgaaaactccttttcagtccacgtgtcaacagcggcccctagcagaacgtattgacccaccggacatacataaagatcatatcggttgaacctctagtgtatacttgtatgaacccctttgcctcacgatatcaattaagctcaaggctagatatgtgtcatcatctaatagctcaatcattcactcgaacttgtgatagattatataacttgtgtttgactcctcaatcaccttaggtatagccatgcacttccataatctataatatcgaggggcccagatatatctctccatatgaggggcgaatcttatcttgattattcatttcccactacatgtttcatagcatacccaaaaattatttttataactacctaattacggagtagtgtttagcagtccctaagtaagctactacatatgttgggaaccatgataatcttaggtctaagaattcaataccaacattaaatgagatcaccgatgacacaacacatattgctcttgcagtgtctcatgttgggtatatacaacaacatataccccaacatgtgtcaacattattaatttagtatgtctatatcatgatccataagacatgatcatcaattaatacatgtgctgatcatttaaacatatttgttccacatataatatttgatcagggatcctttagaaatagcaacatataacataaagagtctcatgaaagaatcacatattcattaaccaataataagttatctatttcaaggaataatgtcggataaatatgtaaatatagtttgtgatacaattatctctatgattgcctcttggccatatcaccaatacgatgcaccagtaccgccctaggcacactagctgcgtcagcaccttgcaccatcctagccaaggttgttaggatcgggatactaggtagtatcgttttgctcaaagtaatatcgtatcgtaggaccatatcgtagtatctatgatattttctattttaagtttaattaatatttatattaattatatttatattaattgtttctatttgcacnacatatatcattcctatattttttatatagaatggctatatataattattataaatattaattaaacttaaaaaagaaaatttgtatcctgancnatantacctagtatcccgatcctagcaaccttggagagtgccttcctcacgtcacagccatttgtctttagcgcttggccttaccagacctcgaaaccgcacgcgacgattcaccaacgagtgcgcctggctctttgcacctccggtctgtctcaactccctgttccggaccactatgtcccatttctgtatatactaatttgttgtgtacagctttgcagtgggtggcctgcctcaaccctgaggagtttcattcacagtgtatgattttgcttccttggaggttcctttctatttgcaccaaatcaagcggtcaaggcaaattctagttcatttaagagtaacggtgaagtctaaccctatatcggttatctggccatgatagtagctcacaggaggtctaccatcactccatcaggcagcttctatctctgtactcaacagttagtttccctttgctttcgtccgatacacggcatcaaaccaatctcatcttgggctccgagagccatctacaactattccccactgctttcactcaaagaacctaatttatacaccattcaacatcccatctgcataggtctatctcaaactatgttggatcatcatgaccaagtatgtccggtacccaagatctcacgagtacattatcacgatgtcacattattttcatctcgacaacaccacaaccatgaatccgtctcggatagaggtttccttggtgaatacaaagcttcacactttgcaccgcgagtttttacaattgcatctattttagaaacattgctaacacccagtgtcatttccctggtgatatgacaatcaggtataggcatacaaccaagcatgataaatataaaatattgccaaagaatacatcagctaaatggaggatctacaacatattcaaatccaacgagttttgtaatccagttcggtctctggagacagcactaacttcaaacggacccagcactttcatgtcaactccgatttgggcgatcttggattgttggaaagaatatatcgtcacctttcaaatgcatctggtctcatattaaaattcatcccgagtcaatgggaatcatcaaaataagcctgtgttgtttctgaaaccaaacatggaccctgtgccttgtaatagactaggcctatcttggaagtgtctccctagctctatttttctctataaatgtctatgtacaccctctaaaacaattgtgcgtcatcacctggaagatcaaaaacccatttcccctacacaaaaattatatgagaagtgtctttggaactcatgcttggagatcgtggttattgaggtaccgtaaaagtggaggaacaagactacataggttctcaacatcctacggacataactcaactaataggtaggtccgccagttcgtcacacaaactggggcttgtcaaatttaacgtgcacacttaaatgtagttttgcaaacaaaacattttataagttaggagcaatatcatgaaaaggtgacatgccttgggtcttcttcttcaaaacctctgaaattccacgccgaactaatttccgttatcgtcaactacacacaaaaaatactactattattaactaattgtgctattaggtatatctcaattttaatagaatttagaaacttgaaaggggtcaataggtgttacggattgggatttatgaatttttttaagtttaaagggttttatgaatttatttgaattgggaagtgtaaaattattcctccgctgacaagtggggcccattggtcagagagagaaagagaggaagggcttgtgtcttttggctaaggaggggattctaatttggctcgtatgcgctattaagcgaagtaacgcataccttatccaatctattttctcttccctcattggaatcttccaagttaatattcaaacattttcaactcagaattaaaaactttcaagtcaagatttcaaaacctccaagttaatatttgagactttcaactcagatttgaaaactttcaagcaaagattttaaacttttaactcaagacttgaaattttttactcagattttaactcggatttgaaaaaaaagtcaactcaaattttaataaattgaagtcaagatatgaaaacttaactaatgtttgaaaattttcaacaaaaatttaaaaactttcatctcaaaattcaaaacattcaatttaaatttgaaaactttcatctcaaaatacaaaacttgcaacttacattttaatctgttaactcaaattattggtgaaatattcaatttataaaatacaacaaaaaagttttcacaaaaaaaaaagaatttgttaaatttgggatgtcagattttgttgcacattatgattttaagtcatactagttatcgtgcacgtctaaggttcgttttggcattatatacacaacagtagaataataaatgcgaccttttttttatgcagtactccatataaattcttcacgtaaaaattgagtttcatgggatgatattttgaatgatctctacaaaaagttgcacagtctattcctagattgacaacataagatgcaatgcaccatccacctttattaatagatattccaaagctacatatgagtgcccctgaggaaaggatatctacacagattttatttcatttgtaaaaaaaaaagaatcaactctgaagtagagtcactatgcacattgtttctgtgagattgctacatctccagctagtaaagaaaatgccaacagctagcatctcatttttctcatttgtagaattgcattacagagagtaatattatggttagcaatcccatggcagtggacctcaaacagataaaaaataaccggggaactttaatgactcacattagtcggtggtttatctatgaagagcactttttggaatatatcacagataatgtatataatatctattgtgatgtacataatgacgccgattattagtccatttgagcctgtaaataaagaaaggcataccttatcaattgtagccaacagttcactttcatggtctctcagcgcccctcctcttactattaagccacagagctctccaaccagaacctcgacaagatgaaaaaaaaggataattatccctaatttaaattcaataaactaggaaggtagcccgcacattcgcgcaggtatgtattataaattatgtttgaaaaactgatataggtgaaatattaattaaatgacacctgtcatatttcaacagtattgtttgtccataatttttttaacggcattgcttagataattttttcaaactatttcttagcttctaaaatatatagcatttaatacatccatataaacaattatctaatatatagcatttaatacatccatataataaacaattatcttttattctggagttagatttaatttgttggaaaaacatgtctaacaaattaagtgtaaattaaaagtaaggtgttttgtcctgtttaattgaaagtttagtggctttttcaaccaatcctaaagaactattattgttaataaatatgttctatttggaccatcatggttggttcaaattgccgcaagttgctacatacttacatataaattatgaaagacatatcatagaactcacttcctcgtgacatgcacggtctatactatattttctaaaagaaaatactgtgttaacatgactccaaaaaattaaacttaatattaataaatataacttttcaaacaactatatactatattcttagcgtggcttatatatgctacgaacttattacattttctccaaatagttcaatttattgacattttctttttcttgctttattttctaccagttcaaaatataggcgttatggatcttcaaatcgttggttcaattgtgaatacaacaatagctagattagaaatcagtatgtatattttattttttttaaacatttctagctataaagaacatggagagtagagtgcagagctcaaatcgagagaagagcggactggtagtattgtgttgtttgcatgtgtgggggaggccaaagtgtagtggtggtttattttttttaatatgatttaagtgaaaaccgatgatccaatacttttcttagatttctaatttcttttttttcctaacttttaagatgtaacacatggcgcggtttaagattttcttttaaaaagtatatctattggttaaaaaaagagtttcttataatttctaagattttatttttatttaagacgtaacatgtgatgccttaagtgcactacggaggatgtacttgtgatattatacatatgtcatttttttgtaatgttttttgctatttggttaccacacaaaggattggtgtctatgatcaaatggcatacttttatttttatgtagtaaaatatggctaatatggatcttatatattttatttaactataaataaaacaaataaatatagttatatatttatttagtttaattaaaataaactaaaaatcatatataacttaagaattataatcattttacttttcaattattgatcatttttattaattagataaaattagaagatggaggaattgaatgatagaggatatgaagagagagggcatgcgcgcatataattataatatttttttacatgttacagtgaatgaaatattagttgtatgatttaaatgtcatagttgcttactttttagcataatttttgctttctaactaatatattttgggaacattactcatagttttcattttacttttaggactttatatctaatttgatcattatgaagttatgtacggtgataaaatctagaatattattattattattttattattttataattgcttgaacgatacgcaaaaaaaaaatataacccaaaattacattatagtgaaatttggtcttcaactctaaatttagtcatacataatttaaagatataagcagataaaaattagttgtatgatttagatgttatagttgcttaattcttcaacacattttttttttcttttctaacttataaagcataaaaataggaggtgaaataggtggaaaagaggagaaaccgaggaaatagttgagggggcgtacgtgagtaaagtacgtgcagtaacgcacgtattacctacgtgcccatgaggcccgaatttaggagatgaatttttctaaggtaagtctaatgatggtaaataatgggtcaccaaatttcatgaaaatcaattattacatgattggttttttatcagaatttttaggactgcctctattttactatagtgccacgtgacagcttagaagtgtttgtaggatgccacactatggttaggagtgttcgtagaaagtttggagaaatcttagtctaaaattgtgttataaataatccagctaatttaccactcttacaaacaaagcgtaactcatgttgccatgcattgcaattactataagggtgtttctggttgttaaacaaagcgtaactcaggctgtgtttcagacactataaatagaagaacattcatcacacttcaaaagtacaattactccatatttttttcattagcattgcaatttaattaatctccgcatcagttatttatagtcttcttcatcatccaaaaatagacttgttttacaagaaaaataaggtagacttatttttttagaacacgtctctagcaaattaatctattttttatgtagtggcttggactactcacattgagctgattttttcttattcactgagcggaatgtctatttttggtgttgcatgtttatagtttgtgttgttgaattattttatagtcttttgtggtgattcaggtgccatacaaaatggcaagttgtgccgtccattgataaaaacatgaatttatattattttattattgttataattttgatatctgcttatatgtttgtagactgatgtataatgacaaaaatagatattgataatatttcttaaatgccaaaatataggcatatgaaacggtttaattataaatagtgcttaaaattattatcttttcagtatctatagttattggttgtttcacttttagtgtaataccccgtatattaaaagatatttaagtttttttaagtttgggttgacttgttaaaataaagatgttaacagaaataaaaaaaaagaaaaatacttttagaagtgggccaacatgagaaggcccataaacccagcccactagttctcccctagaacctagagagaggggaaccgaatctcacctcccctcttggtgccgccacccctctccctggccggcctccaatggcgcctccttccttccctcctcccgtgtttatatctctcccctctacagcaaattgccctcatagatctccaccccaagaacctggatcaagaagcaaagtggaaaaacggaacgaggagacggagaggcgtaggaggggttagattagactcttccctgttgtctcctcacaagttctctaaagaaaccctagttttgctccataggtgtggagagatctggtgtggagggtggtttgtcgggttgccgtcgaggttaaaaggcaagtgcatgacgaactaattgtgtgattcatggattgtttgctctatctatctatttccgttatatttctatgtaatatgtgatctcttatgtttagattgttgttcatgtcatttagattttaagtttatcttaagtttacgacgttattcttgtttcaatattttggattctggttctggttaaataattcaagttccatgcttgacattgatgtgcaatatggtttgaatttggttttttgtttccagtttcaattattcatgttccatgcaagccatggatgtgctatctgattttctattcatgttcctgtgggtaagcgcagatcacgcttactcggctttgccggcaaatgctaggatgtattcactattgtccgggatggaaactactgtttcaattcatgcctgcccgggataggaactactatcttctttgacttggtgtttgaaaatgtgtttcctatcaaagaaagaaagacttctgttcatgctttattgccaatgatgtgtatatgtattttctagttccatattgtacttgttgagtatttttgtactcacttttatgttttatttggttttaggtgtgcattgagaccgacatgcatgggcgggacgtttatctgcacactatcaaactgtattgcctaggtccataatgacacttcaactatatcatggtccggccttgtaataatattttagatattttttagtttttttccatggattatatggatagatagtgctatgggaatgatgttattattagtttaatctataattgcatgtcgtggatgtccgtatttacaggggagactcttacgaaattttttaatgaatttaggatttagtggtttctgtatcgtagtgtgtagcattataggtaagaaaatacctggggtgttatatttagtttatagctgataatagggagaggaggctggagaggaatgaatagcgtagagctcgagcgagagatggaaataggtgagcattattgtactcatgtgatgggaggagaattaggtggagggattttgtatttctaatatttctaaacgatctaagtggaaactgatgattttttttattttctcgaatgtcattttttttatctttaagacctgactttttgcagcttcaagatataatgattgaaaacattgggtgtaccgatttaactgaaaaaacatagctacatgttttatattttgtttgaatgtctaaacttaaaacgtgagacatggtgacttaagagcgctatagaggacgtttaatcaatctttatcatgtaaaatgattcaagatggcataattaatagatattgttaaattttgtttatgtttccttcttctttggtagccatgcaaataataacgatctacgttcaaaattgggcaggtttattttattaaatatatatttaatggatccacttgtttgaattatctacatcattaaatctaatgtttaaaatagtaggtttctgaaaatggacagtaagatgttctatttcttttatattttttctatattaaaattggtataacttccaaaattattagctatagaatagaataggattatataggaaggagagagggagtattagacgaggaggagacgtacatactacgtgtatgtacgtacgtagttgtagtgtggcccggtgggagaggggattagagggaggtgggtcatggtttttttcttttttaaagataatctaataattaaaaatagtgggtccaccaatttattagaatgccacgtggcgattgaggagtgacggagcgtggggctcctcaccgggagaccgcgcaggcccccctttgccggttcggccgggggccctgggtgagattctaagctcctagtctgtggaaagttcgcgagaatggaaaaagcacaagacacgggcgatgtatacaggttcgggccgctgagaagcgtaataccctactcctgtgttctggtggatctgtgtatgaagaagctccaaagagttggagagccagagagctcttactctagaaaccctcttctccctttttttcctctcctgggatctactctccaaatcctctctcctttccttccctttctttttttctcctcagtggccaaggtcctccttttatatctcaaggggataccacatgca

SEQ ID NO: 42421 - DNA, 16705 bp, Oryza sativa
tcacagaccggataaacgagcgcgctgcactggttacatgcggcgtgacgcgctcgtccaaaccgcaataaatgcggttaggtgagccccgttgtgctcacctaacccatacacgcggcgcaaaacccacaaggggtcggggcgcctcagccctcggggccgaaacgagagcggtccgactcctcggggagacaaagaggggggcggccacatcaccctcgggcccgacccccccgagggggtcaggccacgtgggtgattgctcctgccccaagcctctagtcatgatactcccggtcccatgtcaccgacagtagcccccggcgttatgccagggcgatcgccctcctcgagggaagcggtcgggcgtgacgccacttacttaggcctggtgacaagtggggctggtctctacagttgggcagaaacccaacggtcgcaaatcacacacatcggcaatggtaactcggctgtcaataatgggcggtctcttcaagactgccacattactcgagtagcacgcgaatcgggacgagccagttcgttttgcctggagatatggtgatggcgcttcggtcggcgagcgtaattaacgcgcgcacgatatgttccatctcgactgccacagccgcatatccacctcatgcgccgcaagcgggcgaatgggattagtggaagcgtgggcgcgagaaacgagggagcgagatagtgggcgcgagaagcgaggagccgggcacagcgttggcaagggtataaagacaccgaggaaaagatttgcttccttcctctcgccattattccccttgtctacgccgcttgcgccctaactccttgtttcctgtgccctaccctcgccacacgcgctcgctctcaaacatctcttcttccggcgtcatggcacggggctccgttccgctcgatggtagcgtgctgctgccttcccgcatcgtgagcgagaggcaggctgggctgccgcgccgcttcatggcggaatctgccaccggccgggagatagtcacgctgggcgagggacgcccggcgccacgctacccggggcggttcgtcttcttcctcccttttgcaatggcagggctggttccgccattttcttctttcttcatggatgttctggagttttacgatctccagatggcgcacctcacccccaacgcggtaatgacattggccatcttcgcgcacctgtgcgagatgttcatcggggtgcgcctatcccttcggctgttccggtggttcttcaccgtacagccggtgtcgccgccgtcggtggttggtggctgctacttccagccgcgggggccggtgctgaaccgctacattccctgcgtcctccgcaagaagtgggatgactggaagagcgactggttctacacccccctcgccgacgaagcgcgcctccgacttccgagccagccccctgcgcaggcctccaactggcgggcgccggtagatctgggggatggctacgacgccgtcctcgaccgcctggcgggcctgcgatcccaggggctcacaggggccatggtgtacggcgactaccttcgtcgccggatcgcgccactccagcggcgcgcccggggcgcctgggagtacaccgggtccgaggactgtatgaggacccaccggggggtcaaatgggactgggtccctgaagacttcaaggtaatgatccaacgggtgctgaatctcagctccgtggaggcatccctcatcccccaaggagtcctccccctctgcagcgatccagatcgcgccaacatcctgaccatcatgatggcggtcggggcctcagaggagcgagctcctaagggccatgacggtgcgagcgggagccgcaagggagatcaatctatctcaggagggggtcgtgcttccgggccccgtgatgggggctcggggggtagccgccctgccgacgcccgagggaagaggaagcaagagggtacctcctccccatctcctccccgagggggcggggcggcgcgggtcagcagcaggcgcccggagggggccgcgccgacgccgcagcccgagggggagcgaaagaagaaacggctccacaagatgggggggacagaaccatcccggggaaaccttatttcccctccaaggtggtcgtttaaccgaccccctcgcaggttcgtcccacgcccattgtggctgtattcattctcccaacacgagttttcattcacccatcttgtttgtcttatggcttttcttctgcttcagcgagatcccgtcgcgtccttcttgccaatccaagtccggccaatctgaggccgagaatgcggcgtccacggaggcccggaggcgggaatctgaccggcgagaagccgcggatcgcctatgggaagccgaggaggccgcccgggaggccgcccgggctcgccaggctgaggaagccgctcgggaggaggccagactccgccaggctgaggcgacgacatcctccgaggcaacccgcgaaactgaccggcaagaagccgcggatcgccttcaggaagccgaggaagctgcccaggtggccgtccgagctcgccaagctgaagaagccgctcgggaggaggccagacttcgccaggccgaggcgacgacgacttccgaggcagctcacgacaaggccgcgggcgcatcgcttgggcccactccctcgggcgacgctcaggacaagtcaggtccgggggatgtccccgagtccggcacgtccatcggcgggccgagccgcgcggcatcctcaccgaggcggctctcccccacgccttccgccgccccactgagcgcagagccccttctgcaggccttggccgtcgcaaacaccacggtgttggacgggttaagtgcccagatggaggccctgcaagcagagcgggcggagctcgacgccgcatgggcgcgtgtcgaagaggggcgacgctcagtggaggctatggtggaggtgggccgcaaggcacaccgccggcacaactcagagctcgaagcccgtcggaaggtgctgggggagatcgccagggaggtggaggaggagcggggggctgccctcatcgccactaccgtgatgaacgaggcgcaggacgacctccgccttcaatacgggagctgggaggcggagctagggaagaagctcgacgccgcccggggggtccttgacgctgccgctgcccgagaacggcgggcggcggagaccgaggtggcatcccggcggcgcgaagaagccctcgaggcccgtgccatggcgctggaagagcgtgcctgcgtcgtggagagggacctggcggaccgcgaggccgctgttgccattcgggaggtcacactggcggcgcacgaagccgcctgtgccgaagaagagtccgcactccgccttcgcgaggatgcgctcaccgagcgggagcgagccctcgaggaggccgaggccgcagcgcaaaggctggtggagagcgcgtccttccgcgaggctgcgcaagaggaacaagcgcgtcgtaatctggaaagtgcccgcgccgagagggccacactgaaccagcgggccgctgaactcgaggcgcaggcaagggagctggatgcaagggcgcgtagcggcggggcggccacgggcgacagcgacctagccgcccgcctcgcagctgccgaacacaccatcgcggatctgcagggcgcgctggattcgtccaccggggaggtcgaggcccttcgtctggcaggcgagatagggcccaacatgcttcgcgacgccgtgtcccgtttagaccgcgccgggcggtaggcgggtctctggggcgggcggactgtgaagtacgccgccaaccagggaggcctcgcccagcgcctctcggagatggccgggactctccagcggctccccgaggagctcgaggggacgattaagtcatcctcgagggacctcgcccgaggagcggtggagctcgtactggcgagttaccaggccagggaccccgacttctccccctggacagcgctggacgagttccctcccgggaccgaggacggcgcgcgcgcgcaggtctaggatgccgccgaccatatcgtccacagcttcgagggttcggcccctcggctcgcgttcaccctcaactccgacgaggagggcgatgacggcggtgtgggcgacagtggcgacgaggctggcgacccgggtgcatctgagtgagcccccaggcccccgccaatcttcagttttttcttcttttctttcttccaaggccttcgggcctcctttttgtatagattaacttaatctgcaatcaaaataaagaaatttctgtgtcaatttcattttgctatgtgtatgagatgaggatgatctgtgccgtggtccttttgtgtcttagcttgactaagggctcgtgcccaggtcccagtcctcaaaaggcgcgggtcggggctagtgcctggggagatccacgtgtcgagactggccaggccgggagcatggtgaccgagggttatgggtgacccgattgtgggtttttgccgattcccccccggagttcaccacgccccggggcacggctcggttctgggccccttttggcgattttagccggcccgagcccccgagggcaggatcgagcacgagtgacctatttcaagtcaagattcttcaaaagaaaacaacagcacagacacagccttttaggaaatcgaaaatgcttttattgaaatatagatagaagaaaaaatatgcatatgtggtagcccccggccaaccctacacgcccgaggggggtgcggggttggcccgagcccaaaacctgacacccgaactccattaggggtagaagcgacgaaggtgttcgatgttccacgggttaggcagctctgtgccgtcgcccgtggccagccgaacggagcccggccgggggacgccgatcactcgatacggaccctcccacattggtgagagcttgctcaatccagcacgcgtttggacgcggcgtaggacgaggtcgtcgacgcagagtgatcgggcccggacgtggcgctgatggtagcgccgtaggctctgctggtagcgcgcggctcggagggccgcgcgtcgccttcgctcctccaagtagtcgaggtcatctctgcgaagctgatcttgatcagcctcgcagtacatggtggcccgaggggacctcagggtgagctcggatgggagaaccgcttccgcgccgtagacgaggaagaaaggcgtttccccggttgctcggcttggtgtggttcggtttgcccagagcaccgctggcaactcctcgatccacgaatcgccgtgcttcttgaggatgttgaaggtcttggttttaaggcctttgaggatttccgcattggcgcgctccacttggctattgcttctggggtgggcgggtgaggcgaagcagagcttgatgcccatgtcttcgcagtagtcatcgaaaagctcactagtgaattgggtgccgttatccgtaataatacggttaggcaccccaaaccgggctgtgatgcccttaatgaatttaagtgcggagtgcttatcgatcttgacgaccggataagcctcgggccacttagtgaacttgtcgatcgcgacatacagatactcaaatggccatgaaagtggtatgatctgcagggcctgggccggctgatggatttgcttggcgtggaattgacacgctctgcaccgccggaccaggtcaaccgcatcattgagagccgtcggccaatagaaaccctggcgaaaggccttgccaaccaaggtgcgcgaggcggagtgggctccgcattcgccttcatggatatcggcgagaagctcgacgccttgttcccgaggaatgcactttaggaggattccgttagccgcgcgccgatagagggtcccttctatcagcacgtagcgtttggagatgcgctggacgcgttcactcccttcgcggtcctcgggtagagtcttatctatgaggtatgcttggatctcagcgatccaagcaatcaatctaagggagctgggagcgctcccctcgggtcccgaggcctggactccgacgggcctcgggggccggtcaggcgcgtccgtctcccctaaggggtcgggtcgcgccgacggctgggcaagcctttcttcaaaggcgcccggtggggtctgggctcgcgaggaagcgagccgtgagagttcgtcagcaatcgtgttatcccgtctgggcacgtgccgaagctctatcccgtcgaaatggcgctccatacgccgcacttggcgtacataagcatccatctgcgggtcagagcaccggtactccttacagacctggttaacgaccagctgggagtcgcctaacaccaggaggcggcggatccccagtccagctgccaacctgagtcccgcaaggagtccctcgtactctgccatattattggtcgcccgaaagtcaaggcgaaccaggtatctgaggacgtctccgctcggcgaggtcaacgtgacccccgcaccggcgccctgaagagacagggagccgtcgaactgcatcacccagtgggcggtgtgaggcagctgcgaggggcccgagctggcctcggggactgagacgggctcggaagccggggtccactctgccacaaaatcggcgagggcctagctcttgatagcgtaacgtggttcaaagtgcaaatcgaactcagaaagttcaattgcccatttcaccacctgtcctgtaccctctcgattatgcaagatttgggcgagggggtaagacgtaaccaccgtgacccgatacgcctagaaataatgtcgcagtttcctcgaagccatcagaatagcgtaaagcatcttctgggcctgagggtatcgggtcttggcgtcccggagggcctcactaacaaagtagacgggccgctgcacctttcggtggggccgatcctcttcgccaagggccgcatctctggggcgctcttcgtccaagcggcctcgcggggcgcacttgtcttctgtgccgacgacctcggggtcggaggacgacaggtgcggccttcccacagtggcctcaaggccgtcctaggggtcgggggctcctggcgtcgtcggacaagcgggcaaagggccaactccggtcgtcgggagccttaggccaccgttcggctcgggggcctcttctccctgctctctcctgggtcgagtcggcacaggattaacctcggggtcagagggcgataggtgcggccttcccgcagtggcccccgggccatcctgggggtcgggggcacctggcaccgtctgacaagcgggcagagggccaactccggtcgtcgggagccttgggccaccgttcggctcgggggcctctcctccctgctctctcccgggccaagccaacacagggtggggatgcgcggaatgagggttatcctcatcgcgctccacaaccaacgccgcactcactacctgcggggtcaccgctaagtagagtagcaagggttcacctggctccggggcgaccagaaccgggggagagctgagatacgccttcaactgagtgagggcacgttcagcttcctccgtccaggtaaacggctcggagcgtttgaggagcttaaataagggtagcgccttctctcccagtctcgatatgaaccgacttagggcggccatgcaaccggtgacgcattgcacatccctaagtttgctgggggggcgcatccgctctatagctcgtatcttctcggggttggcctcaatgcctcgggcagagaccaagaacccgagaagcttgcccgcaggtacaccaaacacgcacttatcggggttcagctttatgcgggcggagcggagactctcgaaagtttccgccagatctgaaagtaaagtttctcggtcgcgcgtcttcacaaccaagtcatcgacataagcctcaacattacgtcctatttggctacccaaagaaattcgagtagtacgttgaaaagtaggacctgtattctttaacccgaagggcattgtcgtataacaataagttcctatgggggtaatgaacgcagttttttcctcatcctccctagccatgcgaatctgatggtaaccagagtatgcatctagaaaacacaaaaggtcgcaccccgctgtggagtcgacaatctgatctatgcgaggcagggggtaagggtccttaggacatgccttgttaaggtcggtgtagtcgatgcacatccgaagcttgtcgttcgccttgggaacgaccaccgggttcgctagccactccggatggatgacctcacggatgaatccggcctccagaagtcgcgcaacctcctcgcggatgaaagcttgacgttccggggcctgccgccgcactttctgccggaccggctttgcgcccggccgcacggcgagacggtgctcaatcacctccctggggaccccgggcatatccgccggtctccatgcgaagacatcagcgtttgcccgcaggaaggagacgagcgcgtcttcctatttgccatccagaagaccaccgattcgtgtggtcttggacgggccgtcgcccagggcaacctccttgaccgggacctcgtcgcatgtgactatccgctgcctcggggcggcggagacggaggtgccaagcctctcgtcgccaccctcaggcttggacgcagcggcgaggtggtccacgcgctgctccatacaagcaagcgcgactttgaggtcgccatggacagagatggggccaccggggcccggcatcttcatctggaggtaggcgtaatggaccgccgccatgaacttcaccaacgcgggcctccctaggaccgcgttgtagggcagactgaggtccgccacatcaaagttcaatcgttccgtgcggaagttggcggatccaccgaaggtgaccgggaggtcgatatgacctagcggccaagtgtgccccggcgtcacaccgataatcggctgggacggccggagcaccatccccggggccttgatggcgtcaaaggctgcgggggaaaggatgttgagggctgctcccccatcaatgaggacacgccccagcttcacgttgcaaacagtgggggaaaccaccattgcgatctgtcctccccgggcaacgcacggtgggtggtcggtctggtcgaaggtgagggcaacctccgaccaccgcgcccggcgcgtcgcctcatgagtaggggccgcgaccagaagctctcgcttcatggccttgaggctccggcgagaaacgtgagcacatgctcccccatcgacagtggcaatggtggccccaggctcttggaaacctaggtcatcatcgccgtcatcgatgtcctcggcgggggccttctgcttggcctcacttcgccgattgccggaaggaaccgccggggacttgccctctcggcgctcctgcctcctctcctcctcccacttcctcgtccgctcagccaaacttttgactgcgcggcagtccgcgaggtcgtgaagggaggtgttgtggacggtgcaccacttgccggttgggcgctccctgctgggagcgctggcctccttctttttgtcgctcgcaggcctcccctttcgggtggcccgcgaagcaccctcgacggcgaggacatgaccctcgtcgtcggaatgggctgaccttttcttcctcctcctgtcacgccgccctgtccgagcagcggatccgggggcggccgaagctgccacaccggaaccggaggggttccaggtccatgactcctccttacgagccactcggtccgcgagctgaaaaagctccacggtagtctggggctccttggaggcgatcttttcgagcatgcggttgtgccgcacaccccccctgaacgcgtagatcaccgcgtgtgcagggatgcatggtatggtgttgcggacttgacagaaccgctgaatgtatgagcgaagtgactcatcatcccttcgctgtactgcgtgcaagtccgcttcctcacctgggcgcggatatgtgccttgaaagttcatggtgaactgttggcacaaatcctcccaagagtggacggacgcgggtggcaagttcattagccaaccccgcgcctgtcccttcagggccatgggaaagaaattcgccatgaccctgtcgtcacccccggcggcctcgatcccggtcgtgtagacctggagaaactcggcggggttgacgctcccgtcatatttttcggcgatggtgggccggaaccttgggggccaacggacgttccgaaggctcgccacaaaggctctacagccgacaccaccaaccgggggcacggagggctgatccccgcgtccgtgttgaggtgacactccggacgaggaggcgccctccgttgcgtggggagcacgtcggccattacgccggcgctcgatactgatgcgggcatccggccccccacgcagatcttcccgggtcggaggcgctgacgaaggagtggcggccgaatggcgaacagcggccgccgctcgccgcgccctccgtcttgacgacgcggagccggtggtagcagtaccagaggtcttggtggcggaggaccgcccaccagcatctaggcgctgccgcgccgtcatgaccaagttggccacgtcgtccagccaacgttgggctggagactccgggtcagggacgacgggcgggtgacgtaggagcgcgcccgcagcttggagcgcgccctggggcgtgctaccgtcgccgtagacgaggaggcgacgctccccatctcggcgcccttctccatcacccgtggatgtcgaagtcgcggatctttcgaccctctcgagcacctcctcccgcctaggactttggcgtggagggggcggtggagtacgagctcgacggcgtgggttcggctccccgtcgtcaccgctaacactcggagagaggttgtgcgcctttgcttgttcggccattgggctgaacaggaaaagcttggcgcacacgaaagaatgcgagagcttagaaaaacacacgcagagccccctacctggcgcgccagatgacggagcgtggggctcctcaccgggagaccgcgcaggcccccctttgccggttcggccgggggccctgggtgagattctaagctcctagtctgtggaaagttcgcgagaatggaaaaagcacaagacacgggcgatgtatacaggttcgggccgctgagaagcgtaataccctactcctgtgttctggtggatctgtgtatgaaaaagctccaaagagctggagagccagagagctcttactctagaaaccctcttctccctttttttcctctcctgggatctactctccaaatcctctctcctttccttccctttctttttttctcctcagtgggcaaggtcctccttttatatctcaaggggataccacatgcaccacctctacctatctctctttttggtggggactttatcctatctttactcaaacttggcttgccttctctagaaagctaaaaacactgcttgtttttgagtgtggccacgcgtcctcactcgtctaacctcggggatcaccctgtcatctcttcataaatgggcggagacttgcaatggctgctgtccgaatgaccttctgatgggatggcccatacctacctccactccgccagaagcaggtgcaacgtgggtacatggttgtctgccgacgacatgaccagtgtcagaccggtcacaaatcggtcattcttgtccaccacgtgtcagtctagcaatctgcatgttcgcccttcttcatacaatatcttgcttgtaatggttgggatgaagcctggcatatatctgaccgggaccaacgtgccatctccaggagctaacacgccggctccggctagggacgagtgctcggaggctctcatcctgacgggatggggcgaggcgtgcgtcagaccgcctgtcgccacctaacccacgatctgatcggtctgtgaccagtcacagaccggataaacgagcacgctgcactgcgttacatgcggcgtgacgcgctcgtccaaaccgcaataaatgcggttaggtgagccccgttgtgctcacctaacccatacacgcggcgcaaaacccacaaggggtcggggcgcctcagccctcggggccgaaacgagagcggtccgactcctcggggagacaaagaggggggcggccacatcaccctcgggcccgacccccccgagggggtcaggccacgtgggtgattgctcctgccccaagcctctagtcatgatactcccggtcccatgtcaccgacaaggagtatttataggaataacacgtggtggtttaggagtgtttgtagaaagtttaatagacttttagtagataatagatagatagatagatagatagattatccatgtaaggattagataaaaaaatataccatatactgctctgtatttgttatcagttggcatgaattttacaagtggcttgagacatctgtacatttatagagatcaaacaaagcagaatactgaaaatattaaccatatacttattgtataccagggcaccaccccatagaaaagctcacattttagatctagctaactaaccttctattatttaacataaaaatgaacgtatatgttcacacgtatattctgggtacagccgtatagggagcatcagtgtcctgctaatcctaataaggatatggactcatcctaagtaattgatgagtaactcaggccacgccctaagttccccaagaagcaaggcttccattcttgttaaagccactgctgcattttataaacaactttgtggctaattcaattgcataaggctacacatatgaaaggactgctggctagatgtgctagaagcataatctcaagctgtgaaggagtagtagatcagttcattcagtatttcagttgcatagttgcatgccataggttctttcaagctcacacatgtgagccacaaagtggtgctcttctccattggtatctccagttttagaggtaactaatctatcttctctccacttttaacataggcatttatcacaataaatatatcaacacctcaaattttaagaataatatcgacaataatgatatggcctatttttgtaactccttgttacacatttgccatgaaaatagtgcaacgttagagaaaaattgcttgacggacacttgaaaagctgaaagcaagagatttgtctttcagtgggattgaaggtgggattgaagataactccactgtctaaaaaaagaactatgatatctgttgataagcagatgaactccactatctatacaatggttttcctacagccactgagccacagggacttcatatgtgttcttctcacattgaaatcgaaataacatttacatgatcacaagaggaaaaataatcctgggaatgaaacttcagagagttctcgtcgacgaacaaaagaccgtgcagatcgattactttactttagatctttgaataatcacgcacctttttgtcccactggacatattatatacataaaaaaccttatttatgagaaaccagttcaagtatgaactaaattaatttttttcaacttcagtagacagtgagttacctcatgaacatatgcttgtcttgtgagctattatagcagaataagtaccataagtatgaactaaattaatttttcaactttagtagacaatgagttacctcagaatatatgcttgtcttgagggctattatagctaaataagtaccatgaactgcaaaaaatactaaaactttcttcaaaaccaacaactgcaaccattgcaccatggagcccattctccaacgaaaggagagatagcagcgaataactaacctacagtgggcataaaagatcatcaacagtacaacctttgcagctaccaatttgaccccttttatcaactttgcttatttgacccttcttttcaaaattgaagatacggtatgaccctattctgttaagggtatctaacggtgttaactgaagcacaaaatatcccttctgcccttactcatttgaccctataacatgtgggacccacccgtcagttctctcttctcctctcctcctctcttctctcttctctctccacagcgagtggcaagagggcgagcccgtgccagccggcagctgtggagcaccgccgccactcctcgtcgctgccgacccatccacttctcatcgtcaccgagccgtccactcctcatcgccggaaagccgtcgtcgtacactcgggatccaaccgtcactgctccatcgccgggctcgccgccttccttcatccccgtatgtcggcggcgcctcctctaccctccgcgtaccggccaccaccgccgcccctccctcgctagatccaagaactcgagctccaccaccgggcccgcctgcttccttcctccgcgcgccagcagcgccacctcttccctccgcgcgccggccaccgccgccccagacggcgcgcaccctcccaccgtgcacaggcgctgccgccgcagccgctagggatccgccgtcacgaccgggcgccagtgcggatcccctccacgagtgggcactggcgtgggtccgcttcacccgacgccgccccctcagagcgtcaccaccttgcactcccatgccatcgccgcgccgccgctgcaccctcagatgtcatcgccgccgcaactcgcacgagagacagaagcgtggatagggttgagtgaataggggtttctaagggtattctaggcattatgaatattaattacatttttttttgaaaaaaaaacaaacctgaacggagtagtggaaacagggtcaaacgggagcttcgttttttaaaaggagggttaaataaacaaactgcaaaaagtagagtcaatttggcagttagagttcaaaatagggtcaaataaacaattgtccctttattttatagaaaaagaaacccaacatgtcttcctaggcactctgacattttgtctaaactatgcatatttcttcatagctagctgagggaggtccatatcttctctcagaattcatgaaagtgcatacctgaaaacatttgtttctttaatgctcaaacacatgtatttattggaagaactcacagttgcccaaattgagacacaaagaagtacctacaatacacaacattagctcaggaggcccttggcttcctcttaattcctgaagcccgtttgtagatgtcatggtatacataggattgtaaagggtctttcccacctcaaaagcaagccaatgaggtgaggggcttccccacttatattttagttcctttgcccttctacaactaatgtgagactattcaacaatctccccccttcacaagttggtgtccctcagccctccatcgccccttcaccgtttccccacggtcccttaggtatacgggccctgcaggcaccacgattcatcaggccttcacacactatgtctctcgagctagagatattgaactagccagggtttgataccaattgtaggattctaaagggcctttcccaccctaaaagctagccaatgtggtgaggggctcccccacttatatcttagatcatttgcccttccacaaccaatgcgggactattcaacagtatattcaattttcctgcacccatggaacttgctgcatatttcacccaagaatccacgtggtcacatcaagcccaaaatgcattttcagatacaaaatatatgtcagtccataggggcagaactatagaggaaaaataatttgtaaatttgcaaagtagaacgtgatgccatgaagattccatcaaccatgtaattaacctacttataggaaatcaacctacaacatgtatacagaaaatgaaacatgtatccagcagcatcgcctttagtccaaaggcattgcgagggatggtacgatgttgccactgcaccctgctatgagatcaccttctcctgcctacaacctgagaccaccgaccagtggagcaagagaggatggatctaaaaaaactaaatattgtttccattagcagactaatgaacgaaagcttatatcttcggcggaagcggggaaccaccttggcttcggcggctggagatgacctcggctcaggcaggggaagcggcggctggggacgaccttggctccggcaggggcagcagcggctggggacggcctcgactccggcgggggcagcagtacgtagcactacaacaaaaaccttatgtagaggctcttttatagagacaattctcaaaatgcctctaagttttgaagctctgtagtctagagacactttctagaggcactttcaaaatcgcctaaaatatgtttactctagagacactttagagacatttttagcatactttgttaaatttatcttatagagacatcttttcggcacttaaaatttgccatatatctaaaggcattttcttaagacatttaaaacgatgtaaagacatttttccaaatattaatatatatcaagtaattagatataagtaacacaaatcacatatttgcatgtaattatatgaggttgagatggttagtgcattgaatataaaaatggtcaactcaagagatcatgagttcaaggattggtaagagataatatttttcttttttttcatattgatttgctatagttgccgcaacatattaatgcctctacaaagtgcctctatttgcatagagatatcttataaaatatctcttagttcgtagagac

SEQ ID NO: 42422 - DNA, 2430 bp, Oryza sativa
ttggtgaattgtctctacgaactaagacatattttataagatgtctctatgcaaatcatctcacgggagcagagtaaacacgcggtggaggaagtgcgggcagaaatcgtgatggagagggtggaattggtgggtggtagccggttgggacgggtgtgatgcgtgcgacgtggatggacggtagggatttaacctgttgatttcacctgtaggattgctagggtgaactcctttttatattactagaaaagatgcccgtgcattgcaatgggtaaagccaatttattttgtacatatatgtctgtggataaataatcacagtacattattttgcttattcatgtgcttatctgaatcacttattacaaaataaaaagattatttgtgtgcaaatattttatatatatgttcttagcgactcaaaagcaaatgatataaaacaaagtacgataaaaaaaccaagaactcgaattcaaattaagttctaaaatttaaaattcaggttataggaataagcataagccaaataataaggccttcaaacacaagttcgatttatcgtccagttttatcctaagttgggtaggaattgatgacaaacggaatcagcaacttcgatcatcctttatttcaattggcatgtttttttcgaaagtaaaattgattcttatggattatggtaacggtatccttgttagtatgtacgggcatgtgtggagactgacttaaaatcatgctaacatatttcaggaatcgcgtcgtgtaatacgaatagaattggatgatctgggcaatgtacgtaatatccacactgacacacggactctgcaagtttcgttcgcttggtatccacattgcacaaactctctttcgcagttcgcttatgagtcatgacttcgcaatgaatgttccgcgtgacaggaatcggatacgaatgacgtaccataattttgacaaaaaaaaggcatcttcaatttttaaattgcaggcgagacgacgcagtcccaatcagacatgcggcaagggaaaatcacgcgcgtgagggcattgcaggcccaattagtcacgcggaaaatagcgagcacgagggtgttgcggtcccaatcacgacggtgcacaaaggcgcgtgtgaaaaacagacttaggtgcgggcctgaccactgcgtgcgataaagggcgtgtgaaaaggtgcgggcccatttaattcacacatgtctcgaataagagggatactctagcgacgtaagaaaaaagggaaggatttgacataaacataaaattaaaatcgatctaaatacggatgacataccaaaaattctggtgaacgcaccacaatgaacaatttttataatagtagtgactatatatacgcttcgctaagattcgtgtagtaagtacgtaatcgactgtccctggtcaagctacgtaaggtgattagttgtcgtaggaaccacctaattaaatagtagaatctgtttttcttctcgtcctgattgcatccttttgctttttgttttcccaacgtaaaatttaaatttataatgaaaatacattaaaattacatatgtaattttagaacttatattgtaaatatattaaaattatatatgtaatctttaggacttataatgtaaatagttgactattttttcatgaaaaatgaaaaatatgacggcgtagttagtaaaaaaaaagtcgcccgtgcgacgagaaaaaacgtaattaatcacggagaaataaagggagcgctttcccttggaaaaaaagagccatttccctgaaaaaaagaagaaaaagaaaggaactagcgcatgtgtgggcccttggctgctaaatcgcgtttccgcacgttcaaatgggcctgttcagtacgccgagggaaagaaaggagaaagtaaagcccgatgtgggatggagggtcttaggtagtttttggtttgtgggataggatgggatgggatgggacgaacccattttgagaggtgtttggttgaggagcgagtgggatgggttggcccctataaaggaatattcctcccagatccgggacaaacccatccggcaaaatcggtcggacgagctcgtcccacttggacggagcacacggcgtctcctcggcgaccgccggcgctcgtccgcgcccacgcccgccgccttctacgtgaccgccggcggtcgtggcacggcgtctcctcggcgatcgccggcgctcgtccgcgcccgcgcccgccgcctcctctatgaccgccggcgctccgccacgaccgcctgccaccacctccacgaccgccgacgctcctccacgaccccctgcctcaacaccggtcgccgccacgagcgagatgctctgcgccatcccgccgctcatcgcgatgctcgacgagagcggctgcggtgatgtcgatgcggcgggctcgaatggcggcgaag

SEQ ID NO: 42423 - DNA, 63675 bp, Oryza sativa
  unsure (1)..(63675): unsure at all n locations
nnnnnnnnnnnnnnnnnnnnnnnnnnnnnnnnnnnnnnnaacggtatgattagaattttacaaaatttcagtatcacctagccaatttcatgtatagcaatgccattttttcaatgtggcaaatttacaaaggcataggtcatttaaccttcatactaagcccctctttagtgcctccactttcctttcaaaataatttaaaagttaatgtataaactaaatcttatagtgtaattaccgcctaagttttgatttttacattgtaattacaatgtaagtgtacgtagaaatatatctattaatctcattttcatgcacgacagcgctccctttaacttatcaattaattctacgagattggagaaagcagttaataactaataatgcctacattctcatatatatacatagattattttcctctccaaatatacatagataatttgatgatgtcatagaatatctatgcagccaaaccacaaaatcttaaactgttaatatagacagaaacaataggatttgtattgatatgtaaaaatgatattaatagattattcattgtgaaaaaaatatttcatatagttatattgtaataatttttataaatagtttccaaaaacaatagagaccgcgtcgatgcctatctatactttctataaagttaaatcccacttagtctaaaactcaacatgcaaccattccatatcatcgaccaatagcaataatacctcatgcaagcatacaacattatctacaatttatttaattctacaaatcaacatgcaaacatatctaatcatcatctctcatatcatttgcacaatattttaataaatatatctatcacttttacaatatttaacatatacttattaatgtgtttaagactaaagcaccagtatcatttgacagataaaccctaatatttttttttctttttactcctagattgattgtcaaaaaaaaaatttattgagaattgcatacgcagtcaagcgcggggaatcagctagtaacgtcaaataaaaaataacggagatagcagttcaaggaggaaattagtaattacagtcactctctttgggatcacgcgattggcatctgggcattcctgtccctgtccccggttaatttgtcacacgcggacgcggtccattaaatattcgcaacaacaacgtatatatacaatctcaaagctcttttaatttaatttggtcggcaatccaatttacttttgcacttttgcatttgaaatgagtggcatttgaaaaacaaccacttaattatttgttggcctttacggagcgaataatcatcctttttctcgggttggtgttacgttttcttctgtgttaattaactttgtttgtgcgcagggatatgtatgattggacctttttttggtcatgcttcatccagtgcttatgcattggattttcatggacaaattaatatgtatgttattgtacgcttgaggagtgaggacaaacatatgcgacctgtacggacaataatatgcatgcacattattgtggagatcaatcatgcattcaacatttacagaaacctactccctccgtttcaaaatgtttgacaccgttaactttttagcatatgtttgaccgttcgtcttattaaaaaaaattgttaaatatgtaaaactatatgtatacatgaaagtatatttaacgatgaatcaaatgatatgaaaagaataaataattacttaaatttttttaataagacgaatggtcaaacacgtacttaaaaaatcaatggtgtcaaacattttgaaacggagggagtatataggtagatactaatctagcatcaaaccagagtcaagcacgcctagctagctatctgcatgtcaagccaaatcgatcaccccccaaacatgagcatatatgcacaatatatatcatccacctaatattatcctcgttttccttatacctaacatggctatatataagatgcaatttcacctttacatattggaatttttaattacaatgtacaccatcttcaaaaaaaaaaacaagttctagttatgaatctagacattgtctatccaaatttataactaggaaccttttttctttgaacgaagggtgtattgtctatttttaaatttatgatgttgtttacttgcggatatattgaccagctgtcttaactgtccataaggattatgtatttttttacatgtttttatcattaaagacactttaaatatgacgtaatttttatatttacactaattaaaattttagaataagttgaatggtaaaaaacgctcatgagtcgattgtgtcatatatttataaaacagatggagaaccaataaaattataatgcgtatgaaaattttaaaagtgagtcaattcgtaaccacattaaaggtgtgtttggttgctggttacactttaccacaattaaggttagacaagttgtggtagccacaaaaatgtggtggataaattgctatgccacaaaagtgtgataaagttggcaaaaaaaaagagtctataacttgtgggacaatgttattgaaaagtgtggcaagccacaattgtaatataaaccaaacacatgtctaacaaactgtaagtacctaaaagtgtggaagtgtggccataaaccaaacatcccctaagactatgtctggtttaggtctttaaacatattatttctgcaaattatttactcaagaaattaacttaataaataacttaaaacattggtgtaattaatgaaatagaagaaagtaaacatagtttttaaagcccgaagcgataattaatctattttaaacctggcttaattaagatagtttttgccttatttgtgatcaaactaacccctcatataggaaaagattgacagcatagattactaaataagaacgaagacattatatataaacaaatcattaaccctcatcaactagataattgtctttgatctgtaattaacgtcagtaaatcatgcaattagcttcatggattacatggggacgctagcttgccggcatatatataactggaaagatctgctcatctgcatgccttttctgacagggactcttgccgtactgtcgacgagcaaaactagggtgccgacaaataatggggaggacattatttactcagaacatcgatcgaaactccagtaaattatagatgcattcaactactttgcttaagcaaatattaaaccgatgaatcgcctgggcctgcaagttttgataagttaattaattgccaattaggtctatatatatatatagagagagagagagagataagttgacataaacaagaagttctttaattcgggctagcaaccagtacactgtcaataattccgattaattcacgaggaatgatatatatcaaccattactatatttaagaaaaaaaagccatcgaggtgctgtttatttgtgacattattaatgttttagactaatgtgaagttcggactgtttccaaaacatattaacagtccctgcatccgtgccaattgctctttctgaattcaaggacttatttagttgggaaaaattttgggtttgattattgttacatcaaatatacggacacacatttaaagtattaaacatagtctaataataaacaaatcatatatcccgtcaggaaactgcgagacgaatttattaagcctaattaatctgtcattagcaaatatttactataggaccatattgtcaaatcatggcgcaattaagcttaaaagatttgtcttgcaatttacacgtaatctgtgtaattggtttttttgttttgtctatatttaatactttatgtatgtgtacaaacattcaatgtgatgatgtaaaattctttgttttgataactaaacagggccaaattaaccgagcgttgttgacgtacgctgacatcacgacacacgtcatcatgccagaggaagcttgctagctaggctaggcggccatgaaagaaagagaacagaatgggttgtcaggtcccacttgtacaccgtcaaaataataattctcacagtggtgatgctgtttaactaggcaggcatgtacagctagtacagaataatttcatttcagattcttcatctgcaacagctgccgattcatgcatgcatatatatagcgcatcacatgcatattttggaaattaattactgttgaatccacgaaccacatatgaagtatagctaaattcttttccctcttttagaggacacatttctcttttttaaaattttgaagacaagattatacttatacagctgtggtgtctaattgggccttaggcttttggcggcccagtagtaggttgagattctgcttgatggattctttctagaatctggactttctagtcattctaattaattgattactgtatcattatatttataacagaggtccttttaaggggaccatacacacattgtagcaaaggtcaatagataaggttaattcacagtgtgataagttaatctgtctactaattatttgggaatcaatcacaattgtttgtagtcttggcagaggaaggatgaaatcgaccagtgatattccagttctgtgcacaagcagagataattaacccaacatggatattgatttatacaggtagatgtataaaagtgatcagaagctcctctataatgaagtaaattacaggcaaaatgtgggtatatgtggtggttgattgtttgacctgcagtcaccaccctagctaaaataacttatcgtgtggtttcataacaaccaagccacatgattcctagtttatttatcatggagataaatgttacacatttgtttaccagcatacaagacctggacacgtgcaattggggatcgtagtacatatctagccagatctttctgctcatttagtttcatggctagattttactatgagttgctttatgaatcaaaccagaaattctgtactgaagtatttgtgaatgtgtatatttgtcatgtagtaaaaaacacgaatattagggaacgacctaatatgaaataattagaaggggtgagacttcgaacccagatcatttagcccgctatcttgtggagctagccggaagacgacccatgggtgtttgtcgtatttgtcatgtagtagtgtttatattctccattattttttaaaatttttttaacattagttaatcataatttgcatttttttttaattatgacgcattcagctagtatatattcaaccaaagttacaacatttccatttttgtccgattaacgagggaaccacttatgtgctagtagtatatatataatataatacacgcatgcatggtaccagaccagctcataattttcaggtactttggtatgtcattcgtgtttgactcggtttttaaattcactcgtttttaaaaatacatatatgtgtttgagtcggtttttaaattcaaatgcttttggaaatacagaagaagagtcgtataagaaatctctttaaaaaaactcgcatgctaacttgagacgatcagactcctaattgccgctcatgattctgtaaaactaaacaaatccaagcgaattctcacggtgaattttaccttaactaaaccatataataataatcaaaagaaacctcacgcgttgcaatgcacgggcattttttctagtctgattaaatatttaaattgccacatgaatgcatcaagagcatgaacttggtataaacagaaactaaatccgaagttccgaaccaaaccaaatttggcctattatttttagaacctcacttatgaaatatttcccttgcaattatgtacgcgttcctaaaatccttgcgttccaaattaaggaaatcgctgtgtacacaaaaattaaatccaaaattagttgcttaattattacaggtgatcaaaagtactcccttcatctcaaattacttgttctagatttgtccttaattggtcaatgatattaatctttgaatatgaatttatataattaaacttatatagtttgacacatcacaagatttatatatttagatttatcatgagaaatcctatcataatgttgccaaaccatgcagattttcaaaaattaatagtcaaagttagctagctagacacatttgatttataataactaatccgaaacgactagtaattaagaccacgtttgattcagtttaggattatgataatctgaattattaggagtaagctgaaacaaacagatagcttattatgattgattattataatctataagccggattattataatatgataatccactctaaaggtgctttttctaaattattgggtgaataacagctaataatccagagaatcaaaaggctaacagcttattctatgtcagtttattataatccagcttatagtaatctgatttaataatctatattataataatcttaagctgaaataaacaggcctaagttgaaacggagagagtacgtagcaaaatcaatcagagctgggtgcatatgcaacgaattaaatcggagatcgaacggtcgatcgaaactaaagcagtgtactgcatgcaacggcttgcaatgtgtgtaccagtctaaccacttaggtacttaaaccaaccaaaaaagtgtaagcaacccaacgaatccttgcatggttcgtcaaccgtacgtacatcaactccaaatcgggtccccgtaactatacggcattatggcggcgctatatatttcttctatctatctactctctccttctccagatattttgacgccgttgattttttaaaacatatttaaccgtttatcttatttaaaaattttaattaattaataattcttttcatatcatttgattcattgttaaatatgctactaccacttaagtttttaaataagacgaacggtcaaacatgtttaaaaaagtcaacggcgttaaatatttagggataaagggactaattaactatagattatatatataataagatttacttcggttcaacaaaaaaatatctcgagatatcggtaccaaatcattttctaattgttgaatctaacaatgcacatcctgaccagctcgatccaacgatcgaaaacaatttggtaacgtcaggtaccggtatatcgagatacttttcgttggaccggaaaaaatctcatatataatagccatagttagccacacaatgatgggttgcagctgacacacactgccagtactacgtggttatactgctaatgcgtcattagctcagttaattagccattgagaggcgagctcgatcgaggtgaggaggttagctcagctgtcgctgtgaacacggagctctctctctctctctctctctcctctctcctcttcacccgctgccgcccactactactaaaacgggcaactcatccacctcctcgacgcagcctcactcctcctccattgctacctcaagctccagctcgagctcgaggctttgctttggccgcaatgccggagctggaggtgtgtagccctgcgtcgtcgggtggggcgtcgccgccggagtcgccggtggaggggaggaggggaggaggaggaggggagaagagggggagatcaggggatggcgggaggcacccgtcgtaccgcggcgtgcggatgcgggcgtgggggaagtgggtgtcggagatcagggagccccggaagaagtcgcgcatctggctcggcacgttcccgacgccggagatggccgcgcgcgcccacgacgccgccgcactcgtcgtcaagggccccgccgccgtcctcaacttcccggacatggccgcctcgctcccgcgcccggcctccgcctccccgcgcgacgtccaggccgccgccgcccgcgccgccgccatggagcccccccagccgccgccgtcgtcgctcaccgtgcaggccgactccgccgccgccgcattcctgacgcccaagaacggcggtgtcagcggcgccggcgcggcggacgacgagctcgaggcgatcgtcgagctgccgcggctcgacgagctggacgccgccgagctcgtgttcggcgccgcgttccaggacacggcggcggaacacccgtggtgcgaccccgtctggatcgacggcggctacgcggcggccgccgcggcggcggcggcggccgcggcgcacgacgacctgttcggcctcgacgccgaccaccatggatgggcccagtcggttggtgccctcttatggaacctgtgattcgatcataataataattaatctctaattaattaccaagtaattaacagctctagcttctttaattttaatctctccttttttttccagcttcctaaatctgtacataggtttccagttttttttcttctttttttaatcttttttcaggcaggcttaatatatatttctgcttgattttttcccctttcgtttcaagtgtcctgtagctttgcctttttgttcagtttggggctcttgtcttctgaatttgtcttccctcttgcctagtggctctacctgcagagtgtcaactaagctaagtcattaatgacttaattatgtataataaaaatctttacatgcaagcactacattgttaatttggccatcaatggtccataattgaatcctcctcctcctcaaccattactatattatcattatatactccatccgtttcgaaatgtttgacaccgttgactttttagcacatgttttaccgttcgtcttatttaaaaacttttatgagatacgtaaaattatatgtctacataaaaatatatttaataatgaatcaaatgataggaaaagaattaataattacttaattttttaataagacgaacggtcaaacatatgataaaaagtcaacggcgtgaaacatagggagtatatgtacaactcctagctagcagctaggttcctgcatgcatatatattcagtgcagggggcaattgattaagcaacaacttcaaatgacggctttaatttagtaccattgctatcaattgggtaattaactagctagtgttctttgatcactcatcctaattataaagtgtaaggaaaaagtagccgaagcactactgactagtagtactgaggcagccatttttgtgcgtgtggtgaaaattgaacttaacttaatttgatcaaaatgtaactttctttcactgctttagtaattatttggtcagcaactagtccaacgggccatcttttggcttattcaaggaataagtaaaatggtatatttgtaaacgaaaaataatttatgaataaaacttttatatacgcgttcttggtgatataaaagtaaaggttgaaaaataaaactacaattaaaaaaaccctagaatcaactctaaatttaaaattaaaaatttaaatattggcttataagtataagcgaaaaaatgagattgcaagtacgctgccgtagctagctacacactttccgtcctaaaaataattaatttttaaggatgaatttggccgtacctccggaagttgatattttagggatagatgggtataggtttaattgtgtgcttaattgattaattaatcctatatatatatatatatatatatatatatatatatatatatatatatatatattgattattatttgagagagggacacacacttcagtacatctctctcacggacacgcaaaagcaattaagctagctagagagttgtctgttgtattttttggatggtgtgaaattaagaaagcaacaagatatatggctcaatccatgtaatgcaccccaaaaatatcgccatgcatctatcgtccaaatatttggttgtactatacctttttttttttttggttccatccttttgttcgtttcttgtcatttttcttggacagccactgattggaagagagccatttccagtctattatatagctaggttgtggttgggagagatgccagctccatctgagtaatgactggtcagaggttttctccaagtgaacagtgcttcttggtgtgcatgtcaatatgcatgtgtgtggttttttcagaatattcagagttttgtccaggtccaagtacgtcatgctgctgctaggtagtaaggcttgtctgcactgttctggagtgagctcgattaattggtcgcaaatgtaatccttcagacaatgcgcagagagtttcacaggaccaccacatgggagagaaaaacaaaaagacagatatattactccgcttaaaaaaaacttaatttctgattgtgtaactggacaagtatttaaaaaagttaatgttttcttaaacaacttaggaggagtttttattagctttttgactcagctacctttctcatctatcataaacacgtttttcaaaccattaaatgatgtgtatcgtaaaaactttatatatattcttttaaaaaataaatctatttttattttataatagttagtacttaattaattatatactaatacctaatctcattttatatgccgctaaaaatctcgacctatatatccagctatatatccccacattcggacaaagccaaattgagaggagggagtactagatttgtgtgatgcatgggcatacgcaacacacggacgtgcgcattcagggattgatttgtacttgtgaagggaaacaacacaatgaacgggtaaagaaaaggcgagtcatcatacagggtgtagggatatgcaacaagttgtgaaagcaagagagatgtgtgtcaggtgatcaggaccagatcaatgtagtacacagggtgtgggtactcctgcatcttgcaaaggacaggattgactgcaacagtgcaagtcttcctggtaaaatctgatttgggaatgaaacactggaacatgccgagctagtgtacgtactacggattacggatcaaactgtcgtgtactgtagtactccctccctactataaaatatatgtaaagcttttcactatttatatgtccaacgtttgatcgtttattttatttgaaatttttttatgattagtatttttattgttactagatgataaaacatgaatattactttgtgtgactaattttttaaactttttattgtaaatttttcaaataagatacccacggttgtacttattttagaacgaaagtagtactttgttatactactgcatactgtgtcactgaaacgaactgagtaacacagcaacttagttcgaagttaattagttttttcctataatattgtggtaatgcctcttttcagtgtcaaaaccaggacgggttttgacaataccaaatttattgaaatacaatttgtattagtatgagcaaaaattggtagcaaactaaatacaactgagcttgtcatactactgaaatggccaaaaaattggtacgataaaattttggtttcaatctaaataaccctaatatgtgacacgaaatttgcctttataaggcgtcgtcaaaatttaaatattcaaccttaattttagagttaattttaaattttctttcagcatgattccgtttttaatattgatttttttaagacgttaagtacatacatataaagttttatctataaattatatttaatttattaataagccgacataaagaccgaaacaagattttttttcccttctagatgatcgatcgccagcccaaggtaaagaagcagtgtttacgggacaaaggtgaattggagaagcgtcgccatcgagcgatccatctttgctgggcgatcgagaaataatgaagctctcgcagggggaggggggggggggggggggcactgttcgctgggaatcaaaatcaacgcacagcacagagtaagtctagctagatccatcctttcctttgcaattttaatttgcaagcatgcatgcattgctctgatcgatcgagtgtctctggacgtcaaactcagctgcagtgaaacgagtgtgcaacactactgctgcacacatgtgtatactgtatggtaagcgatcgatcgagtagtcgtcgtcgtcgttgctctctgcagctgcagatgcatatgggagatgtatacagtagtaagaggagctagctagccctgcattggcatggccagccaccgccctgtctggctgtctctggccggcggttagcgatgcaccccattattctctaattaattgagatatactgtatattctacctcagtttttatcggcatatttttaaattattaaatggtacatttcttatgaaaactttatatacagagaagtttctctaaaatgtcagatacatttgttttttaagttcatcttcatcttcatctaaaacttcatcttcatattaaagtatgaacaaacaccactttagtaagtcccggaataagttgatttttatgctatctttagaaaaaataggagggaaatgtgtttgtacactattggagaaaccatctttggtcagttgaccaaattccataataatctcgattgcaaaaaaatcagaactaatatattctttagtcccggtttaaaaggttagagctattttttttatctttagttccggttggtgttatcaatcaggactaaagatcatttttagtcctggactaaaaatttagatgccctgagtaacttgcttttaggccgagtttagttccaaactttttcttcgaacttccaactttttcatcacatcaaaactttcttacacacaaacttccaatttttctatcacatcattttaattttaaccaaacttttaattttagtatgaactaaacacacccttagatatggagggagcacgtagaccggccggtccgactgttgtcgattattacgtcttgtcacattaacatctcgaacaatcttctgacaaagccaattaatgcacaccgttattagctggttttgcaatttgtacttattgacctggcatgcatgaacatcgatctcttcttgcgtactatagagtagtaggtatgctccgttccgattaatcattatggattatgggtgtgtttagttcatgttaaaattgaaagtttcgttgaaattaaaacgatatgacgaaaaagttgaaagtttgtgtgtaggaaaagttttgatgtgatggaaaagttagaagtctgaagaaaaagttgggaactaaaccatgcctatattacatatgggtgaaaaaaagaattaaaaaactactccttgtgtcccggaatataaatatttttagatttagatacggttattaagaaagtaggtagaaatgaatggtggaaggatatgattggttgtgtagtggaggtaggtggaaaaaatgaatggtggagagttgtgattggttagaaagaaaatattagtggggaagttgtaataaacatctggtactatatttacttcggtaataaactcgatatatctaggatcctcactattttctacttcctccgttttacaatataagtcattctagcatttttcatattcataataatattaatgaatctagatagatatatatgtctagattcattaacatcaatatgaatgtggaaaatgctagaatgacttacattgtgaaacggagggagtagccaataacaaatcacgacattatatgttgattatatatatggatgcatgtatcaatattcatttactctcatgcataaataacgaatagccttagaaaataaatacaaatatgattgtcatttgagaataacctcaagatatatgtatgataattaattggaaatggatgaagtagtgtataatataataattttacacctacagttatatagacaaaatctctattatgatacgaagataatagcaacatatagcaagttttacagtattagagatgatagtcgtttataattttattcatatcatctactcctttgttcgctaatgatcgtatgatttataagtactctttctaaaatatgatcagtgcacttgtcccaacaccccgtaatagttttaatttatttgtttgattataatctattcatctatttctttcatctcttttaaattttctgtagatatctcattcgtttatctcctctattttcttcccacctcataaatgtaagcatacatatcatcaagagactagatacgtgcctacttcctccgtctaaaaaaaccaacctagaagaattgtttctttttttggacggagggagtagatgttattgcaattgcatctgctgatgtcatggacacgtcactactgatactcctaccccaaacaggcaacagtaacagatgaggctgctagctagaactgctcggaattattttcaagagaaaacttagaatcgggtgcccgatggtttggggaaaaaattgggcgttgatgtcagcatgacgtatgcgtgaaaaaacactttaaactatttttttctcttaacttatttatccaaatcatgatccgattccactattaaattcgttgcaattaaatcttcaaaacaaaaccacacatggatatattccaacgaaaaattcttttagcttattattgaattatttttaaggcaaaattggttatatagcattgatagttcacgttttttgttttatagcacccaaagttcaccatgttcaccatgttcctatttttaacgcttatgtcaattttcgatcgttttctgtctgtcttgatctagccacacacacgatatgacgtttctacccctcacaagtacaagtagaatgcatgtcaatgaggggtagaaacatcatattgtgtgcgtggctgggtcaatagcgatcaagacggatgaaaatattgacggatgtgttaaaaatgggaacggggtgaactttgggtgctattaaagtgaaccggtatctttcgatgctataaaaccaaaaacgtgaactttcaattctatataaccaattttgcctatttttaaatattgcacgatgttctactaggtatatcggaattgtttcactaagtagatcaaaaatgtttcaatcgtttaattcgggcgttgtttcacattatataaaatcaatgtttcagcaaattcagttcactgtaacatttgatacatatatactgaaacattgaaacatttttggtgaaacaaaaaatggaacgaattcccttaatagagggtttccaaaatatgtaggtgatttattgcaaaagaatatttcaattcactgcaacattagatctatacatagtgaaacattgtgagtacactaggtgaaatatttttggtggaacaaaaaatgaaacgaattcccttaatagagggtttctaaaatatgtgggtgatttgttgctaaagaatgtttcaattcactgcaacattatatctatacatagtgaaacattgtgactacactagatgaaacattttttgtatagacacatggcaagtgggggcagaggaccgtggtggggcccaagcatcacgtgtcacgcgcgtggggcggggggagcgcccgatttttgctcccccccgccggtcgaccgatcgctcgcattcttcttattttcctggccggccggacgggtgcattacaattatattattctctcgtgtttaaaagggaaaagggaatgaaaaggaccattgctccacaaccattcgatcgatctggagttaccgctgcaggacacaaaaagcacaatgaatcgccacagcggacaaatcactttcgtcactattgctactgctcgacacttttttcacgcagtgaatttcacaaaatcaaatatttaatggtctaagcttcacaaaaattagctattttaactgatgacatatatataactgtaccgtcccccagctattgtggttctagaattttgcaaaaccacaccctataacatagtgtttatgatttttttttattaaattcttgactaaggttgatatatagttcaactctttgctgttttcaaaagtattgtttcagatatgttgaaattaattgagatttgtatgaaggtaaggctttataacacatttaaatacaaaacctgtggtaataaaacataatgttttctacttctttcaaattatagtcattttcttctccaacactactacataggatggccatgcatcctacttaagtccttcatgacactactaaaagaacctaatgaacctaatataatgggtgccggttatgaatcacacataggtattggtttcctaatcgacaccctaatagcgattctcatatgtgatattgacaccaattttagattaagaaccggcacccatagtgttccacaagccaagaaaaaacaaacaaaaaagccaacttgagccaatactcagagcacccccaaccctgtccctaatctacccaactacaaagtttaattcacagataacacatgagcacaacaaagtttacttcaacactgatcccatattaacaaatcaacaaataaaaccaaataatagcctctagatgttcatattaacatatgaacaacacattccacatgaacataacaacaatcaataatcccctaagttgtacacgcatctggagcctccattgttagatccgtcggcctggtaccatggagaatgcgagggagatgaggaggccaatgatggtccatgacagactcttgataaaggcacgcgagctcgaggtaacatgcatcgtcttcgtagctgctactgctcgttctcgtcactatcaagttcgcggcggctgtatctggttgcccccgacctaattgctgctagatccgccggtggtcaccgacggacttgctggcgttgctcatgctcatggtcgcgaggatgcgcgatggaagagaggggaaggggcagcgaaggtgaggagatagcagaagagattgtagctactagaagctatctaaattgggtgttagcctctcaccgtctctcttactggccgtaaccaaataaatttaaattttaaaatttaattttagagttgattttgataatttttatgatagtctattttctatttctttgaaatcacaaataatacatacccatcaaaaccttagacaaaattcattctccaaaggaaaaagaaaagacagagaagacgacgttttctccatccaagtatgagttgcatgcatcacgacgtactcgcgatctttccctttcatccaagtgcaaatacaaataattttattactacgtattaatttatcctactgttcccgatgcggctgtagcttttatggttcgacggttaattttttacttgtattacaaaagttcctttttcgtagtacacaagggaaccattgtaattaacttccatattaaatgaatgaacaagttgcctaacttttgcaaattggcatatactcctatatgcaccgcactttgcaaaagtgctccatggatgttgatttaccacacgcgtaattaattaagttaattggtcattaatgtaagtgtcactccttacttttgctactccgtacatagtttaagtaaatgtgtgtcttgctgatgaggagggccggaggtcaagtggaacaggaggtcaatcaaatgatcattcggtcgcaatgcagtgtacctgattaaactaatggaggggcaataattccaggggcactgtgcggcaacaccgtctgcttttcttgtggattcatttaggagctgtttggtttacatggacttatttcaagtccatgtcacatcggatgtttggacactaatttagagtattaaacatatattaattataaaacccattccataagtttggactaattcgcgagacgaatcttttgagtctaattacgccatgattttgacaatatgatgctacagtaaacttttgataattatggattaactatgctttaaaaaaatcgtctcgcggattagctctcatttataaaattagtttttttattagtctatatttaatactctaaattagcgtccaaacatccgatgtgacatgggctaaaaagtattagccccatctaaacacccccttaattatagcatgtcgtacaagttgggtgataaacaaaacgatggatcccttggttcactgccactcctgctcgaacgttcaccggattaatgtgcacgcacttgttctcctgtgtgacgagtagaaaatgtagtacgtagtactatactgctcgaagtaacgacgaatagtacaggcagtcgggacttggacagttggcatttgaatgcactactacatgtttttttttttcatatgacaaaaatcgatattcgggggattggacgacccgcatgtatactggtgtctgcgtaaaaacatattttcctgtggtgcccagcgcagccgaatggaaaaatattttcgaccaaaaaaaaaattcaaaacaaaaaatgggccaaaaccctagcccgctgctggcccccagctccccgaggcgctgtcgtcgtcctcaccatagtgcactgccaccatcgtcacatttgtagctgtcaacgagggctgaggacggtggatctgtatctcccgagggcgggatccctcttgcccaagcccaccgccgttgctctcgtgccaacctcgcctgccgccaccgtcgccggagcttgccaccaccggagcccgagcccgctgcctttgccgccggagtccgtcgtcacgaggagaggggataggagtgggtgtgaggagtgggggaaactgaaggagtgggatggacgggaggggacttagtgggagagagagaggagaggataataaaaagagttggaagagagagggtatttttacatgcgcgccatcatatcaacccaattcaattgaaacgaaactcttcaaaattcaattgaaatcatatcaacccatatcttggcacgttcaagatgggcgatggtaccgaggccataaatttttcatcagttattctcttcttcgtctacgatcctactaaaacatgtttattctcttaattagcgcgctccaataatagtttgatgataatcatggccaccttaaagaatatgtatctaatgaagtgatcgcattttgaagaaaccaaatattctacttatccactttaatttgtaaagaaaaactaactagtatgtatacgtagttgcattttcgacacaactatatctccctagacgtacgtagttagagcatatccaccaacattgtcgactggtgagcatcctctcagccgctgttgatcatgtgcaattctttactcatttagtaccaatgcgtagctagataaattaatgagcgtgttaaattgatatctaattctcctgttgtgtatagagagctgctggccgtgatatgaataaaacaaggagactcctcccaacagattgcagagaatacctaatgttcaacaagcatgagacggatctggcatggagaaagaggagctcgagtctccacctttggtgtggggactacgagagccctctagccccgccccctaaatttctctatcatacattcggaagggttagagatctatctagtttgttcagctctctactatttttttgggatatgttcctttaaaaagtaaacatagttatgtagctttgtttaaacaaggcttcattttgtatttaattacaccgaatgatcaaatcttagatatggccctgaattatactattaaatatcttgttatcatcgcctataaattcagtaaagtctaaagcttcctttcatataaatcaaccttaattatcatgtctgtcactaacacacacccccacccatcctcttcataggtactcactccgtcccaaaataagcgtagttttacactattcatattcagcgtttgaccgttcgttttattagatttttttatgattagtatttttgttgttagtagatgataaaacatgagaagtactttatgctgactaattgtttttaattttttcataaaatttttaaataagatggacgattaaacgttgtacacggatacctatggttatactctctccgtttcaaaatgttcgacactgttgactttttagcacatgtttgaccattcatcttattcaaaaaattttgtgaaatatataaaactatatgtgtacatgaaagtatatttaacgatgaatcaaatgatatgaaaagaataaataattacttaaattttttgaataagacgaatggtcaaacatgtactaaaaagtcaacggtgtcaaacattttgaaatggagggagtacttattttgggacaggtgtagtagtggccattcgcatgacagatgacatgcacatatataatcaatccacagagattcatagtacatctgcccaagtacccagcaaatcaattaattaaactaatccactatcgtacctgttccacgtaagaaagtctcgatgaacagataaccttctacaagttcagcattgatatccatcgatccaaacagtgcatcgcattcgaagtttccaaccacagcattaatttatcatccaagattactaatgcgtagtagggttaacttgacccagcactgttggagaaaccatctttatttggtccggcaaaatccacaatagttccggatccaaaaagaaccgggactaaagattgtttttagtcctggttataaatattttgatctttagtcccggttggttcatcccctgtcaaatgtatgtcagggggccgaggatctttagtcgcggttggtgtcaataaccgggactaaagatcaccactttagtcccggttggtagtaaaattaaacacgtagtatataatctctatcccttatcctctcctccacagttacaacttaacggatcgaatctcaccccctctcctcatatctatcctctctaactctcttctccatctcctccccttcctcctctcctcccccttctctccccttcctcctccccttcccggccggcctccccttcccatccggcgggccggccggcggcgggcggcggggcggcgcccagcggggttgcacccggcggagggcggcgggcggcggggccgcgcccgtcgttcgtggcgaccggcggcggcattctctttttttttttaatttgtaatgattcactgagatgtatttatccgagaagttacaaatttgtgattcattgtttggatttgtgatgtatttgagtaatttcttaggatattgtgatgtatttgatttgtgtgtataagtaactttatgatttgtgatgtggatttggtgatgtgaatttgggatgttagttagatttggggatttgcctacttgattcgggagaaaataaaaaggaaaaaagaaaaagaaaaagggaccatctgcactgccgctattttctctttaagatcccctcatcacatctttagtcccggatccttactcccggttaaaaaaccaggattaaaggggattcctaactgggagtgatgatttctccaccatctgcattgtacgtgtgtacgattgtaccaaaagcacgagctcacaatgttgtgtaactgtgtgcaagagctggctaaacgtacgtgcatatgctctcggtgattgatcgatcgatcggctgtttaattggttggtttggtttaatcatggcgcctctgctgctgtttgcacgaggtgacagcttgatcagattgtacgacgttattacgttcaccactatataaaccttattaagcgctagttaattaaaagccccacaaaagatactgaatttttatccctaccatgaaagagaagctattggtatcggttcagaaaccggcatataaggttgtacgagtaaaaaaaaaaacgttggctttgatgcacgaatcgagatgatgcttcaaacggcttctcattaaatcctcatcctcaaaccaatcatcataatacacgaacaaatcattttatatacaaaattataaatggatcaagatttacatatacataattgacgttagaataaaacgcagggtgtggctaatgggcaggtgactgctccgggcgatcacccccatcacccctatacgctactctctcccttcctcctcactttcttctcttcctactgtaccatatttttttaaaaaaataaaaaaataaagttggaaaaaattatgtatagaaaatactatttataaaaaaatatttgaattcaaattcaaatttgaaacgggtatgtaaacttttgacttataaactttgggtctataaactaatatttgaattcaaattcaaatttgaatcggatatgtaaacttttgaattttaaactttggatttataaactttaggtgtataaactttagatgtatagaaatactatatataaaaaatatttgaattcaagttcaaacttgaatcggatataatttaaattcaaatttgaatcgggtatataaacttttgacttataaactttggctctataaactttaggtgtataaactttagatgtatagaaatactatatataaaaaaaatatttgaattcaaattcaaatttgaataggatatataaacttttgacttataaactttgggtctctaaattctaggtgtataaactttagatgtgtaaactagaggtgtataaactttaggtgcataaatttactaaaatatgaaagtaatgtggtgtcaaaaaggaaaccacgtggaggagaagggatcgcgccctgatcgccccgggcgatcgctcgcccagtaggactttcctaaaaaacatgccaatccacaaagtaaaaaacacataagatccatactcatataatcaacttaggccccgtttagtccccagacaaaaattttacaccctgtcacatcgaacgtttgaacacctgcataaagtattaaatataggctaaaaaaataactaattgcacagattgcgactaatttacgagacaaatcttttaagcctaattgctctataatttgataatgtggtgctacaataaacatttggtaataacagattaattaggcttaataaattcgtctcgctgtttactgacggattctgtaattagttttctattagtgtccgaacaccacgtacgacaccctatataatatccgatgtgacacgctaaaactttataaccctgtatcaaaacaccccttactactcatcaaggctagagtagtctagacacctacaaactaccgtcgagcaggcctgctgcacatggatctagccgtacccgacatctgagaggatagatttgactgcccctgacctcttggtgtttggatcgggccacctacgtaccgagatatgcattgagaaagtcattggtgtcaccattaccactgaacacctgggtcacacgctagctacaaatgcatggggaaatcgatgaagccattggtgtcgtcgacttgtcgcagctcgatttcaccacgtacgagcctgtgctcctcaagcttgtgaaacaaagtatccaaatgccacgagcttgagggccatcacatttggcggcccccgagttcaaggtgaccggatccagtcagcccccacattcttgacgtgctgatgcagatggtggtgagagagatggcacgcgggtaggaatgaaaattgctcgaaaacagatatggtacgtactataccacgctaatgtcatcatgacgtcagcatggtaccaatggctgtcgtgtatagtatcacggtatcagatctggtatctagctatcagatctgaacatacagtaccatactgatgtcaacacacataagctattccgtaggaagggtatagccactacaacagagcaccctataggtgtatgtaccattttactaaccgataccaatttaggagtacctctacccattggtataggtgccagttttaaaaccaacaccaatagagattataggtgcttgttctgaatatataaccgatatctttggttttctaggagaaaaaaaaaggaaaacctaactcttgactagctcaaatcgagccaattcatcaagccctagatcccagaatgaagctccaaatcccgtaaaatgaagatgaacacatgaacaacaatcaataatccctatattcttatttcaacaaacaaacaacacatctagatcttcaaaatcaacacaaagacatgaataaacgtgaacaaacacatccagctgctatcgccttcaccgacgacacctaaaccatcgccatggaggtcggaggtggccaaatccgacgacccccgacttccaggcagccagtccggcagccccctacctccatgccagcaaatccgctggccaggccaccaagaaaaagtagagaggagaggagaggagaggaaggagcggtagtcactgtgtcctccgttgttgtcatcgcccctccaatgggtggaaatatagaggggcttctgacaaaggagatggagacagagtgagagattgagaggggtgagggagaaagaggagagaggtcagccacctcctcctcccacttcaccacctcccaggtaactgtccctccttccgcgtggcggcgggagcgcgaggcgcggtggaggtgtcagcgataggggtgttgtggtgtacatcttgatccgatggtcacctttggccacaaagccgtctgtcttgggggcagaggaggagaagtagccattggcggtgggggaggaggaggggaggtagtagtcgttggagtacgagaaggcaaaagatggtggaagggggtggcttcggagagcaggagaaggggagagaggtgttggtgtggataaggatgggtgggtggataagaacggctcggctcggctcggtcggtttttttaaaacatgtggtatatgtttttaattaatcgatacctatacatgtcggttcttttaaaaaatcgggtacctatagtgaatttttttatataatttagacctttttaaaatatgattttattaacaaaccacctaggaaaatattttcaaaaatgaaccttttggccaatagcagtggtgtggccaaactgtgagctgcaacaccaatgttcgtggtgttgcaaaagctaccccgtggtagttgttgccattgaaaatgtcaactgagcgcggactcaaatgggtttcaaattgggggcaagaacattggattttgagtggatttggaaggaattgaggagggggcgtcagttgaaactcgcggacgagagagagaaaaaagagagggctggaagaggagaagagatgaaggaggaagaaagaggcaacggtggctggggatatttggcatggcagcgtcacgccactgagcctggcgtggcaagaccactccctcctcccccgcgccacgttggcgcccggttgacgttttcaatggcaacaactgccactgagcagcttttgccatgtggtagttcagtttgaccacgccaccactgtcaataaaattatatatttgaaaggtctaaattataagaaaatttcacctatagtactagtgcttgctttttctagagccggtacctacagtgataaaagatgctagttctacattttttttaaggacagagatgggaaaagatccaaaccgatatttatgaggagttttgtagtagtgagcgttcagtagtactccctccatccacaaaagttacgtctattttacatttgagtttttctaaataagttgtttctatttgtagtctttatgcattcaaagacttaaatgaagatataaattaaatattttattagaactaaggagacatctaaatactcattggttgtatgcttgcattcattttttgttttttaacatccaaggtgatttaatttctccttagtcttagtgtcaaaagtaatactccctctgtactcgtcaaggaagttatttaagatagcgacaaggtctccaaaacacaactttgatttcttatttctataaaaatatttattgaaaagtgatatatgtatacttttatgaaagtatttttcaagaaaaatctattcatataatttttacatattcaaactcaacaaattaaaagttattcatgatttatattcttaaagtttgacttaaacattgtcctaaacaacttactttacgagtacggagggataacttttatggatggagagagtagtcctctttttgttaggctcaaataattctgtgcttacgtggaggccatgcaaacggacggacggacaacaagtgggtacattattgcaaatcatatccgtcaagatacattgctgtcccggcccctgaacaagtacgtgaggcatgcagcaatggcatggaaaaagaaacatcctactatgaaataatccacgcgttactaatctgggatcgttaattggacattttcacaatcgaaattaaatcgtcgtgatctgatgtggtccagtgacgctcagattttgctgttgggttggacacacaaaagggcaccgcgtgtgaatacgcgtgtcagccgctagctcttgtcattgcatgttgtcgacaagaggacctaccagagctatctctcaagaaccatatatttccatgtgtgtacaaaatatactttatttatcatatatgtgcgcgcataccatattgagaaattgtaaatccaggatgagcattaaactatactcatcggtactcgaccgatataagataaaatatataatacgaatcatatatgtaatagaaacaactgttgaataaaaaaaaaatagatatctaagattcttccgtgtcaccataaataaaaaatttactccctgtaacttttttactcgttatgtgtaaacataccagtaaaatttttacttatgataacgtggacaaatctcaaacgttcaatttttaaaccaacgataagttttcaagttctatctgcatatctagttttcaccttgtatttttctacaatatcaagtgtaaattaattcgatcgagagctagtaccctatgattaatcgaaatctagcgaacatatatatgtccttgtatatataatctagcgaacatatttatttttttcctttcccttttctttttcctcctattcttttactatcttcttcctccactagagccatctcgagctcccctgcgtcgaagaggccgaagaagagataaatgaaagaggaagaacggagaaaaaataataataataataataataatgtgccatgtcgtcgtctacatgttataccacataggcaagaccacggtcaaatgagactttggaccgggatgatacaataaaccaagtttagaaatatcgatacacactttgcaggtacgtggacctagatgaaatctgcttacaagtttaaggaccgccagtgcaatttaattgctctataattaattcaagtttgcaacaacatcaacctaaaaatacaattgtctcttggaagaagtagatatattttaagaagcatgagtacacaacggattcgttgaaaacctggacaatgtgcatgtggccagaagacttgatgaagccattgtagcagaccgggatagcttgttttgcagcagattctgtaggaccgaatcacaataactaagccaaccagagaggggtgaatggttgatataccaaaaaaccgaaaacttttagcggaaatgaaagttaccctcgaaatcgacagaagtcggtctgaccgagattgatatgccggtctgaccgtgtggatgccgccggtctgaccggtatagatcaaccggtctgaccgccgaagccgcctgccacgcctaccgccgctgccggtctgaccgcctcgctcccgccggtctgaccgccgccttgccgtcggtctgaccgccggtgagtcgtcggttagaccgccgaaacccgatgaaacacaaatcgaagaactcttaaagtagatgacgactttattgattctctctgtatttacaaagtgcaccaacagcactccttacaaaaatttcgactaaactcgaaaccctaactcaaaaatcaactcaattgctctcaaaagcgataccgggaagcctcacactccccctctatttatacccgaggtaggcagcctaaagccacgaaccaaactcatactaagagtcctaaacaccttaggaaacccctttgccaataaattccaaataacaaaaccaataatctccgatgccaattgttcatcacagaataataatcaaaaacacctttgattttacaatctccctcttgatgaacacattggcaaacccatcaaaaatgttttggtgtttgaaaaaataaaaacaaaagcgataaaaagcacacttcgtacaaacgtacacatcgtgctcgaaaatcgaaaagaaaacttctctcacttttgaaaagaaagaaactcccaattgaaccaaaaacaacatgctcttctcaactcatttgcttctccaaaaattcaccttgcttctcccaaaactcatatcttctcccccttttgacaatgatttcattaagcataggaattatgttcattaatgttcaagagcttagcatacatatagcatatcatgtcatgtgttgcaataaagagaagatgaacccatctataacataacaagcatgtattaaagtataaccatgaaccaaagattttacaattaagcttgaatcaacaatcaaaattcatgatttcatacgatttataatgcaacatcttaacaagcacataggttgaagaataaacactaaacacatatacctattgcatttatcactctttctcaaataaactttagcacaaaataaccaagagaatttttttcaactttttcttttcttgagcctttttgctcatatttttctcttttattccgggtacgtccctgtcgttaagactgtttctagagattcggcacccattattttgctcacatcgaatacgtccttgtcgtcaagactgtttccaaggattcggtatttatttttttaatatttttattctcttttcacaatgagcaattaaagctatttgaggaataaaaattcaataaagcatatatatagagcatttatagatcaaaccatatgctagcatcaacattgcatattttcttaattcaagtataatttaagtgtcatgcatcatctcccttgaaagcaaaatctaaatctcatgaaaagactagaatacatacaagctatgctagagacaaataaaccttcaaagtattgctagcatgcacaagaaaataccatatgtatagaacaaagctctcttttatcaatttttctcattgtcatattttttgcttgataaaaccatgaggtacaaactccccctcaaaccatgccaaaaggatgaattatgcccaattcaccacgaagaaaagcaaagcgattagaatccaaaggtttagcgaaaatatcagcgagttgcgactttgtgtccaaaaactgtaattcaacatctcctttctcaacatgatctctcaaaaagtgaaaacgaatatcaatgtgctttgtgcgtgagtgttgaacaggattcttagcaatgttaatagcactagtattatcataaaagagaggtactttctcaaaagtaagaccataatctttcaaagtagataaaagccaaagaatctgtgaacaacaactagcagcagcaacatattcagattcagcagttgattaagcaacactagattgtttcctagaagaccatgcaatcaatgatgtaccaagaaaatgacatgttccactagtacttttcctatcaattctacaaccaccaaagttagcattaaacactcttccatatcgagaaatattcaacacagaatcaccacaagaatcaaaaactttacttccagttttcttaaagtgaacctcaaaatcctcatcaacaatttgtgaaacctaaagcaaattgtactttaaatcctcaaccaaagctacgttcttcaattcaaatttttcatttaccttaaccaaacctgtagcgagaacgacacttgtagaagcgtcaccaaatataatcgattcagtcttggatgcctttttgagagagaagaaccaatttttatcaccagtcatgtgccgcgaataaccagaatccacgatccacacgttctccttccgcggcaccaaagcctacatagaagcagaagtcgaagcctcagtactggggttagatgataataaaaatttagcaatctagtactgagacacacgaccataagatccaataggcatatatccacgtgcaaaaacagtttgagaattttcagaaaaattcctccgaggccggtctgatcgagggtgtgcagccggactgaccggaggccggtctgaccgcttctttaccgccggtctaaccggtgcccggtctgaccgacgctcagtagacggtctgactggtcgccggtctgaccgcgggacccactgcggtctgaccggtttcctcgagggaaaaccagattttttgccactttgattttgcaagagcaatctctctctcctttttctgtttatgagttaatctgaaataaaaaccaacaatatgtccatcttttccacaaaaagaacaagtatatttttcacgatgattagacacattggtagaattagaagacttagcaacacaagcaacaacaggaggttttgcatgcacaacattggattttgaagaagatgcattcaaggtagacatgataccagcagatttaaacacaattttggttagaatcaggtttaaccaaaatctcaccacttcaagcaccaacacctaacacaacaggaggatgtctagaattatgagcataaggattaaaacctaaaccacgattatttgtgctaaccttagattcatctaaaatcatgttgaggttctttttaccatcagaaaatcttagcaaataatttttcaaataagaaacctctttttccaaattagcacaatttttacaatctaccatgacacctttgcttttacgacacttggggcaagaaatcacttcattgtatttcacaacatcttccatgtactcaacacgacctaaagcatctttcaatttcatcttattcaaattatatgttgagcaatccaaaacatcatgaggttgttttaactttttagcacaaatcatgttaaacatcaaactagcatgaaaagcaatttgatatttttgcaacaactttttagttaaaaacaactcatccaaagtgcgtgtgtgcaaagcaaaactaagagcaagaaaagatctatttttcaaatcatgtgcagcattaatatctctaatttttgaaatctcattcattaaaacctcacaacttttgcaatcatcatcattaggaataagagattttaatctagcaatttcagaattaagagattcaatgataaattcctgttttctatatatcttttcacacttcttattttttgcacttaaaatattaatagcttcctcaaaagcacttatctcattgttttcacactctgaatccgattcaccacatgccatgaagcaaacaccggagatgttctttcccttagcttcatctccactatcaccatctacgtcgcttagtggctcaaatgcggcgtagacttgatcaaaagccttattgagattctccataatcctccttcctttgaacgtacccttctgcttgttgtcgttggtcttctcaccatctttgtcttctcttttgcctctcccaagcttaggacaatgcgaacgaagatgatcaattgaaccacattcaaagcaacgatttggaccacctcttttcctgttcctggcattattcatagctcgagcaattctgttagcaaccaaagccaaatcctcctcctcgatctgtttgagttggtcatcggatgtggcattaaaaacagcaaaaaaaaagaagacttagatgaagaagcatcaacatccaaagaagaagaagaagaaaccaaagcactcgacttagaatcaactttacgagaaagaacgttcatctcatgtgttttcaattttgtgtaaagcgaatccaaagtcaaagtagacatattaacagactcctgaatagatgtaacattcatctcccaaatagacatgtcaagagcattcaaaaagtgacgagaaatctcatattgtggataattagcatcataagaagaatcaacagatctaagatcactcaaaattttattaaacctagaaagatagtcatccaaagcttctccaggtttcatctcaaatttagtgtactcctttttgaaaatatcacgacgaagttctttaatgttatttgttccttgatgaaagttactcaaagcattccaaatttcatgagcagtttgaaaatgcgcaacacgatcatcatccgaacgagaaatcccactcaaaagaatattgcgagctttgcaattttgttcaaactcagtttttgcagtagcagtattaattacttcaggaatcacataaggatgagaaacttttctccaaatatcataatcttcagccataatgtaagattgcatcctactacaccaatgagaaaaatccgttcaatcgaaaacatgaggcttagttgaaaacctaacaggagtagccatggcaaaaactctagatcgataaaaatccaaagaagaaaacaaggctctgataccacttgttggatcgaatcacaataactaagccaaccagaggggggtgaatggttggtatacccaaaaaccgaaaacttttagcggaaataaaagttaccctcgaaatcgacgaaagtcggtctgaccgagattgatctaccggtctgaccgtgtggatgccgccggtctgatcggtatagatcaaccggtctgaccgccgaagccgcctgccgcgcctgctgccgccaccggtctgaccgcctcgctcccgccggtctgaccgccgccttgccgtcagtctgaccgccggtgaatcgtcggttagaccaccgaaacccggtgaaacacaaaccgaagaactcttaaagtagatgacgactttattgattctctctgtgtttacaaagtgcaccaacagcactccttacaaaaatttcgactaaactcgaaaccctaactcaaaactcaactcaattgctctcaaaagcgataccgggaagcctcacgctccccctctatttatacccgaggtaggcagcctaaagccacgaaccaaactcatactagtagtcctaaacaccttaggaaacccctttgccaataaattccaaataacaaaaccaataatcttcgatgccaattgttcatcacagaataataatcaaaaacacctttgattttacagattcatgggctcgtccaccaggatatgatgcgctcctcgccgatgagctgcgcgcagcgactcgaattgatcctagagacggctactgcaccacaccatgtccattgcaatgcaagcttctctgcggccaaggaggaggacgaagaggacgcagtcatgtattgttgtactttgaaaaattcataactatttttttcacgaacacgtaaaaagattgcacgtcgatatattagaaggaaaaaatagtttttttacacaacacaaccaaccaaactggtctatgccaggggaaggaagaaaaagcaaaaccaacaactgtagctaggaaaagagactactgcggcggctaaacgcaactccgatcagtgggaggggggcagggccacactacactcccaagaaacctccaaatatagcaatgccagcggaaaaccatagacagccatcttataggataaactccagaaccacagacagccctcccaagaaaagttcaaaactatgacatcccatatatccatccacacataccaaaagtgctacataacatacacatctaacttaaacttaacaattaacggtttttacacccgaggaggcagatgtcaagatgagtttattcagaattaacattacaatatatatgtatgcgcgcatgcacgcatttactttttggaaggtaccttcaaatattagactccctctccttattaatattttggtgcttatatataacatgcatgattcggtcaaacatttaaaatttatacgaaacttcgggcatcagttctatattatcatgagtttataagaatgtaataagtttatgatatataatgatattctgcttgcttttttatttaaaaaagttaacatctaatcaacaatcaaaattttaaaagcttaataattcctgtattaattctcaaatatatattatcagctggactgctggagtagtaattaacttgccatcatagagattttcattcaagcaaaaagtttgattaaacattatcgcacgatgcttttagtttattaaatactgtacgtgttgttcttttctgtgaacgacgacttctatatatatgttgatgtgaccacaattaattagctggcaaacttttcttttcaaaaaaaaatccgacctagtgcaggcctatatgagggcagaacaaaattggctgtgtttagttcagcgcaaagtttggattttagttaaaattgtgatgaaaaaggactgaactttggatacaaactttagatctaaatacagccattatcacaaaggagaagaagcatcgacgactttctccgttccaaaaataagtttatttttcacacacacacagatatatatatatatatatatatgtatatatatatatatatgtatatatatatatatatatgtatgtatatatatatatatcacatcgtaaaatctaaacagtgcgcgctctcgttttagtctaatcgcgcgacgcacctctgaccgtccgatctcgttatctatttattttcggcttacgttatcgctttctccactagtacttggctgcagacagtctgacatacccacgtagcaggaaggattgagatagacatgtatgccttttttctctttaaataaagttttctctcaaattacttatccgaactataatttaattacaccattgtgttcgttacaataaaatcttcacaacaagatcttacatgattatattacgatgaaaaaatatttatatttgtaaattacttttattatatacgtaagttacttttatcatatatataagttacttttagattttactaaattacttcttagacatataaaagtaaatttaataaagtctaaaagtaatttatatatatatattataaaagtaacttaaaacaaaacggaagtaactttgtcacgacattagaagtaaattcattgtagtgataaaatatgaatttatatagaaaactttatttaattagtacagatcaacacacataagtttaacaaattttaaaagtaagttcaatgttaacttcaacacacataagatacatactattgcatttttcaagttgaaaggagacactagatggagtataaactagctacgactagctgtgtagtcatgtccaatgaaaaatgcaagcattaaagttactttcttttgttctaagttacttctataatatttgtaaattacctttagtctttgctgaatttacttttatatgtctaagaagtaacttagtgaaatctaaaagtaatttagatatatcataaaagtaatttgtgatttttcattaaaatataatcatgtgagatcttgttataaagatttaattattacgaatagaacggtgtaatcggatcgtagatcggataagtagtttaagagaaaattttatttgaagtataggtggatagagtctctcataaatgacaaaccagctaccattagctgtgtagtcatgttcatatcacatatataaatataataaaaaatacaatacccttactttattaaatcctaatataattattcatctttttatctattcttaatttatttatttatcatttttatcaatttcgatgtaataattactaaaataattattttgagacaaacgaaaaaaagctaaaaataaacttaattactccgtaaccaagggtgtacgtgagtgtacggaccccacacgtaaaattctagtactgcttatgcttgcgatcgactaaaagctagggagagacagcaccattaataaaaaatttgtgccaagtcactgtcacgataactattttggacaataaaaggccagtccgtattgcagccaacatggtactactgctactattatacatatataaaactatatactattatacataaaaatgcggtaacatttgtgacacatgtgtgtatactgtgtgagtacatatatataaatgcttgtgacagcgatgcctgccggggaggggtaaacagttaggggatacgtagcaagttagtatcccatatactggcacatatattcactttcatattttaattaacaggtggtctggcgaccgaggcatatacatataagaaaaaatatatgcggcaagggacaggtcactccaataacagagcaaattaaacaagtgaaactaaataacattattgaatagttagaacgagattgtatggcatatattatactcattatttgcagcttatgttgttcctctattttaaataggccaggaaaggtccagctggttgtggctccagcagcttcaacaagtagagctgcactacgaacaaaagtttcatgcttacgtttaattatgatgtactccctccgtttctcattctagcatttttcacattcatattgatgttaatgaatctagacatatatatctacctagattcataaacatcaatataaatatagaaaatgctagaatgacttacattgtgaaacggaggaagtaattgataataagacattaatctttatgttttctaaaacaaattctcgcaaaacagatgagtggttagagtttgaaacaaacaatatctgatgataaatattttaaaaaagagaaaatgatgtagttagaaaatgtcatattgtacaagttcaatctctgcaaagcattactcggagatattagttattagttataatgggcgtttttacaatattagttattttgctccacggcctcatcttttcgtttatgtttatacttatcagctaaaatttaaattttcaatattaaatttgaagttgattttgttttttttcatcaaagtttatttttcatcatttgcttttacaccgctaagaacacgtatataaaaaatttattcacaaattattttttgtttgcaaatatgccgaataaacgaaaggatgggtccgtcagttcttggccgaacccctatcgatcgaggagataatgggagataccccccgtgtgaatgcgtgatccaagatcatcaaatgccaaggaaaatgcaggatcgcatctgagaataaacgaggcacctgatatacgtgatgaacagacagctagctagctagctcctctgtaaagacttttcaatctagaatgattgccaataattaaattaatttgctgcaaggctcggaatctcttttagaatggacctacacaaacacacatcgatctagcctattatacagtccgtaacaaaataaattcatttttagataaacaaagttcactttactatcctctaactaccctgctttgtaaatcgataaattttatctctttattacccttgcctactctctctcatcaacactaccactctctcatcaaaactagtatcatttttactgataagaggtattttagacatccgtaccaaagtgcataacaaactggctgactctcgcattgcccctcccccttgggcgacaccggaggcgacgcccctgccgacgcacgttcccccctcctcccttctccgcctcgccgccgcctgagcggccaccgacaaagccgcgcagcgcaaggatggcggcggcggggcttcgtcttcgtgccacgctcgggcaaaggggggattgctcggggccgcacaaatcgcctagatctgtgcctcctggccagatctagaggcgaggccgaatggtggggcggtgactggcggtgctggcggcggtggttagaggtgtggcggcggcggaggagaccaccaaatccgagcctggatctggcggggtgggggccggcgacggcgtccattgacggcggcggcggtgcctggtggtggtggcggcgggcggccggatccggctggacggtggatggcctgcggtggttgggttcggccgcggcgacgagttgcaggtgacggcgtcagcggcagaggcgcgagaggctgcgatcggcggcggcaagcgcactagcgcggacgcatagaggccgtgacggcagcggaggctcgggaggccacgatagcaggcgcgacagcagcacgtgcctagacggtggcaagtgcagtgactgtggctggcacgacgatggtagctagcacggcggagtggccagtagctgtgtggtgcgaggagggcgacgaggccggtcggcgcgcggtggctgcgcaacgggaggtaaggccggtggaggctagctaggccgaatggtggggcggcggtgactggcggtgctggtggcggcggttggaggtgtggcggcggaggaggagaccgccaaatccaagcctggatctggtggggtgggggccggcgacggcgtccattgacggcggcggcggcgcctggtggtggcggcggcgggcagccggatccggccggacggtggatggcctgtggtggttgggttcggccgcggcggcgagttgcgggcggcggcgtcagatgcagaggcacgataggctgcggtcggcggtggcaagcgcaacagcgcggacgcatagaggccgtgacggcggcggaggcttgggaggccacgacagcaggcgcgacggcggcgcgtgcctggccggtggcaagtgcggtgactgtggatggcacgacgatggcagctagcacggcagagtggccagcagctgtggggtgcgaggagggcgacgaggccggttggtgtgcggtggctgcgcagcgggaggtgaggccggtggaggctgagcccagtaaggtggcgcacgtgaagactggccggctgggggcaccggtgcggtggtgcccacacatcgacgtaggtttaaatggcggtggagcaacggtgcatttgtggtagatcggcaggtgaaaccccagcctggccttggccgggccagcaacgataacgttcaagcgtcattcccctcctgagggtgttgtcgtgctgtctcacccctcaagtgtggatgcagggcaaaagcccagtctcgattctctctctaagaccttgacggacggcggcggcggtgtttcgtcgcttctctccttagagacgtcgtctaggcacccccttgccgaaaccccccttgcaattggtgcaaacttgctctagattctcatcctcttgtattggcatcctagcttttacaagttggtcatgtcggagggcctaggggtagaggagttccatcttcactctcaccctctctccctaaatcctgaagacttggatagagtggggttttgttagttgtaagggtcgggttctgggcgatctcggcggtgttccgttgttggcctagcggcggccggtcctgtgctagccttctcctgggtttgtgtgttggcgttttcggtatgtgggtggtggtatacttttttcgttttcctggttacaaccttccagggttgtaatctcgtaactttttcctgctctatcaatagaacttcgcaccgtctagtgcgagttgtaaaaaaaaaggtattttagacattttcgttctatcttcattttttttctaagaattaaaagataaacttatttagaaacgagagagtaaattagctagagatcggtgagtgcagtaggcactatgcttgtgaaacaggtaacagggcacagagccgagatcggcaaattaactagctatacagcgtgggccggcccgcacgcacgcgtcgcgcgcgcggtgtcgatcgatcgatctccgtgtggccgggagcacgtacgcacgcaggcgcaggcgagcacagtggccgggacagcgacggccggcgccggagaagacgcagtgccacgacgttgacgcgcgagcagccgttggccacaaactcactcactgatcgatgcatgcacgcagccaatgggatcgaaatccaagctaattttagctcgatcgcgcgcgcgcgcgttgccgtccacgtaaaaaggtcgcgtcgcgtcgccggtgtggcgggccggggtggggcgcgtcagcttttggcgatggcgtgcgtgcgcgccagctgtgcggtggtacgatctagctgtggatggatccgccgacggcgacggcgcggggacgacgacgacgacgcgggccggccgctggtcgctgtctccatcgatctagcgagtagcgctcgcgcgtgagttggacgctgcatgcaaatgtgcaatgcattcacctggtcatcccatccatgcgtacgtgttcccccaccacatgacaacacttgctactaatttttccaacaacgactatttgcttgacattatacaccgcacacgctcaggggcggatcccattaggcagggtacgtggatcgaccgatccagctacgacccgtgtcactctatactcccaatacctcctaccatttatagtagtcatgggccatcaaaattaggtatagtaaggtgtgaacacccaacagattagtccgtatcttaacaacgcacgcacaccgcaaacaatgatcgaggcaattatgcgattgaactataaatacgatatgtattgtgttcgattgttcttatcgagtgatcatctctgttttccgccccatctatattttaaagttacgtcgtcactgacacgctggttagcgtgccatcttaatacacgcttaggtgtgtatgagagaagtcaaaagtagaaatataagaagatatgcaaaacgagatgagtcataaacacatttgagtattaatgatcccaaactattttttttttaacgcaccgcataattttttttaaaaaaaaatgcatcgtttagctgttcaaaaaatgtgcatgtgaagcacgagtaagttttcctcttaatctcactggtggagagatgatttttactcctgattggaaaccccctatagtcccggttttccaaccgggagtaagaatccgagactaaatatcgctatctttagtcccggtttaaatgcccgtgactaaagatttagtaaagttttttcccatttttttctatttttttctattttgtatatctcactcccattatcttaaatcattcacagcaatatagtcatcccaaatcattcacaataacagttcatcccaaatcattcacagcaatcatcccaaatcattcacagcaatatagtttattctcaaaatcattcacaacaataacacagatcgaatcatgcattaagaaaaaaagaaataaaaattccgcagcagcgccggcctccacccgctgctgctgcaccggcctccgtgccggccgccaccgggcgcggccctccacgcgaggccgccgcccccttcggatccggcgacggccggccgcctcctctcccagatccgccacgcgaggccgcctctgctgccacccggctgctaccgtgcgaggccgccgccgccaccgccacccggccttctgagaatgggaaggagagaggaggaggagatgaggaagaggaagagaatgaggagaggaggaggaagaggaagagttaggggtgaagaggaggaagagataatggtgagggaggaggagatagaacttattaactaatcctgctttctcctcctcgatcttgcgcacgcctcgtcctctccgccgcacatgctgattttttttcccggttggtgttaccaaccgggattagaaatagatatttagtatcgggactaaagataatagagggtctaacaccgcctgctgtttttttgaaccaggactaaaaatgatctttagtcctgataggtgttcccaaccgggactaaagataaaaaagtagctctaaccttttgaaccgggactaaagatatctttagtcccggtttttattgcaaccaggacaattatgtaatttggtcgaccgatcaaaagatggtttctccagtagtgtctgatgctaccaaacgtcaccaagaaaactttccctcatagttagcacccaacgaaactggatttccattgctctctagtcttggcggttattaattaacagttggtcgataaaatatattgtcttcccggtttagtttgatgttatccttgatggtttatggttgcgaagaaaattctggtttattgtagggacttcccggccctagcttattactactaaccaaatactcctccgtattttaatgtatgacaccgttgacttttcgaccaacgtttgatcattcgttttattcaaaatttttgtgtaaatatgaaagtatttatatcatgcttaaagaacatttgatgatgaatcgagtcacaataaaataaatgataatttataaattttttgaataagacaaatggtcaaacgttggataaaaagtcaatgacgtcatatattaaaatattaaaatatagagatagtatatagtacgtacttccagctcgatttggttcttttccaccacctgacaagcaagcaataggcatgcatgcataatttagatcatccaatctgtgacggtatttgtcagcttcctagctacatgtatggtccattataatgcatgtctactgtgtacgtggcaggcgccctgaactgaacccatataatttgagtgagctatatataggctatatctactgaagtttaagtcacatggaaccaaagacagctggtctagctagctgcaatatgcagctaggatatgttgtttgaagctaagtgctttcctttcaatatcctgcagtacttgcaaattactgtggtacggttttgtacttctcttgctgatctgaatgaatgaggagttgccatggctttacttacattattggtaatttactacagctggccgatctatcaatctaaagtcttcaaaccaactgggaagtgaagcgctcacagaattttgtgctgccgtggccatcgcggggtcacaacgcgtggacgcgcacttgagagcgggtggatttcgcggcctctcgtgagtccgcgtcggccctcctatactacgtacctccatattttaatatataaccaacgtcataaaaaaaatcggagaaagtactatatactctttttattcaaaataagttactaatacggatgtgacacgtctcgatacaacggctactattcaaatttgtaatattgtgatatgttacctctcataataaattaatttattttagaacagaaggagtataatggacaacctgctagctggctattgctgtatcagtggacatgctcgcagcacaatattctacctttaatcatgcatagacgaatgggataagattctcaacggttaaatcatccatatgtgctgatcattagttgtagctagctatgctgctatacagtcacagccattacatactactagtacagaaactatcataggttctggttgggaaccagttataggtgtcagttttctaactgacacctattggtcggcaccaatataagcaaccggcatctataggttcgtacgagcaagaaaacgagctagctcgaattgagccgatctcacaatcgccatcaccgtgccatgcccatatcgagttgctcccgacattcccaaatccccacatatcgcagatcacagatcgcattaacatactcaacaacaaaatcattcacaaattcacataaacattaaaattctacaaaatcatccacaaaaatccctcgggcgccgcctcctgctgcctctcctcgagcgcctcctgcccgccctggctgcccaacgcctccctttctcaccggatcaagcggaggggagggcgcggccacagccgctaccgtccccgaggtctgccgcctcctctctggccggatcttgcggagaggagggtgcggctgctgccgctgctgcctctgccgggccgctgaagcatctaggtccccgttgttaattttgataattaatgacaaacgctaattgtggactaaccgttgctattgagataatattttaagttaggtccacgtcagtgtgcgcatggatgactatcgatggattaaaattgacggcgcaaagcaaagagaaagaagacggtaaaactagtgctttaatttagaattgatcgaggtgtagggcgatcaaatttgctagtttactttttagtttcgccgtactattaagaggggtaataaccttgcaaagagatgattttaattgccgtattaggtcattatgcatttagacttgtgctcgtttttcatcacacacacacaatcacttaggatttcactggtttcggcctgaccagtggcggtctgaccggcaagacggcggtctgaccggcgcataaggccggtcagagcggcggcacatgagcgggcataccggccccttggaggccgcgatggtgctgctcgggatggccgatacagagccgacggagccgtatttggccagaccgaaccgatggcggtctaaccgagccgaggccggtctgaccgcccactcaacgccggtctgaccggccagtccgatggggccctctgacagcactacaacggctagttttctagccgttgcagagtagcacggtctgaccggccacatacctaggattgctaaacattaacataggagtgtgatttactttcctagagatataattgagccactatcaccctagatttgcaaaacataacttagttgcttagttagagttcaccctcaccaagcctagcaacttaggttagttttgattaggtgtcatttagttttaaatagcctattcacccccctctagtcgacatctcgatcctacaagtggtatcagagcttggtctctcttgattgggcttcaccgcctagagagaagatgtcgaacgaggtgaaccatgtagggaaggctcccatgtttaatggcacaaactactctacttggaaaattaaaatgtctactcacctcaaagctatgagcttccatatttggagtattgtggatgtagactttgctatcaccggcacgcccttgacggagattgatcaccgcaacctccaactcaatgcccaagccatgaatgctttgttcaactctttgagtcaagaggagttcgatagagtgagcaaccttgagaccgcatatgagatttggaacaagttggcggagatccatgagggcacaagcgagtacaaggatgccaagcttcatttcctcaagatccaatatgagacattctccatgttgcctcatgagagtgtgaatgacatgtatgggaggctcaatgtcattgtgaatgatctcaaggggcttggggcaaactacactgatcttgaggttgcccaaaagatgcttagggctctaccggagaagtatgagacccttgtcaccatgctcatcaactccgacatgtcaaggatgacacccgcaagcctcttggggaagatcaacaccaatgacatgtacaagttgaagaagaaggagatggaggaagcctcaccttccaagaagtgcattgctctccaagccgaagttgaagataagggcaagggcaaggtgaatgaagtcaatgaggacttggaggaagagatagcccttcttgatagaaggttcaatgatctcttgggaaggagaaaggagagaggaaggggctccaactcaaataggagaagaaataaaagacccaacaagactctctccaacttgaagtgctttgagtgtggtgagaagggacactttgcttccaagtgctcttccaaggatgatgatggagacaagtcatccaagaaaaagagtggaggctacaagctcatgaagaagctcaagaaggaaggcaagaagattgaggcattcatcggggaatgggactcaaatgaggagagctccgcttcatccgggtccgaggaagaaggtggtgatgatgcaagctccaagaagaagaagatggccgttgttgccatcaaggaggctccatcattgttcgctccaatttgtctcatggcaaagggctcctctaaggtaacatctcttagtgatagtgagagtgatgatgattgtgatgatgtttcctatgatgagcttgtgagtatgtttgaggagttccatgcttatagtgaaaaggagattgtcaacttcaaggccctaaagaaggatcatgcttctttagagatcttgtatgaggagctaaagacctctcatgagagactcaccatttctcatgagaagcttaagaaagctcatgaaaacctccttttcactactcaacatggagctctcattgatgttggcatatcttgtgatttgcttgatgatagtgctacttgccatattgctcatgttgcatcatctagcatttctacctcttgtgatgatcctgtggatatgcctagctctagctctagctcttgtatttctatttatgatgcctcacttgttgttgagaacaatgagcttaaggagcaagtggccaagctcaacaagagtttggagaggtgcttcaagggtaagaacactcttgacaagattttgagtgagcaacggtgcatccttaacaaggagtgacttggattcattccaaagaagggtaagaaaccttctcaccgtgccattcgttttgtcaagtgccgtaaggttgggcatttggtgaatgattgccccggtggtaagccttctaaaacatgcatgtttgattctcattatatgcttaggacggctcataatggtagcattgttgctagatatgtgggttcccctatactcagtggtaaaaagaatgtcatttgggtgcccaaagctttggtctctaacctccaaggacccaaacaagtttgggtacctaaaagagcttgatcttcttttgtaggtgaactaccgcactggtggaagccattgggtgcttgatagtggatgcactcaacacatgaccggtgatagagctatgttcaccacatttgaagaaggagggaaagaacaagaaaaagtgacatttggagacaatagtaaaggaaaggtaattgggttaggtaaaattgctatttccaatgatttgtcaattgataatgtctctcttgttaaatctctaaatttcaatttgctttcggttgctcaaatttgtgatcttggcttgtcatgtgctttcttcctgcaagaggttattgtttctagtcttcttgacaagtcttgtgtgttcaaaggttttagatatggaaatctttatttggttgatttcaattctagtgaagcaaatttgaaaacttgtttagttgcaaaaacttcattgggttggctttggcataggaggctagcccatgttggcatgaatcaattgagcaaactttcaaaacgtgatctagttgtgggcttgaaagatgtgaagtttgagaaagataagctttgtagtgcttgtcaagccggcaagcaagttgcatgttctcatcctactaaaagtatcatgtccacatctataccattggagctcttgcatatggatttgtttggcccaacaacctataagagcattggtggtaatagtcattgtcttgtgattgttgatgattattctcgctatacttgggtgttctttttgcatgataagtctattgttgctgagcttttcaaaaagtttgcaaaaagggcccaaaatgaatttagttgcactcttgtgaaaattagaagtgacaatggttccgagtttaagaataccaatatcgaggactattgtgatgatcttggtattaaacacgaactttccgctacctactcaactcaacaaaatggtgtagtgtagaggaaaaatcgtacattgattgatatggcaaggactttgcttgatgaatatggtgtttccgattccttttgggcggaagccataaacaccgcttgccatgcaaccaataggctttatttgcatcgtctcttgaaaaagacttcctatgagctaattgttgggaggaagccaaatgttgcctattttttgagtttttggttgcaagtgttatatttatcgaaagggtgttagattaaccaaatttgaaagtcggtgtgatgaagggtttcttataggttatgcttcaaatagcaaggcataccgggtctacaacaagaacaaaggtattgtggaagaaaccgccgatgttcaatttgatgagactaatggctcctaagaggggtacgagaatttggatgatgtaggtgatgaaggcttgatgagagctatgaagaacatgtcaattggagatgtcaagcctattgaagtggaagacaagccatccacctccactcaagatgagccatctacttccgctacgccaagtcaagctcaagttgaagtggaggaggagaaggcacaagatccacctatgccaccgaggatacacaccgctctttccaaggatcacccaattgaccaagtgttgggcgacattagtaagggtgttcaaactcgatctcgtgtcgcttcgatttgtgaacattactcgtttgtttcttgtcttgagccaaaacatatagatgaagctctttgtgatccggattggatgaatgctatgcatgaagagctcaacaattttgcaagaaacaaggtgtggactttggttgaaagacctagaaaccacaatgtcatagggacaaagtgggtctttaggaacaaacaagatgagaacgggttggtggtgagaaacaaggcaagattggtggcacaaggttttacacaagttgaaggtttggactttggtgaaacttttgcccccgtggcaagacttgaggttattcgcatccttcttgcatttgcatcatgctttgatataaaactatttcaaatggatgtgaaaagtgcttttctaaatggtaaaattgccgaacttgtctttgttgaacaacctcccggttttgaagatcctaaaaatcctaaccatgtttataaactctcaaaagctctttatggtttaaaacaagctccttgggcttggtatgaaagattgagagattttcttttgtcaaaggatttcaaaattggaaaagttgacaccacccttttcacaaaaatcattggtgatgatttctttgtgtgtcaaatttatgttgatgacatcatattcggttctactaatgaggtattttgcaaggaatttggtgatatgatatctagggaatttgagatgtccacgattggagagttgagcttcttccttggacttcaaatcaagcaactcaaggatgggacgttcgtgagccaaaccaagtacatcaaggatctactcaagaggtctggcttggaggatgcgaagcccatcaagacacctatggcaaccaacgggcatctcgaccttaatgagggaggtaaaccggtagatttaaagctttatcgttctatgattggtagcttgctttaccttaccgcatctaggccggatatcatgtttagtgtttgcatgtgtgcaaggtttcaaaccgctcctaaggagtgtcacttagtggccgtgaaaagaattctaagatatttaaagcattcctctactattggcttgtggtacccaaaaggtgctaagtttaagcttgttggctattccgattcgaattatgccattgcaaagtggatagaaagagcacatccggtagttgccaaatgcttggtagatcctttgtgtcatggtcatccaagaaacaaaactccgtagccctctctaccgccgaggcggaatatgtttcggcgggtagttgttgtgcccaattgctttggatgaaacaaatattgttggactatggcatatccttcaccaaaaccccactcctatgtgacaatgatagtgccataaagatagccaataacccggtccaacattctagaaccaagcatattgacatacgccatcacttcctaagagaccatgtagccaagtgtgacatagtcattagccacataagaaccgaggatcaactagccaacatctttaccaagcctcttgatgaaacccgcttttgcaaattgaggaatgagttaaatgtcatagatttctctaatgtggcttgagatggtgcaccatggttgtttctttttgcattatgtatatttgctctcatttgctcttatgctttggatttgttgccatttggttcttcattgcgaaaatggagcatgtcacattaagggggacttttgtactcttgcatgtgctctacttccctttatatgtgagcaaatcaactagtggtgctagtagtatttccaaaaatgcccaagtcaacataagtcaaaacttttgcaaaatcaatgtaatttgaaaactatctcttggaaaatgtttcaaaaggtttcctatatgttttccacacctcacattgcaagaaaaatgatttttgaatgaaaatcccattttggccctcttttgaagaaactagattcttagttttggccaaaatgagattgagaaggagtttgagaaaagtttcaaaacaaagttagtagagaagaagatttgaaatgtttttggtattcaaacctatttcaaaaaccaaatcattcaaaagttatttgaaaatcaaattcgcccaaaaacccctatagaccataaaaggtcacctcctagcactcaagtgagttttgttacaaatcttcataattttcaaatgttatgaatggttggcaatatttaaactcacacatttcaaaatatgctccaaaagtcaatttttttatcgaatttcattatgtgggggttgtcggcctgtgcaagggctgtgcacagccggcaggtggcctggcggtttgaccggcgctatatgcgcggtctgaccggccaggtttggcggtctaacaggccacatagggccggtctgaccagccgaggtgggcccagggaatttttattccccctcttcttctacccccacctacctctctcctcctcatcctctcacttccccaactcgattttttcttcctctctctcacctcccctcaaaccctaactccttcctccatcaaatccattcaatttgaccacggatttcattctggttacaccgtaagtgattctcctccgcttcctctctctattccatggattagtttgtgtttttgttgagtttttgatccatggcatggaaccctaggtgaagcacgaggtgttcttcaatttgcaccaatagagggtagtttcttggtgtgattcaactcctccaactggtaaatccctctccctcttgtgcattctctcaaatcgatctatttcaccctagggctatgggtagttgttccaatcttgatgaaataggtccaaccctttgatgttctagttccactcttgtgcaatattgttctagcaatttttagactcaaatgagtagatgtgaaaatttttggatgcttgaacttgtgggaggaggtctacctggagccacaggcggtctgaccgtgggtcagccgccggtctgaccggcgagtgcgcccggtctgaccggctggcaaccgtctgaccggcctgatgccgtcagacgccctgctggctgtggtctgaccacccctccataggatatagtcaaattttcacctctccaaattgtttctagaattattgctaatatctatcatcctttactctttgacagtgatgcctccccgcacttgccatggtcgtcgtgcacccactccggatgccgtgagtgagcctgaggaatcgagcggagatgattatgctcaaagtgatgaagaggttgaggcaaatgttgagggggctagtgaggaggctagtggagatgataacagtggaagtggagaggatgaggatgaaggaagtgataatatgcacattgatccctccatccagtttgttgtgaacatgaggaatccatcgcagtataccatcttgaggcaccatgatcagtttttgaggcctcgggacaccccggatccccgttttcacaccgctttccagaagtctgtgtatgagcaggtttatgcagggaaagcatttgcagagcataagtggatttcttggagagacataaatgagactccagagtttgagggattgtaggatctcttcaagactgttggcattgactggattgtgaccctcaagcaagactacaatgaagatttgatccggcagttttatgttacagtgtgggtggctggggactatagtgagatgaagtggatgtccgacaccctccactgttctatctctaggaggcaattccggcggctcctcaatattcgcttggactttggagatgacttgcatgagaagcacacccataatctgctctccatagactatctctctcagttttatgaagatggagtgcggtacacacatgggaaggttgccggcttgaggactatccccagtgtggttaacaggattgtgagagctaccatcctccctcgccttggcaacaatgatgacattaggggggtggcttggcacgtcatcgatgcaatcattcagggccgtcagttcgacattgtgtctctcatgatgcaagagattgccatctccaaggggaccttcactcagggaatctattatgccccttacatcatgaggttgattcaagacaagcttggggctgctgggcaaaatttgaagaagcacaagcagtacaagccccgccttcagcttggagctccctgtgctcctagggcggcgccctcctctcatcctggagctagctcaagctcagcacctcttcctcctcctcctcctgggtatgatccaaatactttcttccatccacagtatgcttattttggaatgcaacccaacgagtacttcaacccggtacttggagctattaataccctaagtgaaagcattcaacgcttgtctaccgggcatgaagctttgcatgaggatgttcgtggcttgcgcaccgatgttggagacttgaatgcttccgtggggagattgcacactagagtgggtacattagattctcgagtccaaatgttggagagctcccaagcatttgtgtatcatcgtagtcatgatgctccttatccttccactttggtgcgtcctccttctcctccacaagagtgaagacatttttggtgcttaatgccaaaagggggataaaagtgtgctttatgttttgtgggttgggactagtagtagtgaggatagtgccctcatatctaataggttaaggtggtttgggctatattttgtatgggtatgggctattactctatattgtgtgttctttgtcgttttgttaaactctatgtcatttggaccctttgtggtcttgtaatagcctatgtttatttgtgagcccttttaggatgatttgtgacttttgtgatttgattggttaagtgatgtgaacttgtgcgatgatggatggtgtatgcgatattgatatatatgtgaccatcttatgcttatggatgaatatttcttgaagtttacattgagatattgcttatgtgtttgtgcttattggaatgtgaaattgaaatgtgcattggctccatatttgttgtctatgattgatatgcacatgtttacggggagcttttgatttccattgcaatatatatatatatatatatatatatatatatatatatatatatttgtggtgtttgtcatcaattaccaaaaacggggagattgaagcatctaggtccccgttgttaattttggtaattaatgacaaacgctaattgtggactagtgctttaatttagaattgatcgaggtgtagggcgatcaaatttgctagtttactttttagtttcgccgtactattaagaggggtaatgacctagcaaagagatgattttaattgccacattaggtcattatgcatttagacttgtgctcacttttcatcacacacacacaatcacttgggatttcactggtttcggcctgaccagtggcggtctgaccagcaagacggcggtctgaccagcgcataaggccggtctgaccggcggcacatgagcggtcagaccggccccctggaggccgggatggtgctgctcgggatggccgatacagagccgacggagctgtattcggtcagaccgagccgatggggtctgaccgcccactcaacgccggtctgaccggccagtccgatggggccctctgacagcgctacaacggctagttttctagccattgcagagtagcacggtctgaccggccacatacctccggtcagaccagcagagcacaaagttgggggattttgcccccaacggctagttttggttggtgggagtataaatactccccctccagcagcaagggggctctcttggtacccaatttaattgcatacaccccttgcacctctatcacacccacttgaactttgtgttcatccatctagtgtgttagaaggttaattagccaagagtcaagtgctttgcttccatttgtagagctagtgtggcacttgattgatcatctccacgccgggtcattgcttgttactcttggaggttgccgcctcctagacgacttgtggaggagttgcccggtgacctctccgagaagattgtggaggaggcccggcgccagtttgtgagtggtttggagttcaccaccttcggagtgaaggaagaactaccctagtgatcgaggcttgggtagtcctctccataagccggctcccgccttgcccaccccttgacgaagggggcgtgcggtggcttcgtgattgagcggtggagttgggctcaccttaacgggaagtaggaaaccgacgagtttccgaacctcggtgaaaaatctcttgtctccttgtctcatttgattgtcgcatttacatttgtgcaatttacatttctagagacatacttgagatcatatcaccctaggattgctcaacattgacataggagtgtgatttactttcctagagatataattgagccactatcaccctaggtttgcaaaacataacttagttgcttagttagaattcaccctcaccaagcctagcaacttaagttagttttgattaggtgtcatttagttttaaatcgcctattcaccccccctagtcgacatctcgatcctacagccaccgccgagacaggcgagagagtgcgagggagagaggcaagagagaaagagagaaggagagagagagagatgtagagacggagagagcaagagggtttgagaagatatggacggaaagacaaagagagcgagatggtttgagaagataaggacagagacgatcggcttgccagctcggctcgcctcgatataggtgccggtttttttaaatgaccaacacctattgtataggtgccggtttttctttagaaccggcacctatagttgtttaaaggtgctggttttatgtgtgcttttagtctgcggagaaaggaacaatattataggtatcggttttaactgttgcatcacctatagtggcaatctgtatgagctttgtttaagtagtgtacggagaataaacagccatatatataaaatgactctttcaagtaaataaatgagcatcgccatcgtcctacaattgatgtttgcgtaaaatggcacacacgccgtccggtttcaacagcctaggatgcccctaataaacagaaaatgaattaagctactcggtacagagacttaattataattaattaggtgtatgtataattgttggaatgaagccatcatatatatcgatcctaagctatagctgcagattaattattgaatagctagctctacttgtttttgagaggcggcttgagcttagctagctttgctaaattgatcattaattgagaggcttgaacttagctagctttgctaaattgatcattaactcaaacttgaagaaaactagcttctctctatctcagaatataaaaatttctagcatttaaaatttgtcacaaaaatatatataggaactctgttacacacttctcatatcaagcaatcacaactatctgatatcatttcatttctcttcgtctttcttaacttaaccaatcataattgaacatcacctacttataatttcatctcttttattaatctctataaagaaaaccttaaaacctagataaaaagaactatatatatagatatgtttatattttgagatctatatgtctatattttgagactgaaggagtatacgatagctaatacaggtaatattgatatggggaattttgtcaaggcgggtcagggtcacagcccgtgcgtcgcgtcatcagaaaaggggcagggcccgggcattgccaggccaccacctgaaggccatcagccaacacccagtactatccagctatagcgttgtatagcctcttcttgcatgatcaatcaaaatctaatggatgcaagctagatgtcacagttagggcactgtcgccacaatgtcctctcttggagggcatatacatgcactaattattattaattcttggaataactagtctggatcaccatgattataactccctgttaaatcctgacgcgacagccagatgaacagtgtgactaattgtgtgcatatggattagtagttaatttgattaattctgcagccaaattgacctgtgtttatgttgatgatgatgatgattatgatgatgatagcaactgcagatgaattcgcactctcgttcgtacgtacgttcaaaaactacgtcccaactaatgctagctgatgatgaattagtctctccgggctccattgatctttcttgtgtgtttgattgatcatgttgactgcagaaaagtattggagctttgctgtatgttcgttgttgctgtacgtgtgctaatataattaggctattagcagtagtttttgtgtactgattctctagagctgtagcgatcactgatggtgaagtagtcggttgttgcgatattcttacctgtccttttttgacattttcttcccttccagtacatgtacatgtaacagtctctcgtattaattgtgcactacctccagtgaaaaatatttgacgccaaatatatgctccctccattttcaattataagggcccctttgaatcgcaggattaagaaaacgtaataatagaaaaatgtacaatattgatataaatgtaggtgtaaaatagaggattgcaaaacacaggaatgacggtttgattggaccgcaggaaaaacacaggaattagaggagagataaagactcaaagaaaagtttctattaggtagaacctcatgttagttttcctacaaaatttacatggcattaggtattccatagaagttttataggattcattcctttgattcaaaggaatatataagaaaattcttgtaggaataaaatcctctaaaatttctatgaatcaaagggggcctaaaacgcgtatgcatgtatgtatgtaattaattagcacatctcatatcttatatgtcaaaaaattagcgcatcccatatcctttagtttgtattttaaatcatatattctcaagatctctaattttattggattcgcgcatgcattatatttactagaattacataaacgaaaagatgatgataattattttttggttttttagttacaccgtattactccgtactacattttagaatagatggtatagtgattagtgatttgtcataatagtaataatatcatatgtgtatatgcgcaaattttagtgattggagtaatgatttgaattgtacgagtatatcagtgttataatttgatggtggtgaatagtataattagttttgttggtgaagtaattattacaagagaatgggcggctataattgttgggagggagacacgtgtataagttagaacaggcagcagacagcggtctctgtcgagcgtcgcgacaacggggcaataacttggaaagcgattgtcggcatcacctacgggcgccacgtggacagcatcactcgaatgtgggcccagcgccgtttcacaccacgaacatcagtatacgatctcaccggtttccaaacgtactccccctttttcttggtggagattaaagagatagctaaagttaaatagtgatggtttgtgtttggtttaaatgaaatactactagttgatagagaaattaaataaaaaatgattatcattggttgagttagaaaggaaaaatatgtagtacatatcccattgaatctaggaataaaatttttactcttagatttgaaaatgattacaaatggttgagataggaagaaaaatatgtagtgcaaaacacatgtacactaaaaatctagaaactaccatttaatctgggagtacaatttttactcttgttgatgtggaagcttccatttctagatccaacagtaatttctaggttttcacagatagaaaagtagatagagagattgctactctgcagtagagaagggtgtgataccattttttttattttttatgtacttttatccttatattaaaaaaacacgtacacataaaagtatgctctgcatgttagcaatgtttgtgtgcatatatatatatacaactgtacattttttatgaatcataaattaattgtctaaaatttatatcatcaaatctaaaatatggatatcaatagtgtgacgtatatacacatgcttctttatagaggtcatatttttatcggaagtcgaagacatatattagtattgcaaagaaagaactcatatgccattaattaagctatatctggtaattaaacccatgcaatgcatgctcagtaaacaagactcgagtggggactacggagtggctcgttttcagatctgacagaagagatgatgaaatgatcagaaaacgtcgagcattctaattaagagggctagccgtcaaacctagctacaacttaaaaatacgatatttgtgaaataaatcatcaagctaaaagtatggtcagcaaatattaatcggcactaattactccttttgacaaaaaaaaagaaaaaaaagaaaagaggaacatatcaaccaaaaggaaagtaactttgctgcatgatggctatatataattcgtgcagccataaagaggagcaaaagatctaggtctctgcaggcatgtcgtcgttcttagcttctttgtcttcttcctcgtgcggtgtagctctagatcaaactatgcaattaatcccagtcctgtaattaaaattcatgcaagatttggtgaaatttgtggagaacaaaatcgataatcctagctactagttgcgccgtcattatcgcattgcaacgtataactgtcttgtgatatgtccacgcaatgactagtacactgctccctcctgatctcctctgaattaaaaaaagagatgatgatatgatgatgatagaacagaaaaataaacagtgctagcgctgagctgctatatatctgacttttcttcgttctaatgatgatgagtcatcgtgacaacgcccctcttgtttaatcgaaaattaatcaatgactcgatatcgaatctgcgattaagaataatgtcaatgcgccgatcgaatcggatgctgtttcttgtgccctacttttgggcaaagcaattaaatatatatctgatattaaccggttaattaatttactcgattatactattagagaagccatgatcttatatttagccgtcgtacctaccaatactaaaagcagacaagaattcaagacgtcgtccaaccacagctctgcaacggctgcacagagacaagactcttgcatacattgctttctttgtttagggcaagagggcgccgccatttgcatggagtagttagggttaattagttccatatactccagtatcgcgaaagctacgtacgtacttcaagtactatatataataaattaattggtacgtatatacttgctaagtgagttttggaatcaaataaattaatgcaaaatttcattgtacatgcaaaatatctgcagaatttttatatgggattgatcttaaggtggattgggcatttaataaacaatatgcatattttgtagatacataattatgcaagggcacattcagtggctataatgaatttaatatccgttgtgctaaagagcgcacctcgcagtaacccactcgactcgctcccctccccttccctcttatgtataaaaggttaatcccacgtctcgcctttacattggttttgtcgctaggatgtccatcagtctcctcccgtcccctcccccctctctccacttgatgaaaaaaattatcctcatctctcaaagaattgaaaagatcttgcaagtaacttttttccaatgctagcttcctctcatcttgatccattttttctaccataagtgatgtgaatttctttttttacataaagacaagggggatgggggtacgtgtggacgggatatcaggagagtgaggaagggggtggatggtacaggtggagaacctaccaacaaaattaatgtttgggtaaatgtgagtaatattttttttttacataaggagagaggggaaccagtctctttaccaaaagcagtgtggtgtggctccttttagcacgcactcgctccccctctctctctctctctctttatctctctctaagatataatagagtgagcaacaaaattgtccacggcaataaggaaatttgccacgtacatgtcgcaaaggtaacctttagctatattagacgaaatttacgttgaattgtacttcttttttttaactgaagcaattcacttaagttgtcatcacaagcgcactaattctgtgatggaggtgacattaataataaaatccagcgagagatgtgggtgacaaagtgcagagtggagacatgtagagacatggttctctttcagtaaaaaggtatacgtgttcaagtgactgaaagagcatgtcaatgtacaccttataaagtattgagctacgacatattgctttagtttttagctcatctatcacccaattcagtcaagtgtgatcgagagatcaaatgtttttcaaagaatcaaaaggtgctcgacctaataatggccgatatatatcatgttaattaatcccaaagggatcaaccaggcagctagcagcaagcctccgcgagcaagaatcggctttatttggtcattttattaacttgttaattaattaaacatgtttaggtgagggattaattaattaactaacgggaggagtggtgcaactatgctgtcattaattaatcaatctagggtaaattaatagcacactgacccatctcgtttagcctctgcttatctcacagcccttggagcgatgcgtctcccggccaaaattctattgcccgatcgatcgattcggatttcgccgaatctaatgatgtcaatcacgcaatgatttaattagcctaatctcgaaagccacttctccaccactcattttgttaattaatctctgggattatattagtaactagctgtagtggaaggtggcatcatatgcagcatgcaaagatttttattaactatatgtggaaggggtagatgattaatttttgtataaatgtagtaaacactttggtagcacagttaacgccttgctataataggagatgtacacatatatatatacacacacacacacacgatcgtcgcaatcattaaccattctaatacgtatacgtatctgtagtgtgcaggtcggccggaggaaaccgttaaacaaacattaacttttgaaaaattatttaatctgcttttgttctctttttgtttggaccttctccgtgcatggaaagtttgtgttctaaatgtagaagcttgctttggaccaatttgggttgatacaaaagtttcatatagtagcttttttgtagtacgtaggccaattgatcatgtgaaatttatttgatcatatatatctcttcctattttaattcaatttaataagcctataaatcccacataaaagcttccttacatttctacagctaggttgcctttataaaagagtacttactttccatatatactccaccttttgtacatcttgtttatatggtcaaatggatataataaatacatgcaactttccctattcttttattgattgtgtttttttatatggagtgcttgaaatttatcatacagcctataatataattcttgggaccaccaaaatcgccacataggtatacgataagttgtcttggtacatgtaagggtaaaaaaaaattttcacatatgggctatggtaaaagggtagaaataggaaaataactttttttcccaatggtatatgtcaaatttagccttacattattaatttgttttctcctttttttttcttatactgatcatcgtataagtttttctaccaaaaccaagaaagtctgattttcctatattttatttaatgagaatgtgatggagaaaaatcaagaagcatgcacactttaactttccccacgcacaagaaacgagagctttactgccccaagtgcatgcatacacttctggttatatgatgataatatatatgtaatggagggaataatatataagcgaaagtcgccatcaatatggaatggcatgtatgaggtgattttagtggacccaccaccaaagaactatattaggccacataacaaatttcaagagcttatttatagaaaaaaaaagaaaggtcgagtagtaaattgaccccagagcaaaactttagatgccatagatgccataaattgttactctccctctgaaagctcttctttgataggaaaaaaatttcataggaactacacattataatttccgtctaaatatacaatcatacatatatatttcatccgtttcacaatgtaagactttctagcatcatccatattcatatggatattaatgaatctaaatttatatgtgtgtctaaatttattaacatctatataaatatagacaacgctagaaagtcttatattattaaacggatgaagtaccttgtttctacgtacgattcaaacatggtatataagataaacatgtcgtcgtctgaacaacaaataaatattttgtctcgatgtcctcttggtagttgcacgccgaacgttctgcccatttttcagcgtaatcggatagaattgaaatccatatcttcgtctgcttctagcagctagcatcagcttgtccgtatgcttcagagagaggaaatatcatcgccgtccacaatataatgccgatcgaacactgtactaagatatatataaaaaattttgttgctgaggcaagaactagaccggtgtcgttgctggtccaacttggccaatggccatatatatatatatatatatatatatatagttttgcatatatatatatatatatatatatatatatatatatatatatatatatatatatatatatatatatatatatatatatagacacacacacacacaccccctagtaatagctggtcccatgtacatatatatgcttaattgggttagctcgagctaactggggtgccaaaatgaatgctcgctctagtttaagtgcatgcttggtcaagatggataggggatcagatctagtttccctgtatgcgccccaccaaatcatcacggacatagatatgtcccctgcctctaattaatctgatccactccgttaaatatataaatatataaatatatatatatatatatatatatatatatatatatatatatatatatatatatatatat

SEQ ID NO: 42424 - DNA, 4772 bp, Oryza sativa
tgttcccatcaacttgaactgattaactgctgcgcctaacctctaaattaacctgtggcgctggagtgactgagggaggagagagagagaggcggaggagaagaaaaaagaaagactatgttcgttttctattttcccctactgatatgcccatattattaatgattaattactccgctgtcatcggctataatagtttttattctgtatcttactcctctcttaatcaatggtacatattggttcacctctcaataaacaccgtaataatttatcgtgcaaaaaaaaaggtaatcaaactcagaatggggtgtgtgtactgaagaaccatgtcaatgtcctaaacacacatacacataaaaaggaacaggtggaaagtatgtatagattgattggatatacttagttaaatactaaagtcaatgcatgaaccacatgttcatatatattgtattgtacttaaagtatcatcaccatgtacaataataataatacaacgtaggagtgttggtacgtactcaacgatcagtaacatgcaaacacatcgcacttttgttaggtgaagagacagcaacgtggcagtgtgtgtatatatatattattacatgcatggtattgaccattggtgaacgtgcatgaattaagactacacggtcagtacatgcaaattgtagtagtagaaatgtatcaaatcatcaaaaaagctgcatacattgcgtaattaactgggtttaatttgttgaattttccgatcgatcgatgtgtcttcaacacatcaaatcaatgcagaatttcaaaaggaggatgcatggccagaagaaagaacaagatgatgagctcatcatcgaagtagtatatatgctttgatagctccaggtaagacattgtacgtatggcgccgtcgctgtcacacaaacaaaaggagaagagaaaaataaaaatttataagaaagaacacaagtctctttcgcgccactaagaaggcaaccattttttagggtttttttttttctaaaagatcgatcgagatgtcgaacacgaaaataaaacacacgtatatatcaatcggcatcgagtaatgaatttgctggcatcgatggatcggtcgatgttaattcagatttcagagtgagagtagtaggcagcatgtcaccatgcacatgcatccatccatcgatatatctatctacctagccattgggcccggttaattgcaaattaaggtgcgacgacgagaacgagtttatactacaagcaggctcctggttcaaaatttcagttctatcggacctcccctccacccccaacccccatattatattattttggtcaaaattttcaattttttaatttattgaatttggtaacattttgtttaagtttgacttttttttgaaaattcaaaaaaaattggatcgacgtttcaaaaattttggtatatcggcgtcgctgatagaaatgccgaaaatgaaatattgaaccagagcatgctagagttcagaaacactggttatgtagatatttttcaatcatagatagagctttaattagctgtatgattttatcatgattgtaataaatgcatggttttaaatctctaactatagataccgctatcttcggttatagctatttgaatagagatatagttatttgttcttgcatacaatttaaccgctatagctgctgctataactgtttgagaagaccaactgttaaataccttagcccgtcttttaaaacactgaataaatgtaatatatgtctgtctatatggtggtatttctttttctatcttatcgatggtctgttatgagttggctgaagttatctggacacatattgaaacaagtggctatagtctttttaagcaaatcaaataatatatattgttattaattatgttaaataaatctagctaggccatatgtgcatgcatcatcagagattcagaaacaatatttccttcgcctaattaataattagtcgtactctatataacttataagctgtactttttaatgaaaagatatcttgaatccatgcatgcataatgaagcatgttcaatttactaatccttacgattttacaatccaatcatcatgctgtcgaattcccaagaatcagcgatatagcgtatctcgtgaaagtgatatcgggggctccatttcttcgccttgttttgtccatttcttcctcctctgctgctggcatgcacgcttctcctttattttttttccatgcatatgatctcatgaacagggccatcttgtttgattcttccctttaaaactacaaaatgctttctccttttcatctttttgagttgacatattgtctaacctatagctacttttaataaacaaacaaattaacaccttctagaatgatgagttttttaactttaaagacagaaattaatcatgttctacacatatatagtactatatatatcacctgcttaattagtaactgatttaatcctgagtatatatacatgtggcagctgaggaaaagaagtaattaaataaattagcaacgaacctagctagtcggctagctctaggtaggtatatagggcgtatttttggatattttcttggcatgagccggctaggtttgctgctgtgtttgaatgaagaaaataggtctcgtcgaaatcagagtagggcccacccgtcggtactgcctccaaaaggccaagcaaaacttcaaacacgtcgtcatgcatgcatggagattaattatttgcaaggattaattttattaactcgatcgactgcagtatattgcatcatttcaaatgcataactaaaataatactccctccattttttaaatattttattgagaaacacaggacaaacataaatacataatcactcataagtcataacgcgcgcatacttataccctcattctttttatatgatgttggtttgttcaatagtactctctccgtttcaggttaattataagacgttttaattttaattaaagtcaaactatttcaagtttgactaagtttataaataaatatagtaatatttataatattaaattagtttcatcaaatcaataattaaatatattttcataataaatttgtaatgggttaaaaatgttactatttttttttataaatttggtcaatcataaaacagtttaattttaaccaaagtcaaaacatcttataacatgaaacggatgtagtataaaaaaacagattatatgatcgattgttttagactatgtgattagctgcaaaataattaatccacatcgactcgcgcaaatcaaacgcatgcatgggtcgatgaatgcagcaatgcagcatagtgctaagtgctaactacagttcgatcgatccagtcacgatgctgtgatggatatatgattgaaattattagttttcgatcgatgatcgatgcagcgagagccgtacggcctaactgatcgtgctgctcatgaatgaaaatgcattatgcagatgggagtcatggagagaggtatgggctccaaggaggatctgtcgagaggtcgatcgatcgccggcatgcagcttgattgatctgcaaaacattttctatctacccttggattcatgcatgcgtgatactatgatttaattcattacctcagctcaatatgatgcataaatataaccgttgttatactatggttgagttaaatttcagcaaaatagagagaaaaattcgaccaacttgtaataagtcattaggtggaacaattgttatacattatttttttttcttgtttttaagtagttttcttgctttgtaattaatccatgattttataattcatagctatccgtcatacaaactctgcagtaattagatatagcttctttaaagtaaatatcgaaatgaattcgatgatcttaaaaaaataaacagagtggtgactaattaatgtattaggccggtaataataattcaaacaaattgtttatactagagatttaaaacaatctaacctttatatgtctaagcatgtagctggccaattttaaacaaattggtaaaactaaatttctgacatttagaaatcatcatatggttaaacaagggagcacacatatagatatatacagaacgcaaaccacatggacatgacaaagattttaattggatatattattcgttacttcgaatggaattttatctgaaagttcagcatcggatagaattaagcccaataacatttgggctcttaatgctggtgaatcctgcagcagatgtagaacagccagatgtgtgtcaagcctagttggtgggccagaattgcaatcaccgaggcccataaccacatacatataggccggtacttgtctcaggcccagcccaatctgtgaggctgcaatcattccattttggaaaaagtacaccggaggtccttcaacttgtcatcgagttacaaaatcgtcccccaaccgcaaaaccggatatatgaccacccttaactcacgaaaccgttcactttaggtccttgggtggttttgaccccgggtttgtccgacgtggcagctgaatcagcgtgggacccatgtgggtcccacatgtcaggaggccacatcatcagtcatcaccctctctcctctttctttcccctcatctcgcccttcatcggttcctcctctttctcactcttctcagcggcggcgccggctgcgaggtaggaggaaggaggacgtcgacgtcggcggcggcaagacgcgggagaaggggagggcgtcgacgccgcgcga

SEQ ID NO: 42425 - DNA, 15761 bp, Oryza sativa
gggcgccaggatgtcctctcccacctagcagccgccgccgtgtcgtcgggtgccggatgtcctctcccgattcgtagccgccaccgcgtcgccgggccccggatctcctctcccgcctcgcagccgttgccgccgccgcctcgtcgcccggcgccgcgtcgcccaccgccggatctcctttcccacctaggcacggcgacctcctcccctcccaccggccaccgtgcagagagaagcaaagtgacagagagaggggatgaagggagaggagggaaagagatggtgatgatgtggcatattgacatgtgggacctatgtgggtcccacgctgactcagccgccacgtcggacaaacctgggtccaaaaccaccgaaggacctaaagtaaacggtttcgtgagttaagggatatcctatatccggttttgtggttgggggatgattttgtaactcgatgataagttgagggacctctggtgtactttttccttccatttttacctcattgctgtcaaactgctatcaatgctaatcaacatagtacaagattgcaatatttcattttttttttcacctacaagcaagcattaactcaagggactgtccaccagttgatagaaaccctttagaaatcatgtaaattttaaaccattcgattactttaagattcatacaaatcaatcaaaccctaaaacccatttgttcctctctctctccgccccccttctcccaactcccccacacgctgccaatgctatcacaggcgtctaatcgcgatctgcaccatctccaccaccttcgccccagcgtgccaaggtctggctggccgaaatgtgtcaatgactctggcaaggcctcccaatcttgccttctttcactccctctcctctcttttttctcaagccagcggggtgagttgcccccgctcagctagatccaccaccactgaccgtcgcttctaaccattccttctgctttgtctcctgcagccaacactagcccgtcgcatgcttatgatcccgtggcttcggcggcgccgcggctgcctcgctgctcaccacgggttaccctcccatgtccgttcctctaaagccgacgacatccccccttccccctccctccaccccaatgaccctaatccgtaggtccctagtgaggcttggggttggaaaagatgaggaggttgtttgagctgaaggagaagggtggtaacaggaatcacaaaagcacatccgatgatacaaaatctacaacatttggaagtccattttctatcaatgaaggttagcagtttcgttaattcaagttatcgacaaacagggtgcacgattgcaaacaagaaccgtcagccataatctcaaaggaacaaagcggctattaattacactgaattgaacacatgaaacgccacattcatcgatcgaaaatgcaaatacgtacaagatgacacactccatttaattaacacaaactaacagtttgaacttgaacaaacactgatcctaaattatcgacagcaacgacactgcttgaacaaccctgaattaagcaagttaattcgagcaatcattaatcctaaatgaaattacaatcctacagtagatattacgcgcttgatagtttatcaaagtgtcaaaccaagccggccatggccatcgcggcagccgacacgacgggagcgaagaacgacgccgcggcgaacgcggatcccgccgccgctccggtgtcgtagtccgtcgacggcgccggcgctgctgccggcggcacggcggcgaggacgttgatcatgagcctctggccctcgttgcagcggccgaggtcggggctggcgaagtaggcgaagccggggacctagaggtagaacaccctggcgccgtcgcccggcacgggggcgtcgccggcgtcgacgccggccgtctcgttgcagtggtagtaccccgccttgctcaccttgatcaccgagtcgttcctgtactcgaactctgccaccacacgccatggatgcgaatgcgaatgcaaaatcaaagaagaggagatcgatgacgagttgacgacgatgagatgaaactgccgttgattcgttaccgatggagtcgccgacgtagaaggcgatggacgacgcccaccgggagtagtacaactcctcctcctccggcggcggggcgatccacccgtcggggccaccgacgcggtactgctcccctgccgccgccgccgccgcgccggcggcgaggacagccacgggaggagacggagacgagacgaagccgcgacagccgccatgcctgactgactgatgaaagcgccgatcgatggagcgattgccggagatcgaagaagaaagaagcggaaactgctcgtacgtgtgattgatggtgtgccgcggcgatcgacagaagtggcaagaatttataggcggaggcgcgcgatcgatcgatcgagccgttgagagggggagcgtcggcggcggttgcgtcaaaaagcctcgtcggcgccgcgcgcgcgggagggagtggagaacgtggccgtttgaactcggtcgtctccgcgcgctctgcagttgcatatgcgatgcgaacttgttcgtgtctgcaccgtgaagacgaggtttggaattcagcccatttgtttttcgtcaacaatttcggtccataggggtgtatgggcttgaattacggcccatacatgtggaccggtgggccggccctttaacgataatgggcctggagttgtctgttcattattaagctttggaataagttcactttaggtccctctatttcttcgtcagttcgattttcatcccttaaccgcaaaaccgggtataacccgtcccccaacttacgaaaaccgggcaaacgaggtcccctagcagtatggagcgtagttttaattgactgacgtggcacttgcatggctcctttgactgatattcgtcccacgtggcattgacatggcgtttacatggcaattttatccccacaaaataataaaaatcgtgggacccatatgtcagctacacacaaaataattcctctctctctcgcagccagagcaagcgatgggtggggccgagaggggcgggccgggccgcaaccggagtaggccggcaaagcggcggcgaccggagcaggcgaggggcaaggcggcgctccacgcactccctcttcttcatcatcgcgccgcggcgccgcctcacagccggcggagcggcggcggagcggagggccaggcggagtggcggggcggcggcatgccgcggccacgagacgagcttgtagatgacacggctccccgtacccatcgccacgaccgccgcggtggcgattgccatgtccatcctggcgctcctcccaaccccagcagcgctccccaccaccttccccgccgtcgcgcacctcgccggcgcatactccctagggtcacccttctcgttcccaaccacaccgccacctcgatgcaccgcacgtgcgccacctgcatcacctccctctgcctcatggtagggaggagctccatcgccgccgccgccggcggtccgttcgtcagggatgcaggtatgggttgctccgctcccgccggtcgccgtcgcgtgcccctttggccaccgccacgacttctcccccgccggccggccgctccgcccctctgctccgcccacgacgcaccgctcctcctcttcttccccgccgccgctccggccgtcgaccggccgctgaccaccccacttcgcccattggctccacccctctgctctaccaccgctccgcccaacggcttcgccacgctgctccggccacccctctactccgcccaatggctttgccttgccgtcggccgcccgcctcgctgctccggccgccaactggccgcttcgcgccatgacacggcgccgctctgaccgccgaccatccctatgctccaccccaccgtcgcccgctccggccgccacccaccacgctccgccggcttgagagagaggagggagagagaggatagagggagaggagatagagagaagaggtagtgatgatgacgtgtgggtccacatgggcccatcattttttattatttgtgtgtgaaactgacatgtgggtcccacaagttttattattttatcggatctaattaccacgtaagcgtcacgtcaacaacacgttagacaaaaacctagtcaaaatgagtcacataggtgctacctcagccaaaaccagatataatactgttgaggggcccatttaaactgttccgtaagttgggggacccgtcgtatccggttttgtgactaaacgaaaatcggacaggggcgacaaatggagggccccaaagtgaacttattccttaagctttttaatggacctctgttaagacccacaagtttatgtgggcctggtaattatctggcggcccatccagaattccagacaaggctagtcaactcggcaagggtttcctcgccgttgccgtcgccgtcgccgtcgccgctgccgcttccgcttgcgtgccctcgtcgccgtcgaatcgctcgcccgtcggtcgggtccggtgacctcgctgcctccgagatcctcctctcctcgcctgcgcgctcttcccgtcggctagaagggctgcttcttccgtcccggctccgtcgccatccccccgccggcggcgacttgggcggcctcggctacttcgcccttgttttccggccaagttgaaggttccggttccgtttccgatcctcaggtaaaagagcacatacttctccaatcatttgaatagctaacagcaatccattgtgcatttgtgcttcatgcggctacggatgtatccatcaattagttgagagataggatcgattcactgtgtgttctactgatgtgtaaatgccgctatgttctgcatcatctgtgctgtgggatttgctatttctgttactttgatgcggccgcggtaatgtataggagtaggaaggatttattggcatttcaccaatcgtccttagttaggtagctgatgcgacgctgaagttggctgcactgcctcaacagtataactgagggcctttccttgaatcattcgtgtgacttctttcacattcctctgttgtttggaggaataccaagggggatgggctcatctgtagagtattttttaaaatatagacagtagcatgtgttctggatcataaactatgcgaaattgcgagccaaaattttgatgcaaggttgctttgttacaaatatgatctgtatttccttgatttaaaattaagttgttgtgtaatttgttcaactacaaagaatgtaaaatcttgggactcggattgttggcctgtatttcacgcataaaactacaaatattgttatgcttttgtttaactcctcaggggttttgcagccagcactcgaattttcatcattgttttaggcatttgatattcttatcagttcatcattctaaaattaatctactcggattctaatagattttgagaaaatggatcctgaagatcttactgactctgaggaagatgaagatgatgacatgatgttttttatcttgcctacactatatcttgtttctactggaagcgaagagccatgtcatacatcgaagttcagtggtgcagagtggatttgtgaagtgcttgaagatgaccgtggtgaaggctatgccaaatttcgaatggagcctcaaattcttcagaaattttcagaccttcttaggtcaaagaatcttttgcggaatacaagaggcgtttctgtggaagagcaaattggcatgtttatttatatgctctctcgaaatgccagctttcagaaaatgagtgatagatttgagcacagtagggagactatccatagacatatcaaggcatgctttgatgcaatcacctcattgacagatgagtttgtcaagcatccttcaactgagactcattggaaaatatcatctgatccgcaatatgggccttattttaaggtaggtttaacctgtctctttgcattgtatgaagttctacacttctctgctacatctgaatcagtagtgtgtttccttgcagaactgtataggggcaatcgatggagttcatgtacctatcacaatatcagactatgaagcagctccatatcgaaatatagaagattccctttctcaaaatgtgatgctggcttgtgactttgatttgaattttgtccatgtgtgcagtggccacgaagggtctgcatccgacgcggcagtcctatatgctgctgtggagtctggatttgaagtcccaagtaacaagtattatttggttgataggggttatgcaaacacaccatcttttcttgctccttatagagaagctgcataccatattgaagaggaggagcagagcaattgtcagccaagtgactacaaggagttgttcaaccttcgtcactcaaagctgcgcaacaacataaagcgtgccacagcgctattgaagatgaggttcccaattttaaatgtcgcaacattctatcagatagaaactcaagcgaaaatcccagcagcagcagtggtgctgcacaatataatgcagggccaaaaagatgatgatgatgatgatgggtgggcatttaaccaggcaatgccagtttcatcccgtagaactgtagttttacccagtggggatgatgcttatggcaatgatgtcgaagaactgaacaaccaatgtagcatgggtgatgcttgagagattatattgcgaagaagatgtggacagattatgaaaggaacaggaggtaggtttccctattctgaggccaaacaacatataggtgaaaggaaagagctgctcatgtgtgatttgtatcttgaattctgatgtttatggttaaagatggaactaggcaatgccctgtagaagctgtactcagttgacacccaccagtaagatatggcattttcatgtcctccatttggctatcaatctgtgtggatgttgtggttgccaagatagtgccttgctagcaaacatggcgtggcatttaactaccgccacgccagtataaatggcgtaacaaaagaggaattgcctatgcatccgtcgggtgatttttgagaaaaattatctccctttagatttgcatcttacggactaaaaaaataccaactagaaatttcaattgtcaacaatcaacaaatactataaaatttccaactaataaaatgcttaacacgctcaggcacagcttccagattacacccgaatttaccgtacgtaacctaatttaccccaaaatcacacgaatttaccctcggggactcaaaggtggagctgaagtctagctaaacagtttcagctctatttaaaatgagtgtggagctgcttggagtgtgttctcacaaaatgaattagagaaaatgaactacagaggtggagctgggtttaggctgctctacaactccactctaaacccaattcctaaagttaaatttatgagttggagctctaccaaatatgtctatctttcctaagtaagatagaatatgcgatactatttttatatttttctttattcctgtgacgtgaaggctttactagtagtagtactttgaaaacagatcaagctgcatcccggcaacaaatcattgaactatacaagaatttttattacatgataggaattgctgcttgaaatgcatcagtaaataacagtgtgcaaatgtatcgtgttgtagcagcaaaaacatctgtagcttactgctgtagtgatcaagaaacttcggaagataaattcggcagtgctgcagacaccaatttattacctaacgttcatgcttcattcctcagtgttccacttctattgacaccattttattacctaacgtcaaatgctcgtggcgaaaaatgcttcctttattgacattacctcactatatacatcatgtatcaatggccgatcttttggcgactcttcagagcattccaggccaagtttaaggagttgtagagcacagatatccattatacctgtcttgtgttcatgcaattgcagggtatgattagaaggttgttctgtcatttcaggaataagcctggggtcaagtatgtctttgatctgtgaaagtgatgcattgacatacatgcggagtgtgaagccatcagtaaatatttcattggtagggtgtcttcctgttagcatttccagaagaataatgccataactatagacatcaccctcagttgagatttgactgcccatgccatactctgcaatgttttgaaaccaaaaagctcagatcaccagtaaaatgaaccatattgttaatcataaaatactgaagtcctttttattaaatgatactctgctttgtttgaaaacaaaagattcagataaccagcaaaatataggagtaccatattataatcataagagatttttttagataatgggaatttttaaaccccgcttctacagcaacgggggtgtataatcataagagatataatcgtaatttcgttatattaaataaatgattttctgcagtgtgctctgaaaagtgaaaaccaactcaccaggagcaatgtacccaatagacccccttggcccagccatgcttcttgatatgctttgagttccggatgaatattcacgaattgaccttgccagaccaaagtcacagacgcaggcaacatagtcatggttgaaaagtacattgcttggcttcaaatcgcagtgaacaacaggtggaatgcattggttgtgaaggtattctagagcagaagcaatatcaaatgctatgctaatcctttctcccaaactcaaatcaccacatggatcaaaccttgtgtgtagtcggctttctaggctaccattagccatatattcaaatactagagccttgaactcactgcccatcggatcataagttgagcatgcagttatcaccttgacaagatttcggtgacggatgttcttcaatgctttgcactctgccataaagctatccaatgcaccacactgatcgagcttgaacaccttaacagcgaccatagtgtcttctgtatccagtatacctctatagactgtcccaaaatgcccagagccgactatgttggctgcagaaaaattatttgttgctttgctaacatcactgtatgttaactttttcagctccatgtaggagtgatctatgtgctcattggatttccccttccttttcaggaaaacatttacgatcaacaaatataatccgaggattgaagaaagtaagacaatagatgaaaaaactgccaacattggaataacgagcttatgctttcttttggatgctgaagcagagcagacagtcaactcgtccattggaacattggtgcaaaggtgtggatttccttggacaaacaccttatctctgtcagaaaatattccaccaactggaattggcccctcaaagttgttgtatgacatatttagatactgtaatgaggtgaaagtcccaaagaaatccggtattgcaccagataaattgttcgcggagaaatccagcactttggtgcctctgaggtttgctaatgattgtggaatacttccctctaggaggttgcctgctacacgaagtgattccaatcggacgcaagaaccaagtgtagatgggatcctgcctgtgagtctgttgtgggaaatgttcaaagaagcaagatttatcaggctaccaaattttagtggtatggagcttatgaattggttgtgtgataaatcaagtagccaactcaattgatttagcttgacaaacatgtctccgcttatgcttccagtaagggcattacttgaaaggttcaatgccaacaattgttggcacctcgctaaagttgtaggtattcttccactcagttgattttctgataaataaagttcagccaattgattcaagttaccaatggattgtggtatttctcctgaaaatttgttttgtgaaaggctaaggacaacaagattgtttagttggccaagagtatgaggtatgctccctgtcaatagattgttatcaagatagagtagggacatgctagataggttcccaatctccaagggaatggtgccagatatatagtttgacgggagagcgagtgaagttaatgttttcggcaggtcggctacagagctgggcatgtccccacgtaggttattttcaccaaagtgcagtttcagcagattggagcaatttttcaaggatgataggaatgcccagtctccagcttctaactggtttgagtacagcatgacaacctgcaaatctgtcatcaaactaaaagaaggaatcacccctctcaaagagttgttggccaggtacagaaactgcatgttggaagcattagctagagatttagggatttctccaacaaaatggttgttagacatcatgagaacttggatgttaggaagtgtgtttcctatgtcaggaggcatcatcccctcaagattgttgttggccaaaccgagaaaactgatggacgacatgttgtaaatggagggatttacagccccagaaagattgttgtaagagaggtcaagatattgtagcgccgacagcttactaaaatccggtatacttccctgcaactggttttgtgcagctaaaaatgctgtaagcgatgagagattcgctagagatggtggtatgcctcctgacaggctatttgttgtaagatcaaggttggtgatccgtgaagtgaacatcgttacgggtggaattgcaccagaaagattgtttttcctaaggtatatctccctgatggttgagctgttgaaaagtgctgcagggatgctcccgtagaggctattgttcttcagtgaaagatagcggagtgacgacgcattagccaagaacaatgggatctctccggtcaggtagttgtccgcgaggccgacagactccaacgccgatgagctcccaagcaatggtgggattctgccatggaggttgttgctggttaggtccagggatgagaggttaggaagcgtaccgaggcctcgtgggatctcaccactgatcgcgttgaagctgaggttgaggtactggagcctggccacatcggctgtgaatgtgaggccacctgagaggccattgttggggaggtggattctcgcgagggacgagaggttggagatgcagggtgggatctctccggtgaggcctcctgcctccatgtccagggccacaaccacacgaggtcgttcttggagcttgatggagcaagtgacgccgcgccaggtgcagaaatcgggtgagatggtgttgctccatgtggagaaggcggacccgtttgggcttgaaagatgtgatttcaggcaaagcagtgcttcccgttcatcagctaatgctgtcagggtggagaagaagaggattgcagcgactgcaaccagagctgcacatgccatcttgcttaatttgctggtgtgtattttggacagtatgctggtggtaagttatgagatgcttgtgattcttaattatagtggactaggatgcgtcaagatcttctacccattaaaaccatatattggccacatctttgacccatgttgattgttggatggtgccatattcttagtcaaatagtgaatgcattaattcctgttgaacatgattaggttgcgtgcatggacttaattacggagatcttgttgaattaagctttgactagattgttttattatgcaaactttcagaccttatttttcagcaaaataagtaatggtaccttattagttagttataccaactgacaatttgcctgcctacgtacattttccaacatccgtctgacggtattttgcgacgcggtgtagaccagttctgaacttctgatggttcatttgaaaagcatgatctttttccaatttcacctaacaatccacaaagtaaactgtgctatcaaacctcttacatattttgtgcattagacaaacacttttgtcctatggtgccctgttgtcaggaaaaaggaatatcaatgctttataaaactaattggaggaacatgatggatattaattttaaacgtatttgttattttctttggcagatcactaatctatatttgtagagcttatatcgttattactttggattatgtcatcgaacatgtcaatcatgggaaaattgtcactgtccacaggtatgaaatagttgaaacttcaagaatagaaaagtaagaacaaatttacgtggtaatttcctcgacaatggaagtccattccattacattagtcaacacatgatctgcctcaaagtcgtatgaaattgataagtctggaaatttcaccttatcctttcgataccaatgatgtatctttgacatttgtgactggtttaggcccagtcactgctcattggtcgttgataagaaaacatcatataaaaacttctaaaatttataaataattagttataagttcaaatgcagtggctctacattcgttagactcataattttatgatcttaattactctgaattaaatgtagaacatatagtactactccctcagtcccattttaagtgcagttatgggtttctgttttcaacgtttgattgttcgtcttatttgaaaaatttatgagaaagttaaaaaaagtcgcagataaagtattattcatgttttatcatctaataacaataagattgctaatcataaaaaaattcaaataagacagacggccaaatattggacacagaaaccaaaaaaatacacttaaaatgagacggatggagtagagttaaaacttctaaaatatagtatagctagtaaatactacaattggtcacataacttgtaaaattcatactagctctaaaaatggaaaactcaacggggttgaatttcatagaacacactctttattgctgtaacccaaatctttatagaacttagatataaactatacttagaattatttaacttaaataaagtataactaacatagagcttggtaaattcataactcacaaatgctaagtgataaaatagaattattgcttaggttagaattgttgcttaggtttgagtgatgtgggaatagttgatcttcaggatggttctactaggggcctacccctagtcggtttgctgtgtgctaaggtagataggcttttcactgaacctttatctagttgtttctaagaccatgtttggaaccagggactagagtttagtccctgtcatatcgaatgtttggacactaattagaagtattaaacgtacactgaactacattggacatatagccgattgctcaaaaccctagcgacatcggctggaattaccccattagcttgtcagccgattggctctttgatctgctatttatatatcttgtcagttacaagatcgtactgactggcacgctagcatatcatctattttaggacctgtattggagttaagcggatctcccaggccttcgtgtttttgtcgacttagttcgcgttaacgcagatttggcactatcgaccgagcgcggatttttttatcaacactaccttgtcatatttggtgattaaagaatggaacggctttgattcaagttactcctgacaagtaatttgttttttttctttttgctgataaggaacgtaactttaatttttttccttaattgattctctcggatcgctcaatgtgtacgacttctcaccatgacattgattgtacatttttctaattctacttgtcataaggcttatgtggagctcatggtagaaaataagaatggcgtacttgtataacatacattgtaaagtcaaaaatcggattcaagaagatagctagttataaaactatgatcaagatatgcatgtgtgtggaaatgtgaaagtgaaatgataacccctttgtatgatcctcctccttgcacttatttagtgaacatggctatttttctcccttttttttttctttttttcatgctcgagaatattttgtctctttttctttgtgagcatttctctttttctcatcaacatttttttttggctcatgtctcattttgtatgaatagttagaggtaggattgtaagcgtatgaagtctttatttggtggatggatgactgatgctgattttcagtgtagaagtatcacatatggtagatgcatgcatgacatatttttgctaacctctagtgtagagggtgagaaaatatagtgggtatcagtgttaaggataaaacactgaatatagtaggtatcttctatagttgggtttgtactatacggaagtaccatatacctaattatacatgggaatgtatcttttgattaagagaatacgataaatccaaaaagaaattgtcttctcgggatagaaagtgtcaggaacccaaccgagaatgctcatgttacattctcaccccaaacgtggagcgttggggaccgcatctagatttgagagatattttgcagtgcgccacctcccaaaggcatagcggtggcgcctacttggcgcgtgtgtgcctccagcgcgcgtttcggacgagaaggtatagttagctaatcaattagttttagataattacaatttgaaataatgacggtagtagttaagattttttttcatgagatttttctaactaacaaattgaaaagaaatctatacctgaagtcaaattttcaaaattttaaatctagatttgaaatttttaactcgaaatttaaattttttaagtcaaattttgaaaactttcaacttttcatcttaaatttgaaaacctttcaactcaacttcgaaaactttcaacccagatttgaaaactttcaaatctagatttgaaaaaattcaagtcaagtcaagatttgaaaactttcaagtcagatttagaaacttttaactacagatttgaaactttcaactcagatttaaaaactttcatctgaaaattcaaaacatttaacttaaatttaaaaactttcatctcaaagttcaaaaattcaactcaaatcttaaaaattttcaactcaaatttgaaactttcaactaaaattgaagatgaaagattcaacttctaaaataaaaaaatcacaaaaaaaatgcaaaaagaaacgaaaaaacacagacggtagcttttccaggaaaaaagttacggacgtagacgctacgcgtgagccttatgggcctaaaaacgcgcgcgcccgaattagctctcgtggcggaagttctgcatcgcggtatttgaacggcggcctgaagccgcgtcctcatgcttcgccgggattgcgtcgcctggtggtattcttgattttctcaagtttggccgtgctatatgtgatgtcaggaaggatgccatcaagctcttgctgttgctcgctgtgttaatttgattctttgggcaagctgagagcctgagaatggacttcaacggttgttcggtggaaaggcatgtgtcaaaacccaaaaccgaatcagggagcttgtcaatagggtggtggacggttccgtggagatatttgaggaattgctcgtgcaggtagagctgcagtgcaatatgcatgcatagctgcacatgacttttttttctttttcttccgcggggaagctgcacatgacacatctggctggtgtgtattttagacaatatggttgtggacgcagtgtgacgtcagcgttcgatttacgtgcaaaactattttaaactgatttttcttctaaattacttatccaaatcctgatctaattgcaccattaatttcattacaattaaacttcaaaacaagaccacacgtggatatattcccacgaaaaaaa

SEQ ID NO: 42426 - DNA, 2942 bp, Oryza sativa
  unsure (1)..(2942): unsure at all n locations
tatataaaaacaatgtttcagaaaatagcgaaagaatgttttagttcactgcaacattaaatctatacatagtgaaacattgtgagtacactatgtgaaacatttttcggtggaataaaaaataaatcaaattcccttaatagggggtttccaaaatacgtggtttttttttttttgttgcaatggaatgtttcgttcactacaacattagatttatacatagtgaaacattatgagtactctaggtgaaacatttttttgtggaacaaaaaataaaccaaattcccttaataaagagttttcaaaatatgtgggttttttttgcaaaagaatattttaattcactgtagatctataaatagtgaaacattgtaagtatactagttgaaacatcttttgtggaaaaaaaggggagggagaagtaggtgggtccagcagatacgcatgtagggggaggggagcgcccgatccggctccccccgcgccggtcgctcagagtagagcattatcgtatggttgtaagttgagacaatcgtttatttgacaatatttcaaaacctaactagtaatctagactttttttttttttgcttatttgaccctgcttttcacaatgaacacctgtctgactctgctttcattgcaccgttaaagtttcattaaaaaaagaaaaaatatataattacttttcataatgaccaaaataccctcgaaaaacccaatccacatataaccatgtcccttcagatcccctctctctctcttgtatcccgtctctctctcggcgagtggtggtggcgacacactgaggggataaagcggcggtgttggctcgtcgagggagggagcggcgggctatggagggaggggatccgcaccagcaccggctcgcgaagggagggcggcgcggagaagcggcgctggctcgtggaggcaggtagcagcagcgtcggggcgcggagggagagagcgccgccgtagagggaggtgcacgacgcacggaggggataagcggtgatgtgcctgcatgtggagggagggcacgactgtggcgccggtccgtggagtgaggagcggcgatggtgccggcgcggggagggaggcgcgggtggtggtgcgcttgcgtgtggagggaggagggggcagtggcgcgtggagggaggtgcgggcggcggtgtgccggcgcgtggagggaggaggcagcagagcgccatcacgcggagggaggcgctggcagcgttggtgccagtgcacgggggagtggcaactgttgcgtgtggcatcggcgactactgttatggcacttgccgtgaatttgttgtttggttatcatctctgttggatttgactataatttgtgtttctacatcattgtatgcaatttgcacggctgcacaaccaatctttaccactggttggcaaccatctgttgtcccagttatacaaccggaacggtgaattcggaataaatatcgctatctttagtcccggttcaatcgatctttagtcccggttggtgtgatgtggtcccggctagagggttttttccttcttttttttcttctctctctttttcactgttcttttgctatttgcccaaatcatctcagatcaaacattcatcattcacggtaatatagttcatcccaaatcattcacaacaacacatattgaatcacacggtaaggacaaaagaaaaaaaaatccaaaagcagcgccggcctccaccgcctaccgctgcactagccttcgcaccggccgcctcccccttcggatccggcggtggccggctgcctcccctcccagatgcgcagccgcccggccgccgcggtgcgaggccgccgccgccgctgccgcctaggggaggaagagaatgaggagaggaggaggaagaggaagagatggggtgaagaggaggaagagataaggtgagggtggaggagatagaacttattaactgatccgtctcctcctcctcgatctcacgcatgcctcagcctctccgccgcgcatgccaatctttttttccggttggtgtaactaaccgggactagaaatatatctttagtcccggttggtaacaccaaccaggactaaagataatagagaggtctgacattgcatgttgttcttttaaccaggactaaaaatgatctttagtcccggttggtataaaaaagtagctctaatctttcgaaccgagactaaagataatctttaatcccgatttttattgcaactgggactattgtggtttttgctcgaccgagtaaagatggtttctccagtagtgttgggatccacaaaataagacaatatgctgtcaaaattttgttaaaaattctgccaaattttatttgccttattttgtcaaaaatccgtcaaatttaagtcaaatttgttaaattgattcaaaattttcaaatttataaattgaagccaaatctgtcaaacttatctctaatctggtagatatacagaattcgttacaaatatgtcaaaagatccaaatatatgcacgttttgatgtaacagggtcaaataagtagagcaaaaggggccatttgccctttagttaacaccgttaactcgctttaacggaattgggtaagcattcatcttcaattttgaaaagcatggttaaataagcgaactaaaaaaagtatagtcatattaataagttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn
